United States Patent 11,559,588 (MATERIALS AND METHODS FOR TREATMENT OF SPINOCEREBELLAR ATAXIA TYPE 1 (SCA1) AND OTHER SPINOCEREBELLAR ATAXIA TYPE 1 PROTEIN (ATXN1) GENE RELATED CONDITIONS OR DISORDERS) - sequence listing, part 8

SEQ ID NO: 103920 - DNA, 20 bp, Artificial Sequence
  Description of Artificial Sequence: Synthetic oligonucleotide
  Target: ATXN1; (+) strand; PAM type: NRG; PAM sequence: GAG
tcgaccacccaaggactgag

SEQ ID NO: 103921 - DNA, 20 bp, Artificial Sequence
  Description of Artificial Sequence: Synthetic oligonucleotide
  Target: ATXN1; (+) strand; PAM type: NRG; PAM sequence: CGG
cacccaaggactgaggagtg

SEQ ID NO: 103922 - DNA, 20 bp, Artificial Sequence
  Description of Artificial Sequence: Synthetic oligonucleotide
  Target: ATXN1; (+) strand; PAM type: NRG; PAM sequence: GGG
acccaaggactgaggagtgc

SEQ ID NO: 103923 - DNA, 20 bp, Artificial Sequence
  Description of Artificial Sequence: Synthetic oligonucleotide
  Target: ATXN1; (+) strand; PAM type: NRG; PAM sequence: CGG
gactgaggagtgcgggcgca

SEQ ID NO: 103924 - DNA, 20 bp, Artificial Sequence
  Description of Artificial Sequence: Synthetic oligonucleotide
  Target: ATXN1; (+) strand; PAM type: NRG; PAM sequence: TGG
ggagtgcgggcgcacggcac

SEQ ID NO: 103925 - DNA, 20 bp, Artificial Sequence
  Description of Artificial Sequence: Synthetic oligonucleotide
  Target: ATXN1; (+) strand; PAM type: NRG; PAM sequence: CAG
gtgcgggcgcacggcactgg

SEQ ID NO: 103926 - DNA, 20 bp, Artificial Sequence
  Description of Artificial Sequence: Synthetic oligonucleotide
  Target: ATXN1; (+) strand; PAM type: NRG; PAM sequence: AGG
tgcgggcgcacggcactggc

SEQ ID NO: 103927 - DNA, 20 bp, Artificial Sequence
  Description of Artificial Sequence: Synthetic oligonucleotide
  Target: ATXN1; (+) strand; PAM type: NRG; PAM sequence: CAG
gggcgcacggcactggcagg

SEQ ID NO: 103928 - DNA, 20 bp, Artificial Sequence
  Description of Artificial Sequence: Synthetic oligonucleotide
  Target: ATXN1; (+) strand; PAM type: NRG; PAM sequence: AAG
ctccacctactgcctctgtg

SEQ ID NO: 103929 - DNA, 20 bp, Artificial Sequence
  Description of Artificial Sequence: Synthetic oligonucleotide
  Target: ATXN1; (+) strand; PAM type: NRG; PAM sequence: TAG
ctgcctctgtgaagatccac

SEQ ID NO: 103930 - DNA, 20 bp, Artificial Sequence
  Description of Artificial Sequence: Synthetic oligonucleotide
  Target: ATXN1; (+) strand; PAM type: NRG; PAM sequence: AGG
tgcctctgtgaagatccact

SEQ ID NO: 103931 - DNA, 20 bp, Artificial Sequence
  Description of Artificial Sequence: Synthetic oligonucleotide
  Target: ATXN1; (+) strand; PAM type: NRG; PAM sequence: AAG
ctgtgaagatccactaggtg

SEQ ID NO: 103932 - DNA, 20 bp, Artificial Sequence
  Description of Artificial Sequence: Synthetic oligonucleotide
  Target: ATXN1; (+) strand; PAM type: NRG; PAM sequence: CAG
gaagatccactaggtgaagc

SEQ ID NO: 103933 - DNA, 20 bp, Artificial Sequence
  Description of Artificial Sequence: Synthetic oligonucleotide
  Target: ATXN1; (+) strand; PAM type: NRG; PAM sequence: TGG
atccactaggtgaagccagc

SEQ ID NO: 103934 - DNA, 20 bp, Artificial Sequence
  Description of Artificial Sequence: Synthetic oligonucleotide
  Target: ATXN1; (+) strand; PAM type: NRG; PAM sequence: GGG
tccactaggtgaagccagct

SEQ ID NO: 103935 - DNA, 20 bp, Artificial Sequence
  Description of Artificial Sequence: Synthetic oligonucleotide
  Target: ATXN1; (+) strand; PAM type: NRG; PAM sequence: GAG
gtgaagccagctgggctcct

SEQ ID NO: 103936 - DNA, 20 bp, Artificial Sequence
  Description of Artificial Sequence: Synthetic oligonucleotide
  Target: ATXN1; (+) strand; PAM type: NRG; PAM sequence: TGG
gccagctgggctcctgagtc

SEQ ID NO: 103937 - DNA, 20 bp, Artificial Sequence
  Description of Artificial Sequence: Synthetic oligonucleotide
  Target: ATXN1; (+) strand; PAM type: NRG; PAM sequence: TGG
agctgggctcctgagtctgg

SEQ ID NO: 103938 - DNA, 20 bp, Artificial Sequence
  Description of Artificial Sequence: Synthetic oligonucleotide
  Target: ATXN1; (+) strand; PAM type: NRG; PAM sequence: GGG
gctgggctcctgagtctggt

SEQ ID NO: 103939 - DNA, 20 bp, Artificial Sequence
  Description of Artificial Sequence: Synthetic oligonucleotide
  Target: ATXN1; (+) strand; PAM type: NRG; PAM sequence: GGG
ctgggctcctgagtctggtg

SEQ ID NO: 103940 - DNA, 20 bp, Artificial Sequence
  Description of Artificial Sequence: Synthetic oligonucleotide
  Target: ATXN1; (+) strand; PAM type: NRG; PAM sequence: TGG
tcctgagtctggtggggcct

SEQ ID NO: 103941 - DNA, 20 bp, Artificial Sequence
  Description of Artificial Sequence: Synthetic oligonucleotide
  Target: ATXN1; (+) strand; PAM type: NRG; PAM sequence: GAG
ctgagtctggtggggccttg

SEQ ID NO: 103942 - DNA, 20 bp, Artificial Sequence
  Description of Artificial Sequence: Synthetic oligonucleotide
  Target: ATXN1; (+) strand; PAM type: NRG; PAM sequence: TAG
ccttggagaacctttatgtc

SEQ ID NO: 103943 - DNA, 20 bp, Artificial Sequence
  Description of Artificial Sequence: Synthetic oligonucleotide
  Target: ATXN1; (+) strand; PAM type: NRG; PAM sequence: AAG
gagaacctttatgtctagct

SEQ ID NO: 103944 - DNA, 20 bp, Artificial Sequence
  Description of Artificial Sequence: Synthetic oligonucleotide
  Target: ATXN1; (+) strand; PAM type: NRG; PAM sequence: AGG
agaacctttatgtctagcta

SEQ ID NO: 103945 - DNA, 20 bp, Artificial Sequence
  Description of Artificial Sequence: Synthetic oligonucleotide
  Target: ATXN1; (+) strand; PAM type: NRG; PAM sequence: GGG
gaacctttatgtctagctaa

SEQ ID NO: 103946 - DNA, 20 bp, Artificial Sequence
  Description of Artificial Sequence: Synthetic oligonucleotide
  Target: ATXN1; (+) strand; PAM type: NRG; PAM sequence: CAG
gggattttaaatacaccaat

SEQ ID NO: 103947 - DNA, 20 bp, Artificial Sequence
  Description of Artificial Sequence: Synthetic oligonucleotide
  Target: ATXN1; (+) strand; PAM type: NRG; PAM sequence: TAG
accaatcagcactctatatc

SEQ ID NO: 103948 - DNA, 20 bp, Artificial Sequence
  Description of Artificial Sequence: Synthetic oligonucleotide
  Target: ATXN1; (+) strand; PAM type: NRG; PAM sequence: AAG
cagcactctatatctagctc

SEQ ID NO: 103949 - DNA, 20 bp, Artificial Sequence
  Description of Artificial Sequence: Synthetic oligonucleotide
  Target: ATXN1; (+) strand; PAM type: NRG; PAM sequence: AGG
agcactctatatctagctca

SEQ ID NO: 103950 - DNA, 20 bp, Artificial Sequence
  Description of Artificial Sequence: Synthetic oligonucleotide
  Target: ATXN1; (+) strand; PAM type: NRG; PAM sequence: CAG
aggtttgtaaacacaccaat

SEQ ID NO: 103951 - DNA, 20 bp, Artificial Sequence
  Description of Artificial Sequence: Synthetic oligonucleotide
  Target: ATXN1; (+) strand; PAM type: NRG; PAM sequence: TAG
accaatcagcaccctgtgtc

SEQ ID NO: 103952 - DNA, 20 bp, Artificial Sequence
  Description of Artificial Sequence: Synthetic oligonucleotide
  Target: ATXN1; (+) strand; PAM type: NRG; PAM sequence: CAG
tcagcaccctgtgtctagct

SEQ ID NO: 103953 - DNA, 20 bp, Artificial Sequence
  Description of Artificial Sequence: Synthetic oligonucleotide
  Target: ATXN1; (+) strand; PAM type: NRG; PAM sequence: AGG
cagcaccctgtgtctagctc

SEQ ID NO: 103954 - DNA, 20 bp, Artificial Sequence
  Description of Artificial Sequence: Synthetic oligonucleotide
  Target: ATXN1; (+) strand; PAM type: NRG; PAM sequence: GGG
agcaccctgtgtctagctca

SEQ ID NO: 103955 - DNA, 20 bp, Artificial Sequence
  Description of Artificial Sequence: Synthetic oligonucleotide
  Target: ATXN1; (+) strand; PAM type: NRG; PAM sequence: TAG
accaatccacactctgtaac

SEQ ID NO: 103956 - DNA, 20 bp, Artificial Sequence
  Description of Artificial Sequence: Synthetic oligonucleotide
  Target: ATXN1; (+) strand; PAM type: NRG; PAM sequence: TGG
cactctgtaactagctactc

SEQ ID NO: 103957 - DNA, 20 bp, Artificial Sequence
  Description of Artificial Sequence: Synthetic oligonucleotide
  Target: ATXN1; (+) strand; PAM type: NRG; PAM sequence: TGG
tctgtaactagctactctgg

SEQ ID NO: 103958 - DNA, 20 bp, Artificial Sequence
  Description of Artificial Sequence: Synthetic oligonucleotide
  Target: ATXN1; (+) strand; PAM type: NRG; PAM sequence: GGG
ctgtaactagctactctggt

SEQ ID NO: 103959 - DNA, 20 bp, Artificial Sequence
  Description of Artificial Sequence: Synthetic oligonucleotide
  Target: ATXN1; (+) strand; PAM type: NRG; PAM sequence: GGG
tgtaactagctactctggtg

SEQ ID NO: 103960 - DNA, 20 bp, Artificial Sequence
  Description of Artificial Sequence: Synthetic oligonucleotide
  Target: ATXN1; (+) strand; PAM type: NRG; PAM sequence: TGG
tagctactctggtggggact

SEQ ID NO: 103961 - DNA, 20 bp, Artificial Sequence
  Description of Artificial Sequence: Synthetic oligonucleotide
  Target: ATXN1; (+) strand; PAM type: NRG; PAM sequence: GAG
gctactctggtggggacttg

SEQ ID NO: 103962 - DNA, 20 bp, Artificial Sequence
  Description of Artificial Sequence: Synthetic oligonucleotide
  Target: ATXN1; (+) strand; PAM type: NRG; PAM sequence: TAG
acttggagaacctttatgtc

SEQ ID NO: 103963 - DNA, 20 bp, Artificial Sequence
  Description of Artificial Sequence: Synthetic oligonucleotide
  Target: ATXN1; (+) strand; PAM type: NRG; PAM sequence: AAG
gagaacctttatgtctagct

SEQ ID NO: 103964 - DNA, 20 bp, Artificial Sequence
  Description of Artificial Sequence: Synthetic oligonucleotide
  Target: ATXN1; (+) strand; PAM type: NRG; PAM sequence: AGG
agaacctttatgtctagcta

SEQ ID NO: 103965 - DNA, 20 bp, Artificial Sequence
  Description of Artificial Sequence: Synthetic oligonucleotide
  Target: ATXN1; (+) strand; PAM type: NRG; PAM sequence: GGG
gaacctttatgtctagctaa

SEQ ID NO: 103966 - DNA, 20 bp, Artificial Sequence
  Description of Artificial Sequence: Synthetic oligonucleotide
  Target: ATXN1; (+) strand; PAM type: NRG; PAM sequence: CGG
gggattgtaaatacaccaat

SEQ ID NO: 103967 - DNA, 20 bp, Artificial Sequence
  Description of Artificial Sequence: Synthetic oligonucleotide
  Target: ATXN1; (+) strand; PAM type: NRG; PAM sequence: TAG
accaatcggcactctgtatc

SEQ ID NO: 103968 - DNA, 20 bp, Artificial Sequence
  Description of Artificial Sequence: Synthetic oligonucleotide
  Target: ATXN1; (+) strand; PAM type: NRG; PAM sequence: AAG
cggcactctgtatctagctc

SEQ ID NO: 103969 - DNA, 20 bp, Artificial Sequence
  Description of Artificial Sequence: Synthetic oligonucleotide
  Target: ATXN1; (+) strand; PAM type: NRG; PAM sequence: AGG
ggcactctgtatctagctca

SEQ ID NO: 103970 - DNA, 20 bp, Artificial Sequence
  Description of Artificial Sequence: Synthetic oligonucleotide
  Target: ATXN1; (+) strand; PAM type: NRG; PAM sequence: CAG
aggtttgtaaacacaccaat

SEQ ID NO: 103971 - DNA, 20 bp, Artificial Sequence
  Description of Artificial Sequence: Synthetic oligonucleotide
  Target: ATXN1; (+) strand; PAM type: NRG; PAM sequence: TAG
accaatcagcaccctgtgtc

SEQ ID NO: 103972 - DNA, 20 bp, Artificial Sequence
  Description of Artificial Sequence: Synthetic oligonucleotide
  Target: ATXN1; (+) strand; PAM type: NRG; PAM sequence: CAG
tcagcaccctgtgtctagct

SEQ ID NO: 103973 - DNA, 20 bp, Artificial Sequence
  Description of Artificial Sequence: Synthetic oligonucleotide
  Target: ATXN1; (+) strand; PAM type: NRG; PAM sequence: AGG
cagcaccctgtgtctagctc

SEQ ID NO: 103974 - DNA, 20 bp, Artificial Sequence
  Description of Artificial Sequence: Synthetic oligonucleotide
  Target: ATXN1; (+) strand; PAM type: NRG; PAM sequence: GGG
agcaccctgtgtctagctca

SEQ ID NO: 103975 - DNA, 20 bp, Artificial Sequence
  Description of Artificial Sequence: Synthetic oligonucleotide
  Target: ATXN1; (+) strand; PAM type: NRG; PAM sequence: TAG
accaatccacactctgtatc

SEQ ID NO: 103976 - DNA, 20 bp, Artificial Sequence
  Description of Artificial Sequence: Synthetic oligonucleotide
  Target: ATXN1; (+) strand; PAM type: NRG; PAM sequence: TGG
cactctgtatctagctactc

SEQ ID NO: 103977 - DNA, 20 bp, Artificial Sequence
  Description of Artificial Sequence: Synthetic oligonucleotide
  Target: ATXN1; (+) strand; PAM type: NRG; PAM sequence: TGG
tctgtatctagctactctgg

SEQ ID NO: 103978 - DNA, 20 bp, Artificial Sequence
  Description of Artificial Sequence: Synthetic oligonucleotide
  Target: ATXN1; (+) strand; PAM type: NRG; PAM sequence: GGG
ctgtatctagctactctggt

SEQ ID NO: 103979 - DNA, 20 bp, Artificial Sequence
  Description of Artificial Sequence: Synthetic oligonucleotide
  Target: ATXN1; (+) strand; PAM type: NRG; PAM sequence: GGG
tgtatctagctactctggtg

SEQ ID NO: 103980 - DNA, 20 bp, Artificial Sequence
  Description of Artificial Sequence: Synthetic oligonucleotide
  Target: ATXN1; (+) strand; PAM type: NRG; PAM sequence: TGG
tagctactctggtggggact

SEQ ID NO: 103981 - DNA, 20 bp, Artificial Sequence
  Description of Artificial Sequence: Synthetic oligonucleotide
  Target: ATXN1; (+) strand; PAM type: NRG; PAM sequence: GAG
gctactctggtggggacttg

SEQ ID NO: 103982 - DNA, 20 bp, Artificial Sequence
  Description of Artificial Sequence: Synthetic oligonucleotide
  Target: ATXN1; (+) strand; PAM type: NRG; PAM sequence: TAG
ttgtgtcgacactctttatt

SEQ ID NO: 103983 - DNA, 20 bp, Artificial Sequence
  Description of Artificial Sequence: Synthetic oligonucleotide
  Target: ATXN1; (+) strand; PAM type: NRG; PAM sequence: TAG
cactctttatttagctaatc

SEQ ID NO: 103984 - DNA, 20 bp, Artificial Sequence
  Description of Artificial Sequence: Synthetic oligonucleotide
  Target: ATXN1; (+) strand; PAM type: NRG; PAM sequence: TGG
tctttatttagctaatctag

SEQ ID NO: 103985 - DNA, 20 bp, Artificial Sequence
  Description of Artificial Sequence: Synthetic oligonucleotide
  Target: ATXN1; (+) strand; PAM type: NRG; PAM sequence: GGG
ctttatttagctaatctagt

SEQ ID NO: 103986 - DNA, 20 bp, Artificial Sequence
  Description of Artificial Sequence: Synthetic oligonucleotide
  Target: ATXN1; (+) strand; PAM type: NRG; PAM sequence: GGG
tttatttagctaatctagtg

SEQ ID NO: 103987 - DNA, 20 bp, Artificial Sequence
  Description of Artificial Sequence: Synthetic oligonucleotide
  Target: ATXN1; (+) strand; PAM type: NRG; PAM sequence: TGG
tagctaatctagtggggccc

SEQ ID NO: 103988 - DNA, 20 bp, Artificial Sequence
  Description of Artificial Sequence: Synthetic oligonucleotide
  Target: ATXN1; (+) strand; PAM type: NRG; PAM sequence: GAG
gctaatctagtggggccctg

SEQ ID NO: 103989 - DNA, 20 bp, Artificial Sequence
  Description of Artificial Sequence: Synthetic oligonucleotide
  Target: ATXN1; (+) strand; PAM type: NRG; PAM sequence: TAG
ccctggagaacctttgtgtc

SEQ ID NO: 103990 - DNA, 20 bp, Artificial Sequence
  Description of Artificial Sequence: Synthetic oligonucleotide
  Target: ATXN1; (+) strand; PAM type: NRG; PAM sequence: CAG
gagaacctttgtgtctagct

SEQ ID NO: 103991 - DNA, 20 bp, Artificial Sequence
  Description of Artificial Sequence: Synthetic oligonucleotide
  Target: ATXN1; (+) strand; PAM type: NRG; PAM sequence: AGG
agaacctttgtgtctagctc

SEQ ID NO: 103992 - DNA, 20 bp, Artificial Sequence
  Description of Artificial Sequence: Synthetic oligonucleotide
  Target: ATXN1; (+) strand; PAM type: NRG; PAM sequence: GGG
gaacctttgtgtctagctca

SEQ ID NO: 103993 - DNA, 20 bp, Artificial Sequence
  Description of Artificial Sequence: Synthetic oligonucleotide
  Target: ATXN1; (+) strand; PAM type: NRG; PAM sequence: CAG
gggattgtaaatgcaccaat

SEQ ID NO: 103994 - DNA, 20 bp, Artificial Sequence
  Description of Artificial Sequence: Synthetic oligonucleotide
  Target: ATXN1; (+) strand; PAM type: NRG; PAM sequence: CAG
caatcagtaccctgtcaaaa

SEQ ID NO: 103995 - DNA, 20 bp, Artificial Sequence
  Description of Artificial Sequence: Synthetic oligonucleotide
  Target: ATXN1; (+) strand; PAM type: NRG; PAM sequence: TGG
accctgtcaaaacagaccac

SEQ ID NO: 103996 - DNA, 20 bp, Artificial Sequence
  Description of Artificial Sequence: Synthetic oligonucleotide
  Target: ATXN1; (+) strand; PAM type: NRG; PAM sequence: GGG
ccctgtcaaaacagaccact

SEQ ID NO: 103997 - DNA, 20 bp, Artificial Sequence
  Description of Artificial Sequence: Synthetic oligonucleotide
  Target: ATXN1; (+) strand; PAM type: NRG; PAM sequence: TGG
ccactgggctctctgtaaaa

SEQ ID NO: 103998 - DNA, 20 bp, Artificial Sequence
  Description of Artificial Sequence: Synthetic oligonucleotide
  Target: ATXN1; (+) strand; PAM type: NRG; PAM sequence: CAG
tctctgtaaaatggaccaat

SEQ ID NO: 103999 - DNA, 20 bp, Artificial Sequence
  Description of Artificial Sequence: Synthetic oligonucleotide
  Target: ATXN1; (+) strand; PAM type: NRG; PAM sequence: CAG
ctgtaaaatggaccaatcag

SEQ ID NO: 104000 - DNA, 20 bp, Artificial Sequence
  Description of Artificial Sequence: Synthetic oligonucleotide
  Target: ATXN1; (+) strand; PAM type: NRG; PAM sequence: TGG
atggaccaatcagcagaaca

SEQ ID NO: 104001 - DNA, 20 bp, Artificial Sequence
  Description of Artificial Sequence: Synthetic oligonucleotide
  Target: ATXN1; (+) strand; PAM type: NRG; PAM sequence: GGG
tggaccaatcagcagaacat

SEQ ID NO: 104002 - DNA, 20 bp, Artificial Sequence
  Description of Artificial Sequence: Synthetic oligonucleotide
  Target: ATXN1; (+) strand; PAM type: NRG; PAM sequence: TAG
accaatcagcagaacatggg

SEQ ID NO: 104003 - DNA, 20 bp, Artificial Sequence
  Description of Artificial Sequence: Synthetic oligonucleotide
  Target: ATXN1; (+) strand; PAM type: NRG; PAM sequence: AGG
ccaatcagcagaacatgggt

SEQ ID NO: 104004 - DNA, 20 bp, Artificial Sequence
  Description of Artificial Sequence: Synthetic oligonucleotide
  Target: ATXN1; (+) strand; PAM type: NRG; PAM sequence: GGG
caatcagcagaacatgggta

SEQ ID NO: 104005 - DNA, 20 bp, Artificial Sequence
  Description of Artificial Sequence: Synthetic oligonucleotide
  Target: ATXN1; (+) strand; PAM type: NRG; PAM sequence: CAG
cagcagaacatgggtagggc

SEQ ID NO: 104006 - DNA, 20 bp, Artificial Sequence
  Description of Artificial Sequence: Synthetic oligonucleotide
  Target: ATXN1; (+) strand; PAM type: NRG; PAM sequence: AAG
gaacatgggtagggccagat

SEQ ID NO: 104007 - DNA, 20 bp, Artificial Sequence
  Description of Artificial Sequence: Synthetic oligonucleotide
  Target: ATXN1; (+) strand; PAM type: NRG; PAM sequence: GAG
acatgggtagggccagataa

SEQ ID NO: 104008 - DNA, 20 bp, Artificial Sequence
  Description of Artificial Sequence: Synthetic oligonucleotide
  Target: ATXN1; (+) strand; PAM type: NRG; PAM sequence: AAG
agggccagataagagaataa

SEQ ID NO: 104009 - DNA, 20 bp, Artificial Sequence
  Description of Artificial Sequence: Synthetic oligonucleotide
  Target: ATXN1; (+) strand; PAM type: NRG; PAM sequence: CAG
gccagataagagaataaaag

SEQ ID NO: 104010 - DNA, 20 bp, Artificial Sequence
  Description of Artificial Sequence: Synthetic oligonucleotide
  Target: ATXN1; (+) strand; PAM type: NRG; PAM sequence: AGG
ccagataagagaataaaagc

SEQ ID NO: 104011 - DNA, 20 bp, Artificial Sequence
  Description of Artificial Sequence: Synthetic oligonucleotide
  Target: ATXN1; (+) strand; PAM type: NRG; PAM sequence: GAG
agaataaaagcaggctgccc

SEQ ID NO: 104012 - DNA, 20 bp, Artificial Sequence
  Description of Artificial Sequence: Synthetic oligonucleotide
  Target: ATXN1; (+) strand; PAM type: NRG; PAM sequence: CAG
taaaagcaggctgcccgagc

SEQ ID NO: 104013 - DNA, 20 bp, Artificial Sequence
  Description of Artificial Sequence: Synthetic oligonucleotide
  Target: ATXN1; (+) strand; PAM type: NRG; PAM sequence: CAG
aagcaggctgcccgagccag

SEQ ID NO: 104014 - DNA, 20 bp, Artificial Sequence
  Description of Artificial Sequence: Synthetic oligonucleotide
  Target: ATXN1; (+) strand; PAM type: NRG; PAM sequence: TGG
caggctgcccgagccagcag

SEQ ID NO: 104015 - DNA, 20 bp, Artificial Sequence
  Description of Artificial Sequence: Synthetic oligonucleotide
  Target: ATXN1; (+) strand; PAM type: NRG; PAM sequence: TGG
tccgatccctttccacactg

SEQ ID NO: 104016 - DNA, 20 bp, Artificial Sequence
  Description of Artificial Sequence: Synthetic oligonucleotide
  Target: ATXN1; (+) strand; PAM type: NRG; PAM sequence: AAG
gatccctttccacactgtgg

SEQ ID NO: 104017 - DNA, 20 bp, Artificial Sequence
  Description of Artificial Sequence: Synthetic oligonucleotide
  Target: ATXN1; (+) strand; PAM type: NRG; PAM sequence: TGG
tgctgctgctgttcactctt

SEQ ID NO: 104018 - DNA, 20 bp, Artificial Sequence
  Description of Artificial Sequence: Synthetic oligonucleotide
  Target: ATXN1; (+) strand; PAM type: NRG; PAM sequence: GAG
tggatctatactgcctgtat

SEQ ID NO: 104019 - DNA, 20 bp, Artificial Sequence
  Description of Artificial Sequence: Synthetic oligonucleotide
  Target: ATXN1; (+) strand; PAM type: NRG; PAM sequence: CGG
gtatgagctataacactcac

SEQ ID NO: 104020 - DNA, 20 bp, Artificial Sequence
  Description of Artificial Sequence: Synthetic oligonucleotide
  Target: ATXN1; (+) strand; PAM type: NRG; PAM sequence: AAG
gagctataacactcaccgga

SEQ ID NO: 104021 - DNA, 20 bp, Artificial Sequence
  Description of Artificial Sequence: Synthetic oligonucleotide
  Target: ATXN1; (+) strand; PAM type: NRG; PAM sequence: AGG
agctataacactcaccggaa

SEQ ID NO: 104022 - DNA, 20 bp, Artificial Sequence
  Description of Artificial Sequence: Synthetic oligonucleotide
  Target: ATXN1; (+) strand; PAM type: NRG; PAM sequence: CAG
acactcaccggaaaggtctg

SEQ ID NO: 104023 - DNA, 20 bp, Artificial Sequence
  Description of Artificial Sequence: Synthetic oligonucleotide
  Target: ATXN1; (+) strand; PAM type: NRG; PAM sequence: AAG
ggtctgcagcttcattcctg

SEQ ID NO: 104024 - DNA, 20 bp, Artificial Sequence
  Description of Artificial Sequence: Synthetic oligonucleotide
  Target: ATXN1; (+) strand; PAM type: NRG; PAM sequence: CAG
tgcagcttcattcctgaagc

SEQ ID NO: 104025 - DNA, 20 bp, Artificial Sequence
  Description of Artificial Sequence: Synthetic oligonucleotide
  Target: ATXN1; (+) strand; PAM type: NRG; PAM sequence: GAG
gcttcattcctgaagccagt

SEQ ID NO: 104026 - DNA, 20 bp, Artificial Sequence
  Description of Artificial Sequence: Synthetic oligonucleotide
  Target: ATXN1; (+) strand; PAM type: NRG; PAM sequence: CAG
ccagtgagaccatgaaccca

SEQ ID NO: 104027 - DNA, 20 bp, Artificial Sequence
  Description of Artificial Sequence: Synthetic oligonucleotide
  Target: ATXN1; (+) strand; PAM type: NRG; PAM sequence: AGG
cagtgagaccatgaacccac

SEQ ID NO: 104028 - DNA, 20 bp, Artificial Sequence
  Description of Artificial Sequence: Synthetic oligonucleotide
  Target: ATXN1; (+) strand; PAM type: NRG; PAM sequence: GGG
agtgagaccatgaacccaca

SEQ ID NO: 104029 - DNA, 20 bp, Artificial Sequence
  Description of Artificial Sequence: Synthetic oligonucleotide
  Target: ATXN1; (+) strand; PAM type: NRG; PAM sequence: GAG
tgagaccatgaacccacagg

SEQ ID NO: 104030 - DNA, 20 bp, Artificial Sequence
  Description of Artificial Sequence: Synthetic oligonucleotide
  Target: ATXN1; (+) strand; PAM type: NRG; PAM sequence: AGG
gagaccatgaacccacaggg

SEQ ID NO: 104031 - DNA, 20 bp, Artificial Sequence
  Description of Artificial Sequence: Synthetic oligonucleotide
  Target: ATXN1; (+) strand; PAM type: NRG; PAM sequence: CAG
cagggaggaatgaacaactc

SEQ ID NO: 104032 - DNA, 20 bp, Artificial Sequence
  Description of Artificial Sequence: Synthetic oligonucleotide
  Target: ATXN1; (+) strand; PAM type: NRG; PAM sequence: AAG
aactccagacatgccgcttt

SEQ ID NO: 104033 - DNA, 20 bp, Artificial Sequence
  Description of Artificial Sequence: Synthetic oligonucleotide
  Target: ATXN1; (+) strand; PAM type: NRG; PAM sequence: AAG
agaactgtaacactcaccgc

SEQ ID NO: 104034 - DNA, 20 bp, Artificial Sequence
  Description of Artificial Sequence: Synthetic oligonucleotide
  Target: ATXN1; (+) strand; PAM type: NRG; PAM sequence: AGG
gaactgtaacactcaccgca

SEQ ID NO: 104035 - DNA, 20 bp, Artificial Sequence
  Description of Artificial Sequence: Synthetic oligonucleotide
  Target: ATXN1; (+) strand; PAM type: NRG; PAM sequence: GGG
aactgtaacactcaccgcaa

SEQ ID NO: 104036 - DNA, 20 bp, Artificial Sequence
  Description of Artificial Sequence: Synthetic oligonucleotide
  Target: ATXN1; (+) strand; PAM type: NRG; PAM sequence: CGG
acactcaccgcaagggtcca

SEQ ID NO: 104037 - DNA, 20 bp, Artificial Sequence
  Description of Artificial Sequence: Synthetic oligonucleotide
  Target: ATXN1; (+) strand; PAM type: NRG; PAM sequence: AAG
ggtccacggcttaattcttg

SEQ ID NO: 104038 - DNA, 20 bp, Artificial Sequence
  Description of Artificial Sequence: Synthetic oligonucleotide
  Target: ATXN1; (+) strand; PAM type: NRG; PAM sequence: CAG
cacggcttaattcttgaagt

SEQ ID NO: 104039 - DNA, 20 bp, Artificial Sequence
  Description of Artificial Sequence: Synthetic oligonucleotide
  Target: ATXN1; (+) strand; PAM type: NRG; PAM sequence: GAG
gcttaattcttgaagtcagt

SEQ ID NO: 104040 - DNA, 20 bp, Artificial Sequence
  Description of Artificial Sequence: Synthetic oligonucleotide
  Target: ATXN1; (+) strand; PAM type: NRG; PAM sequence: AAG
ttcttgaagtcagtgagacc

SEQ ID NO: 104041 - DNA, 20 bp, Artificial Sequence
  Description of Artificial Sequence: Synthetic oligonucleotide
  Target: ATXN1; (+) strand; PAM type: NRG; PAM sequence: TGG
accaagaacgcacctaattc

SEQ ID NO: 104042 - DNA, 20 bp, Artificial Sequence
  Description of Artificial Sequence: Synthetic oligonucleotide
  Target: ATXN1; (+) strand; PAM type: NRG; PAM sequence: CAG
aacgcacctaattctggaca

SEQ ID NO: 104043 - DNA, 20 bp, Artificial Sequence
  Description of Artificial Sequence: Synthetic oligonucleotide
  Target: ATXN1; (+) strand; PAM type: NRG; PAM sequence: TAG
gcacctaattctggacacag

SEQ ID NO: 104044 - DNA, 20 bp, Artificial Sequence
  Description of Artificial Sequence: Synthetic oligonucleotide
  Target: ATXN1; (+) strand; PAM type: NRG; PAM sequence: TAG
tggacacagtagcacaacca

SEQ ID NO: 104045 - DNA, 20 bp, Artificial Sequence
  Description of Artificial Sequence: Synthetic oligonucleotide
  Target: ATXN1; (+) strand; PAM type: NRG; PAM sequence: TAG
agcacaaccatagtttactg

SEQ ID NO: 104046 - DNA, 20 bp, Artificial Sequence
  Description of Artificial Sequence: Synthetic oligonucleotide
  Target: ATXN1; (+) strand; PAM type: NRG; PAM sequence: AAG
gcctcgacctccctgtgctc

SEQ ID NO: 104047 - DNA, 20 bp, Artificial Sequence
  Description of Artificial Sequence: Synthetic oligonucleotide
  Target: ATXN1; (+) strand; PAM type: NRG; PAM sequence: CAG
ccctgtgctcaagtgatcct

SEQ ID NO: 104048 - DNA, 20 bp, Artificial Sequence
  Description of Artificial Sequence: Synthetic oligonucleotide
  Target: ATXN1; (+) strand; PAM type: NRG; PAM sequence: TAG
caagtgatcctcagcttcct

SEQ ID NO: 104049 - DNA, 20 bp, Artificial Sequence
  Description of Artificial Sequence: Synthetic oligonucleotide
  Target: ATXN1; (+) strand; PAM type: NRG; PAM sequence: TAG
gtgatcctcagcttccttag

SEQ ID NO: 104050 - DNA, 20 bp, Artificial Sequence
  Description of Artificial Sequence: Synthetic oligonucleotide
  Target: ATXN1; (+) strand; PAM type: NRG; PAM sequence: TGG
tcctcagcttccttagtagc

SEQ ID NO: 104051 - DNA, 20 bp, Artificial Sequence
  Description of Artificial Sequence: Synthetic oligonucleotide
  Target: ATXN1; (+) strand; PAM type: NRG; PAM sequence: GGG
cctcagcttccttagtagct

SEQ ID NO: 104052 - DNA, 20 bp, Artificial Sequence
  Description of Artificial Sequence: Synthetic oligonucleotide
  Target: ATXN1; (+) strand; PAM type: NRG; PAM sequence: CAG
ttccttagtagctgggatta

SEQ ID NO: 104053 - DNA, 20 bp, Artificial Sequence
  Description of Artificial Sequence: Synthetic oligonucleotide
  Target: ATXN1; (+) strand; PAM type: NRG; PAM sequence: TAG
cagacttgtgccgccacatc

SEQ ID NO: 104054 - DNA, 20 bp, Artificial Sequence
  Description of Artificial Sequence: Synthetic oligonucleotide
  Target: ATXN1; (+) strand; PAM type: NRG; PAM sequence: CAG
acattttaaacttttttatt

SEQ ID NO: 104055 - DNA, 20 bp, Artificial Sequence
  Description of Artificial Sequence: Synthetic oligonucleotide
  Target: ATXN1; (+) strand; PAM type: NRG; PAM sequence: TAG
tttaaacttttttattcaga

SEQ ID NO: 104056 - DNA, 20 bp, Artificial Sequence
  Description of Artificial Sequence: Synthetic oligonucleotide
  Target: ATXN1; (+) strand; PAM type: NRG; PAM sequence: AGG
ttaaacttttttattcagat

SEQ ID NO: 104057 - DNA, 20 bp, Artificial Sequence
  Description of Artificial Sequence: Synthetic oligonucleotide
  Target: ATXN1; (+) strand; PAM type: NRG; PAM sequence: GGG
taaacttttttattcagata

SEQ ID NO: 104058 - DNA, 20 bp, Artificial Sequence
  Description of Artificial Sequence: Synthetic oligonucleotide
  Target: ATXN1; (+) strand; PAM type: NRG; PAM sequence: CAG
tagggtttcatcacgctgtg

SEQ ID NO: 104059 - DNA, 20 bp, Artificial Sequence
  Description of Artificial Sequence: Synthetic oligonucleotide
  Target: ATXN1; (+) strand; PAM type: NRG; PAM sequence: AGG
agggtttcatcacgctgtgc

SEQ ID NO: 104060 - DNA, 20 bp, Artificial Sequence
  Description of Artificial Sequence: Synthetic oligonucleotide
  Target: ATXN1; (+) strand; PAM type: NRG; PAM sequence: TGG
tttcatcacgctgtgcaggc

SEQ ID NO: 104061 - DNA, 20 bp, Artificial Sequence
  Description of Artificial Sequence: Synthetic oligonucleotide
  Target: ATXN1; (+) strand; PAM type: NRG; PAM sequence: TGG
gcaggctggtctcaaactcc

SEQ ID NO: 104062 - DNA, 20 bp, Artificial Sequence
  Description of Artificial Sequence: Synthetic oligonucleotide
  Target: ATXN1; (+) strand; PAM type: NRG; PAM sequence: GGG
caggctggtctcaaactcct

SEQ ID NO: 104063 - DNA, 20 bp, Artificial Sequence
  Description of Artificial Sequence: Synthetic oligonucleotide
  Target: ATXN1; (+) strand; PAM type: NRG; PAM sequence: AAG
ggtctcaaactcctgggctt

SEQ ID NO: 104064 - DNA, 20 bp, Artificial Sequence
  Description of Artificial Sequence: Synthetic oligonucleotide
  Target: ATXN1; (+) strand; PAM type: NRG; PAM sequence: TGG
cttaagcgatcctcccattt

SEQ ID NO: 104065 - DNA, 20 bp, Artificial Sequence
  Description of Artificial Sequence: Synthetic oligonucleotide
  Target: ATXN1; (+) strand; PAM type: NRG; PAM sequence: TAG
cctcccattttggctttcca

SEQ ID NO: 104066 - DNA, 20 bp, Artificial Sequence
  Description of Artificial Sequence: Synthetic oligonucleotide
  Target: ATXN1; (+) strand; PAM type: NRG; PAM sequence: TAG
attttggctttccatagtgt

SEQ ID NO: 104067 - DNA, 20 bp, Artificial Sequence
  Description of Artificial Sequence: Synthetic oligonucleotide
  Target: ATXN1; (+) strand; PAM type: NRG; PAM sequence: CAG
tttccatagtgttagaatta

SEQ ID NO: 104068 - DNA, 20 bp, Artificial Sequence
  Description of Artificial Sequence: Synthetic oligonucleotide
  Target: ATXN1; (+) strand; PAM type: NRG; PAM sequence: GAG
agtgttagaattacagatat

SEQ ID NO: 104069 - DNA, 20 bp, Artificial Sequence
  Description of Artificial Sequence: Synthetic oligonucleotide
  Target: ATXN1; (+) strand; PAM type: NRG; PAM sequence: CAG
agaattacagatatgagcca

SEQ ID NO: 104070 - DNA, 20 bp, Artificial Sequence
  Description of Artificial Sequence: Synthetic oligonucleotide
  Target: ATXN1; (+) strand; PAM type: NRG; PAM sequence: CGG
acagatatgagccacagcac

SEQ ID NO: 104071 - DNA, 20 bp, Artificial Sequence
  Description of Artificial Sequence: Synthetic oligonucleotide
  Target: ATXN1; (+) strand; PAM type: NRG; PAM sequence: GGG
cagatatgagccacagcacc

SEQ ID NO: 104072 - DNA, 20 bp, Artificial Sequence
  Description of Artificial Sequence: Synthetic oligonucleotide
  Target: ATXN1; (+) strand; PAM type: NRG; PAM sequence: AAG
ccgggcccattcaactttct

SEQ ID NO: 104073 - DNA, 20 bp, Artificial Sequence
  Description of Artificial Sequence: Synthetic oligonucleotide
  Target: ATXN1; (+) strand; PAM type: NRG; PAM sequence: AAG
taagctttgatttcctcttt

SEQ ID NO: 104074 - DNA, 20 bp, Artificial Sequence
  Description of Artificial Sequence: Synthetic oligonucleotide
  Target: ATXN1; (+) strand; PAM type: NRG; PAM sequence: AAG
atttcctctttaagaaaatg

SEQ ID NO: 104075 - DNA, 20 bp, Artificial Sequence
  Description of Artificial Sequence: Synthetic oligonucleotide
  Target: ATXN1; (+) strand; PAM type: NRG; PAM sequence: TAG
cctctttaagaaaatgaaga

SEQ ID NO: 104076 - DNA, 20 bp, Artificial Sequence
  Description of Artificial Sequence: Synthetic oligonucleotide
  Target: ATXN1; (+) strand; PAM type: NRG; PAM sequence: TGG
ttaagaaaatgaagatagta

SEQ ID NO: 104077 - DNA, 20 bp, Artificial Sequence
  Description of Artificial Sequence: Synthetic oligonucleotide
  Target: ATXN1; (+) strand; PAM type: NRG; PAM sequence: GAG
gaaaatgaagatagtatggc

SEQ ID NO: 104078 - DNA, 20 bp, Artificial Sequence
  Description of Artificial Sequence: Synthetic oligonucleotide
  Target: ATXN1; (+) strand; PAM type: NRG; PAM sequence: AGG
aaaatgaagatagtatggcg

SEQ ID NO: 104079 - DNA, 20 bp, Artificial Sequence
  Description of Artificial Sequence: Synthetic oligonucleotide
  Target: ATXN1; (+) strand; PAM type: NRG; PAM sequence: CGG
gaagatagtatggcgaggca

SEQ ID NO: 104080 - DNA, 20 bp, Artificial Sequence
  Description of Artificial Sequence: Synthetic oligonucleotide
  Target: ATXN1; (+) strand; PAM type: NRG; PAM sequence: TGG
gatagtatggcgaggcacgg

SEQ ID NO: 104081 - DNA, 20 bp, Artificial Sequence
  Description of Artificial Sequence: Synthetic oligonucleotide
  Target: ATXN1; (+) strand; PAM type: NRG; PAM sequence: CAG
gtggctcacacatataatcc

SEQ ID NO: 104082 - DNA, 20 bp, Artificial Sequence
  Description of Artificial Sequence: Synthetic oligonucleotide
  Target: ATXN1; (+) strand; PAM type: NRG; PAM sequence: CAG
acatataatcccagcacttt

SEQ ID NO: 104083 - DNA, 20 bp, Artificial Sequence
  Description of Artificial Sequence: Synthetic oligonucleotide
  Target: ATXN1; (+) strand; PAM type: NRG; PAM sequence: GAG
atataatcccagcactttca

SEQ ID NO: 104084 - DNA, 20 bp, Artificial Sequence
  Description of Artificial Sequence: Synthetic oligonucleotide
  Target: ATXN1; (+) strand; PAM type: NRG; PAM sequence: AGG
tataatcccagcactttcag

SEQ ID NO: 104085 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttcagaggcc

SEQ ID NO: 104086 - DNA, 20 bp, Artificial Sequence
  Description of Artificial Sequence: Synthetic oligonucleotide
  Target: ATXN1; (+) strand; PAM type: NRG; PAM sequence: AGG
cccagcactttcagaggccg

SEQ ID NO: 104087 - DNA, 20 bp, Artificial Sequence
  Description of Artificial Sequence: Synthetic oligonucleotide
  Target: ATXN1; (+) strand; PAM type: NRG; PAM sequence: GGG
ccagcactttcagaggccga

SEQ ID NO: 104088 - DNA, 20 bp, Artificial Sequence
  Description of Artificial Sequence: Synthetic oligonucleotide
  Target: ATXN1; (+) strand; PAM type: NRG; PAM sequence: GGG
cagcactttcagaggccgag

SEQ ID NO: 104089 - DNA, 20 bp, Artificial Sequence
  Description of Artificial Sequence: Synthetic oligonucleotide
  Target: ATXN1; (+) strand; PAM type: NRG; PAM sequence: GGG
agcactttcagaggccgagg

SEQ ID NO: 104090 - DNA, 20 bp, Artificial Sequence
  Description of Artificial Sequence: Synthetic oligonucleotide
  Target: ATXN1; (+) strand; PAM type: NRG; PAM sequence: GGG
gcactttcagaggccgaggg

SEQ ID NO: 104091 - DNA, 20 bp, Artificial Sequence
  Description of Artificial Sequence: Synthetic oligonucleotide
  Target: ATXN1; (+) strand; PAM type: NRG; PAM sequence: GGG
cactttcagaggccgagggg

SEQ ID NO: 104092 - DNA, 20 bp, Artificial Sequence
  Description of Artificial Sequence: Synthetic oligonucleotide
  Target: ATXN1; (+) strand; PAM type: NRG; PAM sequence: CAG
tttcagaggccgaggggggg

SEQ ID NO: 104093 - DNA, 20 bp, Artificial Sequence
  Description of Artificial Sequence: Synthetic oligonucleotide
  Target: ATXN1; (+) strand; PAM type: NRG; PAM sequence: GAG
cgagggggggcagatcatgt

SEQ ID NO: 104094 - DNA, 20 bp, Artificial Sequence
  Description of Artificial Sequence: Synthetic oligonucleotide
  Target: ATXN1; (+) strand; PAM type: NRG; PAM sequence: CAG
ggggcagatcatgtgagatc

SEQ ID NO: 104095 - DNA, 20 bp, Artificial Sequence
  Description of Artificial Sequence: Synthetic oligonucleotide
  Target: ATXN1; (+) strand; PAM type: NRG; PAM sequence: GAG
ggcagatcatgtgagatcca

SEQ ID NO: 104096 - DNA, 20 bp, Artificial Sequence
  Description of Artificial Sequence: Synthetic oligonucleotide
  Target: ATXN1; (+) strand; PAM type: NRG; PAM sequence: GAG
tcatgtgagatccagagttc

SEQ ID NO: 104097 - DNA, 20 bp, Artificial Sequence
  Description of Artificial Sequence: Synthetic oligonucleotide
  Target: ATXN1; (+) strand; PAM type: NRG; PAM sequence: CAG
tgagatccagagttcgagac

SEQ ID NO: 104098 - DNA, 20 bp, Artificial Sequence
  Description of Artificial Sequence: Synthetic oligonucleotide
  Target: ATXN1; (+) strand; PAM type: NRG; PAM sequence: TGG
tccagagttcgagaccagcc

SEQ ID NO: 104099 - DNA, 20 bp, Artificial Sequence
  Description of Artificial Sequence: Synthetic oligonucleotide
  Target: ATXN1; (+) strand; PAM type: NRG; PAM sequence: TGG
cgagaccagcctggtcaatg

SEQ ID NO: 104100 - DNA, 20 bp, Artificial Sequence
  Description of Artificial Sequence: Synthetic oligonucleotide
  Target: ATXN1; (+) strand; PAM type: NRG; PAM sequence: AAG
ccagcctggtcaatgtggca

SEQ ID NO: 104101 - DNA, 20 bp, Artificial Sequence
  Description of Artificial Sequence: Synthetic oligonucleotide
  Target: ATXN1; (+) strand; PAM type: NRG; PAM sequence: TAG
actaaaaatacaaaaaaaat

SEQ ID NO: 104102 - DNA, 20 bp, Artificial Sequence
  Description of Artificial Sequence: Synthetic oligonucleotide
  Target: ATXN1; (+) strand; PAM type: NRG; PAM sequence: CGG
aaaatacaaaaaaaattagc

SEQ ID NO: 104103 - DNA, 20 bp, Artificial Sequence
  Description of Artificial Sequence: Synthetic oligonucleotide
  Target: ATXN1; (+) strand; PAM type: NRG; PAM sequence: GGG
aaatacaaaaaaaattagcc

SEQ ID NO: 104104 - DNA, 20 bp, Artificial Sequence
  Description of Artificial Sequence: Synthetic oligonucleotide
  Target: ATXN1; (+) strand; PAM type: NRG; PAM sequence: TGG
caaaaaaaattagccgggct

SEQ ID NO: 104105 - DNA, 20 bp, Artificial Sequence
  Description of Artificial Sequence: Synthetic oligonucleotide
  Target: ATXN1; (+) strand; PAM type: NRG; PAM sequence: TGG
aaaaaattagccgggcttgg

SEQ ID NO: 104106 - DNA, 20 bp, Artificial Sequence
  Description of Artificial Sequence: Synthetic oligonucleotide
  Target: ATXN1; (+) strand; PAM type: NRG; PAM sequence: GAG
aattagccgggcttggtggt

SEQ ID NO: 104107 - DNA, 20 bp, Artificial Sequence
  Description of Artificial Sequence: Synthetic oligonucleotide
  Target: ATXN1; (+) strand; PAM type: NRG; PAM sequence: CAG
gtggtgagtgcctgtaattc

SEQ ID NO: 104108 - DNA, 20 bp, Artificial Sequence
  Description of Artificial Sequence: Synthetic oligonucleotide
  Target: ATXN1; (+) strand; PAM type: NRG; PAM sequence: AGG
tggtgagtgcctgtaattcc

SEQ ID NO: 104109 - DNA, 20 bp, Artificial Sequence
  Description of Artificial Sequence: Synthetic oligonucleotide
  Target: ATXN1; (+) strand; PAM type: NRG; PAM sequence: GGG
ggtgagtgcctgtaattcca

SEQ ID NO: 104110 - DNA, 20 bp, Artificial Sequence
  Description of Artificial Sequence: Synthetic oligonucleotide
  Target: ATXN1; (+) strand; PAM type: NRG; PAM sequence: GAG
tgagtgcctgtaattccagg

SEQ ID NO: 104111 - DNA, 20 bp, Artificial Sequence
  Description of Artificial Sequence: Synthetic oligonucleotide
  Target: ATXN1; (+) strand; PAM type: NRG; PAM sequence: AGG
gagtgcctgtaattccaggg

SEQ ID NO: 104112 - DNA, 20 bp, Artificial Sequence
  Description of Artificial Sequence: Synthetic oligonucleotide
  Target: ATXN1; (+) strand; PAM type: NRG; PAM sequence: GAG
cctgtaattccagggaggct

SEQ ID NO: 104113 - DNA, 20 bp, Artificial Sequence
  Description of Artificial Sequence: Synthetic oligonucleotide
  Target: ATXN1; (+) strand; PAM type: NRG; PAM sequence: AGG
ctgtaattccagggaggctg

SEQ ID NO: 104114 - DNA, 20 bp, Artificial Sequence
  Description of Artificial Sequence: Synthetic oligonucleotide
  Target: ATXN1; (+) strand; PAM type: NRG; PAM sequence: CAG
taattccagggaggctgagg

SEQ ID NO: 104115 - DNA, 20 bp, Artificial Sequence
  Description of Artificial Sequence: Synthetic oligonucleotide
  Target: ATXN1; (+) strand; PAM type: NRG; PAM sequence: AAG
ttccagggaggctgaggcag

SEQ ID NO: 104116 - DNA, 20 bp, Artificial Sequence
  Description of Artificial Sequence: Synthetic oligonucleotide
  Target: ATXN1; (+) strand; PAM type: NRG; PAM sequence: GAG
gaagaatcacttgaacccgc

SEQ ID NO: 104117 - DNA, 20 bp, Artificial Sequence
  Description of Artificial Sequence: Synthetic oligonucleotide
  Target: ATXN1; (+) strand; PAM type: NRG; PAM sequence: AGG
aagaatcacttgaacccgcg

SEQ ID NO: 104118 - DNA, 20 bp, Artificial Sequence
  Description of Artificial Sequence: Synthetic oligonucleotide
  Target: ATXN1; (+) strand; PAM type: NRG; PAM sequence: TGG
aatcacttgaacccgcgagg

SEQ ID NO: 104119 - DNA, 20 bp, Artificial Sequence
  Description of Artificial Sequence: Synthetic oligonucleotide
  Target: ATXN1; (+) strand; PAM type: NRG; PAM sequence: GAG
tcacttgaacccgcgaggtg

SEQ ID NO: 104120 - DNA, 20 bp, Artificial Sequence
  Description of Artificial Sequence: Synthetic oligonucleotide
  Target: ATXN1; (+) strand; PAM type: NRG; PAM sequence: AGG
cacttgaacccgcgaggtgg

SEQ ID NO: 104121 - DNA, 20 bp, Artificial Sequence
  Description of Artificial Sequence: Synthetic oligonucleotide
  Target: ATXN1; (+) strand; PAM type: NRG; PAM sequence: CAG
aacccgcgaggtggaggttg

SEQ ID NO: 104122 - DNA, 20 bp, Artificial Sequence
  Description of Artificial Sequence: Synthetic oligonucleotide
  Target: ATXN1; (+) strand; PAM type: NRG; PAM sequence: AAG
ggtggaggttgcagcgaacc

SEQ ID NO: 104123 - DNA, 20 bp, Artificial Sequence
  Description of Artificial Sequence: Synthetic oligonucleotide
  Target: ATXN1; (+) strand; PAM type: NRG; PAM sequence: TAG
aagattgtaccattgcactc

SEQ ID NO: 104124 - DNA, 20 bp, Artificial Sequence
  Description of Artificial Sequence: Synthetic oligonucleotide
  Target: ATXN1; (+) strand; PAM type: NRG; PAM sequence: TGG
tgtaccattgcactctagcc

SEQ ID NO: 104125 - DNA, 20 bp, Artificial Sequence
  Description of Artificial Sequence: Synthetic oligonucleotide
  Target: ATXN1; (+) strand; PAM type: NRG; PAM sequence: GGG
gtaccattgcactctagcct

SEQ ID NO: 104126 - DNA, 20 bp, Artificial Sequence
  Description of Artificial Sequence: Synthetic oligonucleotide
  Target: ATXN1; (+) strand; PAM type: NRG; PAM sequence: CAG
ttgcactctagcctgggcga

SEQ ID NO: 104127 - DNA, 20 bp, Artificial Sequence
  Description of Artificial Sequence: Synthetic oligonucleotide
  Target: ATXN1; (+) strand; PAM type: NRG; PAM sequence: AGG
tgcactctagcctgggcgac

SEQ ID NO: 104128 - DNA, 20 bp, Artificial Sequence
  Description of Artificial Sequence: Synthetic oligonucleotide
  Target: ATXN1; (+) strand; PAM type: NRG; PAM sequence: GAG
cactctagcctgggcgacag

SEQ ID NO: 104129 - DNA, 20 bp, Artificial Sequence
  Description of Artificial Sequence: Synthetic oligonucleotide
  Target: ATXN1; (+) strand; PAM type: NRG; PAM sequence: TAG
acaggagtgaaactctgcct

SEQ ID NO: 104130 - DNA, 20 bp, Artificial Sequence
  Description of Artificial Sequence: Synthetic oligonucleotide
  Target: ATXN1; (+) strand; PAM type: NRG; PAM sequence: AAG
gccttagaaaaaaaaaaatg

SEQ ID NO: 104131 - DNA, 20 bp, Artificial Sequence
  Description of Artificial Sequence: Synthetic oligonucleotide
  Target: ATXN1; (+) strand; PAM type: NRG; PAM sequence: TAG
tagaaaaaaaaaaatgaaga

SEQ ID NO: 104132 - DNA, 20 bp, Artificial Sequence
  Description of Artificial Sequence: Synthetic oligonucleotide
  Target: ATXN1; (+) strand; PAM type: NRG; PAM sequence: AAG
gtaatacgccttatttcatg

SEQ ID NO: 104133 - DNA, 20 bp, Artificial Sequence
  Description of Artificial Sequence: Synthetic oligonucleotide
  Target: ATXN1; (+) strand; PAM type: NRG; PAM sequence: GAG
ttatttcatgaagttgttat

SEQ ID NO: 104134 - DNA, 20 bp, Artificial Sequence
  Description of Artificial Sequence: Synthetic oligonucleotide
  Target: ATXN1; (+) strand; PAM type: NRG; PAM sequence: TGG
aagttgttatgagaattgca

SEQ ID NO: 104135 - DNA, 20 bp, Artificial Sequence
  Description of Artificial Sequence: Synthetic oligonucleotide
  Target: ATXN1; (+) strand; PAM type: NRG; PAM sequence: GGG
agttgttatgagaattgcat

SEQ ID NO: 104136 - DNA, 20 bp, Artificial Sequence
  Description of Artificial Sequence: Synthetic oligonucleotide
  Target: ATXN1; (+) strand; PAM type: NRG; PAM sequence: CAG
gagaattgcatgggacaatt

SEQ ID NO: 104137 - DNA, 20 bp, Artificial Sequence
  Description of Artificial Sequence: Synthetic oligonucleotide
  Target: ATXN1; (+) strand; PAM type: NRG; PAM sequence: TAG
gcatgggacaattcagtgcc

SEQ ID NO: 104138 - DNA, 20 bp, Artificial Sequence
  Description of Artificial Sequence: Synthetic oligonucleotide
  Target: ATXN1; (+) strand; PAM type: NRG; PAM sequence: AAG
caattcagtgcctagcatgc

SEQ ID NO: 104139 - DNA, 20 bp, Artificial Sequence
  Description of Artificial Sequence: Synthetic oligonucleotide
  Target: ATXN1; (+) strand; PAM type: NRG; PAM sequence: CAG
ttcagtgcctagcatgcaag

SEQ ID NO: 104140 - DNA, 20 bp, Artificial Sequence
  Description of Artificial Sequence: Synthetic oligonucleotide
  Target: ATXN1; (+) strand; PAM type: NRG; PAM sequence: AGG
tcagtgcctagcatgcaagc

SEQ ID NO: 104141 - DNA, 20 bp, Artificial Sequence
  Description of Artificial Sequence: Synthetic oligonucleotide
  Target: ATXN1; (+) strand; PAM type: NRG; PAM sequence: CAG
gtgcctagcatgcaagcagg

SEQ ID NO: 104142 - DNA, 20 bp, Artificial Sequence
  Description of Artificial Sequence: Synthetic oligonucleotide
  Target: ATXN1; (+) strand; PAM type: NRG; PAM sequence: TAG
cctagcatgcaagcaggcag

SEQ ID NO: 104143 - DNA, 20 bp, Artificial Sequence
  Description of Artificial Sequence: Synthetic oligonucleotide
  Target: ATXN1; (+) strand; PAM type: NRG; PAM sequence: CAG
tctcatgatgaactgctttc

SEQ ID NO: 104144 - DNA, 20 bp, Artificial Sequence
  Description of Artificial Sequence: Synthetic oligonucleotide
  Target: ATXN1; (+) strand; PAM type: NRG; PAM sequence: CAG
actacctcctatgactgctg

SEQ ID NO: 104145 - DNA, 20 bp, Artificial Sequence
  Description of Artificial Sequence: Synthetic oligonucleotide
  Target: ATXN1; (+) strand; PAM type: NRG; PAM sequence: CAG
cctatgactgctgcagcaaa

SEQ ID NO: 104146 - DNA, 20 bp, Artificial Sequence
  Description of Artificial Sequence: Synthetic oligonucleotide
  Target: ATXN1; (+) strand; PAM type: NRG; PAM sequence: CAG
gactgctgcagcaaacagca

SEQ ID NO: 104147 - DNA, 20 bp, Artificial Sequence
  Description of Artificial Sequence: Synthetic oligonucleotide
  Target: ATXN1; (+) strand; PAM type: NRG; PAM sequence: AGG
actgctgcagcaaacagcac

SEQ ID NO: 104148 - DNA, 20 bp, Artificial Sequence
  Description of Artificial Sequence: Synthetic oligonucleotide
  Target: ATXN1; (+) strand; PAM type: NRG; PAM sequence: TGG
tgcagcaaacagcacaggcc

SEQ ID NO: 104149 - DNA, 20 bp, Artificial Sequence
  Description of Artificial Sequence: Synthetic oligonucleotide
  Target: ATXN1; (+) strand; PAM type: NRG; PAM sequence: GGG
gcagcaaacagcacaggcct

SEQ ID NO: 104150 - DNA, 20 bp, Artificial Sequence
  Description of Artificial Sequence: Synthetic oligonucleotide
  Target: ATXN1; (+) strand; PAM type: NRG; PAM sequence: TAG
aacagcacaggcctgggatc

SEQ ID NO: 104151 - DNA, 20 bp, Artificial Sequence
  Description of Artificial Sequence: Synthetic oligonucleotide
  Target: ATXN1; (+) strand; PAM type: NRG; PAM sequence: AGG
acagcacaggcctgggatct

SEQ ID NO: 104152 - DNA, 20 bp, Artificial Sequence
  Description of Artificial Sequence: Synthetic oligonucleotide
  Target: ATXN1; (+) strand; PAM type: NRG; PAM sequence: TGG
gggatctaggccacctgatt

SEQ ID NO: 104153 - DNA, 20 bp, Artificial Sequence
  Description of Artificial Sequence: Synthetic oligonucleotide
  Target: ATXN1; (+) strand; PAM type: NRG; PAM sequence: TGG
ggccacctgatttggaatcc

SEQ ID NO: 104154 - DNA, 20 bp, Artificial Sequence
  Description of Artificial Sequence: Synthetic oligonucleotide
  Target: ATXN1; (+) strand; PAM type: NRG; PAM sequence: TGG
cacctgatttggaatcctgg

SEQ ID NO: 104155 - DNA, 20 bp, Artificial Sequence
  Description of Artificial Sequence: Synthetic oligonucleotide
  Target: ATXN1; (+) strand; PAM type: NRG; PAM sequence: CAG
atcctggtggccttactcct

SEQ ID NO: 104156 - DNA, 20 bp, Artificial Sequence
  Description of Artificial Sequence: Synthetic oligonucleotide
  Target: ATXN1; (+) strand; PAM type: NRG; PAM sequence: AAG
cagctgtgtatatctgatgc

SEQ ID NO: 104157 - DNA, 20 bp, Artificial Sequence
  Description of Artificial Sequence: Synthetic oligonucleotide
  Target: ATXN1; (+) strand; PAM type: NRG; PAM sequence: AAG
ttaattaatttctctgatct

SEQ ID NO: 104158 - DNA, 20 bp, Artificial Sequence
  Description of Artificial Sequence: Synthetic oligonucleotide
  Target: ATXN1; (+) strand; PAM type: NRG; PAM sequence: CAG
tctctgatctaagtactaac

SEQ ID NO: 104159 - DNA, 20 bp, Artificial Sequence
  Description of Artificial Sequence: Synthetic oligonucleotide
  Target: ATXN1; (+) strand; PAM type: NRG; PAM sequence: AGG
ctctgatctaagtactaacc

SEQ ID NO: 104160 - DNA, 20 bp, Artificial Sequence
  Description of Artificial Sequence: Synthetic oligonucleotide
  Target: ATXN1; (+) strand; PAM type: NRG; PAM sequence: CAG
taattcatttctctgtgcct

SEQ ID NO: 104161 - DNA, 20 bp, Artificial Sequence
  Description of Artificial Sequence: Synthetic oligonucleotide
  Target: ATXN1; (+) strand; PAM type: NRG; PAM sequence: AAG
cctcagtttgctcatctcca

SEQ ID NO: 104162 - DNA, 20 bp, Artificial Sequence
  Description of Artificial Sequence: Synthetic oligonucleotide
  Target: ATXN1; (+) strand; PAM type: NRG; PAM sequence: TGG
cagtttgctcatctccaaag

SEQ ID NO: 104163 - DNA, 20 bp, Artificial Sequence
  Description of Artificial Sequence: Synthetic oligonucleotide
  Target: ATXN1; (+) strand; PAM type: NRG; PAM sequence: GGG
agtttgctcatctccaaagt

SEQ ID NO: 104164 - DNA, 20 bp, Artificial Sequence
  Description of Artificial Sequence: Synthetic oligonucleotide
  Target: ATXN1; (+) strand; PAM type: NRG; PAM sequence: TAG
ctccaaagtgggaataatac

SEQ ID NO: 104165 - DNA, 20 bp, Artificial Sequence
  Description of Artificial Sequence: Synthetic oligonucleotide
  Target: ATXN1; (+) strand; PAM type: NRG; PAM sequence: CAG
taatactagttcctacccca

SEQ ID NO: 104166 - DNA, 20 bp, Artificial Sequence
  Description of Artificial Sequence: Synthetic oligonucleotide
  Target: ATXN1; (+) strand; PAM type: NRG; PAM sequence: AGG
aatactagttcctaccccac

SEQ ID NO: 104167 - DNA, 20 bp, Artificial Sequence
  Description of Artificial Sequence: Synthetic oligonucleotide
  Target: ATXN1; (+) strand; PAM type: NRG; PAM sequence: GAG
ctaccccacaggcttgctgt

SEQ ID NO: 104168 - DNA, 20 bp, Artificial Sequence
  Description of Artificial Sequence: Synthetic oligonucleotide
  Target: ATXN1; (+) strand; PAM type: NRG; PAM sequence: AAG
cttgctgtgagttcacacat

SEQ ID NO: 104169 - DNA, 20 bp, Artificial Sequence
  Description of Artificial Sequence: Synthetic oligonucleotide
  Target: ATXN1; (+) strand; PAM type: NRG; PAM sequence: AAG
gctgtgagttcacacataag

SEQ ID NO: 104170 - DNA, 20 bp, Artificial Sequence
  Description of Artificial Sequence: Synthetic oligonucleotide
  Target: ATXN1; (+) strand; PAM type: NRG; PAM sequence: TAG
gttcacacataagaagaatt

SEQ ID NO: 104171 - DNA, 20 bp, Artificial Sequence
  Description of Artificial Sequence: Synthetic oligonucleotide
  Target: ATXN1; (+) strand; PAM type: NRG; PAM sequence: GAG
cacataagaagaatttagat

SEQ ID NO: 104172 - DNA, 20 bp, Artificial Sequence
  Description of Artificial Sequence: Synthetic oligonucleotide
  Target: ATXN1; (+) strand; PAM type: NRG; PAM sequence: AGG
acataagaagaatttagatg

SEQ ID NO: 104173 - DNA, 20 bp, Artificial Sequence
  Description of Artificial Sequence: Synthetic oligonucleotide
  Target: ATXN1; (+) strand; PAM type: NRG; PAM sequence: GGG
cataagaagaatttagatga

SEQ ID NO: 104174 - DNA, 20 bp, Artificial Sequence
  Description of Artificial Sequence: Synthetic oligonucleotide
  Target: ATXN1; (+) strand; PAM type: NRG; PAM sequence: TGG
gaagaatttagatgagggcc

SEQ ID NO: 104175 - DNA, 20 bp, Artificial Sequence
  Description of Artificial Sequence: Synthetic oligonucleotide
  Target: ATXN1; (+) strand; PAM type: NRG; PAM sequence: AAG
gatgagggcctggcgtactc

SEQ ID NO: 104176 - DNA, 20 bp, Artificial Sequence
  Description of Artificial Sequence: Synthetic oligonucleotide
  Target: ATXN1; (+) strand; PAM type: NRG; PAM sequence: TGG
tactcaagacctacaattac

SEQ ID NO: 104177 - DNA, 20 bp, Artificial Sequence
  Description of Artificial Sequence: Synthetic oligonucleotide
  Target: ATXN1; (+) strand; PAM type: NRG; PAM sequence: TGG
agacctacaattactggctg

SEQ ID NO: 104178 - DNA, 20 bp, Artificial Sequence
  Description of Artificial Sequence: Synthetic oligonucleotide
  Target: ATXN1; (+) strand; PAM type: NRG; PAM sequence: AAG
ggttgttccgattattttct

SEQ ID NO: 104179 - DNA, 20 bp, Artificial Sequence
  Description of Artificial Sequence: Synthetic oligonucleotide
  Target: ATXN1; (+) strand; PAM type: NRG; PAM sequence: AAG
gttccgattattttctaaga

SEQ ID NO: 104180 - DNA, 20 bp, Artificial Sequence
  Description of Artificial Sequence: Synthetic oligonucleotide
  Target: ATXN1; (+) strand; PAM type: NRG; PAM sequence: AGG
ttccgattattttctaagaa

SEQ ID NO: 104181 - DNA, 20 bp, Artificial Sequence
  Description of Artificial Sequence: Synthetic oligonucleotide
  Target: ATXN1; (+) strand; PAM type: NRG; PAM sequence: TGG
cttctctacctccttcactg

SEQ ID NO: 104182 - DNA, 20 bp, Artificial Sequence
  Description of Artificial Sequence: Synthetic oligonucleotide
  Target: ATXN1; (+) strand; PAM type: NRG; PAM sequence: CAG
gcataaaaaaatcacatttt

SEQ ID NO: 104183 - DNA, 20 bp, Artificial Sequence
  Description of Artificial Sequence: Synthetic oligonucleotide
  Target: ATXN1; (+) strand; PAM type: NRG; PAM sequence: AGG
cataaaaaaatcacattttc

SEQ ID NO: 104184 - DNA, 20 bp, Artificial Sequence
  Description of Artificial Sequence: Synthetic oligonucleotide
  Target: ATXN1; (+) strand; PAM type: NRG; PAM sequence: TGG
aaaaaatcacattttcaggc

SEQ ID NO: 104185 - DNA, 20 bp, Artificial Sequence
  Description of Artificial Sequence: Synthetic oligonucleotide
  Target: ATXN1; (+) strand; PAM type: NRG; PAM sequence: GGG
aaaaatcacattttcaggct

SEQ ID NO: 104186 - DNA, 20 bp, Artificial Sequence
  Description of Artificial Sequence: Synthetic oligonucleotide
  Target: ATXN1; (+) strand; PAM type: NRG; PAM sequence: TGG
tcacattttcaggctgggca

SEQ ID NO: 104187 - DNA, 20 bp, Artificial Sequence
  Description of Artificial Sequence: Synthetic oligonucleotide
  Target: ATXN1; (+) strand; PAM type: NRG; PAM sequence: TGG
cattttcaggctgggcatgg

SEQ ID NO: 104188 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctgtaatcc

SEQ ID NO: 104189 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagcactt

SEQ ID NO: 104190 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 104191 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 104192 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 104193 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggct

SEQ ID NO: 104194 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggctg

SEQ ID NO: 104195 - DNA, 20 bp, Artificial Sequence
  Description of Artificial Sequence: Synthetic oligonucleotide
  Target: ATXN1; (+) strand; PAM type: NRG; PAM sequence: TGG
gcactttgggaggctgaggc

SEQ ID NO: 104196 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggctgaggctgg

SEQ ID NO: 104197 - DNA, 20 bp, Artificial Sequence
  Description of Artificial Sequence: Synthetic oligonucleotide
  Target: ATXN1; (+) strand; PAM type: NRG; PAM sequence: GAG
ggctgaggctggtggatcac

SEQ ID NO: 104198 - DNA, 20 bp, Artificial Sequence
  Description of Artificial Sequence: Synthetic oligonucleotide
  Target: ATXN1; (+) strand; PAM type: NRG; PAM sequence: AAG
ggctggtggatcacgagatg

SEQ ID NO: 104199 - DNA, 20 bp, Artificial Sequence
  Description of Artificial Sequence: Synthetic oligonucleotide
  Target: ATXN1; (+) strand; PAM type: NRG; PAM sequence: GAG
ctggtggatcacgagatgaa

SEQ ID NO: 104200 - DNA, 20 bp, Artificial Sequence
  Description of Artificial Sequence: Synthetic oligonucleotide
  Target: ATXN1; (+) strand; PAM type: NRG; PAM sequence: GAG
gatcacgagatgaagagatc

SEQ ID NO: 104201 - DNA, 20 bp, Artificial Sequence
  Description of Artificial Sequence: Synthetic oligonucleotide
  Target: ATXN1; (+) strand; PAM type: NRG; PAM sequence: TGG
tgaagagatcgagaccatcc

SEQ ID NO: 104202 - DNA, 20 bp, Artificial Sequence
  Description of Artificial Sequence: Synthetic oligonucleotide
  Target: ATXN1; (+) strand; PAM type: NRG; PAM sequence: TGG
cgagaccatcctggccaaca

SEQ ID NO: 104203 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 104204 - DNA, 20 bp, Artificial Sequence
  Description of Artificial Sequence: Synthetic oligonucleotide
  Target: ATXN1; (+) strand; PAM type: NRG; PAM sequence: TGG
ctaaaaatacaaaaattagc

SEQ ID NO: 104205 - DNA, 20 bp, Artificial Sequence
  Description of Artificial Sequence: Synthetic oligonucleotide
  Target: ATXN1; (+) strand; PAM type: NRG; PAM sequence: GGG
taaaaatacaaaaattagct

SEQ ID NO: 104206 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagctgggca

SEQ ID NO: 104207 - DNA, 20 bp, Artificial Sequence
  Description of Artificial Sequence: Synthetic oligonucleotide
  Target: ATXN1; (+) strand; PAM type: NRG; PAM sequence: TGG
caaaaattagctgggcatgg

SEQ ID NO: 104208 - DNA, 20 bp, Artificial Sequence
  Description of Artificial Sequence: Synthetic oligonucleotide
  Target: ATXN1; (+) strand; PAM type: NRG; PAM sequence: TAG
ggcatggtggcacgtgcctg

SEQ ID NO: 104209 - DNA, 20 bp, Artificial Sequence
  Description of Artificial Sequence: Synthetic oligonucleotide
  Target: ATXN1; (+) strand; PAM type: NRG; PAM sequence: CAG
gtggcacgtgcctgtagttc

SEQ ID NO: 104210 - DNA, 20 bp, Artificial Sequence
  Description of Artificial Sequence: Synthetic oligonucleotide
  Target: ATXN1; (+) strand; PAM type: NRG; PAM sequence: CGG
tgcctgtagttccagctact

SEQ ID NO: 104211 - DNA, 20 bp, Artificial Sequence
  Description of Artificial Sequence: Synthetic oligonucleotide
  Target: ATXN1; (+) strand; PAM type: NRG; PAM sequence: GGG
gcctgtagttccagctactc

SEQ ID NO: 104212 - DNA, 20 bp, Artificial Sequence
  Description of Artificial Sequence: Synthetic oligonucleotide
  Target: ATXN1; (+) strand; PAM type: NRG; PAM sequence: GAG
ctgtagttccagctactcgg

SEQ ID NO: 104213 - DNA, 20 bp, Artificial Sequence
  Description of Artificial Sequence: Synthetic oligonucleotide
  Target: ATXN1; (+) strand; PAM type: NRG; PAM sequence: AGG
tgtagttccagctactcggg

SEQ ID NO: 104214 - DNA, 20 bp, Artificial Sequence
  Description of Artificial Sequence: Synthetic oligonucleotide
  Target: ATXN1; (+) strand; PAM type: NRG; PAM sequence: GAG
ttccagctactcgggaggct

SEQ ID NO: 104215 - DNA, 20 bp, Artificial Sequence
  Description of Artificial Sequence: Synthetic oligonucleotide
  Target: ATXN1; (+) strand; PAM type: NRG; PAM sequence: AGG
tccagctactcgggaggctg

SEQ ID NO: 104216 - DNA, 20 bp, Artificial Sequence
  Description of Artificial Sequence: Synthetic oligonucleotide
  Target: ATXN1; (+) strand; PAM type: NRG; PAM sequence: CAG
agctactcgggaggctgagg

SEQ ID NO: 104217 - DNA, 20 bp, Artificial Sequence
  Description of Artificial Sequence: Synthetic oligonucleotide
  Target: ATXN1; (+) strand; PAM type: NRG; PAM sequence: AAG
tactcgggaggctgaggcag

SEQ ID NO: 104218 - DNA, 20 bp, Artificial Sequence
  Description of Artificial Sequence: Synthetic oligonucleotide
  Target: ATXN1; (+) strand; PAM type: NRG; PAM sequence: CGG
gcagaagaatcacttgaacc

SEQ ID NO: 104219 - DNA, 20 bp, Artificial Sequence
  Description of Artificial Sequence: Synthetic oligonucleotide
  Target: ATXN1; (+) strand; PAM type: NRG; PAM sequence: GGG
cagaagaatcacttgaaccc

SEQ ID NO: 104220 - DNA, 20 bp, Artificial Sequence
  Description of Artificial Sequence: Synthetic oligonucleotide
  Target: ATXN1; (+) strand; PAM type: NRG; PAM sequence: GAG
gaagaatcacttgaacccgg

SEQ ID NO: 104221 - DNA, 20 bp, Artificial Sequence
  Description of Artificial Sequence: Synthetic oligonucleotide
  Target: ATXN1; (+) strand; PAM type: NRG; PAM sequence: AGG
aagaatcacttgaacccggg

SEQ ID NO: 104222 - DNA, 20 bp, Artificial Sequence
  Description of Artificial Sequence: Synthetic oligonucleotide
  Target: ATXN1; (+) strand; PAM type: NRG; PAM sequence: CAG
aatcacttgaacccgggagg

SEQ ID NO: 104223 - DNA, 20 bp, Artificial Sequence
  Description of Artificial Sequence: Synthetic oligonucleotide
  Target: ATXN1; (+) strand; PAM type: NRG; PAM sequence: GAG
tcacttgaacccgggaggca

SEQ ID NO: 104224 - DNA, 20 bp, Artificial Sequence
  Description of Artificial Sequence: Synthetic oligonucleotide
  Target: ATXN1; (+) strand; PAM type: NRG; PAM sequence: AGG
cacttgaacccgggaggcag

SEQ ID NO: 104225 - DNA, 20 bp, Artificial Sequence
  Description of Artificial Sequence: Synthetic oligonucleotide
  Target: ATXN1; (+) strand; PAM type: NRG; PAM sequence: CAG
aacccgggaggcagaggttg

SEQ ID NO: 104226 - DNA, 20 bp, Artificial Sequence
  Description of Artificial Sequence: Synthetic oligonucleotide
  Target: ATXN1; (+) strand; PAM type: NRG; PAM sequence: GAG
cgggaggcagaggttgcagt

SEQ ID NO: 104227 - DNA, 20 bp, Artificial Sequence
  Description of Artificial Sequence: Synthetic oligonucleotide
  Target: ATXN1; (+) strand; PAM type: NRG; PAM sequence: GAG
ggcagaggttgcagtgagct

SEQ ID NO: 104228 - DNA, 20 bp, Artificial Sequence
  Description of Artificial Sequence: Synthetic oligonucleotide
  Target: ATXN1; (+) strand; PAM type: NRG; PAM sequence: CAG
gagatcatgccactgcactc

SEQ ID NO: 104229 - DNA, 20 bp, Artificial Sequence
  Description of Artificial Sequence: Synthetic oligonucleotide
  Target: ATXN1; (+) strand; PAM type: NRG; PAM sequence: TGG
catgccactgcactccagcc

SEQ ID NO: 104230 - DNA, 20 bp, Artificial Sequence
  Description of Artificial Sequence: Synthetic oligonucleotide
  Target: ATXN1; (+) strand; PAM type: NRG; PAM sequence: CAG
actgcactccagcctggtga

SEQ ID NO: 104231 - DNA, 20 bp, Artificial Sequence
  Description of Artificial Sequence: Synthetic oligonucleotide
  Target: ATXN1; (+) strand; PAM type: NRG; PAM sequence: GAG
tgcactccagcctggtgaca

SEQ ID NO: 104232 - DNA, 20 bp, Artificial Sequence
  Description of Artificial Sequence: Synthetic oligonucleotide
  Target: ATXN1; (+) strand; PAM type: NRG; PAM sequence: GAG
ctccagcctggtgacagagc

SEQ ID NO: 104233 - DNA, 20 bp, Artificial Sequence
  Description of Artificial Sequence: Synthetic oligonucleotide
  Target: ATXN1; (+) strand; PAM type: NRG; PAM sequence: AAG
agcgagactgtgtctcaaaa

SEQ ID NO: 104234 - DNA, 20 bp, Artificial Sequence
  Description of Artificial Sequence: Synthetic oligonucleotide
  Target: ATXN1; (+) strand; PAM type: NRG; PAM sequence: AAG
agactgtgtctcaaaaaaga

SEQ ID NO: 104235 - DNA, 20 bp, Artificial Sequence
  Description of Artificial Sequence: Synthetic oligonucleotide
  Target: ATXN1; (+) strand; PAM type: NRG; PAM sequence: AAG
tgtgtctcaaaaaagaaaga

SEQ ID NO: 104236 - DNA, 20 bp, Artificial Sequence
  Description of Artificial Sequence: Synthetic oligonucleotide
  Target: ATXN1; (+) strand; PAM type: NRG; PAM sequence: TAG
aaaaaacacattttcctccc

SEQ ID NO: 104237 - DNA, 20 bp, Artificial Sequence
  Description of Artificial Sequence: Synthetic oligonucleotide
  Target: ATXN1; (+) strand; PAM type: NRG; PAM sequence: CAG
tcctccctagaattctttct

SEQ ID NO: 104238 - DNA, 20 bp, Artificial Sequence
  Description of Artificial Sequence: Synthetic oligonucleotide
  Target: ATXN1; (+) strand; PAM type: NRG; PAM sequence: AGG
cctccctagaattctttctc

SEQ ID NO: 104239 - DNA, 20 bp, Artificial Sequence
  Description of Artificial Sequence: Synthetic oligonucleotide
  Target: ATXN1; (+) strand; PAM type: NRG; PAM sequence: TAG
tcaggttacttcctgcatca

SEQ ID NO: 104240 - DNA, 20 bp, Artificial Sequence
  Description of Artificial Sequence: Synthetic oligonucleotide
  Target: ATXN1; (+) strand; PAM type: NRG; PAM sequence: CAG
acttcctgcatcatagacac

SEQ ID NO: 104241 - DNA, 20 bp, Artificial Sequence
  Description of Artificial Sequence: Synthetic oligonucleotide
  Target: ATXN1; (+) strand; PAM type: NRG; PAM sequence: CAG
cctgcatcatagacaccagt

SEQ ID NO: 104242 - DNA, 20 bp, Artificial Sequence
  Description of Artificial Sequence: Synthetic oligonucleotide
  Target: ATXN1; (+) strand; PAM type: NRG; PAM sequence: CAG
tcatagacaccagtcagctc

SEQ ID NO: 104243 - DNA, 20 bp, Artificial Sequence
  Description of Artificial Sequence: Synthetic oligonucleotide
  Target: ATXN1; (+) strand; PAM type: NRG; PAM sequence: AAG
gacaccagtcagctccagca

SEQ ID NO: 104244 - DNA, 20 bp, Artificial Sequence
  Description of Artificial Sequence: Synthetic oligonucleotide
  Target: ATXN1; (+) strand; PAM type: NRG; PAM sequence: TGG
ccagtcagctccagcaaaga

SEQ ID NO: 104245 - DNA, 20 bp, Artificial Sequence
  Description of Artificial Sequence: Synthetic oligonucleotide
  Target: ATXN1; (+) strand; PAM type: NRG; PAM sequence: TGG
gctccagcaaagatggtgaa

SEQ ID NO: 104246 - DNA, 20 bp, Artificial Sequence
  Description of Artificial Sequence: Synthetic oligonucleotide
  Target: ATXN1; (+) strand; PAM type: NRG; PAM sequence: AAG
atggaataatctctcattaa

SEQ ID NO: 104247 - DNA, 20 bp, Artificial Sequence
  Description of Artificial Sequence: Synthetic oligonucleotide
  Target: ATXN1; (+) strand; PAM type: NRG; PAM sequence: GAG
cctgcctcacttcccttcat

SEQ ID NO: 104248 - DNA, 20 bp, Artificial Sequence
  Description of Artificial Sequence: Synthetic oligonucleotide
  Target: ATXN1; (+) strand; PAM type: NRG; PAM sequence: AGG
ctgcctcacttcccttcatg

SEQ ID NO: 104249 - DNA, 20 bp, Artificial Sequence
  Description of Artificial Sequence: Synthetic oligonucleotide
  Target: ATXN1; (+) strand; PAM type: NRG; PAM sequence: AAG
ttcccttcatgaggcatttc

SEQ ID NO: 104250 - DNA, 20 bp, Artificial Sequence
  Description of Artificial Sequence: Synthetic oligonucleotide
  Target: ATXN1; (+) strand; PAM type: NRG; PAM sequence: CGG
tgaggcatttcaagtcttac

SEQ ID NO: 104251 - DNA, 20 bp, Artificial Sequence
  Description of Artificial Sequence: Synthetic oligonucleotide
  Target: ATXN1; (+) strand; PAM type: NRG; PAM sequence: CAG
catttcaagtcttaccggtt

SEQ ID NO: 104252 - DNA, 20 bp, Artificial Sequence
  Description of Artificial Sequence: Synthetic oligonucleotide
  Target: ATXN1; (+) strand; PAM type: NRG; PAM sequence: AAG
tcaagtcttaccggttcaga

SEQ ID NO: 104253 - DNA, 20 bp, Artificial Sequence
  Description of Artificial Sequence: Synthetic oligonucleotide
  Target: ATXN1; (+) strand; PAM type: NRG; PAM sequence: AAG
accggttcagaaagtttact

SEQ ID NO: 104254 - DNA, 20 bp, Artificial Sequence
  Description of Artificial Sequence: Synthetic oligonucleotide
  Target: ATXN1; (+) strand; PAM type: NRG; PAM sequence: TAG
tctctaaaattgtcttcttt

SEQ ID NO: 104255 - DNA, 20 bp, Artificial Sequence
  Description of Artificial Sequence: Synthetic oligonucleotide
  Target: ATXN1; (+) strand; PAM type: NRG; PAM sequence: TAG
ttttagaaaatactccacac

SEQ ID NO: 104256 - DNA, 20 bp, Artificial Sequence
  Description of Artificial Sequence: Synthetic oligonucleotide
  Target: ATXN1; (+) strand; PAM type: NRG; PAM sequence: TGG
atttttttttccccctaaac

SEQ ID NO: 104257 - DNA, 20 bp, Artificial Sequence
  Description of Artificial Sequence: Synthetic oligonucleotide
  Target: ATXN1; (+) strand; PAM type: NRG; PAM sequence: AAG
tttccccctaaactggacca

SEQ ID NO: 104258 - DNA, 20 bp, Artificial Sequence
  Description of Artificial Sequence: Synthetic oligonucleotide
  Target: ATXN1; (+) strand; PAM type: NRG; PAM sequence: CAG
ctggaccaaagccttgtttg

SEQ ID NO: 104259 - DNA, 20 bp, Artificial Sequence
  Description of Artificial Sequence: Synthetic oligonucleotide
  Target: ATXN1; (+) strand; PAM type: NRG; PAM sequence: TGG
agccttgtttgcagaacaaa

SEQ ID NO: 104260 - DNA, 20 bp, Artificial Sequence
  Description of Artificial Sequence: Synthetic oligonucleotide
  Target: ATXN1; (+) strand; PAM type: NRG; PAM sequence: AAG
tgtgctcatgttttcaattt

SEQ ID NO: 104261 - DNA, 20 bp, Artificial Sequence
  Description of Artificial Sequence: Synthetic oligonucleotide
  Target: ATXN1; (+) strand; PAM type: NRG; PAM sequence: TGG
ttgtttgctgtttattcctt

SEQ ID NO: 104262 - DNA, 20 bp, Artificial Sequence
  Description of Artificial Sequence: Synthetic oligonucleotide
  Target: ATXN1; (+) strand; PAM type: NRG; PAM sequence: TAG
gtttattcctttggtataaa

SEQ ID NO: 104263 - DNA, 20 bp, Artificial Sequence
  Description of Artificial Sequence: Synthetic oligonucleotide
  Target: ATXN1; (+) strand; PAM type: NRG; PAM sequence: AAG
tattcctttggtataaatag

SEQ ID NO: 104264 - DNA, 20 bp, Artificial Sequence
  Description of Artificial Sequence: Synthetic oligonucleotide
  Target: ATXN1; (+) strand; PAM type: NRG; PAM sequence: TGG
tggtataaatagaagctttc

SEQ ID NO: 104265 - DNA, 20 bp, Artificial Sequence
  Description of Artificial Sequence: Synthetic oligonucleotide
  Target: ATXN1; (+) strand; PAM type: NRG; PAM sequence: CAG
ctttctggcttatttgaacg

SEQ ID NO: 104266 - DNA, 20 bp, Artificial Sequence
  Description of Artificial Sequence: Synthetic oligonucleotide
  Target: ATXN1; (+) strand; PAM type: NRG; PAM sequence: TAG
ttatttgaacgcagaacaca

SEQ ID NO: 104267 - DNA, 20 bp, Artificial Sequence
  Description of Artificial Sequence: Synthetic oligonucleotide
  Target: ATXN1; (+) strand; PAM type: NRG; PAM sequence: TAG
agaacacatagtacactgtt

SEQ ID NO: 104268 - DNA, 20 bp, Artificial Sequence
  Description of Artificial Sequence: Synthetic oligonucleotide
  Target: ATXN1; (+) strand; PAM type: NRG; PAM sequence: TAG
aaatcaatgcttttcctttt

SEQ ID NO: 104269 - DNA, 20 bp, Artificial Sequence
  Description of Artificial Sequence: Synthetic oligonucleotide
  Target: ATXN1; (+) strand; PAM type: NRG; PAM sequence: TAG
ttagaataccatgccctaac

SEQ ID NO: 104270 - DNA, 20 bp, Artificial Sequence
  Description of Artificial Sequence: Synthetic oligonucleotide
  Target: ATXN1; (+) strand; PAM type: NRG; PAM sequence: AAG
tatgactaacgatttaattt

SEQ ID NO: 104271 - DNA, 20 bp, Artificial Sequence
  Description of Artificial Sequence: Synthetic oligonucleotide
  Target: ATXN1; (+) strand; PAM type: NRG; PAM sequence: AGG
atgactaacgatttaattta

SEQ ID NO: 104272 - DNA, 20 bp, Artificial Sequence
  Description of Artificial Sequence: Synthetic oligonucleotide
  Target: ATXN1; (+) strand; PAM type: NRG; PAM sequence: AAG
aaggccctaattcccaatga

SEQ ID NO: 104273 - DNA, 20 bp, Artificial Sequence
  Description of Artificial Sequence: Synthetic oligonucleotide
  Target: ATXN1; (+) strand; PAM type: NRG; PAM sequence: TAG
aaagataaataatgctgctg

SEQ ID NO: 104274 - DNA, 20 bp, Artificial Sequence
  Description of Artificial Sequence: Synthetic oligonucleotide
  Target: ATXN1; (+) strand; PAM type: NRG; PAM sequence: AGG
aagataaataatgctgctgt

SEQ ID NO: 104275 - DNA, 20 bp, Artificial Sequence
  Description of Artificial Sequence: Synthetic oligonucleotide
  Target: ATXN1; (+) strand; PAM type: NRG; PAM sequence: CAG
accaatgactgtaatctaaa

SEQ ID NO: 104276 - DNA, 20 bp, Artificial Sequence
  Description of Artificial Sequence: Synthetic oligonucleotide
  Target: ATXN1; (+) strand; PAM type: NRG; PAM sequence: AGG
ccaatgactgtaatctaaac

SEQ ID NO: 104277 - DNA, 20 bp, Artificial Sequence
  Description of Artificial Sequence: Synthetic oligonucleotide
  Target: ATXN1; (+) strand; PAM type: NRG; PAM sequence: TGG
acaggcaataaaatatttaa

SEQ ID NO: 104278 - DNA, 20 bp, Artificial Sequence
  Description of Artificial Sequence: Synthetic oligonucleotide
  Target: ATXN1; (+) strand; PAM type: NRG; PAM sequence: AAG
caataaaatatttaatggac

SEQ ID NO: 104279 - DNA, 20 bp, Artificial Sequence
  Description of Artificial Sequence: Synthetic oligonucleotide
  Target: ATXN1; (+) strand; PAM type: NRG; PAM sequence: CGG
taaaatatttaatggacaag

SEQ ID NO: 104280 - DNA, 20 bp, Artificial Sequence
  Description of Artificial Sequence: Synthetic oligonucleotide
  Target: ATXN1; (+) strand; PAM type: NRG; PAM sequence: AAG
gacaagcggaaatgcaaaaa

SEQ ID NO: 104281 - DNA, 20 bp, Artificial Sequence
  Description of Artificial Sequence: Synthetic oligonucleotide
  Target: ATXN1; (+) strand; PAM type: NRG; PAM sequence: AAG
agcggaaatgcaaaaaaagt

SEQ ID NO: 104282 - DNA, 20 bp, Artificial Sequence
  Description of Artificial Sequence: Synthetic oligonucleotide
  Target: ATXN1; (+) strand; PAM type: NRG; PAM sequence: AGG
gcggaaatgcaaaaaaagta

SEQ ID NO: 104283 - DNA, 20 bp, Artificial Sequence
  Description of Artificial Sequence: Synthetic oligonucleotide
  Target: ATXN1; (+) strand; PAM type: NRG; PAM sequence: CAG
gaaatgcaaaaaaagtaagg

SEQ ID NO: 104284 - DNA, 20 bp, Artificial Sequence
  Description of Artificial Sequence: Synthetic oligonucleotide
  Target: ATXN1; (+) strand; PAM type: NRG; PAM sequence: AAG
gcagtctcctgtttacaaca

SEQ ID NO: 104285 - DNA, 20 bp, Artificial Sequence
  Description of Artificial Sequence: Synthetic oligonucleotide
  Target: ATXN1; (+) strand; PAM type: NRG; PAM sequence: TAG
acaaagctcattttctatac

SEQ ID NO: 104286 - DNA, 20 bp, Artificial Sequence
  Description of Artificial Sequence: Synthetic oligonucleotide
  Target: ATXN1; (+) strand; PAM type: NRG; PAM sequence: TGG
cattttctatactagcactg

SEQ ID NO: 104287 - DNA, 20 bp, Artificial Sequence
  Description of Artificial Sequence: Synthetic oligonucleotide
  Target: ATXN1; (+) strand; PAM type: NRG; PAM sequence: TGG
ctatactagcactgtggacg

SEQ ID NO: 104288 - DNA, 20 bp, Artificial Sequence
  Description of Artificial Sequence: Synthetic oligonucleotide
  Target: ATXN1; (+) strand; PAM type: NRG; PAM sequence: AAG
tactagcactgtggacgtgg

SEQ ID NO: 104289 - DNA, 20 bp, Artificial Sequence
  Description of Artificial Sequence: Synthetic oligonucleotide
  Target: ATXN1; (+) strand; PAM type: NRG; PAM sequence: CAG
cactgtggacgtggaagatg

SEQ ID NO: 104290 - DNA, 20 bp, Artificial Sequence
  Description of Artificial Sequence: Synthetic oligonucleotide
  Target: ATXN1; (+) strand; PAM type: NRG; PAM sequence: AAG
aagatgcagttaacctctgt

SEQ ID NO: 104291 - DNA, 20 bp, Artificial Sequence
  Description of Artificial Sequence: Synthetic oligonucleotide
  Target: ATXN1; (+) strand; PAM type: NRG; PAM sequence: CAG
cagttaacctctgtaagcct

SEQ ID NO: 104292 - DNA, 20 bp, Artificial Sequence
  Description of Artificial Sequence: Synthetic oligonucleotide
  Target: ATXN1; (+) strand; PAM type: NRG; PAM sequence: TGG
taagcctcagtttcctcatc

SEQ ID NO: 104293 - DNA, 20 bp, Artificial Sequence
  Description of Artificial Sequence: Synthetic oligonucleotide
  Target: ATXN1; (+) strand; PAM type: NRG; PAM sequence: AAG
tgatgataatacgttttcaa

SEQ ID NO: 104294 - DNA, 20 bp, Artificial Sequence
  Description of Artificial Sequence: Synthetic oligonucleotide
  Target: ATXN1; (+) strand; PAM type: NRG; PAM sequence: GAG
tacgttttcaaaagattgtt

SEQ ID NO: 104295 - DNA, 20 bp, Artificial Sequence
  Description of Artificial Sequence: Synthetic oligonucleotide
  Target: ATXN1; (+) strand; PAM type: NRG; PAM sequence: AAG
agattgttgagatgaaataa

SEQ ID NO: 104296 - DNA, 20 bp, Artificial Sequence
  Description of Artificial Sequence: Synthetic oligonucleotide
  Target: ATXN1; (+) strand; PAM type: NRG; PAM sequence: TAG
ataaaagcaactataatgcc

SEQ ID NO: 104297 - DNA, 20 bp, Artificial Sequence
  Description of Artificial Sequence: Synthetic oligonucleotide
  Target: ATXN1; (+) strand; PAM type: NRG; PAM sequence: AAG
gcaactataatgcctagcat

SEQ ID NO: 104298 - DNA, 20 bp, Artificial Sequence
  Description of Artificial Sequence: Synthetic oligonucleotide
  Target: ATXN1; (+) strand; PAM type: NRG; PAM sequence: CAG
ctagcataagaaaaaaaatc

SEQ ID NO: 104299 - DNA, 20 bp, Artificial Sequence
  Description of Artificial Sequence: Synthetic oligonucleotide
  Target: ATXN1; (+) strand; PAM type: NRG; PAM sequence: AGG
tagcataagaaaaaaaatcc

SEQ ID NO: 104300 - DNA, 20 bp, Artificial Sequence
  Description of Artificial Sequence: Synthetic oligonucleotide
  Target: ATXN1; (+) strand; PAM type: NRG; PAM sequence: CAG
gtgttcttcttcctgaactt

SEQ ID NO: 104301 - DNA, 20 bp, Artificial Sequence
  Description of Artificial Sequence: Synthetic oligonucleotide
  Target: ATXN1; (+) strand; PAM type: NRG; PAM sequence: CAG
ttcttcctgaacttcagtct

SEQ ID NO: 104302 - DNA, 20 bp, Artificial Sequence
  Description of Artificial Sequence: Synthetic oligonucleotide
  Target: ATXN1; (+) strand; PAM type: NRG; PAM sequence: AAG
ctgaacttcagtctcagctc

SEQ ID NO: 104303 - DNA, 20 bp, Artificial Sequence
  Description of Artificial Sequence: Synthetic oligonucleotide
  Target: ATXN1; (+) strand; PAM type: NRG; PAM sequence: GAG
gaacttcagtctcagctcaa

SEQ ID NO: 104304 - DNA, 20 bp, Artificial Sequence
  Description of Artificial Sequence: Synthetic oligonucleotide
  Target: ATXN1; (+) strand; PAM type: NRG; PAM sequence: GAG
gtctcagctcaagagtctgt

SEQ ID NO: 104305 - DNA, 20 bp, Artificial Sequence
  Description of Artificial Sequence: Synthetic oligonucleotide
  Target: ATXN1; (+) strand; PAM type: NRG; PAM sequence: AGG
tctcagctcaagagtctgtg

SEQ ID NO: 104306 - DNA, 20 bp, Artificial Sequence
  Description of Artificial Sequence: Synthetic oligonucleotide
  Target: ATXN1; (+) strand; PAM type: NRG; PAM sequence: TGG
gtctgtgaggaatttccact

SEQ ID NO: 104307 - DNA, 20 bp, Artificial Sequence
  Description of Artificial Sequence: Synthetic oligonucleotide
  Target: ATXN1; (+) strand; PAM type: NRG; PAM sequence: CAG
gcttaccacccctctcaaat

SEQ ID NO: 104308 - DNA, 20 bp, Artificial Sequence
  Description of Artificial Sequence: Synthetic oligonucleotide
  Target: ATXN1; (+) strand; PAM type: NRG; PAM sequence: CGG
tctcaaatcagcatgcactc

SEQ ID NO: 104309 - DNA, 20 bp, Artificial Sequence
  Description of Artificial Sequence: Synthetic oligonucleotide
  Target: ATXN1; (+) strand; PAM type: NRG; PAM sequence: CGG
cggttccatatttctgctaa

SEQ ID NO: 104310 - DNA, 20 bp, Artificial Sequence
  Description of Artificial Sequence: Synthetic oligonucleotide
  Target: ATXN1; (+) strand; PAM type: NRG; PAM sequence: AAG
cggttttgcaccatttctcc

SEQ ID NO: 104311 - DNA, 20 bp, Artificial Sequence
  Description of Artificial Sequence: Synthetic oligonucleotide
  Target: ATXN1; (+) strand; PAM type: NRG; PAM sequence: TAG
ttgcaccatttctccaagca

SEQ ID NO: 104312 - DNA, 20 bp, Artificial Sequence
  Description of Artificial Sequence: Synthetic oligonucleotide
  Target: ATXN1; (+) strand; PAM type: NRG; PAM sequence: AGG
tgcaccatttctccaagcat

SEQ ID NO: 104313 - DNA, 20 bp, Artificial Sequence
  Description of Artificial Sequence: Synthetic oligonucleotide
  Target: ATXN1; (+) strand; PAM type: NRG; PAM sequence: CAG
ccatttctccaagcataggc

SEQ ID NO: 104314 - DNA, 20 bp, Artificial Sequence
  Description of Artificial Sequence: Synthetic oligonucleotide
  Target: ATXN1; (+) strand; PAM type: NRG; PAM sequence: GAG
atttctccaagcataggcca

SEQ ID NO: 104315 - DNA, 20 bp, Artificial Sequence
  Description of Artificial Sequence: Synthetic oligonucleotide
  Target: ATXN1; (+) strand; PAM type: NRG; PAM sequence: CAG
tcgcacttcactcctatatc

SEQ ID NO: 104316 - DNA, 20 bp, Artificial Sequence
  Description of Artificial Sequence: Synthetic oligonucleotide
  Target: ATXN1; (+) strand; PAM type: NRG; PAM sequence: CAG
agcgactcccctaattgtgt

SEQ ID NO: 104317 - DNA, 20 bp, Artificial Sequence
  Description of Artificial Sequence: Synthetic oligonucleotide
  Target: ATXN1; (+) strand; PAM type: NRG; PAM sequence: TGG
cttcaaaatgtctcaactct

SEQ ID NO: 104318 - DNA, 20 bp, Artificial Sequence
  Description of Artificial Sequence: Synthetic oligonucleotide
  Target: ATXN1; (+) strand; PAM type: NRG; PAM sequence: GGG
ttcaaaatgtctcaactctt

SEQ ID NO: 104319 - DNA, 20 bp, Artificial Sequence
  Description of Artificial Sequence: Synthetic oligonucleotide
  Target: ATXN1; (+) strand; PAM type: NRG; PAM sequence: GGG
tcaaaatgtctcaactcttg

SEQ ID NO: 104320 - DNA, 20 bp, Artificial Sequence
  Description of Artificial Sequence: Synthetic oligonucleotide
  Target: ATXN1; (+) strand; PAM type: NRG; PAM sequence: AAG
atgtctcaactcttggggtg

SEQ ID NO: 104321 - DNA, 20 bp, Artificial Sequence
  Description of Artificial Sequence: Synthetic oligonucleotide
  Target: ATXN1; (+) strand; PAM type: NRG; PAM sequence: AAG
aactcttggggtgaagcttg

SEQ ID NO: 104322 - DNA, 20 bp, Artificial Sequence
  Description of Artificial Sequence: Synthetic oligonucleotide
  Target: ATXN1; (+) strand; PAM type: NRG; PAM sequence: TAG
tttttcccatatttactgtg

SEQ ID NO: 104323 - DNA, 20 bp, Artificial Sequence
  Description of Artificial Sequence: Synthetic oligonucleotide
  Target: ATXN1; (+) strand; PAM type: NRG; PAM sequence: AGG
ttttcccatatttactgtgt

SEQ ID NO: 104324 - DNA, 20 bp, Artificial Sequence
  Description of Artificial Sequence: Synthetic oligonucleotide
  Target: ATXN1; (+) strand; PAM type: NRG; PAM sequence: AAG
cccatatttactgtgtagga

SEQ ID NO: 104325 - DNA, 20 bp, Artificial Sequence
  Description of Artificial Sequence: Synthetic oligonucleotide
  Target: ATXN1; (+) strand; PAM type: NRG; PAM sequence: TGG
ttactgtgtaggaaagaatt

SEQ ID NO: 104326 - DNA, 20 bp, Artificial Sequence
  Description of Artificial Sequence: Synthetic oligonucleotide
  Target: ATXN1; (+) strand; PAM type: NRG; PAM sequence: TGG
tgtaggaaagaatttggctt

SEQ ID NO: 104327 - DNA, 20 bp, Artificial Sequence
  Description of Artificial Sequence: Synthetic oligonucleotide
  Target: ATXN1; (+) strand; PAM type: NRG; PAM sequence: AAG
aaagaatttggctttggcca

SEQ ID NO: 104328 - DNA, 20 bp, Artificial Sequence
  Description of Artificial Sequence: Synthetic oligonucleotide
  Target: ATXN1; (+) strand; PAM type: NRG; PAM sequence: CGG
aatttggctttggccaaaga

SEQ ID NO: 104329 - DNA, 20 bp, Artificial Sequence
  Description of Artificial Sequence: Synthetic oligonucleotide
  Target: ATXN1; (+) strand; PAM type: NRG; PAM sequence: GGG
atttggctttggccaaagac

SEQ ID NO: 104330 - DNA, 20 bp, Artificial Sequence
  Description of Artificial Sequence: Synthetic oligonucleotide
  Target: ATXN1; (+) strand; PAM type: NRG; PAM sequence: TGG
acgggtctgccctttgccct

SEQ ID NO: 104331 - DNA, 20 bp, Artificial Sequence
  Description of Artificial Sequence: Synthetic oligonucleotide
  Target: ATXN1; (+) strand; PAM type: NRG; PAM sequence: TGG
tgccctttgcccttggctcc

SEQ ID NO: 104332 - DNA, 20 bp, Artificial Sequence
  Description of Artificial Sequence: Synthetic oligonucleotide
  Target: ATXN1; (+) strand; PAM type: NRG; PAM sequence: GGG
gccctttgcccttggctcct

SEQ ID NO: 104333 - DNA, 20 bp, Artificial Sequence
  Description of Artificial Sequence: Synthetic oligonucleotide
  Target: ATXN1; (+) strand; PAM type: NRG; PAM sequence: TAG
atgatctatgtgatatctga

SEQ ID NO: 104334 - DNA, 20 bp, Artificial Sequence
  Description of Artificial Sequence: Synthetic oligonucleotide
  Target: ATXN1; (+) strand; PAM type: NRG; PAM sequence: TGG
atctatgtgatatctgatag

SEQ ID NO: 104335 - DNA, 20 bp, Artificial Sequence
  Description of Artificial Sequence: Synthetic oligonucleotide
  Target: ATXN1; (+) strand; PAM type: NRG; PAM sequence: TGG
gatagtggtgtccctatttg

SEQ ID NO: 104336 - DNA, 20 bp, Artificial Sequence
  Description of Artificial Sequence: Synthetic oligonucleotide
  Target: ATXN1; (+) strand; PAM type: NRG; PAM sequence: GGG
atagtggtgtccctatttgt

SEQ ID NO: 104337 - DNA, 20 bp, Artificial Sequence
  Description of Artificial Sequence: Synthetic oligonucleotide
  Target: ATXN1; (+) strand; PAM type: NRG; PAM sequence: GGG
tagtggtgtccctatttgtg

SEQ ID NO: 104338 - DNA, 20 bp, Artificial Sequence
  Description of Artificial Sequence: Synthetic oligonucleotide
  Target: ATXN1; (+) strand; PAM type: NRG; PAM sequence: GAG
gtggtgtccctatttgtggg

SEQ ID NO: 104339 - DNA, 20 bp, Artificial Sequence
  Description of Artificial Sequence: Synthetic oligonucleotide
  Target: ATXN1; (+) strand; PAM type: NRG; PAM sequence: AGG
tggtgtccctatttgtgggg

SEQ ID NO: 104340 - DNA, 20 bp, Artificial Sequence
  Description of Artificial Sequence: Synthetic oligonucleotide
  Target: ATXN1; (+) strand; PAM type: NRG; PAM sequence: GGG
ggtgtccctatttgtgggga

SEQ ID NO: 104341 - DNA, 20 bp, Artificial Sequence
  Description of Artificial Sequence: Synthetic oligonucleotide
  Target: ATXN1; (+) strand; PAM type: NRG; PAM sequence: AAG
gtccctatttgtggggaggg

SEQ ID NO: 104342 - DNA, 20 bp, Artificial Sequence
  Description of Artificial Sequence: Synthetic oligonucleotide
  Target: ATXN1; (+) strand; PAM type: NRG; PAM sequence: AGG
tccctatttgtggggaggga

SEQ ID NO: 104343 - DNA, 20 bp, Artificial Sequence
  Description of Artificial Sequence: Synthetic oligonucleotide
  Target: ATXN1; (+) strand; PAM type: NRG; PAM sequence: CAG
tgtggggagggaaggatttt

SEQ ID NO: 104344 - DNA, 20 bp, Artificial Sequence
  Description of Artificial Sequence: Synthetic oligonucleotide
  Target: ATXN1; (+) strand; PAM type: NRG; PAM sequence: CAG
gagggaaggattttcagtca

SEQ ID NO: 104345 - DNA, 20 bp, Artificial Sequence
  Description of Artificial Sequence: Synthetic oligonucleotide
  Target: ATXN1; (+) strand; PAM type: NRG; PAM sequence: AAG
cacagcaaatcaccgaaccc

SEQ ID NO: 104346 - DNA, 20 bp, Artificial Sequence
  Description of Artificial Sequence: Synthetic oligonucleotide
  Target: ATXN1; (+) strand; PAM type: NRG; PAM sequence: TGG
aaatcaccgaacccaagcct

SEQ ID NO: 104347 - DNA, 20 bp, Artificial Sequence
  Description of Artificial Sequence: Synthetic oligonucleotide
  Target: ATXN1; (+) strand; PAM type: NRG; PAM sequence: TGG
ttggtttcctcattttaaaa

SEQ ID NO: 104348 - DNA, 20 bp, Artificial Sequence
  Description of Artificial Sequence: Synthetic oligonucleotide
  Target: ATXN1; (+) strand; PAM type: NRG; PAM sequence: GGG
tggtttcctcattttaaaat

SEQ ID NO: 104349 - DNA, 20 bp, Artificial Sequence
  Description of Artificial Sequence: Synthetic oligonucleotide
  Target: ATXN1; (+) strand; PAM type: NRG; PAM sequence: TGG
cctcattttaaaatgggaat

SEQ ID NO: 104350 - DNA, 20 bp, Artificial Sequence
  Description of Artificial Sequence: Synthetic oligonucleotide
  Target: ATXN1; (+) strand; PAM type: NRG; PAM sequence: TGG
attttaaaatgggaattggc

SEQ ID NO: 104351 - DNA, 20 bp, Artificial Sequence
  Description of Artificial Sequence: Synthetic oligonucleotide
  Target: ATXN1; (+) strand; PAM type: NRG; PAM sequence: GGG
ttttaaaatgggaattggct

SEQ ID NO: 104352 - DNA, 20 bp, Artificial Sequence
  Description of Artificial Sequence: Synthetic oligonucleotide
  Target: ATXN1; (+) strand; PAM type: NRG; PAM sequence: TGG
aaatgggaattggctgggtg

SEQ ID NO: 104353 - DNA, 20 bp, Artificial Sequence
  Description of Artificial Sequence: Synthetic oligonucleotide
  Target: ATXN1; (+) strand; PAM type: NRG; PAM sequence: TGG
tgggaattggctgggtgtgg

SEQ ID NO: 104354 - DNA, 20 bp, Artificial Sequence
  Description of Artificial Sequence: Synthetic oligonucleotide
  Target: ATXN1; (+) strand; PAM type: NRG; PAM sequence: CAG
gtggctcacacctgtaatcc

SEQ ID NO: 104355 - DNA, 20 bp, Artificial Sequence
  Description of Artificial Sequence: Synthetic oligonucleotide
  Target: ATXN1; (+) strand; PAM type: NRG; PAM sequence: CAG
cacctgtaatcccagcactt

SEQ ID NO: 104356 - DNA, 20 bp, Artificial Sequence
  Description of Artificial Sequence: Synthetic oligonucleotide
  Target: ATXN1; (+) strand; PAM type: NRG; PAM sequence: AGG
acctgtaatcccagcacttc

SEQ ID NO: 104357 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcacttcag

SEQ ID NO: 104358 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcacttcagg

SEQ ID NO: 104359 - DNA, 20 bp, Artificial Sequence
  Description of Artificial Sequence: Synthetic oligonucleotide
  Target: ATXN1; (+) strand; PAM type: NRG; PAM sequence: GAG
tcccagcacttcaggaggcc

SEQ ID NO: 104360 - DNA, 20 bp, Artificial Sequence
  Description of Artificial Sequence: Synthetic oligonucleotide
  Target: ATXN1; (+) strand; PAM type: NRG; PAM sequence: AGG
cccagcacttcaggaggccg

SEQ ID NO: 104361 - DNA, 20 bp, Artificial Sequence
  Description of Artificial Sequence: Synthetic oligonucleotide
  Target: ATXN1; (+) strand; PAM type: NRG; PAM sequence: CAG
agcacttcaggaggccgagg

SEQ ID NO: 104362 - DNA, 20 bp, Artificial Sequence
  Description of Artificial Sequence: Synthetic oligonucleotide
  Target: ATXN1; (+) strand; PAM type: NRG; PAM sequence: AGG
gcacttcaggaggccgaggc

SEQ ID NO: 104363 - DNA, 20 bp, Artificial Sequence
  Description of Artificial Sequence: Synthetic oligonucleotide
  Target: ATXN1; (+) strand; PAM type: NRG; PAM sequence: GAG
acttcaggaggccgaggcag

SEQ ID NO: 104364 - DNA, 20 bp, Artificial Sequence
  Description of Artificial Sequence: Synthetic oligonucleotide
  Target: ATXN1; (+) strand; PAM type: NRG; PAM sequence: AGG
cttcaggaggccgaggcagg

SEQ ID NO: 104365 - DNA, 20 bp, Artificial Sequence
  Description of Artificial Sequence: Synthetic oligonucleotide
  Target: ATXN1; (+) strand; PAM type: NRG; PAM sequence: GAG
ccgaggcaggaggactatgt

SEQ ID NO: 104366 - DNA, 20 bp, Artificial Sequence
  Description of Artificial Sequence: Synthetic oligonucleotide
  Target: ATXN1; (+) strand; PAM type: NRG; PAM sequence: AGG
cgaggcaggaggactatgtg

SEQ ID NO: 104367 - DNA, 20 bp, Artificial Sequence
  Description of Artificial Sequence: Synthetic oligonucleotide
  Target: ATXN1; (+) strand; PAM type: NRG; PAM sequence: CAG
gcaggaggactatgtgaggc

SEQ ID NO: 104368 - DNA, 20 bp, Artificial Sequence
  Description of Artificial Sequence: Synthetic oligonucleotide
  Target: ATXN1; (+) strand; PAM type: NRG; PAM sequence: AGG
caggaggactatgtgaggcc

SEQ ID NO: 104369 - DNA, 20 bp, Artificial Sequence
  Description of Artificial Sequence: Synthetic oligonucleotide
  Target: ATXN1; (+) strand; PAM type: NRG; PAM sequence: GAG
ctatgtgaggccaggaattc

SEQ ID NO: 104370 - DNA, 20 bp, Artificial Sequence
  Description of Artificial Sequence: Synthetic oligonucleotide
  Target: ATXN1; (+) strand; PAM type: NRG; PAM sequence: CAG
tgaggccaggaattcgagac

SEQ ID NO: 104371 - DNA, 20 bp, Artificial Sequence
  Description of Artificial Sequence: Synthetic oligonucleotide
  Target: ATXN1; (+) strand; PAM type: NRG; PAM sequence: TGG
ccaggaattcgagaccagcc

SEQ ID NO: 104372 - DNA, 20 bp, Artificial Sequence
  Description of Artificial Sequence: Synthetic oligonucleotide
  Target: ATXN1; (+) strand; PAM type: NRG; PAM sequence: GGG
caggaattcgagaccagcct

SEQ ID NO: 104373 - DNA, 20 bp, Artificial Sequence
  Description of Artificial Sequence: Synthetic oligonucleotide
  Target: ATXN1; (+) strand; PAM type: NRG; PAM sequence: AAG
cgagaccagcctgggtaaca

SEQ ID NO: 104374 - DNA, 20 bp, Artificial Sequence
  Description of Artificial Sequence: Synthetic oligonucleotide
  Target: ATXN1; (+) strand; PAM type: NRG; PAM sequence: GAG
accagcctgggtaacaaagt

SEQ ID NO: 104375 - DNA, 20 bp, Artificial Sequence
  Description of Artificial Sequence: Synthetic oligonucleotide
  Target: ATXN1; (+) strand; PAM type: NRG; PAM sequence: AGG
ccagcctgggtaacaaagtg

SEQ ID NO: 104376 - DNA, 20 bp, Artificial Sequence
  Description of Artificial Sequence: Synthetic oligonucleotide
  Target: ATXN1; (+) strand; PAM type: NRG; PAM sequence: TAG
tacaaaataataaaaaaatt

SEQ ID NO: 104377 - DNA, 20 bp, Artificial Sequence
  Description of Artificial Sequence: Synthetic oligonucleotide
  Target: ATXN1; (+) strand; PAM type: NRG; PAM sequence: AGG
acaaaataataaaaaaattt

SEQ ID NO: 104378 - DNA, 20 bp, Artificial Sequence
  Description of Artificial Sequence: Synthetic oligonucleotide
  Target: ATXN1; (+) strand; PAM type: NRG; PAM sequence: CAG
aaataataaaaaaatttagg

SEQ ID NO: 104379 - DNA, 20 bp, Artificial Sequence
  Description of Artificial Sequence: Synthetic oligonucleotide
  Target: ATXN1; (+) strand; PAM type: NRG; PAM sequence: AGG
aataataaaaaaatttaggc

SEQ ID NO: 104380 - DNA, 20 bp, Artificial Sequence
  Description of Artificial Sequence: Synthetic oligonucleotide
  Target: ATXN1; (+) strand; PAM type: NRG; PAM sequence: TGG
taaaaaaatttaggcaggtg

SEQ ID NO: 104381 - DNA, 20 bp, Artificial Sequence
  Description of Artificial Sequence: Synthetic oligonucleotide
  Target: ATXN1; (+) strand; PAM type: NRG; PAM sequence: TGG
aaaaatttaggcaggtgtgg

SEQ ID NO: 104382 - DNA, 20 bp, Artificial Sequence
  Description of Artificial Sequence: Synthetic oligonucleotide
  Target: ATXN1; (+) strand; PAM type: NRG; PAM sequence: CAG
ggtgtggtggtgcatgcttg

SEQ ID NO: 104383 - DNA, 20 bp, Artificial Sequence
  Description of Artificial Sequence: Synthetic oligonucleotide
  Target: ATXN1; (+) strand; PAM type: NRG; PAM sequence: CAG
gtggtgcatgcttgcagtcc

SEQ ID NO: 104384 - DNA, 20 bp, Artificial Sequence
  Description of Artificial Sequence: Synthetic oligonucleotide
  Target: ATXN1; (+) strand; PAM type: NRG; PAM sequence: TGG
tgcttgcagtcccagcaact

SEQ ID NO: 104385 - DNA, 20 bp, Artificial Sequence
  Description of Artificial Sequence: Synthetic oligonucleotide
  Target: ATXN1; (+) strand; PAM type: NRG; PAM sequence: GGG
gcttgcagtcccagcaactt

SEQ ID NO: 104386 - DNA, 20 bp, Artificial Sequence
  Description of Artificial Sequence: Synthetic oligonucleotide
  Target: ATXN1; (+) strand; PAM type: NRG; PAM sequence: GAG
ttgcagtcccagcaacttgg

SEQ ID NO: 104387 - DNA, 20 bp, Artificial Sequence
  Description of Artificial Sequence: Synthetic oligonucleotide
  Target: ATXN1; (+) strand; PAM type: NRG; PAM sequence: AGG
tgcagtcccagcaacttggg

SEQ ID NO: 104388 - DNA, 20 bp, Artificial Sequence
  Description of Artificial Sequence: Synthetic oligonucleotide
  Target: ATXN1; (+) strand; PAM type: NRG; PAM sequence: GAG
tcccagcaacttgggaggct

SEQ ID NO: 104389 - DNA, 20 bp, Artificial Sequence
  Description of Artificial Sequence: Synthetic oligonucleotide
  Target: ATXN1; (+) strand; PAM type: NRG; PAM sequence: AGG
cccagcaacttgggaggctg

SEQ ID NO: 104390 - DNA, 20 bp, Artificial Sequence
  Description of Artificial Sequence: Synthetic oligonucleotide
  Target: ATXN1; (+) strand; PAM type: NRG; PAM sequence: TGG
agcaacttgggaggctgagg

SEQ ID NO: 104391 - DNA, 20 bp, Artificial Sequence
  Description of Artificial Sequence: Synthetic oligonucleotide
  Target: ATXN1; (+) strand; PAM type: NRG; PAM sequence: GGG
gcaacttgggaggctgaggt

SEQ ID NO: 104392 - DNA, 20 bp, Artificial Sequence
  Description of Artificial Sequence: Synthetic oligonucleotide
  Target: ATXN1; (+) strand; PAM type: NRG; PAM sequence: GAG
aacttgggaggctgaggtgg

SEQ ID NO: 104393 - DNA, 20 bp, Artificial Sequence
  Description of Artificial Sequence: Synthetic oligonucleotide
  Target: ATXN1; (+) strand; PAM type: NRG; PAM sequence: AGG
acttgggaggctgaggtggg

SEQ ID NO: 104394 - DNA, 20 bp, Artificial Sequence
  Description of Artificial Sequence: Synthetic oligonucleotide
  Target: ATXN1; (+) strand; PAM type: NRG; PAM sequence: GAG
ctgaggtgggaggattgctt

SEQ ID NO: 104395 - DNA, 20 bp, Artificial Sequence
  Description of Artificial Sequence: Synthetic oligonucleotide
  Target: ATXN1; (+) strand; PAM type: NRG; PAM sequence: TAG
gtgggaggattgcttgagcc

SEQ ID NO: 104396 - DNA, 20 bp, Artificial Sequence
  Description of Artificial Sequence: Synthetic oligonucleotide
  Target: ATXN1; (+) strand; PAM type: NRG; PAM sequence: TGG
aggattgcttgagcctagcc

SEQ ID NO: 104397 - DNA, 20 bp, Artificial Sequence
  Description of Artificial Sequence: Synthetic oligonucleotide
  Target: ATXN1; (+) strand; PAM type: NRG; PAM sequence: GGG
ggattgcttgagcctagcct

SEQ ID NO: 104398 - DNA, 20 bp, Artificial Sequence
  Description of Artificial Sequence: Synthetic oligonucleotide
  Target: ATXN1; (+) strand; PAM type: NRG; PAM sequence: GAG
attgcttgagcctagcctgg

SEQ ID NO: 104399 - DNA, 20 bp, Artificial Sequence
  Description of Artificial Sequence: Synthetic oligonucleotide
  Target: ATXN1; (+) strand; PAM type: NRG; PAM sequence: AAG
gagcctagcctgggagatca

SEQ ID NO: 104400 - DNA, 20 bp, Artificial Sequence
  Description of Artificial Sequence: Synthetic oligonucleotide
  Target: ATXN1; (+) strand; PAM type: NRG; PAM sequence: GAG
tgggagatcaaagctgcatt

SEQ ID NO: 104401 - DNA, 20 bp, Artificial Sequence
  Description of Artificial Sequence: Synthetic oligonucleotide
  Target: ATXN1; (+) strand; PAM type: NRG; PAM sequence: GAG
gatcaaagctgcattgagct

SEQ ID NO: 104402 - DNA, 20 bp, Artificial Sequence
  Description of Artificial Sequence: Synthetic oligonucleotide
  Target: ATXN1; (+) strand; PAM type: NRG; PAM sequence: CGG
gctgcattgagctgagatcg

SEQ ID NO: 104403 - DNA, 20 bp, Artificial Sequence
  Description of Artificial Sequence: Synthetic oligonucleotide
  Target: ATXN1; (+) strand; PAM type: NRG; PAM sequence: TGG
cgcggcactgcactccaacc

SEQ ID NO: 104404 - DNA, 20 bp, Artificial Sequence
  Description of Artificial Sequence: Synthetic oligonucleotide
  Target: ATXN1; (+) strand; PAM type: NRG; PAM sequence: GGG
gcggcactgcactccaacct

SEQ ID NO: 104405 - DNA, 20 bp, Artificial Sequence
  Description of Artificial Sequence: Synthetic oligonucleotide
  Target: ATXN1; (+) strand; PAM type: NRG; PAM sequence: GAG
ggcactgcactccaacctgg

SEQ ID NO: 104406 - DNA, 20 bp, Artificial Sequence
  Description of Artificial Sequence: Synthetic oligonucleotide
  Target: ATXN1; (+) strand; PAM type: NRG; PAM sequence: CAG
ctgcactccaacctgggaga

SEQ ID NO: 104407 - DNA, 20 bp, Artificial Sequence
  Description of Artificial Sequence: Synthetic oligonucleotide
  Target: ATXN1; (+) strand; PAM type: NRG; PAM sequence: AAG
tccaacctgggagacagaac

SEQ ID NO: 104408 - DNA, 20 bp, Artificial Sequence
  Description of Artificial Sequence: Synthetic oligonucleotide
  Target: ATXN1; (+) strand; PAM type: NRG; PAM sequence: AAG
agaccctgtctcaaaaaata

SEQ ID NO: 104409 - DNA, 20 bp, Artificial Sequence
  Description of Artificial Sequence: Synthetic oligonucleotide
  Target: ATXN1; (+) strand; PAM type: NRG; PAM sequence: TGG
gtctcaaaaaataaagaaaa

SEQ ID NO: 104410 - DNA, 20 bp, Artificial Sequence
  Description of Artificial Sequence: Synthetic oligonucleotide
  Target: ATXN1; (+) strand; PAM type: NRG; PAM sequence: GAG
ctcaaaaaataaagaaaatg

SEQ ID NO: 104411 - DNA, 20 bp, Artificial Sequence
  Description of Artificial Sequence: Synthetic oligonucleotide
  Target: ATXN1; (+) strand; PAM type: NRG; PAM sequence: CAG
agataataacacgtacccta

SEQ ID NO: 104412 - DNA, 20 bp, Artificial Sequence
  Description of Artificial Sequence: Synthetic oligonucleotide
  Target: ATXN1; (+) strand; PAM type: NRG; PAM sequence: AGG
gataataacacgtaccctac

SEQ ID NO: 104413 - DNA, 20 bp, Artificial Sequence
  Description of Artificial Sequence: Synthetic oligonucleotide
  Target: ATXN1; (+) strand; PAM type: NRG; PAM sequence: GGG
ataataacacgtaccctaca

SEQ ID NO: 104414 - DNA, 20 bp, Artificial Sequence
  Description of Artificial Sequence: Synthetic oligonucleotide
  Target: ATXN1; (+) strand; PAM type: NRG; PAM sequence: TAG
taacacgtaccctacagggt

SEQ ID NO: 104415 - DNA, 20 bp, Artificial Sequence
  Description of Artificial Sequence: Synthetic oligonucleotide
  Target: ATXN1; (+) strand; PAM type: NRG; PAM sequence: AGG
aacacgtaccctacagggtt

SEQ ID NO: 104416 - DNA, 20 bp, Artificial Sequence
  Description of Artificial Sequence: Synthetic oligonucleotide
  Target: ATXN1; (+) strand; PAM type: NRG; PAM sequence: GGG
acacgtaccctacagggtta

SEQ ID NO: 104417 - DNA, 20 bp, Artificial Sequence
  Description of Artificial Sequence: Synthetic oligonucleotide
  Target: ATXN1; (+) strand; PAM type: NRG; PAM sequence: GAG
ggttagggtgatgactaaat

SEQ ID NO: 104418 - DNA, 20 bp, Artificial Sequence
  Description of Artificial Sequence: Synthetic oligonucleotide
  Target: ATXN1; (+) strand; PAM type: NRG; PAM sequence: GAG
gagatgcattcaacaaatgt

SEQ ID NO: 104419 - DNA, 20 bp, Artificial Sequence
  Description of Artificial Sequence: Synthetic oligonucleotide
  Target: ATXN1; (+) strand; PAM type: NRG; PAM sequence: AGG
agatgcattcaacaaatgtg

SEQ ID NO: 104420 - DNA, 20 bp, Artificial Sequence
  Description of Artificial Sequence: Synthetic oligonucleotide
  Target: ATXN1; (+) strand; PAM type: NRG; PAM sequence: TAG
tgcattcaacaaatgtgagg

SEQ ID NO: 104421 - DNA, 20 bp, Artificial Sequence
  Description of Artificial Sequence: Synthetic oligonucleotide
  Target: ATXN1; (+) strand; PAM type: NRG; PAM sequence: CAG
tagaaaaaacttctcttatt

SEQ ID NO: 104422 - DNA, 20 bp, Artificial Sequence
  Description of Artificial Sequence: Synthetic oligonucleotide
  Target: ATXN1; (+) strand; PAM type: NRG; PAM sequence: CAG
aaaaaacttctcttattcag

SEQ ID NO: 104423 - DNA, 20 bp, Artificial Sequence
  Description of Artificial Sequence: Synthetic oligonucleotide
  Target: ATXN1; (+) strand; PAM type: NRG; PAM sequence: AGG
aaaaacttctcttattcagc

SEQ ID NO: 104424 - DNA, 20 bp, Artificial Sequence
  Description of Artificial Sequence: Synthetic oligonucleotide
  Target: ATXN1; (+) strand; PAM type: NRG; PAM sequence: GAG
tctttttcttttataattat

SEQ ID NO: 104425 - DNA, 20 bp, Artificial Sequence
  Description of Artificial Sequence: Synthetic oligonucleotide
  Target: ATXN1; (+) strand; PAM type: NRG; PAM sequence: AAG
tttataattatgagaacatg

SEQ ID NO: 104426 - DNA, 20 bp, Artificial Sequence
  Description of Artificial Sequence: Synthetic oligonucleotide
  Target: ATXN1; (+) strand; PAM type: NRG; PAM sequence: AGG
ttataattatgagaacatga

SEQ ID NO: 104427 - DNA, 20 bp, Artificial Sequence
  Description of Artificial Sequence: Synthetic oligonucleotide
  Target: ATXN1; (+) strand; PAM type: NRG; PAM sequence: TGG
ttatgagaacatgaaggaaa

SEQ ID NO: 104428 - DNA, 20 bp, Artificial Sequence
  Description of Artificial Sequence: Synthetic oligonucleotide
  Target: ATXN1; (+) strand; PAM type: NRG; PAM sequence: GGG
tatgagaacatgaaggaaat

SEQ ID NO: 104429 - DNA, 20 bp, Artificial Sequence
  Description of Artificial Sequence: Synthetic oligonucleotide
  Target: ATXN1; (+) strand; PAM type: NRG; PAM sequence: CAG
gagaacatgaaggaaatggg

SEQ ID NO: 104430 - DNA, 20 bp, Artificial Sequence
  Description of Artificial Sequence: Synthetic oligonucleotide
  Target: ATXN1; (+) strand; PAM type: NRG; PAM sequence: GAG
gaacatgaaggaaatgggca

SEQ ID NO: 104431 - DNA, 20 bp, Artificial Sequence
  Description of Artificial Sequence: Synthetic oligonucleotide
  Target: ATXN1; (+) strand; PAM type: NRG; PAM sequence: AGG
aacatgaaggaaatgggcag

SEQ ID NO: 104432 - DNA, 20 bp, Artificial Sequence
  Description of Artificial Sequence: Synthetic oligonucleotide
  Target: ATXN1; (+) strand; PAM type: NRG; PAM sequence: CAG
aggaaatgggcagaggattc

SEQ ID NO: 104433 - DNA, 20 bp, Artificial Sequence
  Description of Artificial Sequence: Synthetic oligonucleotide
  Target: ATXN1; (+) strand; PAM type: NRG; PAM sequence: CAG
aaatgggcagaggattccag

SEQ ID NO: 104434 - DNA, 20 bp, Artificial Sequence
  Description of Artificial Sequence: Synthetic oligonucleotide
  Target: ATXN1; (+) strand; PAM type: NRG; PAM sequence: AAG
gattccagcagaattctgcc

SEQ ID NO: 104435 - DNA, 20 bp, Artificial Sequence
  Description of Artificial Sequence: Synthetic oligonucleotide
  Target: ATXN1; (+) strand; PAM type: NRG; PAM sequence: CAG
cagaattctgccaagatttt

SEQ ID NO: 104436 - DNA, 20 bp, Artificial Sequence
  Description of Artificial Sequence: Synthetic oligonucleotide
  Target: ATXN1; (+) strand; PAM type: NRG; PAM sequence: TGG
attttcagtcttttcctgat

SEQ ID NO: 104437 - DNA, 20 bp, Artificial Sequence
  Description of Artificial Sequence: Synthetic oligonucleotide
  Target: ATXN1; (+) strand; PAM type: NRG; PAM sequence: CAG
ttcagtcttttcctgattgg

SEQ ID NO: 104438 - DNA, 20 bp, Artificial Sequence
  Description of Artificial Sequence: Synthetic oligonucleotide
  Target: ATXN1; (+) strand; PAM type: NRG; PAM sequence: CAG
agtcttttcctgattggcag

SEQ ID NO: 104439 - DNA, 20 bp, Artificial Sequence
  Description of Artificial Sequence: Synthetic oligonucleotide
  Target: ATXN1; (+) strand; PAM type: NRG; PAM sequence: GAG
tcttttcctgattggcagca

SEQ ID NO: 104440 - DNA, 20 bp, Artificial Sequence
  Description of Artificial Sequence: Synthetic oligonucleotide
  Target: ATXN1; (+) strand; PAM type: NRG; PAM sequence: GAG
agcatttccattttcatttt

SEQ ID NO: 104441 - DNA, 20 bp, Artificial Sequence
  Description of Artificial Sequence: Synthetic oligonucleotide
  Target: ATXN1; (+) strand; PAM type: NRG; PAM sequence: TGG
attttcattttgagttttgc

SEQ ID NO: 104442 - DNA, 20 bp, Artificial Sequence
  Description of Artificial Sequence: Synthetic oligonucleotide
  Target: ATXN1; (+) strand; PAM type: NRG; PAM sequence: AAG
tttgctggtattcttctact

SEQ ID NO: 104443 - DNA, 20 bp, Artificial Sequence
  Description of Artificial Sequence: Synthetic oligonucleotide
  Target: ATXN1; (+) strand; PAM type: NRG; PAM sequence: CAG
taagaaaccaatttttcccc

SEQ ID NO: 104444 - DNA, 20 bp, Artificial Sequence
  Description of Artificial Sequence: Synthetic oligonucleotide
  Target: ATXN1; (+) strand; PAM type: NRG; PAM sequence: CAG
agtgaatgtttttttaattt

SEQ ID NO: 104445 - DNA, 20 bp, Artificial Sequence
  Description of Artificial Sequence: Synthetic oligonucleotide
  Target: ATXN1; (+) strand; PAM type: NRG; PAM sequence: AGG
gtgaatgtttttttaatttc

SEQ ID NO: 104446 - DNA, 20 bp, Artificial Sequence
  Description of Artificial Sequence: Synthetic oligonucleotide
  Target: ATXN1; (+) strand; PAM type: NRG; PAM sequence: GGG
tgaatgtttttttaatttca

SEQ ID NO: 104447 - DNA, 20 bp, Artificial Sequence
  Description of Artificial Sequence: Synthetic oligonucleotide
  Target: ATXN1; (+) strand; PAM type: NRG; PAM sequence: AAG
tttttttttttttttgaaac

SEQ ID NO: 104448 - DNA, 20 bp, Artificial Sequence
  Description of Artificial Sequence: Synthetic oligonucleotide
  Target: ATXN1; (+) strand; PAM type: NRG; PAM sequence: AGG
ttttttttttttttgaaaca

SEQ ID NO: 104449 - DNA, 20 bp, Artificial Sequence
  Description of Artificial Sequence: Synthetic oligonucleotide
  Target: ATXN1; (+) strand; PAM type: NRG; PAM sequence: CAG
caaggtctcactctgtcata

SEQ ID NO: 104450 - DNA, 20 bp, Artificial Sequence
  Description of Artificial Sequence: Synthetic oligonucleotide
  Target: ATXN1; (+) strand; PAM type: NRG; PAM sequence: AGG
aaggtctcactctgtcatac

SEQ ID NO: 104451 - DNA, 20 bp, Artificial Sequence
  Description of Artificial Sequence: Synthetic oligonucleotide
  Target: ATXN1; (+) strand; PAM type: NRG; PAM sequence: TGG
tctcactctgtcatacaggc

SEQ ID NO: 104452 - DNA, 20 bp, Artificial Sequence
  Description of Artificial Sequence: Synthetic oligonucleotide
  Target: ATXN1; (+) strand; PAM type: NRG; PAM sequence: GAG
tcactctgtcatacaggctg

SEQ ID NO: 104453 - DNA, 20 bp, Artificial Sequence
  Description of Artificial Sequence: Synthetic oligonucleotide
  Target: ATXN1; (+) strand; PAM type: NRG; PAM sequence: CAG
ctgtcatacaggctggagtg

SEQ ID NO: 104454 - DNA, 20 bp, Artificial Sequence
  Description of Artificial Sequence: Synthetic oligonucleotide
  Target: ATXN1; (+) strand; PAM type: NRG; PAM sequence: TGG
tcatacaggctggagtgcag

SEQ ID NO: 104455 - DNA, 20 bp, Artificial Sequence
  Description of Artificial Sequence: Synthetic oligonucleotide
  Target: ATXN1; (+) strand; PAM type: NRG; PAM sequence: TGG
ggagtgcagtggcccaatct

SEQ ID NO: 104456 - DNA, 20 bp, Artificial Sequence
  Description of Artificial Sequence: Synthetic oligonucleotide
  Target: ATXN1; (+) strand; PAM type: NRG; PAM sequence: TAG
ggcccaatcttggctcactg

SEQ ID NO: 104457 - DNA, 20 bp, Artificial Sequence
  Description of Artificial Sequence: Synthetic oligonucleotide
  Target: ATXN1; (+) strand; PAM type: NRG; PAM sequence: CAG
tcactgtagcttcgacctcc

SEQ ID NO: 104458 - DNA, 20 bp, Artificial Sequence
  Description of Artificial Sequence: Synthetic oligonucleotide
  Target: ATXN1; (+) strand; PAM type: NRG; PAM sequence: AGG
cactgtagcttcgacctccc

SEQ ID NO: 104459 - DNA, 20 bp, Artificial Sequence
  Description of Artificial Sequence: Synthetic oligonucleotide
  Target: ATXN1; (+) strand; PAM type: NRG; PAM sequence: AAG
agcttcgacctcccaggctc

SEQ ID NO: 104460 - DNA, 20 bp, Artificial Sequence
  Description of Artificial Sequence: Synthetic oligonucleotide
  Target: ATXN1; (+) strand; PAM type: NRG; PAM sequence: GAG
tccacccacctctgcctctt

SEQ ID NO: 104461 - DNA, 20 bp, Artificial Sequence
  Description of Artificial Sequence: Synthetic oligonucleotide
  Target: ATXN1; (+) strand; PAM type: NRG; PAM sequence: TGG
acctctgcctcttgagttgc

SEQ ID NO: 104462 - DNA, 20 bp, Artificial Sequence
  Description of Artificial Sequence: Synthetic oligonucleotide
  Target: ATXN1; (+) strand; PAM type: NRG; PAM sequence: GGG
cctctgcctcttgagttgct

SEQ ID NO: 104463 - DNA, 20 bp, Artificial Sequence
  Description of Artificial Sequence: Synthetic oligonucleotide
  Target: ATXN1; (+) strand; PAM type: NRG; PAM sequence: CAG
ctcttgagttgctgggacta

SEQ ID NO: 104464 - DNA, 20 bp, Artificial Sequence
  Description of Artificial Sequence: Synthetic oligonucleotide
  Target: ATXN1; (+) strand; PAM type: NRG; PAM sequence: AGG
tcttgagttgctgggactac

SEQ ID NO: 104465 - DNA, 20 bp, Artificial Sequence
  Description of Artificial Sequence: Synthetic oligonucleotide
  Target: ATXN1; (+) strand; PAM type: NRG; PAM sequence: CAG
caggcgcatgccaccacgcc

SEQ ID NO: 104466 - DNA, 20 bp, Artificial Sequence
  Description of Artificial Sequence: Synthetic oligonucleotide
  Target: ATXN1; (+) strand; PAM type: NRG; PAM sequence: TAG
ccacgcccagctaatttttg

SEQ ID NO: 104467 - DNA, 20 bp, Artificial Sequence
  Description of Artificial Sequence: Synthetic oligonucleotide
  Target: ATXN1; (+) strand; PAM type: NRG; PAM sequence: TAG
gctaatttttgtagtttttg

SEQ ID NO: 104468 - DNA, 20 bp, Artificial Sequence
  Description of Artificial Sequence: Synthetic oligonucleotide
  Target: ATXN1; (+) strand; PAM type: NRG; PAM sequence: GAG
taatttttgtagtttttgta

SEQ ID NO: 104469 - DNA, 20 bp, Artificial Sequence
  Description of Artificial Sequence: Synthetic oligonucleotide
  Target: ATXN1; (+) strand; PAM type: NRG; PAM sequence: CGG
ttttgtagtttttgtagaga

SEQ ID NO: 104470 - DNA, 20 bp, Artificial Sequence
  Description of Artificial Sequence: Synthetic oligonucleotide
  Target: ATXN1; (+) strand; PAM type: NRG; PAM sequence: GGG
tttgtagtttttgtagagac

SEQ ID NO: 104471 - DNA, 20 bp, Artificial Sequence
  Description of Artificial Sequence: Synthetic oligonucleotide
  Target: ATXN1; (+) strand; PAM type: NRG; PAM sequence: GGG
ttgtagtttttgtagagacg

SEQ ID NO: 104472 - DNA, 20 bp, Artificial Sequence
  Description of Artificial Sequence: Synthetic oligonucleotide
  Target: ATXN1; (+) strand; PAM type: NRG; PAM sequence: CAG
cggggtttcaccatgttgtc

SEQ ID NO: 104473 - DNA, 20 bp, Artificial Sequence
  Description of Artificial Sequence: Synthetic oligonucleotide
  Target: ATXN1; (+) strand; PAM type: NRG; PAM sequence: AGG
ggggtttcaccatgttgtcc

SEQ ID NO: 104474 - DNA, 20 bp, Artificial Sequence
  Description of Artificial Sequence: Synthetic oligonucleotide
  Target: ATXN1; (+) strand; PAM type: NRG; PAM sequence: TGG
ccaggcttgtcttgaactct

SEQ ID NO: 104475 - DNA, 20 bp, Artificial Sequence
  Description of Artificial Sequence: Synthetic oligonucleotide
  Target: ATXN1; (+) strand; PAM type: NRG; PAM sequence: GGG
caggcttgtcttgaactctt

SEQ ID NO: 104476 - DNA, 20 bp, Artificial Sequence
  Description of Artificial Sequence: Synthetic oligonucleotide
  Target: ATXN1; (+) strand; PAM type: NRG; PAM sequence: AAG
tgtcttgaactcttgggctc

SEQ ID NO: 104477 - DNA, 20 bp, Artificial Sequence
  Description of Artificial Sequence: Synthetic oligonucleotide
  Target: ATXN1; (+) strand; PAM type: NRG; PAM sequence: GAG
tcttgaactcttgggctcaa

SEQ ID NO: 104478 - DNA, 20 bp, Artificial Sequence
  Description of Artificial Sequence: Synthetic oligonucleotide
  Target: ATXN1; (+) strand; PAM type: NRG; PAM sequence: CAG
ctcaagagatctgcctgtct

SEQ ID NO: 104479 - DNA, 20 bp, Artificial Sequence
  Description of Artificial Sequence: Synthetic oligonucleotide
  Target: ATXN1; (+) strand; PAM type: NRG; PAM sequence: AAG
ctgcctgtctcagcctccca

SEQ ID NO: 104480 - DNA, 20 bp, Artificial Sequence
  Description of Artificial Sequence: Synthetic oligonucleotide
  Target: ATXN1; (+) strand; PAM type: NRG; PAM sequence: TGG
gtctcagcctcccaaagtgt

SEQ ID NO: 104481 - DNA, 20 bp, Artificial Sequence
  Description of Artificial Sequence: Synthetic oligonucleotide
  Target: ATXN1; (+) strand; PAM type: NRG; PAM sequence: GGG
tctcagcctcccaaagtgtt

SEQ ID NO: 104482 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgttgggataa

SEQ ID NO: 104483 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgttgggataac

SEQ ID NO: 104484 - DNA, 20 bp, Artificial Sequence
  Description of Artificial Sequence: Synthetic oligonucleotide
  Target: ATXN1; (+) strand; PAM type: NRG; PAM sequence: GAG
agtgttgggataacaggcat

SEQ ID NO: 104485 - DNA, 20 bp, Artificial Sequence
  Description of Artificial Sequence: Synthetic oligonucleotide
  Target: ATXN1; (+) strand; PAM type: NRG; PAM sequence: CAG
caggcatgagctaccacacc

SEQ ID NO: 104486 - DNA, 20 bp, Artificial Sequence
  Description of Artificial Sequence: Synthetic oligonucleotide
  Target: ATXN1; (+) strand; PAM type: NRG; PAM sequence: GAG
accacacccagcccattctt

SEQ ID NO: 104487 - DNA, 20 bp, Artificial Sequence
  Description of Artificial Sequence: Synthetic oligonucleotide
  Target: ATXN1; (+) strand; PAM type: NRG; PAM sequence: TGG
cagcccattcttgagtatgc

SEQ ID NO: 104488 - DNA, 20 bp, Artificial Sequence
  Description of Artificial Sequence: Synthetic oligonucleotide
  Target: ATXN1; (+) strand; PAM type: NRG; PAM sequence: CAG
tccttgtaatgtaattccaa

SEQ ID NO: 104489 - DNA, 20 bp, Artificial Sequence
  Description of Artificial Sequence: Synthetic oligonucleotide
  Target: ATXN1; (+) strand; PAM type: NRG; PAM sequence: AAG
ttgtaatgtaattccaacag

SEQ ID NO: 104490 - DNA, 20 bp, Artificial Sequence
  Description of Artificial Sequence: Synthetic oligonucleotide
  Target: ATXN1; (+) strand; PAM type: NRG; PAM sequence: AGG
tgtaatgtaattccaacaga

SEQ ID NO: 104491 - DNA, 20 bp, Artificial Sequence
  Description of Artificial Sequence: Synthetic oligonucleotide
  Target: ATXN1; (+) strand; PAM type: NRG; PAM sequence: GGG
gtaatgtaattccaacagaa

SEQ ID NO: 104492 - DNA, 20 bp, Artificial Sequence
  Description of Artificial Sequence: Synthetic oligonucleotide
  Target: ATXN1; (+) strand; PAM type: NRG; PAM sequence: CAG
aattccaacagaagggaaac

SEQ ID NO: 104493 - DNA, 20 bp, Artificial Sequence
  Description of Artificial Sequence: Synthetic oligonucleotide
  Target: ATXN1; (+) strand; PAM type: NRG; PAM sequence: AGG
attccaacagaagggaaacc

SEQ ID NO: 104494 - DNA, 20 bp, Artificial Sequence
  Description of Artificial Sequence: Synthetic oligonucleotide
  Target: ATXN1; (+) strand; PAM type: NRG; PAM sequence: CAG
agggaaaccaggcctccttt

SEQ ID NO: 104495 - DNA, 20 bp, Artificial Sequence
  Description of Artificial Sequence: Synthetic oligonucleotide
  Target: ATXN1; (+) strand; PAM type: NRG; PAM sequence: CAG
caggcctcctttcagtatcg

SEQ ID NO: 104496 - DNA, 20 bp, Artificial Sequence
  Description of Artificial Sequence: Synthetic oligonucleotide
  Target: ATXN1; (+) strand; PAM type: NRG; PAM sequence: GAG
tcctttcagtatcgcagctt

SEQ ID NO: 104497 - DNA, 20 bp, Artificial Sequence
  Description of Artificial Sequence: Synthetic oligonucleotide
  Target: ATXN1; (+) strand; PAM type: NRG; PAM sequence: CAG
gtatcgcagcttgagcctgt

SEQ ID NO: 104498 - DNA, 20 bp, Artificial Sequence
  Description of Artificial Sequence: Synthetic oligonucleotide
  Target: ATXN1; (+) strand; PAM type: NRG; PAM sequence: CAG
ctgtcagcatcccctgattt

SEQ ID NO: 104499 - DNA, 20 bp, Artificial Sequence
  Description of Artificial Sequence: Synthetic oligonucleotide
  Target: ATXN1; (+) strand; PAM type: NRG; PAM sequence: TAG
catcccctgatttcagaacg

SEQ ID NO: 104500 - DNA, 20 bp, Artificial Sequence
  Description of Artificial Sequence: Synthetic oligonucleotide
  Target: ATXN1; (+) strand; PAM type: NRG; PAM sequence: AGG
atcccctgatttcagaacgt

SEQ ID NO: 104501 - DNA, 20 bp, Artificial Sequence
  Description of Artificial Sequence: Synthetic oligonucleotide
  Target: ATXN1; (+) strand; PAM type: NRG; PAM sequence: CAG
ttcagaacgtaggctacaaa

SEQ ID NO: 104502 - DNA, 20 bp, Artificial Sequence
  Description of Artificial Sequence: Synthetic oligonucleotide
  Target: ATXN1; (+) strand; PAM type: NRG; PAM sequence: CAG
acgtaggctacaaacagtcc

SEQ ID NO: 104503 - DNA, 20 bp, Artificial Sequence
  Description of Artificial Sequence: Synthetic oligonucleotide
  Target: ATXN1; (+) strand; PAM type: NRG; PAM sequence: CGG
cagtcccagatgtgtgctga

SEQ ID NO: 104504 - DNA, 20 bp, Artificial Sequence
  Description of Artificial Sequence: Synthetic oligonucleotide
  Target: ATXN1; (+) strand; PAM type: NRG; PAM sequence: TGG
tgctgacggtactacattcc

SEQ ID NO: 104505 - DNA, 20 bp, Artificial Sequence
  Description of Artificial Sequence: Synthetic oligonucleotide
  Target: ATXN1; (+) strand; PAM type: NRG; PAM sequence: CAG
actacattcctggtctttca

SEQ ID NO: 104506 - DNA, 20 bp, Artificial Sequence
  Description of Artificial Sequence: Synthetic oligonucleotide
  Target: ATXN1; (+) strand; PAM type: NRG; PAM sequence: TGG
gtctttcacagcatttactt

SEQ ID NO: 104507 - DNA, 20 bp, Artificial Sequence
  Description of Artificial Sequence: Synthetic oligonucleotide
  Target: ATXN1; (+) strand; PAM type: NRG; PAM sequence: TGG
tcacagcatttactttggat

SEQ ID NO: 104508 - DNA, 20 bp, Artificial Sequence
  Description of Artificial Sequence: Synthetic oligonucleotide
  Target: ATXN1; (+) strand; PAM type: NRG; PAM sequence: GGG
cacagcatttactttggatt

SEQ ID NO: 104509 - DNA, 20 bp, Artificial Sequence
  Description of Artificial Sequence: Synthetic oligonucleotide
  Target: ATXN1; (+) strand; PAM type: NRG; PAM sequence: TGG
atttactttggattgggaaa

SEQ ID NO: 104510 - DNA, 20 bp, Artificial Sequence
  Description of Artificial Sequence: Synthetic oligonucleotide
  Target: ATXN1; (+) strand; PAM type: NRG; PAM sequence: GGG
tttactttggattgggaaat

SEQ ID NO: 104511 - DNA, 20 bp, Artificial Sequence
  Description of Artificial Sequence: Synthetic oligonucleotide
  Target: ATXN1; (+) strand; PAM type: NRG; PAM sequence: AAG
actttggattgggaaatggg

SEQ ID NO: 104512 - DNA, 20 bp, Artificial Sequence
  Description of Artificial Sequence: Synthetic oligonucleotide
  Target: ATXN1; (+) strand; PAM type: NRG; PAM sequence: GAG
tggattgggaaatgggaagt

SEQ ID NO: 104513 - DNA, 20 bp, Artificial Sequence
  Description of Artificial Sequence: Synthetic oligonucleotide
  Target: ATXN1; (+) strand; PAM type: NRG; PAM sequence: AGG
ggattgggaaatgggaagtg

SEQ ID NO: 104514 - DNA, 20 bp, Artificial Sequence
  Description of Artificial Sequence: Synthetic oligonucleotide
  Target: ATXN1; (+) strand; PAM type: NRG; PAM sequence: CAG
gggaagtgaggtctctcttt

SEQ ID NO: 104515 - DNA, 20 bp, Artificial Sequence
  Description of Artificial Sequence: Synthetic oligonucleotide
  Target: ATXN1; (+) strand; PAM type: NRG; PAM sequence: GAG
tgaggtctctctttcagtat

SEQ ID NO: 104516 - DNA, 20 bp, Artificial Sequence
  Description of Artificial Sequence: Synthetic oligonucleotide
  Target: ATXN1; (+) strand; PAM type: NRG; PAM sequence: TAG
ttcagtatgagattatttct

SEQ ID NO: 104517 - DNA, 20 bp, Artificial Sequence
  Description of Artificial Sequence: Synthetic oligonucleotide
  Target: ATXN1; (+) strand; PAM type: NRG; PAM sequence: CAG
tatgagattatttcttagaa

SEQ ID NO: 104518 - DNA, 20 bp, Artificial Sequence
  Description of Artificial Sequence: Synthetic oligonucleotide
  Target: ATXN1; (+) strand; PAM type: NRG; PAM sequence: AGG
atgagattatttcttagaac

SEQ ID NO: 104519 - DNA, 20 bp, Artificial Sequence
  Description of Artificial Sequence: Synthetic oligonucleotide
  Target: ATXN1; (+) strand; PAM type: NRG; PAM sequence: TAG
gattatttcttagaacaggt

SEQ ID NO: 104520 - DNA, 20 bp, Artificial Sequence
  Description of Artificial Sequence: Synthetic oligonucleotide
  Target: ATXN1; (+) strand; PAM type: NRG; PAM sequence: TGG
tttcttagaacaggttagtt

SEQ ID NO: 104521 - DNA, 20 bp, Artificial Sequence
  Description of Artificial Sequence: Synthetic oligonucleotide
  Target: ATXN1; (+) strand; PAM type: NRG; PAM sequence: AAG
gcctttgctaaaatataaat

SEQ ID NO: 104522 - DNA, 20 bp, Artificial Sequence
  Description of Artificial Sequence: Synthetic oligonucleotide
  Target: ATXN1; (+) strand; PAM type: NRG; PAM sequence: CAG
tttgctaaaatataaataag

SEQ ID NO: 104523 - DNA, 20 bp, Artificial Sequence
  Description of Artificial Sequence: Synthetic oligonucleotide
  Target: ATXN1; (+) strand; PAM type: NRG; PAM sequence: GAG
tgctaaaatataaataagca

SEQ ID NO: 104524 - DNA, 20 bp, Artificial Sequence
  Description of Artificial Sequence: Synthetic oligonucleotide
  Target: ATXN1; (+) strand; PAM type: NRG; PAM sequence: AGG
gctaaaatataaataagcag

SEQ ID NO: 104525 - DNA, 20 bp, Artificial Sequence
  Description of Artificial Sequence: Synthetic oligonucleotide
  Target: ATXN1; (+) strand; PAM type: NRG; PAM sequence: CAG
aaataagcagaggcttccat

SEQ ID NO: 104526 - DNA, 20 bp, Artificial Sequence
  Description of Artificial Sequence: Synthetic oligonucleotide
  Target: ATXN1; (+) strand; PAM type: NRG; PAM sequence: GAG
cttccatcagaaaaacatct

SEQ ID NO: 104527 - DNA, 20 bp, Artificial Sequence
  Description of Artificial Sequence: Synthetic oligonucleotide
  Target: ATXN1; (+) strand; PAM type: NRG; PAM sequence: AAG
cagaaaaacatctgagtgtt

SEQ ID NO: 104528 - DNA, 20 bp, Artificial Sequence
  Description of Artificial Sequence: Synthetic oligonucleotide
  Target: ATXN1; (+) strand; PAM type: NRG; PAM sequence: TAG
aaaaacatctgagtgttaag

SEQ ID NO: 104529 - DNA, 20 bp, Artificial Sequence
  Description of Artificial Sequence: Synthetic oligonucleotide
  Target: ATXN1; (+) strand; PAM type: NRG; PAM sequence: GAG
aaatgcatcccttcaacatt

SEQ ID NO: 104530 - DNA, 20 bp, Artificial Sequence
  Description of Artificial Sequence: Synthetic oligonucleotide
  Target: ATXN1; (+) strand; PAM type: NRG; PAM sequence: CAG
atgcactcttattttttcat

SEQ ID NO: 104531 - DNA, 20 bp, Artificial Sequence
  Description of Artificial Sequence: Synthetic oligonucleotide
  Target: ATXN1; (+) strand; PAM type: NRG; PAM sequence: AGG
tgcactcttattttttcatc

SEQ ID NO: 104532 - DNA, 20 bp, Artificial Sequence
  Description of Artificial Sequence: Synthetic oligonucleotide
  Target: ATXN1; (+) strand; PAM type: NRG; PAM sequence: CAG
tttttcatcaggacacgttc

SEQ ID NO: 104533 - DNA, 20 bp, Artificial Sequence
  Description of Artificial Sequence: Synthetic oligonucleotide
  Target: ATXN1; (+) strand; PAM type: NRG; PAM sequence: TGG
caggacacgttccagaaact

SEQ ID NO: 104534 - DNA, 20 bp, Artificial Sequence
  Description of Artificial Sequence: Synthetic oligonucleotide
  Target: ATXN1; (+) strand; PAM type: NRG; PAM sequence: TAG
ttggatctttttccctgcta

SEQ ID NO: 104535 - DNA, 20 bp, Artificial Sequence
  Description of Artificial Sequence: Synthetic oligonucleotide
  Target: ATXN1; (+) strand; PAM type: NRG; PAM sequence: TAG
ctatagtttcgcgaataata

SEQ ID NO: 104536 - DNA, 20 bp, Artificial Sequence
  Description of Artificial Sequence: Synthetic oligonucleotide
  Target: ATXN1; (+) strand; PAM type: NRG; PAM sequence: TGG
agtttgcttctattttgctc

SEQ ID NO: 104537 - DNA, 20 bp, Artificial Sequence
  Description of Artificial Sequence: Synthetic oligonucleotide
  Target: ATXN1; (+) strand; PAM type: NRG; PAM sequence: AAG
tattttgctctggttaaccc

SEQ ID NO: 104538 - DNA, 20 bp, Artificial Sequence
  Description of Artificial Sequence: Synthetic oligonucleotide
  Target: ATXN1; (+) strand; PAM type: NRG; PAM sequence: AGG
attttgctctggttaaccca

SEQ ID NO: 104539 - DNA, 20 bp, Artificial Sequence
  Description of Artificial Sequence: Synthetic oligonucleotide
  Target: ATXN1; (+) strand; PAM type: NRG; PAM sequence: GGG
ttttgctctggttaacccaa

SEQ ID NO: 104540 - DNA, 20 bp, Artificial Sequence
  Description of Artificial Sequence: Synthetic oligonucleotide
  Target: ATXN1; (+) strand; PAM type: NRG; PAM sequence: TGG
gctctggttaacccaaggga

SEQ ID NO: 104541 - DNA, 20 bp, Artificial Sequence
  Description of Artificial Sequence: Synthetic oligonucleotide
  Target: ATXN1; (+) strand; PAM type: NRG; PAM sequence: TGG
ctggttaacccaagggatgg

SEQ ID NO: 104542 - DNA, 20 bp, Artificial Sequence
  Description of Artificial Sequence: Synthetic oligonucleotide
  Target: ATXN1; (+) strand; PAM type: NRG; PAM sequence: GGG
tggttaacccaagggatggt

SEQ ID NO: 104543 - DNA, 20 bp, Artificial Sequence
  Description of Artificial Sequence: Synthetic oligonucleotide
  Target: ATXN1; (+) strand; PAM type: NRG; PAM sequence: TGG
ttaacccaagggatggtggg

SEQ ID NO: 104544 - DNA, 20 bp, Artificial Sequence
  Description of Artificial Sequence: Synthetic oligonucleotide
  Target: ATXN1; (+) strand; PAM type: NRG; PAM sequence: GGG
taacccaagggatggtgggt

SEQ ID NO: 104545 - DNA, 20 bp, Artificial Sequence
  Description of Artificial Sequence: Synthetic oligonucleotide
  Target: ATXN1; (+) strand; PAM type: NRG; PAM sequence: AAG
atggtgggtgggatgatgaa

SEQ ID NO: 104546 - DNA, 20 bp, Artificial Sequence
  Description of Artificial Sequence: Synthetic oligonucleotide
  Target: ATXN1; (+) strand; PAM type: NRG; PAM sequence: CAG
gtgggtgggatgatgaaaag

SEQ ID NO: 104547 - DNA, 20 bp, Artificial Sequence
  Description of Artificial Sequence: Synthetic oligonucleotide
  Target: ATXN1; (+) strand; PAM type: NRG; PAM sequence: AAG
ggatgatgaaaagcagcaat

SEQ ID NO: 104548 - DNA, 20 bp, Artificial Sequence
  Description of Artificial Sequence: Synthetic oligonucleotide
  Target: ATXN1; (+) strand; PAM type: NRG; PAM sequence: AGG
gatgatgaaaagcagcaata

SEQ ID NO: 104549 - DNA, 20 bp, Artificial Sequence
  Description of Artificial Sequence: Synthetic oligonucleotide
  Target: ATXN1; (+) strand; PAM type: NRG; PAM sequence: CAG
gatgaaaagcagcaataagg

SEQ ID NO: 104550 - DNA, 20 bp, Artificial Sequence
  Description of Artificial Sequence: Synthetic oligonucleotide
  Target: ATXN1; (+) strand; PAM type: NRG; PAM sequence: GAG
gcagcaataaggcagtgact

SEQ ID NO: 104551 - DNA, 20 bp, Artificial Sequence
  Description of Artificial Sequence: Synthetic oligonucleotide
  Target: ATXN1; (+) strand; PAM type: NRG; PAM sequence: TAG
aatctataacgtttccaacg

SEQ ID NO: 104552 - DNA, 20 bp, Artificial Sequence
  Description of Artificial Sequence: Synthetic oligonucleotide
  Target: ATXN1; (+) strand; PAM type: NRG; PAM sequence: AAG
ctataacgtttccaacgtag

SEQ ID NO: 104553 - DNA, 20 bp, Artificial Sequence
  Description of Artificial Sequence: Synthetic oligonucleotide
  Target: ATXN1; (+) strand; PAM type: NRG; PAM sequence: TGG
gaacccataataaacatatt

SEQ ID NO: 104554 - DNA, 20 bp, Artificial Sequence
  Description of Artificial Sequence: Synthetic oligonucleotide
  Target: ATXN1; (+) strand; PAM type: NRG; PAM sequence: GGG
aacccataataaacatattt

SEQ ID NO: 104555 - DNA, 20 bp, Artificial Sequence
  Description of Artificial Sequence: Synthetic oligonucleotide
  Target: ATXN1; (+) strand; PAM type: NRG; PAM sequence: AAG
catatttgggaaaatataca

SEQ ID NO: 104556 - DNA, 20 bp, Artificial Sequence
  Description of Artificial Sequence: Synthetic oligonucleotide
  Target: ATXN1; (+) strand; PAM type: NRG; PAM sequence: CAG
aaaatatacaaagaacttca

SEQ ID NO: 104557 - DNA, 20 bp, Artificial Sequence
  Description of Artificial Sequence: Synthetic oligonucleotide
  Target: ATXN1; (+) strand; PAM type: NRG; PAM sequence: AAG
tatacaaagaacttcacaga

SEQ ID NO: 104558 - DNA, 20 bp, Artificial Sequence
  Description of Artificial Sequence: Synthetic oligonucleotide
  Target: ATXN1; (+) strand; PAM type: NRG; PAM sequence: CGG
acttcacagaaagctctcaa

SEQ ID NO: 104559 - DNA, 20 bp, Artificial Sequence
  Description of Artificial Sequence: Synthetic oligonucleotide
  Target: ATXN1; (+) strand; PAM type: NRG; PAM sequence: GAG
ttcacagaaagctctcaacg

SEQ ID NO: 104560 - DNA, 20 bp, Artificial Sequence
  Description of Artificial Sequence: Synthetic oligonucleotide
  Target: ATXN1; (+) strand; PAM type: NRG; PAM sequence: GAG
cacagaaagctctcaacgga

SEQ ID NO: 104561 - DNA, 20 bp, Artificial Sequence
  Description of Artificial Sequence: Synthetic oligonucleotide
  Target: ATXN1; (+) strand; PAM type: NRG; PAM sequence: AAG
agctctcaacggagagcctg

SEQ ID NO: 104562 - DNA, 20 bp, Artificial Sequence
  Description of Artificial Sequence: Synthetic oligonucleotide
  Target: ATXN1; (+) strand; PAM type: NRG; PAM sequence: AGG
gctctcaacggagagcctga

SEQ ID NO: 104563 - DNA, 20 bp, Artificial Sequence
  Description of Artificial Sequence: Synthetic oligonucleotide
  Target: ATXN1; (+) strand; PAM type: NRG; PAM sequence: GGG
ctctcaacggagagcctgaa

SEQ ID NO: 104564 - DNA, 20 bp, Artificial Sequence
  Description of Artificial Sequence: Synthetic oligonucleotide
  Target: ATXN1; (+) strand; PAM type: NRG; PAM sequence: CAG
aacggagagcctgaagggac

SEQ ID NO: 104565 - DNA, 20 bp, Artificial Sequence
  Description of Artificial Sequence: Synthetic oligonucleotide
  Target: ATXN1; (+) strand; PAM type: NRG; PAM sequence: CAG
gagagcctgaagggaccagc

SEQ ID NO: 104566 - DNA, 20 bp, Artificial Sequence
  Description of Artificial Sequence: Synthetic oligonucleotide
  Target: ATXN1; (+) strand; PAM type: NRG; PAM sequence: AGG
agagcctgaagggaccagcc

SEQ ID NO: 104567 - DNA, 20 bp, Artificial Sequence
  Description of Artificial Sequence: Synthetic oligonucleotide
  Target: ATXN1; (+) strand; PAM type: NRG; PAM sequence: GGG
gagcctgaagggaccagcca

SEQ ID NO: 104568 - DNA, 20 bp, Artificial Sequence
  Description of Artificial Sequence: Synthetic oligonucleotide
  Target: ATXN1; (+) strand; PAM type: NRG; PAM sequence: GAG
gcctgaagggaccagccagg

SEQ ID NO: 104569 - DNA, 20 bp, Artificial Sequence
  Description of Artificial Sequence: Synthetic oligonucleotide
  Target: ATXN1; (+) strand; PAM type: NRG; PAM sequence: AAG
ccagccagggagtctaatgc

SEQ ID NO: 104570 - DNA, 20 bp, Artificial Sequence
  Description of Artificial Sequence: Synthetic oligonucleotide
  Target: ATXN1; (+) strand; PAM type: NRG; PAM sequence: CAG
ccagggagtctaatgcaagc

SEQ ID NO: 104571 - DNA, 20 bp, Artificial Sequence
  Description of Artificial Sequence: Synthetic oligonucleotide
  Target: ATXN1; (+) strand; PAM type: NRG; PAM sequence: AGG
cagggagtctaatgcaagcc

SEQ ID NO: 104572 - DNA, 20 bp, Artificial Sequence
  Description of Artificial Sequence: Synthetic oligonucleotide
  Target: ATXN1; (+) strand; PAM type: NRG; PAM sequence: CAG
agtctaatgcaagccaggaa

SEQ ID NO: 104573 - DNA, 20 bp, Artificial Sequence
  Description of Artificial Sequence: Synthetic oligonucleotide
  Target: ATXN1; (+) strand; PAM type: NRG; PAM sequence: CAG
taatgcaagccaggaacagc

SEQ ID NO: 104574 - DNA, 20 bp, Artificial Sequence
  Description of Artificial Sequence: Synthetic oligonucleotide
  Target: ATXN1; (+) strand; PAM type: NRG; PAM sequence: AGG
aatgcaagccaggaacagcc

SEQ ID NO: 104575 - DNA, 20 bp, Artificial Sequence
  Description of Artificial Sequence: Synthetic oligonucleotide
  Target: ATXN1; (+) strand; PAM type: NRG; PAM sequence: GAG
agccaggaacagccaggcat

SEQ ID NO: 104576 - DNA, 20 bp, Artificial Sequence
  Description of Artificial Sequence: Synthetic oligonucleotide
  Target: ATXN1; (+) strand; PAM type: NRG; PAM sequence: TAG
gccaggcatgagtaatgcct

SEQ ID NO: 104577 - DNA, 20 bp, Artificial Sequence
  Description of Artificial Sequence: Synthetic oligonucleotide
  Target: ATXN1; (+) strand; PAM type: NRG; PAM sequence: TGG
ggcatgagtaatgccttaga

SEQ ID NO: 104578 - DNA, 20 bp, Artificial Sequence
  Description of Artificial Sequence: Synthetic oligonucleotide
  Target: ATXN1; (+) strand; PAM type: NRG; PAM sequence: GGG
gcatgagtaatgccttagat

SEQ ID NO: 104579 - DNA, 20 bp, Artificial Sequence
  Description of Artificial Sequence: Synthetic oligonucleotide
  Target: ATXN1; (+) strand; PAM type: NRG; PAM sequence: TGG
tgagtaatgccttagatggg

SEQ ID NO: 104580 - DNA, 20 bp, Artificial Sequence
  Description of Artificial Sequence: Synthetic oligonucleotide
  Target: ATXN1; (+) strand; PAM type: NRG; PAM sequence: GGG
gagtaatgccttagatgggt

SEQ ID NO: 104581 - DNA, 20 bp, Artificial Sequence
  Description of Artificial Sequence: Synthetic oligonucleotide
  Target: ATXN1; (+) strand; PAM type: NRG; PAM sequence: CAG
gtgggttttgttttctttca

SEQ ID NO: 104582 - DNA, 20 bp, Artificial Sequence
  Description of Artificial Sequence: Synthetic oligonucleotide
  Target: ATXN1; (+) strand; PAM type: NRG; PAM sequence: TAG
aacttccctcaatgacactg

SEQ ID NO: 104583 - DNA, 20 bp, Artificial Sequence
  Description of Artificial Sequence: Synthetic oligonucleotide
  Target: ATXN1; (+) strand; PAM type: NRG; PAM sequence: AAG
ttccctcaatgacactgtag

SEQ ID NO: 104584 - DNA, 20 bp, Artificial Sequence
  Description of Artificial Sequence: Synthetic oligonucleotide
  Target: ATXN1; (+) strand; PAM type: NRG; PAM sequence: TGG
taatgttttaacaaaacgca

SEQ ID NO: 104585 - DNA, 20 bp, Artificial Sequence
  Description of Artificial Sequence: Synthetic oligonucleotide
  Target: ATXN1; (+) strand; PAM type: NRG; PAM sequence: AAG
aacaaaacgcatggatttac

SEQ ID NO: 104586 - DNA, 20 bp, Artificial Sequence
  Description of Artificial Sequence: Synthetic oligonucleotide
  Target: ATXN1; (+) strand; PAM type: NRG; PAM sequence: AAG
ttacaagcttcctcacactc

SEQ ID NO: 104587 - DNA, 20 bp, Artificial Sequence
  Description of Artificial Sequence: Synthetic oligonucleotide
  Target: ATXN1; (+) strand; PAM type: NRG; PAM sequence: CAG
cttcctcacactcaagccga

SEQ ID NO: 104588 - DNA, 20 bp, Artificial Sequence
  Description of Artificial Sequence: Synthetic oligonucleotide
  Target: ATXN1; (+) strand; PAM type: NRG; PAM sequence: GAG
tcctcacactcaagccgaca

SEQ ID NO: 104589 - DNA, 20 bp, Artificial Sequence
  Description of Artificial Sequence: Synthetic oligonucleotide
  Target: ATXN1; (+) strand; PAM type: NRG; PAM sequence: GAG
aagccgacagagcatcacac

SEQ ID NO: 104590 - DNA, 20 bp, Artificial Sequence
  Description of Artificial Sequence: Synthetic oligonucleotide
  Target: ATXN1; (+) strand; PAM type: NRG; PAM sequence: AGG
agccgacagagcatcacacg

SEQ ID NO: 104591 - DNA, 20 bp, Artificial Sequence
  Description of Artificial Sequence: Synthetic oligonucleotide
  Target: ATXN1; (+) strand; PAM type: NRG; PAM sequence: TGG
gcatcacacgaggctctgtc

SEQ ID NO: 104592 - DNA, 20 bp, Artificial Sequence
  Description of Artificial Sequence: Synthetic oligonucleotide
  Target: ATXN1; (+) strand; PAM type: NRG; PAM sequence: TAG
tcacacgaggctctgtctgg

SEQ ID NO: 104593 - DNA, 20 bp, Artificial Sequence
  Description of Artificial Sequence: Synthetic oligonucleotide
  Target: ATXN1; (+) strand; PAM type: NRG; PAM sequence: CAG
gtctggtagtctccacatct

SEQ ID NO: 104594 - DNA, 20 bp, Artificial Sequence
  Description of Artificial Sequence: Synthetic oligonucleotide
  Target: ATXN1; (+) strand; PAM type: NRG; PAM sequence: AGG
tctggtagtctccacatctc

SEQ ID NO: 104595 - DNA, 20 bp, Artificial Sequence
  Description of Artificial Sequence: Synthetic oligonucleotide
  Target: ATXN1; (+) strand; PAM type: NRG; PAM sequence: TGG
gtagtctccacatctcaggc

SEQ ID NO: 104596 - DNA, 20 bp, Artificial Sequence
  Description of Artificial Sequence: Synthetic oligonucleotide
  Target: ATXN1; (+) strand; PAM type: NRG; PAM sequence: GGG
tagtctccacatctcaggct

SEQ ID NO: 104597 - DNA, 20 bp, Artificial Sequence
  Description of Artificial Sequence: Synthetic oligonucleotide
  Target: ATXN1; (+) strand; PAM type: NRG; PAM sequence: TGG
ctccacatctcaggctgggc

SEQ ID NO: 104598 - DNA, 20 bp, Artificial Sequence
  Description of Artificial Sequence: Synthetic oligonucleotide
  Target: ATXN1; (+) strand; PAM type: NRG; PAM sequence: TGG
acatctcaggctgggctgga

SEQ ID NO: 104599 - DNA, 20 bp, Artificial Sequence
  Description of Artificial Sequence: Synthetic oligonucleotide
  Target: ATXN1; (+) strand; PAM type: NRG; PAM sequence: AAG
tctcaggctgggctggatgg

SEQ ID NO: 104600 - DNA, 20 bp, Artificial Sequence
  Description of Artificial Sequence: Synthetic oligonucleotide
  Target: ATXN1; (+) strand; PAM type: NRG; PAM sequence: AGG
ctcaggctgggctggatgga

SEQ ID NO: 104601 - DNA, 20 bp, Artificial Sequence
  Description of Artificial Sequence: Synthetic oligonucleotide
  Target: ATXN1; (+) strand; PAM type: NRG; PAM sequence: CAG
tggatggaaggaaatgatca

SEQ ID NO: 104602 - DNA, 20 bp, Artificial Sequence
  Description of Artificial Sequence: Synthetic oligonucleotide
  Target: ATXN1; (+) strand; PAM type: NRG; PAM sequence: AAG
tggaaggaaatgatcacagc

SEQ ID NO: 104603 - DNA, 20 bp, Artificial Sequence
  Description of Artificial Sequence: Synthetic oligonucleotide
  Target: ATXN1; (+) strand; PAM type: NRG; PAM sequence: AGG
ggaaggaaatgatcacagca

SEQ ID NO: 104604 - DNA, 20 bp, Artificial Sequence
  Description of Artificial Sequence: Synthetic oligonucleotide
  Target: ATXN1; (+) strand; PAM type: NRG; PAM sequence: GGG
gaaggaaatgatcacagcaa

SEQ ID NO: 104605 - DNA, 20 bp, Artificial Sequence
  Description of Artificial Sequence: Synthetic oligonucleotide
  Target: ATXN1; (+) strand; PAM type: NRG; PAM sequence: AAG
gatcacagcaagggaattta

SEQ ID NO: 104606 - DNA, 20 bp, Artificial Sequence
  Description of Artificial Sequence: Synthetic oligonucleotide
  Target: ATXN1; (+) strand; PAM type: NRG; PAM sequence: AGG
atcacagcaagggaatttaa

SEQ ID NO: 104607 - DNA, 20 bp, Artificial Sequence
  Description of Artificial Sequence: Synthetic oligonucleotide
  Target: ATXN1; (+) strand; PAM type: NRG; PAM sequence: CAG
gaatttaaaggaaatgacca

SEQ ID NO: 104608 - DNA, 20 bp, Artificial Sequence
  Description of Artificial Sequence: Synthetic oligonucleotide
  Target: ATXN1; (+) strand; PAM type: NRG; PAM sequence: AAG
ttaaaggaaatgaccacagc

SEQ ID NO: 104609 - DNA, 20 bp, Artificial Sequence
  Description of Artificial Sequence: Synthetic oligonucleotide
  Target: ATXN1; (+) strand; PAM type: NRG; PAM sequence: AGG
taaaggaaatgaccacagca

SEQ ID NO: 104610 - DNA, 20 bp, Artificial Sequence
  Description of Artificial Sequence: Synthetic oligonucleotide
  Target: ATXN1; (+) strand; PAM type: NRG; PAM sequence: GAG
tgaccacagcaaggcacatc

SEQ ID NO: 104611 - DNA, 20 bp, Artificial Sequence
  Description of Artificial Sequence: Synthetic oligonucleotide
  Target: ATXN1; (+) strand; PAM type: NRG; PAM sequence: AGG
gaccacagcaaggcacatcg

SEQ ID NO: 104612 - DNA, 20 bp, Artificial Sequence
  Description of Artificial Sequence: Synthetic oligonucleotide
  Target: ATXN1; (+) strand; PAM type: NRG; PAM sequence: GGG
accacagcaaggcacatcga

SEQ ID NO: 104613 - DNA, 20 bp, Artificial Sequence
  Description of Artificial Sequence: Synthetic oligonucleotide
  Target: ATXN1; (+) strand; PAM type: NRG; PAM sequence: TGG
cacatcgagggctccctttg

SEQ ID NO: 104614 - DNA, 20 bp, Artificial Sequence
  Description of Artificial Sequence: Synthetic oligonucleotide
  Target: ATXN1; (+) strand; PAM type: NRG; PAM sequence: AAG
gggctccctttgtggctcaa

SEQ ID NO: 104615 - DNA, 20 bp, Artificial Sequence
  Description of Artificial Sequence: Synthetic oligonucleotide
  Target: ATXN1; (+) strand; PAM type: NRG; PAM sequence: AAG
ctccctttgtggctcaaaag

SEQ ID NO: 104616 - DNA, 20 bp, Artificial Sequence
  Description of Artificial Sequence: Synthetic oligonucleotide
  Target: ATXN1; (+) strand; PAM type: NRG; PAM sequence: TGG
gtggctcaaaagaagcatca

SEQ ID NO: 104617 - DNA, 20 bp, Artificial Sequence
  Description of Artificial Sequence: Synthetic oligonucleotide
  Target: ATXN1; (+) strand; PAM type: NRG; PAM sequence: CAG
gctcaaaagaagcatcatgg

SEQ ID NO: 104618 - DNA, 20 bp, Artificial Sequence
  Description of Artificial Sequence: Synthetic oligonucleotide
  Target: ATXN1; (+) strand; PAM type: NRG; PAM sequence: GAG
tcaaaagaagcatcatggca

SEQ ID NO: 104619 - DNA, 20 bp, Artificial Sequence
  Description of Artificial Sequence: Synthetic oligonucleotide
  Target: ATXN1; (+) strand; PAM type: NRG; PAM sequence: CAG
catcatggcagagttattgt

SEQ ID NO: 104620 - DNA, 20 bp, Artificial Sequence
  Description of Artificial Sequence: Synthetic oligonucleotide
  Target: ATXN1; (+) strand; PAM type: NRG; PAM sequence: CAG
gcagagttattgtcagattt

SEQ ID NO: 104621 - DNA, 20 bp, Artificial Sequence
  Description of Artificial Sequence: Synthetic oligonucleotide
  Target: ATXN1; (+) strand; PAM type: NRG; PAM sequence: TAG
attgtcagatttcagtacaa

SEQ ID NO: 104622 - DNA, 20 bp, Artificial Sequence
  Description of Artificial Sequence: Synthetic oligonucleotide
  Target: ATXN1; (+) strand; PAM type: NRG; PAM sequence: GAG
atagtccccgccttatccat

SEQ ID NO: 104623 - DNA, 20 bp, Artificial Sequence
  Description of Artificial Sequence: Synthetic oligonucleotide
  Target: ATXN1; (+) strand; PAM type: NRG; PAM sequence: AGG
tagtccccgccttatccatg

SEQ ID NO: 104624 - DNA, 20 bp, Artificial Sequence
  Description of Artificial Sequence: Synthetic oligonucleotide
  Target: ATXN1; (+) strand; PAM type: NRG; PAM sequence: TAG
cccgccttatccatgaggaa

SEQ ID NO: 104625 - DNA, 20 bp, Artificial Sequence
  Description of Artificial Sequence: Synthetic oligonucleotide
  Target: ATXN1; (+) strand; PAM type: NRG; PAM sequence: AGG
ccgccttatccatgaggaat

SEQ ID NO: 104626 - DNA, 20 bp, Artificial Sequence
  Description of Artificial Sequence: Synthetic oligonucleotide
  Target: ATXN1; (+) strand; PAM type: NRG; PAM sequence: AAG
atccatgaggaataggttcc

SEQ ID NO: 104627 - DNA, 20 bp, Artificial Sequence
  Description of Artificial Sequence: Synthetic oligonucleotide
  Target: ATXN1; (+) strand; PAM type: NRG; PAM sequence: CAG
ggaataggttccaagacccc

SEQ ID NO: 104628 - DNA, 20 bp, Artificial Sequence
  Description of Artificial Sequence: Synthetic oligonucleotide
  Target: ATXN1; (+) strand; PAM type: NRG; PAM sequence: TGG
ataggttccaagacccccag

SEQ ID NO: 104629 - DNA, 20 bp, Artificial Sequence
  Description of Artificial Sequence: Synthetic oligonucleotide
  Target: ATXN1; (+) strand; PAM type: NRG; PAM sequence: GGG
taggttccaagacccccagt

SEQ ID NO: 104630 - DNA, 20 bp, Artificial Sequence
  Description of Artificial Sequence: Synthetic oligonucleotide
  Target: ATXN1; (+) strand; PAM type: NRG; PAM sequence: TGG
agtgggttcctgaaacccac

SEQ ID NO: 104631 - DNA, 20 bp, Artificial Sequence
  Description of Artificial Sequence: Synthetic oligonucleotide
  Target: ATXN1; (+) strand; PAM type: NRG; PAM sequence: TAG
ggttcctgaaacccactgga

SEQ ID NO: 104632 - DNA, 20 bp, Artificial Sequence
  Description of Artificial Sequence: Synthetic oligonucleotide
  Target: ATXN1; (+) strand; PAM type: NRG; PAM sequence: AAG
atatatacatacctacgata

SEQ ID NO: 104633 - DNA, 20 bp, Artificial Sequence
  Description of Artificial Sequence: Synthetic oligonucleotide
  Target: ATXN1; (+) strand; PAM type: NRG; PAM sequence: TAG
ataaagtttgatttatacat

SEQ ID NO: 104634 - DNA, 20 bp, Artificial Sequence
  Description of Artificial Sequence: Synthetic oligonucleotide
  Target: ATXN1; (+) strand; PAM type: NRG; PAM sequence: AGG
taaagtttgatttatacatt

SEQ ID NO: 104635 - DNA, 20 bp, Artificial Sequence
  Description of Artificial Sequence: Synthetic oligonucleotide
  Target: ATXN1; (+) strand; PAM type: NRG; PAM sequence: CAG
tttgatttatacattaggca

SEQ ID NO: 104636 - DNA, 20 bp, Artificial Sequence
  Description of Artificial Sequence: Synthetic oligonucleotide
  Target: ATXN1; (+) strand; PAM type: NRG; PAM sequence: GAG
ttatacattaggcacagtat

SEQ ID NO: 104637 - DNA, 20 bp, Artificial Sequence
  Description of Artificial Sequence: Synthetic oligonucleotide
  Target: ATXN1; (+) strand; PAM type: NRG; PAM sequence: TAG
cagtatgagattaatgataa

SEQ ID NO: 104638 - DNA, 20 bp, Artificial Sequence
  Description of Artificial Sequence: Synthetic oligonucleotide
  Target: ATXN1; (+) strand; PAM type: NRG; PAM sequence: TAG
gataatagctaataataaaa

SEQ ID NO: 104639 - DNA, 20 bp, Artificial Sequence
  Description of Artificial Sequence: Synthetic oligonucleotide
  Target: ATXN1; (+) strand; PAM type: NRG; PAM sequence: CAG
ataaaatagaacgattgtaa

SEQ ID NO: 104640 - DNA, 20 bp, Artificial Sequence
  Description of Artificial Sequence: Synthetic oligonucleotide
  Target: ATXN1; (+) strand; PAM type: NRG; PAM sequence: CAG
gaacgattgtaacagtatgc

SEQ ID NO: 104641 - DNA, 20 bp, Artificial Sequence
  Description of Artificial Sequence: Synthetic oligonucleotide
  Target: ATXN1; (+) strand; PAM type: NRG; PAM sequence: AAG
aacagtatgccagcatcact

SEQ ID NO: 104642 - DNA, 20 bp, Artificial Sequence
  Description of Artificial Sequence: Synthetic oligonucleotide
  Target: ATXN1; (+) strand; PAM type: NRG; PAM sequence: TGG
gccagcatcactaagtgctt

SEQ ID NO: 104643 - DNA, 20 bp, Artificial Sequence
  Description of Artificial Sequence: Synthetic oligonucleotide
  Target: ATXN1; (+) strand; PAM type: NRG; PAM sequence: GGG
ccagcatcactaagtgcttt

SEQ ID NO: 104644 - DNA, 20 bp, Artificial Sequence
  Description of Artificial Sequence: Synthetic oligonucleotide
  Target: ATXN1; (+) strand; PAM type: NRG; PAM sequence: AAG
agtgctttgggaccatcatt

SEQ ID NO: 104645 - DNA, 20 bp, Artificial Sequence
  Description of Artificial Sequence: Synthetic oligonucleotide
  Target: ATXN1; (+) strand; PAM type: NRG; PAM sequence: AAG
gaccatcattaagtaaaata

SEQ ID NO: 104646 - DNA, 20 bp, Artificial Sequence
  Description of Artificial Sequence: Synthetic oligonucleotide
  Target: ATXN1; (+) strand; PAM type: NRG; PAM sequence: AGG
accatcattaagtaaaataa

SEQ ID NO: 104647 - DNA, 20 bp, Artificial Sequence
  Description of Artificial Sequence: Synthetic oligonucleotide
  Target: ATXN1; (+) strand; PAM type: NRG; PAM sequence: AAG
aataaaggtgacttgaacac

SEQ ID NO: 104648 - DNA, 20 bp, Artificial Sequence
  Description of Artificial Sequence: Synthetic oligonucleotide
  Target: ATXN1; (+) strand; PAM type: NRG; PAM sequence: CAG
caagcacttccatcccacca

SEQ ID NO: 104649 - DNA, 20 bp, Artificial Sequence
  Description of Artificial Sequence: Synthetic oligonucleotide
  Target: ATXN1; (+) strand; PAM type: NRG; PAM sequence: TGG
gcacttccatcccaccacag

SEQ ID NO: 104650 - DNA, 20 bp, Artificial Sequence
  Description of Artificial Sequence: Synthetic oligonucleotide
  Target: ATXN1; (+) strand; PAM type: NRG; PAM sequence: AAG
catcccaccacagtggatct

SEQ ID NO: 104651 - DNA, 20 bp, Artificial Sequence
  Description of Artificial Sequence: Synthetic oligonucleotide
  Target: ATXN1; (+) strand; PAM type: NRG; PAM sequence: AAG
ccacagtggatctaagcacc

SEQ ID NO: 104652 - DNA, 20 bp, Artificial Sequence
  Description of Artificial Sequence: Synthetic oligonucleotide
  Target: ATXN1; (+) strand; PAM type: NRG; PAM sequence: TGG
agtggatctaagcaccaaga

SEQ ID NO: 104653 - DNA, 20 bp, Artificial Sequence
  Description of Artificial Sequence: Synthetic oligonucleotide
  Target: ATXN1; (+) strand; PAM type: NRG; PAM sequence: TAG
ctaagcaccaagatggccgc

SEQ ID NO: 104654 - DNA, 20 bp, Artificial Sequence
  Description of Artificial Sequence: Synthetic oligonucleotide
  Target: ATXN1; (+) strand; PAM type: NRG; PAM sequence: AGG
taagcaccaagatggccgct

SEQ ID NO: 104655 - DNA, 20 bp, Artificial Sequence
  Description of Artificial Sequence: Synthetic oligonucleotide
  Target: ATXN1; (+) strand; PAM type: NRG; PAM sequence: CGG
atggccgctaggtgactcac

SEQ ID NO: 104656 - DNA, 20 bp, Artificial Sequence
  Description of Artificial Sequence: Synthetic oligonucleotide
  Target: ATXN1; (+) strand; PAM type: NRG; PAM sequence: CGG
gccgctaggtgactcaccgg

SEQ ID NO: 104657 - DNA, 20 bp, Artificial Sequence
  Description of Artificial Sequence: Synthetic oligonucleotide
  Target: ATXN1; (+) strand; PAM type: NRG; PAM sequence: GGG
ccgctaggtgactcaccggc

SEQ ID NO: 104658 - DNA, 20 bp, Artificial Sequence
  Description of Artificial Sequence: Synthetic oligonucleotide
  Target: ATXN1; (+) strand; PAM type: NRG; PAM sequence: GGG
cgctaggtgactcaccggcg

SEQ ID NO: 104659 - DNA, 20 bp, Artificial Sequence
  Description of Artificial Sequence: Synthetic oligonucleotide
  Target: ATXN1; (+) strand; PAM type: NRG; PAM sequence: GAG
ctaggtgactcaccggcggg

SEQ ID NO: 104660 - DNA, 20 bp, Artificial Sequence
  Description of Artificial Sequence: Synthetic oligonucleotide
  Target: ATXN1; (+) strand; PAM type: NRG; PAM sequence: CAG
caccggcggggagcgctgcg

SEQ ID NO: 104661 - DNA, 20 bp, Artificial Sequence
  Description of Artificial Sequence: Synthetic oligonucleotide
  Target: ATXN1; (+) strand; PAM type: NRG; PAM sequence: CGG
cggcggggagcgctgcgcag

SEQ ID NO: 104662 - DNA, 20 bp, Artificial Sequence
  Description of Artificial Sequence: Synthetic oligonucleotide
  Target: ATXN1; (+) strand; PAM type: NRG; PAM sequence: AAG
gggagcgctgcgcagcggac

SEQ ID NO: 104663 - DNA, 20 bp, Artificial Sequence
  Description of Artificial Sequence: Synthetic oligonucleotide
  Target: ATXN1; (+) strand; PAM type: NRG; PAM sequence: TGG
gcgctgcgcagcggacaagc

SEQ ID NO: 104664 - DNA, 20 bp, Artificial Sequence
  Description of Artificial Sequence: Synthetic oligonucleotide
  Target: ATXN1; (+) strand; PAM type: NRG; PAM sequence: GAG
gctgcgcagcggacaagctg

SEQ ID NO: 104665 - DNA, 20 bp, Artificial Sequence
  Description of Artificial Sequence: Synthetic oligonucleotide
  Target: ATXN1; (+) strand; PAM type: NRG; PAM sequence: AAG
cgcagcggacaagctggaga

SEQ ID NO: 104666 - DNA, 20 bp, Artificial Sequence
  Description of Artificial Sequence: Synthetic oligonucleotide
  Target: ATXN1; (+) strand; PAM type: NRG; PAM sequence: AGG
gcagcggacaagctggagaa

SEQ ID NO: 104667 - DNA, 20 bp, Artificial Sequence
  Description of Artificial Sequence: Synthetic oligonucleotide
  Target: ATXN1; (+) strand; PAM type: NRG; PAM sequence: GGG
cagcggacaagctggagaaa

SEQ ID NO: 104668 - DNA, 20 bp, Artificial Sequence
  Description of Artificial Sequence: Synthetic oligonucleotide
  Target: ATXN1; (+) strand; PAM type: NRG; PAM sequence: TAG
gggacgattcacgtctgcgt

SEQ ID NO: 104669 - DNA, 20 bp, Artificial Sequence
  Description of Artificial Sequence: Synthetic oligonucleotide
  Target: ATXN1; (+) strand; PAM type: NRG; PAM sequence: AGG
ggacgattcacgtctgcgtt

SEQ ID NO: 104670 - DNA, 20 bp, Artificial Sequence
  Description of Artificial Sequence: Synthetic oligonucleotide
  Target: ATXN1; (+) strand; PAM type: NRG; PAM sequence: TGG
gattcacgtctgcgttagga

SEQ ID NO: 104671 - DNA, 20 bp, Artificial Sequence
  Description of Artificial Sequence: Synthetic oligonucleotide
  Target: ATXN1; (+) strand; PAM type: NRG; PAM sequence: GGG
attcacgtctgcgttaggat

SEQ ID NO: 104672 - DNA, 20 bp, Artificial Sequence
  Description of Artificial Sequence: Synthetic oligonucleotide
  Target: ATXN1; (+) strand; PAM type: NRG; PAM sequence: GGG
ttcacgtctgcgttaggatg

SEQ ID NO: 104673 - DNA, 20 bp, Artificial Sequence
  Description of Artificial Sequence: Synthetic oligonucleotide
  Target: ATXN1; (+) strand; PAM type: NRG; PAM sequence: AAG
cgtctgcgttaggatggggt

SEQ ID NO: 104674 - DNA, 20 bp, Artificial Sequence
  Description of Artificial Sequence: Synthetic oligonucleotide
  Target: ATXN1; (+) strand; PAM type: NRG; PAM sequence: AGG
gtctgcgttaggatggggta

SEQ ID NO: 104675 - DNA, 20 bp, Artificial Sequence
  Description of Artificial Sequence: Synthetic oligonucleotide
  Target: ATXN1; (+) strand; PAM type: NRG; PAM sequence: GAG
gttaggatggggtaaggcgt

SEQ ID NO: 104676 - DNA, 20 bp, Artificial Sequence
  Description of Artificial Sequence: Synthetic oligonucleotide
  Target: ATXN1; (+) strand; PAM type: NRG; PAM sequence: GAG
tgagattttatcatgctact

SEQ ID NO: 104677 - DNA, 20 bp, Artificial Sequence
  Description of Artificial Sequence: Synthetic oligonucleotide
  Target: ATXN1; (+) strand; PAM type: NRG; PAM sequence: CAG
ttttatcatgctactgagaa

SEQ ID NO: 104678 - DNA, 20 bp, Artificial Sequence
  Description of Artificial Sequence: Synthetic oligonucleotide
  Target: ATXN1; (+) strand; PAM type: NRG; PAM sequence: TAG
acagcacgcaacttaaaact

SEQ ID NO: 104679 - DNA, 20 bp, Artificial Sequence
  Description of Artificial Sequence: Synthetic oligonucleotide
  Target: ATXN1; (+) strand; PAM type: NRG; PAM sequence: AGG
cagcacgcaacttaaaactt

SEQ ID NO: 104680 - DNA, 20 bp, Artificial Sequence
  Description of Artificial Sequence: Synthetic oligonucleotide
  Target: ATXN1; (+) strand; PAM type: NRG; PAM sequence: TGG
acttaggaactgtttatttc

SEQ ID NO: 104681 - DNA, 20 bp, Artificial Sequence
  Description of Artificial Sequence: Synthetic oligonucleotide
  Target: ATXN1; (+) strand; PAM type: NRG; PAM sequence: CAG
aattttccatttcatacttt

SEQ ID NO: 104682 - DNA, 20 bp, Artificial Sequence
  Description of Artificial Sequence: Synthetic oligonucleotide
  Target: ATXN1; (+) strand; PAM type: NRG; PAM sequence: CAG
catttcatactttcagtctg

SEQ ID NO: 104683 - DNA, 20 bp, Artificial Sequence
  Description of Artificial Sequence: Synthetic oligonucleotide
  Target: ATXN1; (+) strand; PAM type: NRG; PAM sequence: TGG
tcatactttcagtctgcagt

SEQ ID NO: 104684 - DNA, 20 bp, Artificial Sequence
  Description of Artificial Sequence: Synthetic oligonucleotide
  Target: ATXN1; (+) strand; PAM type: NRG; PAM sequence: CAG
tttcagtctgcagttggcct

SEQ ID NO: 104685 - DNA, 20 bp, Artificial Sequence
  Description of Artificial Sequence: Synthetic oligonucleotide
  Target: ATXN1; (+) strand; PAM type: NRG; PAM sequence: CGG
tggcctcagaaatcaacctg

SEQ ID NO: 104686 - DNA, 20 bp, Artificial Sequence
  Description of Artificial Sequence: Synthetic oligonucleotide
  Target: ATXN1; (+) strand; PAM type: NRG; PAM sequence: CGG
agaaatcaacctgcggataa

SEQ ID NO: 104687 - DNA, 20 bp, Artificial Sequence
  Description of Artificial Sequence: Synthetic oligonucleotide
  Target: ATXN1; (+) strand; PAM type: NRG; PAM sequence: GGG
gaaatcaacctgcggataac

SEQ ID NO: 104688 - DNA, 20 bp, Artificial Sequence
  Description of Artificial Sequence: Synthetic oligonucleotide
  Target: ATXN1; (+) strand; PAM type: NRG; PAM sequence: GGG
aaatcaacctgcggataacg

SEQ ID NO: 104689 - DNA, 20 bp, Artificial Sequence
  Description of Artificial Sequence: Synthetic oligonucleotide
  Target: ATXN1; (+) strand; PAM type: NRG; PAM sequence: GGG
aatcaacctgcggataacgg

SEQ ID NO: 104690 - DNA, 20 bp, Artificial Sequence
  Description of Artificial Sequence: Synthetic oligonucleotide
  Target: ATXN1; (+) strand; PAM type: NRG; PAM sequence: TGG
tgcggataacgggggacgtc

SEQ ID NO: 104691 - DNA, 20 bp, Artificial Sequence
  Description of Artificial Sequence: Synthetic oligonucleotide
  Target: ATXN1; (+) strand; PAM type: NRG; PAM sequence: CGG
taacgggggacgtctggctg

SEQ ID NO: 104692 - DNA, 20 bp, Artificial Sequence
  Description of Artificial Sequence: Synthetic oligonucleotide
  Target: ATXN1; (+) strand; PAM type: NRG; PAM sequence: TAG
gacgtctggctgcggtgttc

SEQ ID NO: 104693 - DNA, 20 bp, Artificial Sequence
  Description of Artificial Sequence: Synthetic oligonucleotide
  Target: ATXN1; (+) strand; PAM type: NRG; PAM sequence: AGG
acgtctggctgcggtgttct

SEQ ID NO: 104694 - DNA, 20 bp, Artificial Sequence
  Description of Artificial Sequence: Synthetic oligonucleotide
  Target: ATXN1; (+) strand; PAM type: NRG; PAM sequence: AAG
aaatactccacactaaacta

SEQ ID NO: 104695 - DNA, 20 bp, Artificial Sequence
  Description of Artificial Sequence: Synthetic oligonucleotide
  Target: ATXN1; (+) strand; PAM type: NRG; PAM sequence: AGG
aatactccacactaaactaa

SEQ ID NO: 104696 - DNA, 20 bp, Artificial Sequence
  Description of Artificial Sequence: Synthetic oligonucleotide
  Target: ATXN1; (+) strand; PAM type: NRG; PAM sequence: GAG
tactccacactaaactaaag

SEQ ID NO: 104697 - DNA, 20 bp, Artificial Sequence
  Description of Artificial Sequence: Synthetic oligonucleotide
  Target: ATXN1; (+) strand; PAM type: NRG; PAM sequence: AGG
actccacactaaactaaagg

SEQ ID NO: 104698 - DNA, 20 bp, Artificial Sequence
  Description of Artificial Sequence: Synthetic oligonucleotide
  Target: ATXN1; (+) strand; PAM type: NRG; PAM sequence: AAG
actaaaggaggtgtctcaac

SEQ ID NO: 104699 - DNA, 20 bp, Artificial Sequence
  Description of Artificial Sequence: Synthetic oligonucleotide
  Target: ATXN1; (+) strand; PAM type: NRG; PAM sequence: AGG
ctaaaggaggtgtctcaaca

SEQ ID NO: 104700 - DNA, 20 bp, Artificial Sequence
  Description of Artificial Sequence: Synthetic oligonucleotide
  Target: ATXN1; (+) strand; PAM type: NRG; PAM sequence: GAG
ggaggtgtctcaacaaggct

SEQ ID NO: 104701 - DNA, 20 bp, Artificial Sequence
  Description of Artificial Sequence: Synthetic oligonucleotide
  Target: ATXN1; (+) strand; PAM type: NRG; PAM sequence: GAG
gtctcaacaaggctgagaac

SEQ ID NO: 104702 - DNA, 20 bp, Artificial Sequence
  Description of Artificial Sequence: Synthetic oligonucleotide
  Target: ATXN1; (+) strand; PAM type: NRG; PAM sequence: AGG
tctcaacaaggctgagaacg

SEQ ID NO: 104703 - DNA, 20 bp, Artificial Sequence
  Description of Artificial Sequence: Synthetic oligonucleotide
  Target: ATXN1; (+) strand; PAM type: NRG; PAM sequence: CAG
gctgagaacgaggtctatga

SEQ ID NO: 104704 - DNA, 20 bp, Artificial Sequence
  Description of Artificial Sequence: Synthetic oligonucleotide
  Target: ATXN1; (+) strand; PAM type: NRG; PAM sequence: AAG
gtctatgacagaaatgtgcc

SEQ ID NO: 104705 - DNA, 20 bp, Artificial Sequence
  Description of Artificial Sequence: Synthetic oligonucleotide
  Target: ATXN1; (+) strand; PAM type: NRG; PAM sequence: AAG
atgacagaaatgtgccaaga

SEQ ID NO: 104706 - DNA, 20 bp, Artificial Sequence
  Description of Artificial Sequence: Synthetic oligonucleotide
  Target: ATXN1; (+) strand; PAM type: NRG; PAM sequence: CAG
acagaaatgtgccaagaaag

SEQ ID NO: 104707 - DNA, 20 bp, Artificial Sequence
  Description of Artificial Sequence: Synthetic oligonucleotide
  Target: ATXN1; (+) strand; PAM type: NRG; PAM sequence: AAG
aaatgtgccaagaaagcaga

SEQ ID NO: 104708 - DNA, 20 bp, Artificial Sequence
  Description of Artificial Sequence: Synthetic oligonucleotide
  Target: ATXN1; (+) strand; PAM type: NRG; PAM sequence: AGG
aatgtgccaagaaagcagaa

SEQ ID NO: 104709 - DNA, 20 bp, Artificial Sequence
  Description of Artificial Sequence: Synthetic oligonucleotide
  Target: ATXN1; (+) strand; PAM type: NRG; PAM sequence: AAG
gccaagaaagcagaaaggaa

SEQ ID NO: 104710 - DNA, 20 bp, Artificial Sequence
  Description of Artificial Sequence: Synthetic oligonucleotide
  Target: ATXN1; (+) strand; PAM type: NRG; PAM sequence: TAG
gcagaaaggaaaagcgctca

SEQ ID NO: 104711 - DNA, 20 bp, Artificial Sequence
  Description of Artificial Sequence: Synthetic oligonucleotide
  Target: ATXN1; (+) strand; PAM type: NRG; PAM sequence: TGG
aaggaaaagcgctcatagaa

SEQ ID NO: 104712 - DNA, 20 bp, Artificial Sequence
  Description of Artificial Sequence: Synthetic oligonucleotide
  Target: ATXN1; (+) strand; PAM type: NRG; PAM sequence: GGG
aggaaaagcgctcatagaat

SEQ ID NO: 104713 - DNA, 20 bp, Artificial Sequence
  Description of Artificial Sequence: Synthetic oligonucleotide
  Target: ATXN1; (+) strand; PAM type: NRG; PAM sequence: GGG
ggaaaagcgctcatagaatg

SEQ ID NO: 104714 - DNA, 20 bp, Artificial Sequence
  Description of Artificial Sequence: Synthetic oligonucleotide
  Target: ATXN1; (+) strand; PAM type: NRG; PAM sequence: TGG
catagaatggggaatgctgc

SEQ ID NO: 104715 - DNA, 20 bp, Artificial Sequence
  Description of Artificial Sequence: Synthetic oligonucleotide
  Target: ATXN1; (+) strand; PAM type: NRG; PAM sequence: TGG
gaatggggaatgctgctggt

SEQ ID NO: 104716 - DNA, 20 bp, Artificial Sequence
  Description of Artificial Sequence: Synthetic oligonucleotide
  Target: ATXN1; (+) strand; PAM type: NRG; PAM sequence: TAG
ggggaatgctgctggttggt

SEQ ID NO: 104717 - DNA, 20 bp, Artificial Sequence
  Description of Artificial Sequence: Synthetic oligonucleotide
  Target: ATXN1; (+) strand; PAM type: NRG; PAM sequence: TGG
gaatgctgctggttggttag

SEQ ID NO: 104718 - DNA, 20 bp, Artificial Sequence
  Description of Artificial Sequence: Synthetic oligonucleotide
  Target: ATXN1; (+) strand; PAM type: NRG; PAM sequence: CAG
tgctggttggttagtggctt

SEQ ID NO: 104719 - DNA, 20 bp, Artificial Sequence
  Description of Artificial Sequence: Synthetic oligonucleotide
  Target: ATXN1; (+) strand; PAM type: NRG; PAM sequence: AAG
ggttggttagtggcttcaga

SEQ ID NO: 104720 - DNA, 20 bp, Artificial Sequence
  Description of Artificial Sequence: Synthetic oligonucleotide
  Target: ATXN1; (+) strand; PAM type: NRG; PAM sequence: AGG
gttggttagtggcttcagaa

SEQ ID NO: 104721 - DNA, 20 bp, Artificial Sequence
  Description of Artificial Sequence: Synthetic oligonucleotide
  Target: ATXN1; (+) strand; PAM type: NRG; PAM sequence: AAG
aggtgtctgattctcttaac

SEQ ID NO: 104722 - DNA, 20 bp, Artificial Sequence
  Description of Artificial Sequence: Synthetic oligonucleotide
  Target: ATXN1; (+) strand; PAM type: NRG; PAM sequence: CAG
attctcttaacaagcaatta

SEQ ID NO: 104723 - DNA, 20 bp, Artificial Sequence
  Description of Artificial Sequence: Synthetic oligonucleotide
  Target: ATXN1; (+) strand; PAM type: NRG; PAM sequence: AGG
ttctcttaacaagcaattac

SEQ ID NO: 104724 - DNA, 20 bp, Artificial Sequence
  Description of Artificial Sequence: Synthetic oligonucleotide
  Target: ATXN1; (+) strand; PAM type: NRG; PAM sequence: GAG
ctcttaacaagcaattacag

SEQ ID NO: 104725 - DNA, 20 bp, Artificial Sequence
  Description of Artificial Sequence: Synthetic oligonucleotide
  Target: ATXN1; (+) strand; PAM type: NRG; PAM sequence: AGG
tcttaacaagcaattacagg

SEQ ID NO: 104726 - DNA, 20 bp, Artificial Sequence
  Description of Artificial Sequence: Synthetic oligonucleotide
  Target: ATXN1; (+) strand; PAM type: NRG; PAM sequence: CGG
acaagcaattacaggaggcc

SEQ ID NO: 104727 - DNA, 20 bp, Artificial Sequence
  Description of Artificial Sequence: Synthetic oligonucleotide
  Target: ATXN1; (+) strand; PAM type: NRG; PAM sequence: TGG
caattacaggaggcccggca

SEQ ID NO: 104728 - DNA, 20 bp, Artificial Sequence
  Description of Artificial Sequence: Synthetic oligonucleotide
  Target: ATXN1; (+) strand; PAM type: NRG; PAM sequence: TGG
ttacaggaggcccggcatgg

SEQ ID NO: 104729 - DNA, 20 bp, Artificial Sequence
  Description of Artificial Sequence: Synthetic oligonucleotide
  Target: ATXN1; (+) strand; PAM type: NRG; PAM sequence: TAG
ggcatggtggctcacacctg

SEQ ID NO: 104730 - DNA, 20 bp, Artificial Sequence
  Description of Artificial Sequence: Synthetic oligonucleotide
  Target: ATXN1; (+) strand; PAM type: NRG; PAM sequence: CAG
gtggctcacacctgtagtcc

SEQ ID NO: 104731 - DNA, 20 bp, Artificial Sequence
  Description of Artificial Sequence: Synthetic oligonucleotide
  Target: ATXN1; (+) strand; PAM type: NRG; PAM sequence: TGG
cacctgtagtcccagcactt

SEQ ID NO: 104732 - DNA, 20 bp, Artificial Sequence
  Description of Artificial Sequence: Synthetic oligonucleotide
  Target: ATXN1; (+) strand; PAM type: NRG; PAM sequence: GGG
acctgtagtcccagcacttt

SEQ ID NO: 104733 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagcactttgg

SEQ ID NO: 104734 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagcactttggg

SEQ ID NO: 104735 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggct

SEQ ID NO: 104736 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggctg

SEQ ID NO: 104737 - DNA, 20 bp, Artificial Sequence
  Description of Artificial Sequence: Synthetic oligonucleotide
  Target: ATXN1; (+) strand; PAM type: NRG; PAM sequence: TGG
agcactttgggaggctgagg

SEQ ID NO: 104738 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggctgaggt

SEQ ID NO: 104739 - DNA, 20 bp, Artificial Sequence
  Description of Artificial Sequence: Synthetic oligonucleotide
  Target: ATXN1; (+) strand; PAM type: NRG; PAM sequence: CGG
ctttgggaggctgaggtggg

SEQ ID NO: 104740 - DNA, 20 bp, Artificial Sequence
  Description of Artificial Sequence: Synthetic oligonucleotide
  Target: ATXN1; (+) strand; PAM type: NRG; PAM sequence: TGG
aggctgaggtgggcggatct

SEQ ID NO: 104741 - DNA, 20 bp, Artificial Sequence
  Description of Artificial Sequence: Synthetic oligonucleotide
  Target: ATXN1; (+) strand; PAM type: NRG; PAM sequence: GGG
ggctgaggtgggcggatctt

SEQ ID NO: 104742 - DNA, 20 bp, Artificial Sequence
  Description of Artificial Sequence: Synthetic oligonucleotide
  Target: ATXN1; (+) strand; PAM type: NRG; PAM sequence: GGG
gctgaggtgggcggatcttg

SEQ ID NO: 104743 - DNA, 20 bp, Artificial Sequence
  Description of Artificial Sequence: Synthetic oligonucleotide
  Target: ATXN1; (+) strand; PAM type: NRG; PAM sequence: CAG
aggtgggcggatcttggggt

SEQ ID NO: 104744 - DNA, 20 bp, Artificial Sequence
  Description of Artificial Sequence: Synthetic oligonucleotide
  Target: ATXN1; (+) strand; PAM type: NRG; PAM sequence: AGG
ggtgggcggatcttggggtc

SEQ ID NO: 104745 - DNA, 20 bp, Artificial Sequence
  Description of Artificial Sequence: Synthetic oligonucleotide
  Target: ATXN1; (+) strand; PAM type: NRG; PAM sequence: GAG
tgggcggatcttggggtcag

SEQ ID NO: 104746 - DNA, 20 bp, Artificial Sequence
  Description of Artificial Sequence: Synthetic oligonucleotide
  Target: ATXN1; (+) strand; PAM type: NRG; PAM sequence: GAG
gatcttggggtcaggagttc

SEQ ID NO: 104747 - DNA, 20 bp, Artificial Sequence
  Description of Artificial Sequence: Synthetic oligonucleotide
  Target: ATXN1; (+) strand; PAM type: NRG; PAM sequence: CAG
tggggtcaggagttcgagac

SEQ ID NO: 104748 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcgagaccagcc

SEQ ID NO: 104749 - DNA, 20 bp, Artificial Sequence
  Description of Artificial Sequence: Synthetic oligonucleotide
  Target: ATXN1; (+) strand; PAM type: NRG; PAM sequence: TAG
tctactaaaactacaaaaat

SEQ ID NO: 104750 - DNA, 20 bp, Artificial Sequence
  Description of Artificial Sequence: Synthetic oligonucleotide
  Target: ATXN1; (+) strand; PAM type: NRG; PAM sequence: CAG
ctaaaactacaaaaattagc

SEQ ID NO: 104751 - DNA, 20 bp, Artificial Sequence
  Description of Artificial Sequence: Synthetic oligonucleotide
  Target: ATXN1; (+) strand; PAM type: NRG; PAM sequence: AGG
taaaactacaaaaattagcc

SEQ ID NO: 104752 - DNA, 20 bp, Artificial Sequence
  Description of Artificial Sequence: Synthetic oligonucleotide
  Target: ATXN1; (+) strand; PAM type: NRG; PAM sequence: TGG
ctacaaaaattagccaggca

SEQ ID NO: 104753 - DNA, 20 bp, Artificial Sequence
  Description of Artificial Sequence: Synthetic oligonucleotide
  Target: ATXN1; (+) strand; PAM type: NRG; PAM sequence: TGG
caaaaattagccaggcatgg

SEQ ID NO: 104754 - DNA, 20 bp, Artificial Sequence
  Description of Artificial Sequence: Synthetic oligonucleotide
  Target: ATXN1; (+) strand; PAM type: NRG; PAM sequence: CAG
tgcctgtaatccctgctact

SEQ ID NO: 104755 - DNA, 20 bp, Artificial Sequence
  Description of Artificial Sequence: Synthetic oligonucleotide
  Target: ATXN1; (+) strand; PAM type: NRG; PAM sequence: AGG
gcctgtaatccctgctactc

SEQ ID NO: 104756 - DNA, 20 bp, Artificial Sequence
  Description of Artificial Sequence: Synthetic oligonucleotide
  Target: ATXN1; (+) strand; PAM type: NRG; PAM sequence: GAG
ctgtaatccctgctactcag

SEQ ID NO: 104757 - DNA, 20 bp, Artificial Sequence
  Description of Artificial Sequence: Synthetic oligonucleotide
  Target: ATXN1; (+) strand; PAM type: NRG; PAM sequence: AGG
tgtaatccctgctactcagg

SEQ ID NO: 104758 - DNA, 20 bp, Artificial Sequence
  Description of Artificial Sequence: Synthetic oligonucleotide
  Target: ATXN1; (+) strand; PAM type: NRG; PAM sequence: GAG
tccctgctactcaggaggct

SEQ ID NO: 104759 - DNA, 20 bp, Artificial Sequence
  Description of Artificial Sequence: Synthetic oligonucleotide
  Target: ATXN1; (+) strand; PAM type: NRG; PAM sequence: AGG
ccctgctactcaggaggctg

SEQ ID NO: 104760 - DNA, 20 bp, Artificial Sequence
  Description of Artificial Sequence: Synthetic oligonucleotide
  Target: ATXN1; (+) strand; PAM type: NRG; PAM sequence: GAG
tactcaggaggctgaggcat

SEQ ID NO: 104761 - DNA, 20 bp, Artificial Sequence
  Description of Artificial Sequence: Synthetic oligonucleotide
  Target: ATXN1; (+) strand; PAM type: NRG; PAM sequence: TGG
gcatgagaatcacttgaacc

SEQ ID NO: 104762 - DNA, 20 bp, Artificial Sequence
  Description of Artificial Sequence: Synthetic oligonucleotide
  Target: ATXN1; (+) strand; PAM type: NRG; PAM sequence: GGG
catgagaatcacttgaacct

SEQ ID NO: 104763 - DNA, 20 bp, Artificial Sequence
  Description of Artificial Sequence: Synthetic oligonucleotide
  Target: ATXN1; (+) strand; PAM type: NRG; PAM sequence: GAG
tgagaatcacttgaacctgg

SEQ ID NO: 104764 - DNA, 20 bp, Artificial Sequence
  Description of Artificial Sequence: Synthetic oligonucleotide
  Target: ATXN1; (+) strand; PAM type: NRG; PAM sequence: AGG
gagaatcacttgaacctggg

SEQ ID NO: 104765 - DNA, 20 bp, Artificial Sequence
  Description of Artificial Sequence: Synthetic oligonucleotide
  Target: ATXN1; (+) strand; PAM type: NRG; PAM sequence: CGG
aatcacttgaacctgggagg

SEQ ID NO: 104766 - DNA, 20 bp, Artificial Sequence
  Description of Artificial Sequence: Synthetic oligonucleotide
  Target: ATXN1; (+) strand; PAM type: NRG; PAM sequence: GAG
tcacttgaacctgggaggcg

SEQ ID NO: 104767 - DNA, 20 bp, Artificial Sequence
  Description of Artificial Sequence: Synthetic oligonucleotide
  Target: ATXN1; (+) strand; PAM type: NRG; PAM sequence: AGG
cacttgaacctgggaggcgg

SEQ ID NO: 104768 - DNA, 20 bp, Artificial Sequence
  Description of Artificial Sequence: Synthetic oligonucleotide
  Target: ATXN1; (+) strand; PAM type: NRG; PAM sequence: GAG
tgggaggcggaggttgcaat

SEQ ID NO: 104769 - DNA, 20 bp, Artificial Sequence
  Description of Artificial Sequence: Synthetic oligonucleotide
  Target: ATXN1; (+) strand; PAM type: NRG; PAM sequence: GAG
ggcggaggttgcaatgagct

SEQ ID NO: 104770 - DNA, 20 bp, Artificial Sequence
  Description of Artificial Sequence: Synthetic oligonucleotide
  Target: ATXN1; (+) strand; PAM type: NRG; PAM sequence: CAG
gagattgcaccactgcactc

SEQ ID NO: 104771 - DNA, 20 bp, Artificial Sequence
  Description of Artificial Sequence: Synthetic oligonucleotide
  Target: ATXN1; (+) strand; PAM type: NRG; PAM sequence: TGG
tgcaccactgcactccagcc

SEQ ID NO: 104772 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctggacga

SEQ ID NO: 104773 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctggacgaca

SEQ ID NO: 104774 - DNA, 20 bp, Artificial Sequence
  Description of Artificial Sequence: Synthetic oligonucleotide
  Target: ATXN1; (+) strand; PAM type: NRG; PAM sequence: AAG
tccagcctggacgacagagc

SEQ ID NO: 104775 - DNA, 20 bp, Artificial Sequence
  Description of Artificial Sequence: Synthetic oligonucleotide
  Target: ATXN1; (+) strand; PAM type: NRG; PAM sequence: AAG
gcaagaccttgtctcaaaaa

SEQ ID NO: 104776 - DNA, 20 bp, Artificial Sequence
  Description of Artificial Sequence: Synthetic oligonucleotide
  Target: ATXN1; (+) strand; PAM type: NRG; PAM sequence: TGG
accacaattacaaacacact

SEQ ID NO: 104777 - DNA, 20 bp, Artificial Sequence
  Description of Artificial Sequence: Synthetic oligonucleotide
  Target: ATXN1; (+) strand; PAM type: NRG; PAM sequence: AAG
acacttggccattaaacttg

SEQ ID NO: 104778 - DNA, 20 bp, Artificial Sequence
  Description of Artificial Sequence: Synthetic oligonucleotide
  Target: ATXN1; (+) strand; PAM type: NRG; PAM sequence: CAG
cttggccattaaacttgaag

SEQ ID NO: 104779 - DNA, 20 bp, Artificial Sequence
  Description of Artificial Sequence: Synthetic oligonucleotide
  Target: ATXN1; (+) strand; PAM type: NRG; PAM sequence: CAG
aaacttgaagcagtgaaaaa

SEQ ID NO: 104780 - DNA, 20 bp, Artificial Sequence
  Description of Artificial Sequence: Synthetic oligonucleotide
  Target: ATXN1; (+) strand; PAM type: NRG; PAM sequence: GAG
tgaaaaacagcttcgtctac

SEQ ID NO: 104781 - DNA, 20 bp, Artificial Sequence
  Description of Artificial Sequence: Synthetic oligonucleotide
  Target: ATXN1; (+) strand; PAM type: NRG; PAM sequence: CAG
taaataaataaaaactgcta

SEQ ID NO: 104782 - DNA, 20 bp, Artificial Sequence
  Description of Artificial Sequence: Synthetic oligonucleotide
  Target: ATXN1; (+) strand; PAM type: NRG; PAM sequence: AGG
aaataaataaaaactgctac

SEQ ID NO: 104783 - DNA, 20 bp, Artificial Sequence
  Description of Artificial Sequence: Synthetic oligonucleotide
  Target: ATXN1; (+) strand; PAM type: NRG; PAM sequence: AAG
tgctacaggcattatgcttt

SEQ ID NO: 104784 - DNA, 20 bp, Artificial Sequence
  Description of Artificial Sequence: Synthetic oligonucleotide
  Target: ATXN1; (+) strand; PAM type: NRG; PAM sequence: GAG
ttaagatcacaatcgtgcat

SEQ ID NO: 104785 - DNA, 20 bp, Artificial Sequence
  Description of Artificial Sequence: Synthetic oligonucleotide
  Target: ATXN1; (+) strand; PAM type: NRG; PAM sequence: AGG
taagatcacaatcgtgcatg

SEQ ID NO: 104786 - DNA, 20 bp, Artificial Sequence
  Description of Artificial Sequence: Synthetic oligonucleotide
  Target: ATXN1; (+) strand; PAM type: NRG; PAM sequence: CAG
aatcgtgcatgaggacatta

SEQ ID NO: 104787 - DNA, 20 bp, Artificial Sequence
  Description of Artificial Sequence: Synthetic oligonucleotide
  Target: ATXN1; (+) strand; PAM type: NRG; PAM sequence: GAG
gtgcatgaggacattacagt

SEQ ID NO: 104788 - DNA, 20 bp, Artificial Sequence
  Description of Artificial Sequence: Synthetic oligonucleotide
  Target: ATXN1; (+) strand; PAM type: NRG; PAM sequence: AGG
tgcatgaggacattacagtg

SEQ ID NO: 104789 - DNA, 20 bp, Artificial Sequence
  Description of Artificial Sequence: Synthetic oligonucleotide
  Target: ATXN1; (+) strand; PAM type: NRG; PAM sequence: GGG
gcatgaggacattacagtga

SEQ ID NO: 104790 - DNA, 20 bp, Artificial Sequence
  Description of Artificial Sequence: Synthetic oligonucleotide
  Target: ATXN1; (+) strand; PAM type: NRG; PAM sequence: GAG
cattacagtgagggtcccct

SEQ ID NO: 104791 - DNA, 20 bp, Artificial Sequence
  Description of Artificial Sequence: Synthetic oligonucleotide
  Target: ATXN1; (+) strand; PAM type: NRG; PAM sequence: CAG
gggtcccctgagtcgataat

SEQ ID NO: 104792 - DNA, 20 bp, Artificial Sequence
  Description of Artificial Sequence: Synthetic oligonucleotide
  Target: ATXN1; (+) strand; PAM type: NRG; PAM sequence: TAG
gtaaaaatacacatcctctg

SEQ ID NO: 104793 - DNA, 20 bp, Artificial Sequence
  Description of Artificial Sequence: Synthetic oligonucleotide
  Target: ATXN1; (+) strand; PAM type: NRG; PAM sequence: AAG
cacatcctctgtagtttccc

SEQ ID NO: 104794 - DNA, 20 bp, Artificial Sequence
  Description of Artificial Sequence: Synthetic oligonucleotide
  Target: ATXN1; (+) strand; PAM type: NRG; PAM sequence: TAG
tgtagtttcccaagattgtg

SEQ ID NO: 104795 - DNA, 20 bp, Artificial Sequence
  Description of Artificial Sequence: Synthetic oligonucleotide
  Target: ATXN1; (+) strand; PAM type: NRG; PAM sequence: AGG
gtagtttcccaagattgtgt

SEQ ID NO: 104796 - DNA, 20 bp, Artificial Sequence
  Description of Artificial Sequence: Synthetic oligonucleotide
  Target: ATXN1; (+) strand; PAM type: NRG; PAM sequence: TGG
ttcccaagattgtgtaggtc

SEQ ID NO: 104797 - DNA, 20 bp, Artificial Sequence
  Description of Artificial Sequence: Synthetic oligonucleotide
  Target: ATXN1; (+) strand; PAM type: NRG; PAM sequence: GGG
tcccaagattgtgtaggtct

SEQ ID NO: 104798 - DNA, 20 bp, Artificial Sequence
  Description of Artificial Sequence: Synthetic oligonucleotide
  Target: ATXN1; (+) strand; PAM type: NRG; PAM sequence: TGG
aagattgtgtaggtctgggc

SEQ ID NO: 104799 - DNA, 20 bp, Artificial Sequence
  Description of Artificial Sequence: Synthetic oligonucleotide
  Target: ATXN1; (+) strand; PAM type: NRG; PAM sequence: GGG
agattgtgtaggtctgggct

SEQ ID NO: 104800 - DNA, 20 bp, Artificial Sequence
  Description of Artificial Sequence: Synthetic oligonucleotide
  Target: ATXN1; (+) strand; PAM type: NRG; PAM sequence: TAG
tgtaggtctgggctgggacc

SEQ ID NO: 104801 - DNA, 20 bp, Artificial Sequence
  Description of Artificial Sequence: Synthetic oligonucleotide
  Target: ATXN1; (+) strand; PAM type: NRG; PAM sequence: AGG
gtaggtctgggctgggacct

SEQ ID NO: 104802 - DNA, 20 bp, Artificial Sequence
  Description of Artificial Sequence: Synthetic oligonucleotide
  Target: ATXN1; (+) strand; PAM type: NRG; PAM sequence: TGG
tgtattttaaaaatctcttt

SEQ ID NO: 104803 - DNA, 20 bp, Artificial Sequence
  Description of Artificial Sequence: Synthetic oligonucleotide
  Target: ATXN1; (+) strand; PAM type: NRG; PAM sequence: TGG
tctcttttggtgattctgat

SEQ ID NO: 104804 - DNA, 20 bp, Artificial Sequence
  Description of Artificial Sequence: Synthetic oligonucleotide
  Target: ATXN1; (+) strand; PAM type: NRG; PAM sequence: CAG
cttttggtgattctgattgg

SEQ ID NO: 104805 - DNA, 20 bp, Artificial Sequence
  Description of Artificial Sequence: Synthetic oligonucleotide
  Target: ATXN1; (+) strand; PAM type: NRG; PAM sequence: TAG
tggtgattctgattggcagc

SEQ ID NO: 104806 - DNA, 20 bp, Artificial Sequence
  Description of Artificial Sequence: Synthetic oligonucleotide
  Target: ATXN1; (+) strand; PAM type: NRG; PAM sequence: AGG
ggtgattctgattggcagct

SEQ ID NO: 104807 - DNA, 20 bp, Artificial Sequence
  Description of Artificial Sequence: Synthetic oligonucleotide
  Target: ATXN1; (+) strand; PAM type: NRG; PAM sequence: TGG
attctgattggcagctaggt

SEQ ID NO: 104808 - DNA, 20 bp, Artificial Sequence
  Description of Artificial Sequence: Synthetic oligonucleotide
  Target: ATXN1; (+) strand; PAM type: NRG; PAM sequence: GGG
ttctgattggcagctaggtt

SEQ ID NO: 104809 - DNA, 20 bp, Artificial Sequence
  Description of Artificial Sequence: Synthetic oligonucleotide
  Target: ATXN1; (+) strand; PAM type: NRG; PAM sequence: GGG
tctgattggcagctaggttg

SEQ ID NO: 104810 - DNA, 20 bp, Artificial Sequence
  Description of Artificial Sequence: Synthetic oligonucleotide
  Target: ATXN1; (+) strand; PAM type: NRG; PAM sequence: TAG
aggttggggaactactacac

SEQ ID NO: 104811 - DNA, 20 bp, Artificial Sequence
  Description of Artificial Sequence: Synthetic oligonucleotide
  Target: ATXN1; (+) strand; PAM type: NRG; PAM sequence: TGG
agacctgtgcttcttaacct

SEQ ID NO: 104812 - DNA, 20 bp, Artificial Sequence
  Description of Artificial Sequence: Synthetic oligonucleotide
  Target: ATXN1; (+) strand; PAM type: NRG; PAM sequence: CAG
cctgtgcttcttaaccttgg

SEQ ID NO: 104813 - DNA, 20 bp, Artificial Sequence
  Description of Artificial Sequence: Synthetic oligonucleotide
  Target: ATXN1; (+) strand; PAM type: NRG; PAM sequence: CAG
gcttcttaaccttggcagca

SEQ ID NO: 104814 - DNA, 20 bp, Artificial Sequence
  Description of Artificial Sequence: Synthetic oligonucleotide
  Target: ATXN1; (+) strand; PAM type: NRG; PAM sequence: AGG
cttcttaaccttggcagcac

SEQ ID NO: 104815 - DNA, 20 bp, Artificial Sequence
  Description of Artificial Sequence: Synthetic oligonucleotide
  Target: ATXN1; (+) strand; PAM type: NRG; PAM sequence: GAG
tcttaaccttggcagcacag

SEQ ID NO: 104816 - DNA, 20 bp, Artificial Sequence
  Description of Artificial Sequence: Synthetic oligonucleotide
  Target: ATXN1; (+) strand; PAM type: NRG; PAM sequence: TGG
ggcagcacaggagaatcacc

SEQ ID NO: 104817 - DNA, 20 bp, Artificial Sequence
  Description of Artificial Sequence: Synthetic oligonucleotide
  Target: ATXN1; (+) strand; PAM type: NRG; PAM sequence: AAG
gcacaggagaatcacctgga

SEQ ID NO: 104818 - DNA, 20 bp, Artificial Sequence
  Description of Artificial Sequence: Synthetic oligonucleotide
  Target: ATXN1; (+) strand; PAM type: NRG; PAM sequence: AAG
tcacctggaaagattttgaa

SEQ ID NO: 104819 - DNA, 20 bp, Artificial Sequence
  Description of Artificial Sequence: Synthetic oligonucleotide
  Target: ATXN1; (+) strand; PAM type: NRG; PAM sequence: CGG
aagattttgaaaagtcttgc

SEQ ID NO: 104820 - DNA, 20 bp, Artificial Sequence
  Description of Artificial Sequence: Synthetic oligonucleotide
  Target: ATXN1; (+) strand; PAM type: NRG; PAM sequence: CAG
ttgccggtcacaccacactc

SEQ ID NO: 104821 - DNA, 20 bp, Artificial Sequence
  Description of Artificial Sequence: Synthetic oligonucleotide
  Target: ATXN1; (+) strand; PAM type: NRG; PAM sequence: AGG
tgccggtcacaccacactcc

SEQ ID NO: 104822 - DNA, 20 bp, Artificial Sequence
  Description of Artificial Sequence: Synthetic oligonucleotide
  Target: ATXN1; (+) strand; PAM type: NRG; PAM sequence: CAG
acactccaggccactgaact

SEQ ID NO: 104823 - DNA, 20 bp, Artificial Sequence
  Description of Artificial Sequence: Synthetic oligonucleotide
  Target: ATXN1; (+) strand; PAM type: NRG; PAM sequence: TAG
gccactgaactcagaaccta

SEQ ID NO: 104824 - DNA, 20 bp, Artificial Sequence
  Description of Artificial Sequence: Synthetic oligonucleotide
  Target: ATXN1; (+) strand; PAM type: NRG; PAM sequence: AGG
ccactgaactcagaacctat

SEQ ID NO: 104825 - DNA, 20 bp, Artificial Sequence
  Description of Artificial Sequence: Synthetic oligonucleotide
  Target: ATXN1; (+) strand; PAM type: NRG; PAM sequence: GGG
cactgaactcagaacctata

SEQ ID NO: 104826 - DNA, 20 bp, Artificial Sequence
  Description of Artificial Sequence: Synthetic oligonucleotide
  Target: ATXN1; (+) strand; PAM type: NRG; PAM sequence: CGG
gaactcagaacctatagggt

SEQ ID NO: 104827 - DNA, 20 bp, Artificial Sequence
  Description of Artificial Sequence: Synthetic oligonucleotide
  Target: ATXN1; (+) strand; PAM type: NRG; PAM sequence: GAG
actcagaacctatagggtcg

SEQ ID NO: 104828 - DNA, 20 bp, Artificial Sequence
  Description of Artificial Sequence: Synthetic oligonucleotide
  Target: ATXN1; (+) strand; PAM type: NRG; PAM sequence: TGG
cagaacctatagggtcggag

SEQ ID NO: 104829 - DNA, 20 bp, Artificial Sequence
  Description of Artificial Sequence: Synthetic oligonucleotide
  Target: ATXN1; (+) strand; PAM type: NRG; PAM sequence: GGG
agaacctatagggtcggagt

SEQ ID NO: 104830 - DNA, 20 bp, Artificial Sequence
  Description of Artificial Sequence: Synthetic oligonucleotide
  Target: ATXN1; (+) strand; PAM type: NRG; PAM sequence: CAG
tatagggtcggagtgggtat

SEQ ID NO: 104831 - DNA, 20 bp, Artificial Sequence
  Description of Artificial Sequence: Synthetic oligonucleotide
  Target: ATXN1; (+) strand; PAM type: NRG; PAM sequence: CAG
gtatcagtgatttcaatgtg

SEQ ID NO: 104832 - DNA, 20 bp, Artificial Sequence
  Description of Artificial Sequence: Synthetic oligonucleotide
  Target: ATXN1; (+) strand; PAM type: NRG; PAM sequence: TGG
gtgatttcaatgtgcagcca

SEQ ID NO: 104833 - DNA, 20 bp, Artificial Sequence
  Description of Artificial Sequence: Synthetic oligonucleotide
  Target: ATXN1; (+) strand; PAM type: NRG; PAM sequence: GAG
ttcaatgtgcagccatggtt

SEQ ID NO: 104834 - DNA, 20 bp, Artificial Sequence
  Description of Artificial Sequence: Synthetic oligonucleotide
  Target: ATXN1; (+) strand; PAM type: NRG; PAM sequence: CAG
gtgcagccatggttgagaat

SEQ ID NO: 104835 - DNA, 20 bp, Artificial Sequence
  Description of Artificial Sequence: Synthetic oligonucleotide
  Target: ATXN1; (+) strand; PAM type: NRG; PAM sequence: CAG
gccatggttgagaatcagtg

SEQ ID NO: 104836 - DNA, 20 bp, Artificial Sequence
  Description of Artificial Sequence: Synthetic oligonucleotide
  Target: ATXN1; (+) strand; PAM type: NRG; PAM sequence: TGG
atggttgagaatcagtgcag

SEQ ID NO: 104837 - DNA, 20 bp, Artificial Sequence
  Description of Artificial Sequence: Synthetic oligonucleotide
  Target: ATXN1; (+) strand; PAM type: NRG; PAM sequence: CAG
gaatcagtgcagtggaccct

SEQ ID NO: 104838 - DNA, 20 bp, Artificial Sequence
  Description of Artificial Sequence: Synthetic oligonucleotide
  Target: ATXN1; (+) strand; PAM type: NRG; PAM sequence: CGG
gtggaccctcagttccctga

SEQ ID NO: 104839 - DNA, 20 bp, Artificial Sequence
  Description of Artificial Sequence: Synthetic oligonucleotide
  Target: ATXN1; (+) strand; PAM type: NRG; PAM sequence: GAG
ggaccctcagttccctgacg

SEQ ID NO: 104840 - DNA, 20 bp, Artificial Sequence
  Description of Artificial Sequence: Synthetic oligonucleotide
  Target: ATXN1; (+) strand; PAM type: NRG; PAM sequence: AGG
gaccctcagttccctgacgg

SEQ ID NO: 104841 - DNA, 20 bp, Artificial Sequence
  Description of Artificial Sequence: Synthetic oligonucleotide
  Target: ATXN1; (+) strand; PAM type: NRG; PAM sequence: CAG
atgtatgtacctccctaaaa

SEQ ID NO: 104842 - DNA, 20 bp, Artificial Sequence
  Description of Artificial Sequence: Synthetic oligonucleotide
  Target: ATXN1; (+) strand; PAM type: NRG; PAM sequence: AAG
aaacagtgccctccacaata

SEQ ID NO: 104843 - DNA, 20 bp, Artificial Sequence
  Description of Artificial Sequence: Synthetic oligonucleotide
  Target: ATXN1; (+) strand; PAM type: NRG; PAM sequence: CAG
agtgccctccacaataaagc

SEQ ID NO: 104844 - DNA, 20 bp, Artificial Sequence
  Description of Artificial Sequence: Synthetic oligonucleotide
  Target: ATXN1; (+) strand; PAM type: NRG; PAM sequence: GAG
tttcacttattttttttttt

SEQ ID NO: 104845 - DNA, 20 bp, Artificial Sequence
  Description of Artificial Sequence: Synthetic oligonucleotide
  Target: ATXN1; (+) strand; PAM type: NRG; PAM sequence: TGG
acttatttttttttttgaga

SEQ ID NO: 104846 - DNA, 20 bp, Artificial Sequence
  Description of Artificial Sequence: Synthetic oligonucleotide
  Target: ATXN1; (+) strand; PAM type: NRG; PAM sequence: GAG
ttatttttttttttgagatg

SEQ ID NO: 104847 - DNA, 20 bp, Artificial Sequence
  Description of Artificial Sequence: Synthetic oligonucleotide
  Target: ATXN1; (+) strand; PAM type: NRG; PAM sequence: CAG
tggagtctcgctctgtcgcc

SEQ ID NO: 104848 - DNA, 20 bp, Artificial Sequence
  Description of Artificial Sequence: Synthetic oligonucleotide
  Target: ATXN1; (+) strand; PAM type: NRG; PAM sequence: AGG
ggagtctcgctctgtcgccc

SEQ ID NO: 104849 - DNA, 20 bp, Artificial Sequence
  Description of Artificial Sequence: Synthetic oligonucleotide
  Target: ATXN1; (+) strand; PAM type: NRG; PAM sequence: TGG
tctcgctctgtcgcccaggc

SEQ ID NO: 104850 - DNA, 20 bp, Artificial Sequence
  Description of Artificial Sequence: Synthetic oligonucleotide
  Target: ATXN1; (+) strand; PAM type: NRG; PAM sequence: GAG
tcgctctgtcgcccaggctg

SEQ ID NO: 104851 - DNA, 20 bp, Artificial Sequence
  Description of Artificial Sequence: Synthetic oligonucleotide
  Target: ATXN1; (+) strand; PAM type: NRG; PAM sequence: CAG
ctgtcgcccaggctggagtg

SEQ ID NO: 104852 - DNA, 20 bp, Artificial Sequence
  Description of Artificial Sequence: Synthetic oligonucleotide
  Target: ATXN1; (+) strand; PAM type: NRG; PAM sequence: TGG
tcgcccaggctggagtgcag

SEQ ID NO: 104853 - DNA, 20 bp, Artificial Sequence
  Description of Artificial Sequence: Synthetic oligonucleotide
  Target: ATXN1; (+) strand; PAM type: NRG; PAM sequence: CGG
ggagtgcagtggtgcaatct

SEQ ID NO: 104854 - DNA, 20 bp, Artificial Sequence
  Description of Artificial Sequence: Synthetic oligonucleotide
  Target: ATXN1; (+) strand; PAM type: NRG; PAM sequence: TGG
tcactgcaacctctgcctcc

SEQ ID NO: 104855 - DNA, 20 bp, Artificial Sequence
  Description of Artificial Sequence: Synthetic oligonucleotide
  Target: ATXN1; (+) strand; PAM type: NRG; PAM sequence: GGG
cactgcaacctctgcctcct

SEQ ID NO: 104856 - DNA, 20 bp, Artificial Sequence
  Description of Artificial Sequence: Synthetic oligonucleotide
  Target: ATXN1; (+) strand; PAM type: NRG; PAM sequence: AAG
aacctctgcctcctgggttc

SEQ ID NO: 104857 - DNA, 20 bp, Artificial Sequence
  Description of Artificial Sequence: Synthetic oligonucleotide
  Target: ATXN1; (+) strand; PAM type: NRG; PAM sequence: CAG
ttcaagcgattctcctgcct

SEQ ID NO: 104858 - DNA, 20 bp, Artificial Sequence
  Description of Artificial Sequence: Synthetic oligonucleotide
  Target: ATXN1; (+) strand; PAM type: NRG; PAM sequence: TAG
ttctcctgcctcagcctctc

SEQ ID NO: 104859 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctctctag

SEQ ID NO: 104860 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctctctagtagc

SEQ ID NO: 104861 - DNA, 20 bp, Artificial Sequence
  Description of Artificial Sequence: Synthetic oligonucleotide
  Target: ATXN1; (+) strand; PAM type: NRG; PAM sequence: GGG
cctcagcctctctagtagct

SEQ ID NO: 104862 - DNA, 20 bp, Artificial Sequence
  Description of Artificial Sequence: Synthetic oligonucleotide
  Target: ATXN1; (+) strand; PAM type: NRG; PAM sequence: CAG
ctctctagtagctgggacta

SEQ ID NO: 104863 - DNA, 20 bp, Artificial Sequence
  Description of Artificial Sequence: Synthetic oligonucleotide
  Target: ATXN1; (+) strand; PAM type: NRG; PAM sequence: AGG
tctctagtagctgggactac

SEQ ID NO: 104864 - DNA, 20 bp, Artificial Sequence
  Description of Artificial Sequence: Synthetic oligonucleotide
  Target: ATXN1; (+) strand; PAM type: NRG; PAM sequence: TGG
caggtgtgcgccaccatgcc

SEQ ID NO: 104865 - DNA, 20 bp, Artificial Sequence
  Description of Artificial Sequence: Synthetic oligonucleotide
  Target: ATXN1; (+) strand; PAM type: NRG; PAM sequence: TAG
tggctaattttttgtatttt

SEQ ID NO: 104866 - DNA, 20 bp, Artificial Sequence
  Description of Artificial Sequence: Synthetic oligonucleotide
  Target: ATXN1; (+) strand; PAM type: NRG; PAM sequence: TAG
ctaattttttgtatttttag

SEQ ID NO: 104867 - DNA, 20 bp, Artificial Sequence
  Description of Artificial Sequence: Synthetic oligonucleotide
  Target: ATXN1; (+) strand; PAM type: NRG; PAM sequence: GAG
aattttttgtatttttagta

SEQ ID NO: 104868 - DNA, 20 bp, Artificial Sequence
  Description of Artificial Sequence: Synthetic oligonucleotide
  Target: ATXN1; (+) strand; PAM type: NRG; PAM sequence: CGG
ttttgtatttttagtagaga

SEQ ID NO: 104869 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtagagac

SEQ ID NO: 104870 - DNA, 20 bp, Artificial Sequence
  Description of Artificial Sequence: Synthetic oligonucleotide
  Target: ATXN1; (+) strand; PAM type: NRG; PAM sequence: TAG
gagacgggatttcactgtgt

SEQ ID NO: 104871 - DNA, 20 bp, Artificial Sequence
  Description of Artificial Sequence: Synthetic oligonucleotide
  Target: ATXN1; (+) strand; PAM type: NRG; PAM sequence: CAG
cgggatttcactgtgttagc

SEQ ID NO: 104872 - DNA, 20 bp, Artificial Sequence
  Description of Artificial Sequence: Synthetic oligonucleotide
  Target: ATXN1; (+) strand; PAM type: NRG; PAM sequence: AGG
gggatttcactgtgttagcc

SEQ ID NO: 104873 - DNA, 20 bp, Artificial Sequence
  Description of Artificial Sequence: Synthetic oligonucleotide
  Target: ATXN1; (+) strand; PAM type: NRG; PAM sequence: TGG
tttcactgtgttagccagga

SEQ ID NO: 104874 - DNA, 20 bp, Artificial Sequence
  Description of Artificial Sequence: Synthetic oligonucleotide
  Target: ATXN1; (+) strand; PAM type: NRG; PAM sequence: CAG
acctcctgatctacctgcct

SEQ ID NO: 104875 - DNA, 20 bp, Artificial Sequence
  Description of Artificial Sequence: Synthetic oligonucleotide
  Target: ATXN1; (+) strand; PAM type: NRG; PAM sequence: AAG
ctacctgcctcagcctccca

SEQ ID NO: 104876 - DNA, 20 bp, Artificial Sequence
  Description of Artificial Sequence: Synthetic oligonucleotide
  Target: ATXN1; (+) strand; PAM type: NRG; PAM sequence: TGG
tgcctcagcctcccaaagtg

SEQ ID NO: 104877 - DNA, 20 bp, Artificial Sequence
  Description of Artificial Sequence: Synthetic oligonucleotide
  Target: ATXN1; (+) strand; PAM type: NRG; PAM sequence: GGG
gcctcagcctcccaaagtgt

SEQ ID NO: 104878 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaaagtgtg

SEQ ID NO: 104879 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgtggggatta

SEQ ID NO: 104880 - DNA, 20 bp, Artificial Sequence
  Description of Artificial Sequence: Synthetic oligonucleotide
  Target: ATXN1; (+) strand; PAM type: NRG; PAM sequence: CGG
gggattacagccaccgcact

SEQ ID NO: 104881 - DNA, 20 bp, Artificial Sequence
  Description of Artificial Sequence: Synthetic oligonucleotide
  Target: ATXN1; (+) strand; PAM type: NRG; PAM sequence: AAG
tcggacccttctattttata

SEQ ID NO: 104882 - DNA, 20 bp, Artificial Sequence
  Description of Artificial Sequence: Synthetic oligonucleotide
  Target: ATXN1; (+) strand; PAM type: NRG; PAM sequence: TGG
acccttctattttataaagc

SEQ ID NO: 104883 - DNA, 20 bp, Artificial Sequence
  Description of Artificial Sequence: Synthetic oligonucleotide
  Target: ATXN1; (+) strand; PAM type: NRG; PAM sequence: GGG
cccttctattttataaagct

SEQ ID NO: 104884 - DNA, 20 bp, Artificial Sequence
  Description of Artificial Sequence: Synthetic oligonucleotide
  Target: ATXN1; (+) strand; PAM type: NRG; PAM sequence: TGG
ttataaagctgggttacaca

SEQ ID NO: 104885 - DNA, 20 bp, Artificial Sequence
  Description of Artificial Sequence: Synthetic oligonucleotide
  Target: ATXN1; (+) strand; PAM type: NRG; PAM sequence: AAG
gaatttgtttgtattaaacc

SEQ ID NO: 104886 - DNA, 20 bp, Artificial Sequence
  Description of Artificial Sequence: Synthetic oligonucleotide
  Target: ATXN1; (+) strand; PAM type: NRG; PAM sequence: CAG
gtattaaaccaagcttttcc

SEQ ID NO: 104887 - DNA, 20 bp, Artificial Sequence
  Description of Artificial Sequence: Synthetic oligonucleotide
  Target: ATXN1; (+) strand; PAM type: NRG; PAM sequence: GAG
ttttcccagaaaacaaaatc

SEQ ID NO: 104888 - DNA, 20 bp, Artificial Sequence
  Description of Artificial Sequence: Synthetic oligonucleotide
  Target: ATXN1; (+) strand; PAM type: NRG; PAM sequence: AAG
aaatcgagtccttttaaaca

SEQ ID NO: 104889 - DNA, 20 bp, Artificial Sequence
  Description of Artificial Sequence: Synthetic oligonucleotide
  Target: ATXN1; (+) strand; PAM type: NRG; PAM sequence: TAG
gtccttttaaacaaagtttt

SEQ ID NO: 104890 - DNA, 20 bp, Artificial Sequence
  Description of Artificial Sequence: Synthetic oligonucleotide
  Target: ATXN1; (+) strand; PAM type: NRG; PAM sequence: TAG
aaacaaagtttttagatatt

SEQ ID NO: 104891 - DNA, 20 bp, Artificial Sequence
  Description of Artificial Sequence: Synthetic oligonucleotide
  Target: ATXN1; (+) strand; PAM type: NRG; PAM sequence: GAG
acaaagtttttagatattta

SEQ ID NO: 104892 - DNA, 20 bp, Artificial Sequence
  Description of Artificial Sequence: Synthetic oligonucleotide
  Target: ATXN1; (+) strand; PAM type: NRG; PAM sequence: AGG
caaagtttttagatatttag

SEQ ID NO: 104893 - DNA, 20 bp, Artificial Sequence
  Description of Artificial Sequence: Synthetic oligonucleotide
  Target: ATXN1; (+) strand; PAM type: NRG; PAM sequence: GAG
aatataattatctacacttt

SEQ ID NO: 104894 - DNA, 20 bp, Artificial Sequence
  Description of Artificial Sequence: Synthetic oligonucleotide
  Target: ATXN1; (+) strand; PAM type: NRG; PAM sequence: AGG
atataattatctacactttg

SEQ ID NO: 104895 - DNA, 20 bp, Artificial Sequence
  Description of Artificial Sequence: Synthetic oligonucleotide
  Target: ATXN1; (+) strand; PAM type: NRG; PAM sequence: GGG
tataattatctacactttga

SEQ ID NO: 104896 - DNA, 20 bp, Artificial Sequence
  Description of Artificial Sequence: Synthetic oligonucleotide
  Target: ATXN1; (+) strand; PAM type: NRG; PAM sequence: GGG
ataattatctacactttgag

SEQ ID NO: 104897 - DNA, 20 bp, Artificial Sequence
  Description of Artificial Sequence: Synthetic oligonucleotide
  Target: ATXN1; (+) strand; PAM type: NRG; PAM sequence: GAG
ttatctacactttgaggggt

SEQ ID NO: 104898 - DNA, 20 bp, Artificial Sequence
  Description of Artificial Sequence: Synthetic oligonucleotide
  Target: ATXN1; (+) strand; PAM type: NRG; PAM sequence: GAG
atctacactttgaggggtga

SEQ ID NO: 104899 - DNA, 20 bp, Artificial Sequence
  Description of Artificial Sequence: Synthetic oligonucleotide
  Target: ATXN1; (+) strand; PAM type: NRG; PAM sequence: AAG
tgaggggtgagagctctaaa

SEQ ID NO: 104900 - DNA, 20 bp, Artificial Sequence
  Description of Artificial Sequence: Synthetic oligonucleotide
  Target: ATXN1; (+) strand; PAM type: NRG; PAM sequence: TAG
gagagctctaaaaagaacct

SEQ ID NO: 104901 - DNA, 20 bp, Artificial Sequence
  Description of Artificial Sequence: Synthetic oligonucleotide
  Target: ATXN1; (+) strand; PAM type: NRG; PAM sequence: TGG
taaaaagaaccttagttgct

SEQ ID NO: 104902 - DNA, 20 bp, Artificial Sequence
  Description of Artificial Sequence: Synthetic oligonucleotide
  Target: ATXN1; (+) strand; PAM type: NRG; PAM sequence: GAG
aaaagaaccttagttgcttg

SEQ ID NO: 104903 - DNA, 20 bp, Artificial Sequence
  Description of Artificial Sequence: Synthetic oligonucleotide
  Target: ATXN1; (+) strand; PAM type: NRG; PAM sequence: AGG
aaagaaccttagttgcttgg

SEQ ID NO: 104904 - DNA, 20 bp, Artificial Sequence
  Description of Artificial Sequence: Synthetic oligonucleotide
  Target: ATXN1; (+) strand; PAM type: NRG; PAM sequence: AAG
cttagttgcttggaggcaac

SEQ ID NO: 104905 - DNA, 20 bp, Artificial Sequence
  Description of Artificial Sequence: Synthetic oligonucleotide
  Target: ATXN1; (+) strand; PAM type: NRG; PAM sequence: TAG
agttgcttggaggcaacaag

SEQ ID NO: 104906 - DNA, 20 bp, Artificial Sequence
  Description of Artificial Sequence: Synthetic oligonucleotide
  Target: ATXN1; (+) strand; PAM type: NRG; PAM sequence: AAG
ttggaggcaacaagtagatc

SEQ ID NO: 104907 - DNA, 20 bp, Artificial Sequence
  Description of Artificial Sequence: Synthetic oligonucleotide
  Target: ATXN1; (+) strand; PAM type: NRG; PAM sequence: GAG
ggaggcaacaagtagatcaa

SEQ ID NO: 104908 - DNA, 20 bp, Artificial Sequence
  Description of Artificial Sequence: Synthetic oligonucleotide
  Target: ATXN1; (+) strand; PAM type: NRG; PAM sequence: AGG
gaggcaacaagtagatcaag

SEQ ID NO: 104909 - DNA, 20 bp, Artificial Sequence
  Description of Artificial Sequence: Synthetic oligonucleotide
  Target: ATXN1; (+) strand; PAM type: NRG; PAM sequence: AAG
caacaagtagatcaagagga

SEQ ID NO: 104910 - DNA, 20 bp, Artificial Sequence
  Description of Artificial Sequence: Synthetic oligonucleotide
  Target: ATXN1; (+) strand; PAM type: NRG; PAM sequence: CAG
agatcaagaggaaagaccaa

SEQ ID NO: 104911 - DNA, 20 bp, Artificial Sequence
  Description of Artificial Sequence: Synthetic oligonucleotide
  Target: ATXN1; (+) strand; PAM type: NRG; PAM sequence: AGG
gatcaagaggaaagaccaac

SEQ ID NO: 104912 - DNA, 20 bp, Artificial Sequence
  Description of Artificial Sequence: Synthetic oligonucleotide
  Target: ATXN1; (+) strand; PAM type: NRG; PAM sequence: TGG
caggtgcctgacatcctctc

SEQ ID NO: 104913 - DNA, 20 bp, Artificial Sequence
  Description of Artificial Sequence: Synthetic oligonucleotide
  Target: ATXN1; (+) strand; PAM type: NRG; PAM sequence: GGG
aggtgcctgacatcctctct

SEQ ID NO: 104914 - DNA, 20 bp, Artificial Sequence
  Description of Artificial Sequence: Synthetic oligonucleotide
  Target: ATXN1; (+) strand; PAM type: NRG; PAM sequence: TGG
gttgttcttctgatttgtga

SEQ ID NO: 104915 - DNA, 20 bp, Artificial Sequence
  Description of Artificial Sequence: Synthetic oligonucleotide
  Target: ATXN1; (+) strand; PAM type: NRG; PAM sequence: GGG
ttgttcttctgatttgtgat

SEQ ID NO: 104916 - DNA, 20 bp, Artificial Sequence
  Description of Artificial Sequence: Synthetic oligonucleotide
  Target: ATXN1; (+) strand; PAM type: NRG; PAM sequence: AAG
ttctgatttgtgatgggtac

SEQ ID NO: 104917 - DNA, 20 bp, Artificial Sequence
  Description of Artificial Sequence: Synthetic oligonucleotide
  Target: ATXN1; (+) strand; PAM type: NRG; PAM sequence: CAG
gaaatattcatcacaaatgt

SEQ ID NO: 104918 - DNA, 20 bp, Artificial Sequence
  Description of Artificial Sequence: Synthetic oligonucleotide
  Target: ATXN1; (+) strand; PAM type: NRG; PAM sequence: AGG
aaatattcatcacaaatgtc

SEQ ID NO: 104919 - DNA, 20 bp, Artificial Sequence
  Description of Artificial Sequence: Synthetic oligonucleotide
  Target: ATXN1; (+) strand; PAM type: NRG; PAM sequence: CAG
tcatcacaaatgtcaggtct

SEQ ID NO: 104920 - DNA, 20 bp, Artificial Sequence
  Description of Artificial Sequence: Synthetic oligonucleotide
  Target: ATXN1; (+) strand; PAM type: NRG; PAM sequence: AAG
tctcagattttctgatatgc

SEQ ID NO: 104921 - DNA, 20 bp, Artificial Sequence
  Description of Artificial Sequence: Synthetic oligonucleotide
  Target: ATXN1; (+) strand; PAM type: NRG; PAM sequence: CAG
ctgatatgcaagaaactcta

SEQ ID NO: 104922 - DNA, 20 bp, Artificial Sequence
  Description of Artificial Sequence: Synthetic oligonucleotide
  Target: ATXN1; (+) strand; PAM type: NRG; PAM sequence: GAG
gatatgcaagaaactctaca

SEQ ID NO: 104923 - DNA, 20 bp, Artificial Sequence
  Description of Artificial Sequence: Synthetic oligonucleotide
  Target: ATXN1; (+) strand; PAM type: NRG; PAM sequence: TGG
atgcaagaaactctacagag

SEQ ID NO: 104924 - DNA, 20 bp, Artificial Sequence
  Description of Artificial Sequence: Synthetic oligonucleotide
  Target: ATXN1; (+) strand; PAM type: NRG; PAM sequence: GAG
gcaagaaactctacagagtg

SEQ ID NO: 104925 - DNA, 20 bp, Artificial Sequence
  Description of Artificial Sequence: Synthetic oligonucleotide
  Target: ATXN1; (+) strand; PAM type: NRG; PAM sequence: CAG
agaaactctacagagtggag

SEQ ID NO: 104926 - DNA, 20 bp, Artificial Sequence
  Description of Artificial Sequence: Synthetic oligonucleotide
  Target: ATXN1; (+) strand; PAM type: NRG; PAM sequence: CAG
aactctacagagtggagcag

SEQ ID NO: 104927 - DNA, 20 bp, Artificial Sequence
  Description of Artificial Sequence: Synthetic oligonucleotide
  Target: ATXN1; (+) strand; PAM type: NRG; PAM sequence: TGG
agagtggagcagcagccatg

SEQ ID NO: 104928 - DNA, 20 bp, Artificial Sequence
  Description of Artificial Sequence: Synthetic oligonucleotide
  Target: ATXN1; (+) strand; PAM type: NRG; PAM sequence: TAG
gcagcagccatgtggtcttg

SEQ ID NO: 104929 - DNA, 20 bp, Artificial Sequence
  Description of Artificial Sequence: Synthetic oligonucleotide
  Target: ATXN1; (+) strand; PAM type: NRG; PAM sequence: TGG
ccatgtggtcttgtagccta

SEQ ID NO: 104930 - DNA, 20 bp, Artificial Sequence
  Description of Artificial Sequence: Synthetic oligonucleotide
  Target: ATXN1; (+) strand; PAM type: NRG; PAM sequence: CAG
gtggtcttgtagcctatggt

SEQ ID NO: 104931 - DNA, 20 bp, Artificial Sequence
  Description of Artificial Sequence: Synthetic oligonucleotide
  Target: ATXN1; (+) strand; PAM type: NRG; PAM sequence: GAG
ggtcttgtagcctatggtca

SEQ ID NO: 104932 - DNA, 20 bp, Artificial Sequence
  Description of Artificial Sequence: Synthetic oligonucleotide
  Target: ATXN1; (+) strand; PAM type: NRG; PAM sequence: CAG
tgtagcctatggtcagagca

SEQ ID NO: 104933 - DNA, 20 bp, Artificial Sequence
  Description of Artificial Sequence: Synthetic oligonucleotide
  Target: ATXN1; (+) strand; PAM type: NRG; PAM sequence: CAG
cagagcacagaaaatacctc

SEQ ID NO: 104934 - DNA, 20 bp, Artificial Sequence
  Description of Artificial Sequence: Synthetic oligonucleotide
  Target: ATXN1; (+) strand; PAM type: NRG; PAM sequence: TAG
cacagaaaatacctccagca

SEQ ID NO: 104935 - DNA, 20 bp, Artificial Sequence
  Description of Artificial Sequence: Synthetic oligonucleotide
  Target: ATXN1; (+) strand; PAM type: NRG; PAM sequence: TGG
gaaaatacctccagcatagc

SEQ ID NO: 104936 - DNA, 20 bp, Artificial Sequence
  Description of Artificial Sequence: Synthetic oligonucleotide
  Target: ATXN1; (+) strand; PAM type: NRG; PAM sequence: GAG
aaatacctccagcatagctg

SEQ ID NO: 104937 - DNA, 20 bp, Artificial Sequence
  Description of Artificial Sequence: Synthetic oligonucleotide
  Target: ATXN1; (+) strand; PAM type: NRG; PAM sequence: TGG
cctccagcatagctggagac

SEQ ID NO: 104938 - DNA, 20 bp, Artificial Sequence
  Description of Artificial Sequence: Synthetic oligonucleotide
  Target: ATXN1; (+) strand; PAM type: NRG; PAM sequence: CAG
cagcatagctggagactggc

SEQ ID NO: 104939 - DNA, 20 bp, Artificial Sequence
  Description of Artificial Sequence: Synthetic oligonucleotide
  Target: ATXN1; (+) strand; PAM type: NRG; PAM sequence: GAG
gcatagctggagactggcca

SEQ ID NO: 104940 - DNA, 20 bp, Artificial Sequence
  Description of Artificial Sequence: Synthetic oligonucleotide
  Target: ATXN1; (+) strand; PAM type: NRG; PAM sequence: AGG
catagctggagactggccag

SEQ ID NO: 104941 - DNA, 20 bp, Artificial Sequence
  Description of Artificial Sequence: Synthetic oligonucleotide
  Target: ATXN1; (+) strand; PAM type: NRG; PAM sequence: CAG
agactggccagaggccctga

SEQ ID NO: 104942 - DNA, 20 bp, Artificial Sequence
  Description of Artificial Sequence: Synthetic oligonucleotide
  Target: ATXN1; (+) strand; PAM type: NRG; PAM sequence: TAG
tcctgtaacatatttgactt

SEQ ID NO: 104943 - DNA, 20 bp, Artificial Sequence
  Description of Artificial Sequence: Synthetic oligonucleotide
  Target: ATXN1; (+) strand; PAM type: NRG; PAM sequence: AGG
cctgtaacatatttgacttt

SEQ ID NO: 104944 - DNA, 20 bp, Artificial Sequence
  Description of Artificial Sequence: Synthetic oligonucleotide
  Target: ATXN1; (+) strand; PAM type: NRG; PAM sequence: GGG
ctgtaacatatttgacttta

SEQ ID NO: 104945 - DNA, 20 bp, Artificial Sequence
  Description of Artificial Sequence: Synthetic oligonucleotide
  Target: ATXN1; (+) strand; PAM type: NRG; PAM sequence: TGG
tctttctttttctcctctct

SEQ ID NO: 104946 - DNA, 20 bp, Artificial Sequence
  Description of Artificial Sequence: Synthetic oligonucleotide
  Target: ATXN1; (+) strand; PAM type: NRG; PAM sequence: TGG
ttctttttctcctctcttgg

SEQ ID NO: 104947 - DNA, 20 bp, Artificial Sequence
  Description of Artificial Sequence: Synthetic oligonucleotide
  Target: ATXN1; (+) strand; PAM type: NRG; PAM sequence: GAG
ctttttctcctctcttggtg

SEQ ID NO: 104948 - DNA, 20 bp, Artificial Sequence
  Description of Artificial Sequence: Synthetic oligonucleotide
  Target: ATXN1; (+) strand; PAM type: NRG; PAM sequence: GAG
ttttctcctctcttggtgga

SEQ ID NO: 104949 - DNA, 20 bp, Artificial Sequence
  Description of Artificial Sequence: Synthetic oligonucleotide
  Target: ATXN1; (+) strand; PAM type: NRG; PAM sequence: AGG
tttctcctctcttggtggag

SEQ ID NO: 104950 - DNA, 20 bp, Artificial Sequence
  Description of Artificial Sequence: Synthetic oligonucleotide
  Target: ATXN1; (+) strand; PAM type: NRG; PAM sequence: AAG
aggtatttattttaattacg

SEQ ID NO: 104951 - DNA, 20 bp, Artificial Sequence
  Description of Artificial Sequence: Synthetic oligonucleotide
  Target: ATXN1; (+) strand; PAM type: NRG; PAM sequence: TGG
acgaagtcctctattatgta

SEQ ID NO: 104952 - DNA, 20 bp, Artificial Sequence
  Description of Artificial Sequence: Synthetic oligonucleotide
  Target: ATXN1; (+) strand; PAM type: NRG; PAM sequence: TGG
tatggtgaactgtttaactc

SEQ ID NO: 104953 - DNA, 20 bp, Artificial Sequence
  Description of Artificial Sequence: Synthetic oligonucleotide
  Target: ATXN1; (+) strand; PAM type: NRG; PAM sequence: GGG
atggtgaactgtttaactct

SEQ ID NO: 104954 - DNA, 20 bp, Artificial Sequence
  Description of Artificial Sequence: Synthetic oligonucleotide
  Target: ATXN1; (+) strand; PAM type: NRG; PAM sequence: GGG
tggtgaactgtttaactctg

SEQ ID NO: 104955 - DNA, 20 bp, Artificial Sequence
  Description of Artificial Sequence: Synthetic oligonucleotide
  Target: ATXN1; (+) strand; PAM type: NRG; PAM sequence: CAG
tgaactgtttaactctgggg

SEQ ID NO: 104956 - DNA, 20 bp, Artificial Sequence
  Description of Artificial Sequence: Synthetic oligonucleotide
  Target: ATXN1; (+) strand; PAM type: NRG; PAM sequence: TAG
gcagttgaactgcctcaaac

SEQ ID NO: 104957 - DNA, 20 bp, Artificial Sequence
  Description of Artificial Sequence: Synthetic oligonucleotide
  Target: ATXN1; (+) strand; PAM type: NRG; PAM sequence: AGG
cagttgaactgcctcaaact

SEQ ID NO: 104958 - DNA, 20 bp, Artificial Sequence
  Description of Artificial Sequence: Synthetic oligonucleotide
  Target: ATXN1; (+) strand; PAM type: NRG; PAM sequence: CAG
tcaaactaggctgcataaaa

SEQ ID NO: 104959 - DNA, 20 bp, Artificial Sequence
  Description of Artificial Sequence: Synthetic oligonucleotide
  Target: ATXN1; (+) strand; PAM type: NRG; PAM sequence: AAG
aactaggctgcataaaacag

SEQ ID NO: 104960 - DNA, 20 bp, Artificial Sequence
  Description of Artificial Sequence: Synthetic oligonucleotide
  Target: ATXN1; (+) strand; PAM type: NRG; PAM sequence: AGG
actaggctgcataaaacaga

SEQ ID NO: 104961 - DNA, 20 bp, Artificial Sequence
  Description of Artificial Sequence: Synthetic oligonucleotide
  Target: ATXN1; (+) strand; PAM type: NRG; PAM sequence: AAG
aggctgcataaaacagaagg

SEQ ID NO: 104962 - DNA, 20 bp, Artificial Sequence
  Description of Artificial Sequence: Synthetic oligonucleotide
  Target: ATXN1; (+) strand; PAM type: NRG; PAM sequence: AGG
ggctgcataaaacagaagga

SEQ ID NO: 104963 - DNA, 20 bp, Artificial Sequence
  Description of Artificial Sequence: Synthetic oligonucleotide
  Target: ATXN1; (+) strand; PAM type: NRG; PAM sequence: CAG
taaaacagaaggaaggtcca

SEQ ID NO: 104964 - DNA, 20 bp, Artificial Sequence
  Description of Artificial Sequence: Synthetic oligonucleotide
  Target: ATXN1; (+) strand; PAM type: NRG; PAM sequence: TGG
ggtccacagccatcttccct

SEQ ID NO: 104965 - DNA, 20 bp, Artificial Sequence
  Description of Artificial Sequence: Synthetic oligonucleotide
  Target: ATXN1; (+) strand; PAM type: NRG; PAM sequence: TGG
acagccatcttcccttggac

SEQ ID NO: 104966 - DNA, 20 bp, Artificial Sequence
  Description of Artificial Sequence: Synthetic oligonucleotide
  Target: ATXN1; (+) strand; PAM type: NRG; PAM sequence: TGG
catcttcccttggactggcc

SEQ ID NO: 104967 - DNA, 20 bp, Artificial Sequence
  Description of Artificial Sequence: Synthetic oligonucleotide
  Target: ATXN1; (+) strand; PAM type: NRG; PAM sequence: GGG
atcttcccttggactggcct

SEQ ID NO: 104968 - DNA, 20 bp, Artificial Sequence
  Description of Artificial Sequence: Synthetic oligonucleotide
  Target: ATXN1; (+) strand; PAM type: NRG; PAM sequence: CAG
ggactggcctgggcttgctt

SEQ ID NO: 104969 - DNA, 20 bp, Artificial Sequence
  Description of Artificial Sequence: Synthetic oligonucleotide
  Target: ATXN1; (+) strand; PAM type: NRG; PAM sequence: GAG
tgggcttgcttcagtttgct

SEQ ID NO: 104970 - DNA, 20 bp, Artificial Sequence
  Description of Artificial Sequence: Synthetic oligonucleotide
  Target: ATXN1; (+) strand; PAM type: NRG; PAM sequence: GAG
ggcttgcttcagtttgctga

SEQ ID NO: 104971 - DNA, 20 bp, Artificial Sequence
  Description of Artificial Sequence: Synthetic oligonucleotide
  Target: ATXN1; (+) strand; PAM type: NRG; PAM sequence: CAG
ttgcttcagtttgctgagag

SEQ ID NO: 104972 - DNA, 20 bp, Artificial Sequence
  Description of Artificial Sequence: Synthetic oligonucleotide
  Target: ATXN1; (+) strand; PAM type: NRG; PAM sequence: CAG
agtttgctgagagcagaacc

SEQ ID NO: 104973 - DNA, 20 bp, Artificial Sequence
  Description of Artificial Sequence: Synthetic oligonucleotide
  Target: ATXN1; (+) strand; PAM type: NRG; PAM sequence: TGG
gctgagagcagaacccagct

SEQ ID NO: 104974 - DNA, 20 bp, Artificial Sequence
  Description of Artificial Sequence: Synthetic oligonucleotide
  Target: ATXN1; (+) strand; PAM type: NRG; PAM sequence: CAG
gaacccagcttggatgccca

SEQ ID NO: 104975 - DNA, 20 bp, Artificial Sequence
  Description of Artificial Sequence: Synthetic oligonucleotide
  Target: ATXN1; (+) strand; PAM type: NRG; PAM sequence: CAG
cttttgcacaaacttacata

SEQ ID NO: 104976 - DNA, 20 bp, Artificial Sequence
  Description of Artificial Sequence: Synthetic oligonucleotide
  Target: ATXN1; (+) strand; PAM type: NRG; PAM sequence: GAG
tttgcacaaacttacataca

SEQ ID NO: 104977 - DNA, 20 bp, Artificial Sequence
  Description of Artificial Sequence: Synthetic oligonucleotide
  Target: ATXN1; (+) strand; PAM type: NRG; PAM sequence: CAG
acatacagagcacctaaaac

SEQ ID NO: 104978 - DNA, 20 bp, Artificial Sequence
  Description of Artificial Sequence: Synthetic oligonucleotide
  Target: ATXN1; (+) strand; PAM type: NRG; PAM sequence: AGG
catacagagcacctaaaacc

SEQ ID NO: 104979 - DNA, 20 bp, Artificial Sequence
  Description of Artificial Sequence: Synthetic oligonucleotide
  Target: ATXN1; (+) strand; PAM type: NRG; PAM sequence: GGG
atacagagcacctaaaacca

SEQ ID NO: 104980 - DNA, 20 bp, Artificial Sequence
  Description of Artificial Sequence: Synthetic oligonucleotide
  Target: ATXN1; (+) strand; PAM type: NRG; PAM sequence: GGG
tacagagcacctaaaaccag

SEQ ID NO: 104981 - DNA, 20 bp, Artificial Sequence
  Description of Artificial Sequence: Synthetic oligonucleotide
  Target: ATXN1; (+) strand; PAM type: NRG; PAM sequence: CAG
aaaccaggggcacctaaaac

SEQ ID NO: 104982 - DNA, 20 bp, Artificial Sequence
  Description of Artificial Sequence: Synthetic oligonucleotide
  Target: ATXN1; (+) strand; PAM type: NRG; PAM sequence: TAG
ccaggggcacctaaaaccag

SEQ ID NO: 104983 - DNA, 20 bp, Artificial Sequence
  Description of Artificial Sequence: Synthetic oligonucleotide
  Target: ATXN1; (+) strand; PAM type: NRG; PAM sequence: TGG
ggggcacctaaaaccagtag

SEQ ID NO: 104984 - DNA, 20 bp, Artificial Sequence
  Description of Artificial Sequence: Synthetic oligonucleotide
  Target: ATXN1; (+) strand; PAM type: NRG; PAM sequence: CGG
gtagtggtaatccaatttta

SEQ ID NO: 104985 - DNA, 20 bp, Artificial Sequence
  Description of Artificial Sequence: Synthetic oligonucleotide
  Target: ATXN1; (+) strand; PAM type: NRG; PAM sequence: CAG
tccaattttacggaaaactg

SEQ ID NO: 104986 - DNA, 20 bp, Artificial Sequence
  Description of Artificial Sequence: Synthetic oligonucleotide
  Target: ATXN1; (+) strand; PAM type: NRG; PAM sequence: CAG
aattttacggaaaactgcag

SEQ ID NO: 104987 - DNA, 20 bp, Artificial Sequence
  Description of Artificial Sequence: Synthetic oligonucleotide
  Target: ATXN1; (+) strand; PAM type: NRG; PAM sequence: AGG
attttacggaaaactgcagc

SEQ ID NO: 104988 - DNA, 20 bp, Artificial Sequence
  Description of Artificial Sequence: Synthetic oligonucleotide
  Target: ATXN1; (+) strand; PAM type: NRG; PAM sequence: CAG
ctgccaccttccattttccc

SEQ ID NO: 104989 - DNA, 20 bp, Artificial Sequence
  Description of Artificial Sequence: Synthetic oligonucleotide
  Target: ATXN1; (+) strand; PAM type: NRG; PAM sequence: AAG
cttccattttccccagcact

SEQ ID NO: 104990 - DNA, 20 bp, Artificial Sequence
  Description of Artificial Sequence: Synthetic oligonucleotide
  Target: ATXN1; (+) strand; PAM type: NRG; PAM sequence: TAG
gcactaagaacacctacttt

SEQ ID NO: 104991 - DNA, 20 bp, Artificial Sequence
  Description of Artificial Sequence: Synthetic oligonucleotide
  Target: ATXN1; (+) strand; PAM type: NRG; PAM sequence: CAG
agaacacctacttttagtga

SEQ ID NO: 104992 - DNA, 20 bp, Artificial Sequence
  Description of Artificial Sequence: Synthetic oligonucleotide
  Target: ATXN1; (+) strand; PAM type: NRG; PAM sequence: AGG
gaacacctacttttagtgac

SEQ ID NO: 104993 - DNA, 20 bp, Artificial Sequence
  Description of Artificial Sequence: Synthetic oligonucleotide
  Target: ATXN1; (+) strand; PAM type: NRG; PAM sequence: TAG
tgactcatctgccactcttc

SEQ ID NO: 104994 - DNA, 20 bp, Artificial Sequence
  Description of Artificial Sequence: Synthetic oligonucleotide
  Target: ATXN1; (+) strand; PAM type: NRG; PAM sequence: CAG
ctcatctgccactcttctag

SEQ ID NO: 104995 - DNA, 20 bp, Artificial Sequence
  Description of Artificial Sequence: Synthetic oligonucleotide
  Target: ATXN1; (+) strand; PAM type: NRG; PAM sequence: AGG
tcatctgccactcttctagc

SEQ ID NO: 104996 - DNA, 20 bp, Artificial Sequence
  Description of Artificial Sequence: Synthetic oligonucleotide
  Target: ATXN1; (+) strand; PAM type: NRG; PAM sequence: AAG
ctcttctagcaggctcttct

SEQ ID NO: 104997 - DNA, 20 bp, Artificial Sequence
  Description of Artificial Sequence: Synthetic oligonucleotide
  Target: ATXN1; (+) strand; PAM type: NRG; PAM sequence: AAG
ctagcaggctcttctaagcg

SEQ ID NO: 104998 - DNA, 20 bp, Artificial Sequence
  Description of Artificial Sequence: Synthetic oligonucleotide
  Target: ATXN1; (+) strand; PAM type: NRG; PAM sequence: AAG
ttctaagcgaagacacaaac

SEQ ID NO: 104999 - DNA, 20 bp, Artificial Sequence
  Description of Artificial Sequence: Synthetic oligonucleotide
  Target: ATXN1; (+) strand; PAM type: NRG; PAM sequence: GAG
ctaagcgaagacacaaacaa

SEQ ID NO: 105000 - DNA, 20 bp, Artificial Sequence
  Description of Artificial Sequence: Synthetic oligonucleotide
  Target: ATXN1; (+) strand; PAM type: NRG; PAM sequence: CAG
agcgaagacacaaacaagag

SEQ ID NO: 105001 - DNA, 20 bp, Artificial Sequence
  Description of Artificial Sequence: Synthetic oligonucleotide
  Target: ATXN1; (+) strand; PAM type: NRG; PAM sequence: TGG
aagagcagtgtcgaccctga

SEQ ID NO: 105002 - DNA, 20 bp, Artificial Sequence
  Description of Artificial Sequence: Synthetic oligonucleotide
  Target: ATXN1; (+) strand; PAM type: NRG; PAM sequence: GAG
cagtgtcgaccctgatggat

SEQ ID NO: 105003 - DNA, 20 bp, Artificial Sequence
  Description of Artificial Sequence: Synthetic oligonucleotide
  Target: ATXN1; (+) strand; PAM type: NRG; PAM sequence: TGG
tcgaccctgatggatgagct

SEQ ID NO: 105004 - DNA, 20 bp, Artificial Sequence
  Description of Artificial Sequence: Synthetic oligonucleotide
  Target: ATXN1; (+) strand; PAM type: NRG; PAM sequence: TGG
accctgatggatgagcttgg

SEQ ID NO: 105005 - DNA, 20 bp, Artificial Sequence
  Description of Artificial Sequence: Synthetic oligonucleotide
  Target: ATXN1; (+) strand; PAM type: NRG; PAM sequence: GGG
ccctgatggatgagcttggt

SEQ ID NO: 105006 - DNA, 20 bp, Artificial Sequence
  Description of Artificial Sequence: Synthetic oligonucleotide
  Target: ATXN1; (+) strand; PAM type: NRG; PAM sequence: GGG
cctgatggatgagcttggtg

SEQ ID NO: 105007 - DNA, 20 bp, Artificial Sequence
  Description of Artificial Sequence: Synthetic oligonucleotide
  Target: ATXN1; (+) strand; PAM type: NRG; PAM sequence: GGG
ctgatggatgagcttggtgg

SEQ ID NO: 105008 - DNA, 20 bp, Artificial Sequence
  Description of Artificial Sequence: Synthetic oligonucleotide
  Target: ATXN1; (+) strand; PAM type: NRG; PAM sequence: GAG
gatggatgagcttggtgggg

SEQ ID NO: 105009 - DNA, 20 bp, Artificial Sequence
  Description of Artificial Sequence: Synthetic oligonucleotide
  Target: ATXN1; (+) strand; PAM type: NRG; PAM sequence: AGG
atggatgagcttggtggggg

SEQ ID NO: 105010 - DNA, 20 bp, Artificial Sequence
  Description of Artificial Sequence: Synthetic oligonucleotide
  Target: ATXN1; (+) strand; PAM type: NRG; PAM sequence: GAG
ggatgagcttggtgggggag

SEQ ID NO: 105011 - DNA, 20 bp, Artificial Sequence
  Description of Artificial Sequence: Synthetic oligonucleotide
  Target: ATXN1; (+) strand; PAM type: NRG; PAM sequence: AAG
tgagcttggtgggggaggag

SEQ ID NO: 105012 - DNA, 20 bp, Artificial Sequence
  Description of Artificial Sequence: Synthetic oligonucleotide
  Target: ATXN1; (+) strand; PAM type: NRG; PAM sequence: TGG
gtgggggaggagaagcccca

SEQ ID NO: 105013 - DNA, 20 bp, Artificial Sequence
  Description of Artificial Sequence: Synthetic oligonucleotide
  Target: ATXN1; (+) strand; PAM type: NRG; PAM sequence: AAG
ggaggagaagccccatggat

SEQ ID NO: 105014 - DNA, 20 bp, Artificial Sequence
  Description of Artificial Sequence: Synthetic oligonucleotide
  Target: ATXN1; (+) strand; PAM type: NRG; PAM sequence: AAG
gagaagccccatggataaga

SEQ ID NO: 105015 - DNA, 20 bp, Artificial Sequence
  Description of Artificial Sequence: Synthetic oligonucleotide
  Target: ATXN1; (+) strand; PAM type: NRG; PAM sequence: AGG
agaagccccatggataagaa

SEQ ID NO: 105016 - DNA, 20 bp, Artificial Sequence
  Description of Artificial Sequence: Synthetic oligonucleotide
  Target: ATXN1; (+) strand; PAM type: NRG; PAM sequence: GGG
gaagccccatggataagaaa

SEQ ID NO: 105017 - DNA, 20 bp, Artificial Sequence
  Description of Artificial Sequence: Synthetic oligonucleotide
  Target: ATXN1; (+) strand; PAM type: NRG; PAM sequence: CAG
gctcaatcttccccttcctg

SEQ ID NO: 105018 - DNA, 20 bp, Artificial Sequence
  Description of Artificial Sequence: Synthetic oligonucleotide
  Target: ATXN1; (+) strand; PAM type: NRG; PAM sequence: AGG
ctcaatcttccccttcctgc

SEQ ID NO: 105019 - DNA, 20 bp, Artificial Sequence
  Description of Artificial Sequence: Synthetic oligonucleotide
  Target: ATXN1; (+) strand; PAM type: NRG; PAM sequence: GAG
cttttttttttttctttttt

SEQ ID NO: 105020 - DNA, 20 bp, Artificial Sequence
  Description of Artificial Sequence: Synthetic oligonucleotide
  Target: ATXN1; (+) strand; PAM type: NRG; PAM sequence: CGG
tttttttttcttttttgaga

SEQ ID NO: 105021 - DNA, 20 bp, Artificial Sequence
  Description of Artificial Sequence: Synthetic oligonucleotide
  Target: ATXN1; (+) strand; PAM type: NRG; PAM sequence: GAG
tttttttcttttttgagacg

SEQ ID NO: 105022 - DNA, 20 bp, Artificial Sequence
  Description of Artificial Sequence: Synthetic oligonucleotide
  Target: ATXN1; (+) strand; PAM type: NRG; PAM sequence: CAG
cggagtctcgctctgtcgcc

SEQ ID NO: 105023 - DNA, 20 bp, Artificial Sequence
  Description of Artificial Sequence: Synthetic oligonucleotide
  Target: ATXN1; (+) strand; PAM type: NRG; PAM sequence: AGG
ggagtctcgctctgtcgccc

SEQ ID NO: 105024 - DNA, 20 bp, Artificial Sequence
  Description of Artificial Sequence: Synthetic oligonucleotide
  Target: ATXN1; (+) strand; PAM type: NRG; PAM sequence: CGG
tctcgctctgtcgcccaggc

SEQ ID NO: 105025 - DNA, 20 bp, Artificial Sequence
  Description of Artificial Sequence: Synthetic oligonucleotide
  Target: ATXN1; (+) strand; PAM type: NRG; PAM sequence: AAG
ctgtcgcccaggccggtgtg

SEQ ID NO: 105026 - DNA, 20 bp, Artificial Sequence
  Description of Artificial Sequence: Synthetic oligonucleotide
  Target: ATXN1; (+) strand; PAM type: NRG; PAM sequence: TGG
tcgcccaggccggtgtgaag

SEQ ID NO: 105027 - DNA, 20 bp, Artificial Sequence
  Description of Artificial Sequence: Synthetic oligonucleotide
  Target: ATXN1; (+) strand; PAM type: NRG; PAM sequence: CGG
ggtgtgaagtggcacgatct

SEQ ID NO: 105028 - DNA, 20 bp, Artificial Sequence
  Description of Artificial Sequence: Synthetic oligonucleotide
  Target: ATXN1; (+) strand; PAM type: NRG; PAM sequence: CAG
tcactgcaacctctgcctcc

SEQ ID NO: 105029 - DNA, 20 bp, Artificial Sequence
  Description of Artificial Sequence: Synthetic oligonucleotide
  Target: ATXN1; (+) strand; PAM type: NRG; PAM sequence: AGG
cactgcaacctctgcctccc

SEQ ID NO: 105030 - DNA, 20 bp, Artificial Sequence
  Description of Artificial Sequence: Synthetic oligonucleotide
  Target: ATXN1; (+) strand; PAM type: NRG; PAM sequence: CAG
ttcaaacaattctcctgcct

SEQ ID NO: 105031 - DNA, 20 bp, Artificial Sequence
  Description of Artificial Sequence: Synthetic oligonucleotide
  Target: ATXN1; (+) strand; PAM type: NRG; PAM sequence: GAG
ttctcctgcctcagcctcct

SEQ ID NO: 105032 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcctgag

SEQ ID NO: 105033 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcctgagtagc

SEQ ID NO: 105034 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcctgagtagct

SEQ ID NO: 105035 - DNA, 20 bp, Artificial Sequence
  Description of Artificial Sequence: Synthetic oligonucleotide
  Target: ATXN1; (+) strand; PAM type: NRG; PAM sequence: TAG
ctcctgagtagctgggatta

SEQ ID NO: 105036 - DNA, 20 bp, Artificial Sequence
  Description of Artificial Sequence: Synthetic oligonucleotide
  Target: ATXN1; (+) strand; PAM type: NRG; PAM sequence: AGG
tcctgagtagctgggattat

SEQ ID NO: 105037 - DNA, 20 bp, Artificial Sequence
  Description of Artificial Sequence: Synthetic oligonucleotide
  Target: ATXN1; (+) strand; PAM type: NRG; PAM sequence: CGG
taggcatgcgccaccacgcc

SEQ ID NO: 105038 - DNA, 20 bp, Artificial Sequence
  Description of Artificial Sequence: Synthetic oligonucleotide
  Target: ATXN1; (+) strand; PAM type: NRG; PAM sequence: TAG
ggctaatttttttctatttt

SEQ ID NO: 105039 - DNA, 20 bp, Artificial Sequence
  Description of Artificial Sequence: Synthetic oligonucleotide
  Target: ATXN1; (+) strand; PAM type: NRG; PAM sequence: TAG
taatttttttctatttttag

SEQ ID NO: 105040 - DNA, 20 bp, Artificial Sequence
  Description of Artificial Sequence: Synthetic oligonucleotide
  Target: ATXN1; (+) strand; PAM type: NRG; PAM sequence: GAG
atttttttctatttttagta

SEQ ID NO: 105041 - DNA, 20 bp, Artificial Sequence
  Description of Artificial Sequence: Synthetic oligonucleotide
  Target: ATXN1; (+) strand; PAM type: NRG; PAM sequence: CGG
ttttctatttttagtagaga

SEQ ID NO: 105042 - DNA, 20 bp, Artificial Sequence
  Description of Artificial Sequence: Synthetic oligonucleotide
  Target: ATXN1; (+) strand; PAM type: NRG; PAM sequence: GGG
tttctatttttagtagagac

SEQ ID NO: 105043 - DNA, 20 bp, Artificial Sequence
  Description of Artificial Sequence: Synthetic oligonucleotide
  Target: ATXN1; (+) strand; PAM type: NRG; PAM sequence: GGG
ttctatttttagtagagacg

SEQ ID NO: 105044 - DNA, 20 bp, Artificial Sequence
  Description of Artificial Sequence: Synthetic oligonucleotide
  Target: ATXN1; (+) strand; PAM type: NRG; PAM sequence: TGG
gagacggggtttcaccgtat

SEQ ID NO: 105045 - DNA, 20 bp, Artificial Sequence
  Description of Artificial Sequence: Synthetic oligonucleotide
  Target: ATXN1; (+) strand; PAM type: NRG; PAM sequence: AAG
cggggtttcaccgtattggc

SEQ ID NO: 105046 - DNA, 20 bp, Artificial Sequence
  Description of Artificial Sequence: Synthetic oligonucleotide
  Target: ATXN1; (+) strand; PAM type: NRG; PAM sequence: AGG
ggggtttcaccgtattggca

SEQ ID NO: 105047 - DNA, 20 bp, Artificial Sequence
  Description of Artificial Sequence: Synthetic oligonucleotide
  Target: ATXN1; (+) strand; PAM type: NRG; PAM sequence: TGG
tttcaccgtattggcaaggc

SEQ ID NO: 105048 - DNA, 20 bp, Artificial Sequence
  Description of Artificial Sequence: Synthetic oligonucleotide
  Target: ATXN1; (+) strand; PAM type: NRG; PAM sequence: CAG
tggtcttgaattcctgacct

SEQ ID NO: 105049 - DNA, 20 bp, Artificial Sequence
  Description of Artificial Sequence: Synthetic oligonucleotide
  Target: ATXN1; (+) strand; PAM type: NRG; PAM sequence: AGG
ggtcttgaattcctgacctc

SEQ ID NO: 105050 - DNA, 20 bp, Artificial Sequence
  Description of Artificial Sequence: Synthetic oligonucleotide
  Target: ATXN1; (+) strand; PAM type: NRG; PAM sequence: TGG
ctcaggtgatccacccgcct

SEQ ID NO: 105051 - DNA, 20 bp, Artificial Sequence
  Description of Artificial Sequence: Synthetic oligonucleotide
  Target: ATXN1; (+) strand; PAM type: NRG; PAM sequence: AAG
ccacccgccttggcctccca

SEQ ID NO: 105052 - DNA, 20 bp, Artificial Sequence
  Description of Artificial Sequence: Synthetic oligonucleotide
  Target: ATXN1; (+) strand; PAM type: NRG; PAM sequence: TGG
gccttggcctcccaaagtgc

SEQ ID NO: 105053 - DNA, 20 bp, Artificial Sequence
  Description of Artificial Sequence: Synthetic oligonucleotide
  Target: ATXN1; (+) strand; PAM type: NRG; PAM sequence: GGG
ccttggcctcccaaagtgct

SEQ ID NO: 105054 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 105055 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 105056 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggcgt

SEQ ID NO: 105057 - DNA, 20 bp, Artificial Sequence
  Description of Artificial Sequence: Synthetic oligonucleotide
  Target: ATXN1; (+) strand; PAM type: NRG; PAM sequence: AGG
gtgctgggattacaggcgtg

SEQ ID NO: 105058 - DNA, 20 bp, Artificial Sequence
  Description of Artificial Sequence: Synthetic oligonucleotide
  Target: ATXN1; (+) strand; PAM type: NRG; PAM sequence: CAG
caggcgtgaggcaccacgcc

SEQ ID NO: 105059 - DNA, 20 bp, Artificial Sequence
  Description of Artificial Sequence: Synthetic oligonucleotide
  Target: ATXN1; (+) strand; PAM type: NRG; PAM sequence: TGG
cccctcacccacccttttga

SEQ ID NO: 105060 - DNA, 20 bp, Artificial Sequence
  Description of Artificial Sequence: Synthetic oligonucleotide
  Target: ATXN1; (+) strand; PAM type: NRG; PAM sequence: GGG
ccctcacccacccttttgat

SEQ ID NO: 105061 - DNA, 20 bp, Artificial Sequence
  Description of Artificial Sequence: Synthetic oligonucleotide
  Target: ATXN1; (+) strand; PAM type: NRG; PAM sequence: GAG
acccttttgatgggcaactt

SEQ ID NO: 105062 - DNA, 20 bp, Artificial Sequence
  Description of Artificial Sequence: Synthetic oligonucleotide
  Target: ATXN1; (+) strand; PAM type: NRG; PAM sequence: CAG
accaccacttcttaaaactg

SEQ ID NO: 105063 - DNA, 20 bp, Artificial Sequence
  Description of Artificial Sequence: Synthetic oligonucleotide
  Target: ATXN1; (+) strand; PAM type: NRG; PAM sequence: AAG
acttcttaaaactgcagatg

SEQ ID NO: 105064 - DNA, 20 bp, Artificial Sequence
  Description of Artificial Sequence: Synthetic oligonucleotide
  Target: ATXN1; (+) strand; PAM type: NRG; PAM sequence: AGG
cttcttaaaactgcagatga

SEQ ID NO: 105065 - DNA, 20 bp, Artificial Sequence
  Description of Artificial Sequence: Synthetic oligonucleotide
  Target: ATXN1; (+) strand; PAM type: NRG; PAM sequence: GGG
ttcttaaaactgcagatgaa

SEQ ID NO: 105066 - DNA, 20 bp, Artificial Sequence
  Description of Artificial Sequence: Synthetic oligonucleotide
  Target: ATXN1; (+) strand; PAM type: NRG; PAM sequence: TGG
tgcagatgaagggctgactc

SEQ ID NO: 105067 - DNA, 20 bp, Artificial Sequence
  Description of Artificial Sequence: Synthetic oligonucleotide
  Target: ATXN1; (+) strand; PAM type: NRG; PAM sequence: GGG
gcagatgaagggctgactct

SEQ ID NO: 105068 - DNA, 20 bp, Artificial Sequence
  Description of Artificial Sequence: Synthetic oligonucleotide
  Target: ATXN1; (+) strand; PAM type: NRG; PAM sequence: TGG
gctgactctgggcatgccat

SEQ ID NO: 105069 - DNA, 20 bp, Artificial Sequence
  Description of Artificial Sequence: Synthetic oligonucleotide
  Target: ATXN1; (+) strand; PAM type: NRG; PAM sequence: TGG
actctgggcatgccattggt

SEQ ID NO: 105070 - DNA, 20 bp, Artificial Sequence
  Description of Artificial Sequence: Synthetic oligonucleotide
  Target: ATXN1; (+) strand; PAM type: NRG; PAM sequence: GGG
ctctgggcatgccattggtt

SEQ ID NO: 105071 - DNA, 20 bp, Artificial Sequence
  Description of Artificial Sequence: Synthetic oligonucleotide
  Target: ATXN1; (+) strand; PAM type: NRG; PAM sequence: GAG
cccgcgaccattctcctcct

SEQ ID NO: 105072 - DNA, 20 bp, Artificial Sequence
  Description of Artificial Sequence: Synthetic oligonucleotide
  Target: ATXN1; (+) strand; PAM type: NRG; PAM sequence: GAG
cgcgaccattctcctcctga

SEQ ID NO: 105073 - DNA, 20 bp, Artificial Sequence
  Description of Artificial Sequence: Synthetic oligonucleotide
  Target: ATXN1; (+) strand; PAM type: NRG; PAM sequence: AAG
ttctcctcctgagagctctg

SEQ ID NO: 105074 - DNA, 20 bp, Artificial Sequence
  Description of Artificial Sequence: Synthetic oligonucleotide
  Target: ATXN1; (+) strand; PAM type: NRG; PAM sequence: AAG
gctctgaagtcattacatcg

SEQ ID NO: 105075 - DNA, 20 bp, Artificial Sequence
  Description of Artificial Sequence: Synthetic oligonucleotide
  Target: ATXN1; (+) strand; PAM type: NRG; PAM sequence: AAG
tgaagtcattacatcgaagt

SEQ ID NO: 105076 - DNA, 20 bp, Artificial Sequence
  Description of Artificial Sequence: Synthetic oligonucleotide
  Target: ATXN1; (+) strand; PAM type: NRG; PAM sequence: TAG
ttacatcgaagtaagtaatt

SEQ ID NO: 105077 - DNA, 20 bp, Artificial Sequence
  Description of Artificial Sequence: Synthetic oligonucleotide
  Target: ATXN1; (+) strand; PAM type: NRG; PAM sequence: AAG
tcctcttgctcacatctgtg

SEQ ID NO: 105078 - DNA, 20 bp, Artificial Sequence
  Description of Artificial Sequence: Synthetic oligonucleotide
  Target: ATXN1; (+) strand; PAM type: NRG; PAM sequence: TAG
ttgctcacatctgtgaagtt

SEQ ID NO: 105079 - DNA, 20 bp, Artificial Sequence
  Description of Artificial Sequence: Synthetic oligonucleotide
  Target: ATXN1; (+) strand; PAM type: NRG; PAM sequence: AAG
tctgtgaagtttagcaaata

SEQ ID NO: 105080 - DNA, 20 bp, Artificial Sequence
  Description of Artificial Sequence: Synthetic oligonucleotide
  Target: ATXN1; (+) strand; PAM type: NRG; PAM sequence: TGG
atgtctgaatttcctatctc

SEQ ID NO: 105081 - DNA, 20 bp, Artificial Sequence
  Description of Artificial Sequence: Synthetic oligonucleotide
  Target: ATXN1; (+) strand; PAM type: NRG; PAM sequence: CAG
atttcctatctctggacata

SEQ ID NO: 105082 - DNA, 20 bp, Artificial Sequence
  Description of Artificial Sequence: Synthetic oligonucleotide
  Target: ATXN1; (+) strand; PAM type: NRG; PAM sequence: AGG
tttcctatctctggacatac

SEQ ID NO: 105083 - DNA, 20 bp, Artificial Sequence
  Description of Artificial Sequence: Synthetic oligonucleotide
  Target: ATXN1; (+) strand; PAM type: NRG; PAM sequence: GGG
ttcctatctctggacataca

SEQ ID NO: 105084 - DNA, 20 bp, Artificial Sequence
  Description of Artificial Sequence: Synthetic oligonucleotide
  Target: ATXN1; (+) strand; PAM type: NRG; PAM sequence: AAG
ggacatacagggaaacactg

SEQ ID NO: 105085 - DNA, 20 bp, Artificial Sequence
  Description of Artificial Sequence: Synthetic oligonucleotide
  Target: ATXN1; (+) strand; PAM type: NRG; PAM sequence: AAG
catacagggaaacactgaag

SEQ ID NO: 105086 - DNA, 20 bp, Artificial Sequence
  Description of Artificial Sequence: Synthetic oligonucleotide
  Target: ATXN1; (+) strand; PAM type: NRG; PAM sequence: CGG
cttcctacatttcctgccca

SEQ ID NO: 105087 - DNA, 20 bp, Artificial Sequence
  Description of Artificial Sequence: Synthetic oligonucleotide
  Target: ATXN1; (+) strand; PAM type: NRG; PAM sequence: CAG
gcactctttgcacaaaacct

SEQ ID NO: 105088 - DNA, 20 bp, Artificial Sequence
  Description of Artificial Sequence: Synthetic oligonucleotide
  Target: ATXN1; (+) strand; PAM type: NRG; PAM sequence: TGG
aaaacctcagtaaaaaatcg

SEQ ID NO: 105089 - DNA, 20 bp, Artificial Sequence
  Description of Artificial Sequence: Synthetic oligonucleotide
  Target: ATXN1; (+) strand; PAM type: NRG; PAM sequence: CAG
ctcagtaaaaaatcgtggca

SEQ ID NO: 105090 - DNA, 20 bp, Artificial Sequence
  Description of Artificial Sequence: Synthetic oligonucleotide
  Target: ATXN1; (+) strand; PAM type: NRG; PAM sequence: AGG
tcagtaaaaaatcgtggcac

SEQ ID NO: 105091 - DNA, 20 bp, Artificial Sequence
  Description of Artificial Sequence: Synthetic oligonucleotide
  Target: ATXN1; (+) strand; PAM type: NRG; PAM sequence: CGG
aaaaatcgtggcacaggtca

SEQ ID NO: 105092 - DNA, 20 bp, Artificial Sequence
  Description of Artificial Sequence: Synthetic oligonucleotide
  Target: ATXN1; (+) strand; PAM type: NRG; PAM sequence: CAG
tccctgcttattctatgact

SEQ ID NO: 105093 - DNA, 20 bp, Artificial Sequence
  Description of Artificial Sequence: Synthetic oligonucleotide
  Target: ATXN1; (+) strand; PAM type: NRG; PAM sequence: AAG
ctgcttattctatgactcag

SEQ ID NO: 105094 - DNA, 20 bp, Artificial Sequence
  Description of Artificial Sequence: Synthetic oligonucleotide
  Target: ATXN1; (+) strand; PAM type: NRG; PAM sequence: AGG
tgcttattctatgactcaga

SEQ ID NO: 105095 - DNA, 20 bp, Artificial Sequence
  Description of Artificial Sequence: Synthetic oligonucleotide
  Target: ATXN1; (+) strand; PAM type: NRG; PAM sequence: AAG
tctatgactcagaaggttca

SEQ ID NO: 105096 - DNA, 20 bp, Artificial Sequence
  Description of Artificial Sequence: Synthetic oligonucleotide
  Target: ATXN1; (+) strand; PAM type: NRG; PAM sequence: AAG
gactcagaaggttcaaagca

SEQ ID NO: 105097 - DNA, 20 bp, Artificial Sequence
  Description of Artificial Sequence: Synthetic oligonucleotide
  Target: ATXN1; (+) strand; PAM type: NRG; PAM sequence: AGG
actcagaaggttcaaagcaa

SEQ ID NO: 105098 - DNA, 20 bp, Artificial Sequence
  Description of Artificial Sequence: Synthetic oligonucleotide
  Target: ATXN1; (+) strand; PAM type: NRG; PAM sequence: TGG
caaaggtttttgacctaatt

SEQ ID NO: 105099 - DNA, 20 bp, Artificial Sequence
  Description of Artificial Sequence: Synthetic oligonucleotide
  Target: ATXN1; (+) strand; PAM type: NRG; PAM sequence: AAG
ttttgacctaatttggcctt

SEQ ID NO: 105100 - DNA, 20 bp, Artificial Sequence
  Description of Artificial Sequence: Synthetic oligonucleotide
  Target: ATXN1; (+) strand; PAM type: NRG; PAM sequence: CAG
gacctaatttggccttaagt

SEQ ID NO: 105101 - DNA, 20 bp, Artificial Sequence
  Description of Artificial Sequence: Synthetic oligonucleotide
  Target: ATXN1; (+) strand; PAM type: NRG; PAM sequence: AAG
aatttggccttaagtcagaa

SEQ ID NO: 105102 - DNA, 20 bp, Artificial Sequence
  Description of Artificial Sequence: Synthetic oligonucleotide
  Target: ATXN1; (+) strand; PAM type: NRG; PAM sequence: AGG
atttggccttaagtcagaaa

SEQ ID NO: 105103 - DNA, 20 bp, Artificial Sequence
  Description of Artificial Sequence: Synthetic oligonucleotide
  Target: ATXN1; (+) strand; PAM type: NRG; PAM sequence: GAG
ttccactgctgtctcacact

SEQ ID NO: 105104 - DNA, 20 bp, Artificial Sequence
  Description of Artificial Sequence: Synthetic oligonucleotide
  Target: ATXN1; (+) strand; PAM type: NRG; PAM sequence: AAG
ctgtctcacactgagtttca

SEQ ID NO: 105105 - DNA, 20 bp, Artificial Sequence
  Description of Artificial Sequence: Synthetic oligonucleotide
  Target: ATXN1; (+) strand; PAM type: NRG; PAM sequence: AAG
tcacactgagtttcaaagca

SEQ ID NO: 105106 - DNA, 20 bp, Artificial Sequence
  Description of Artificial Sequence: Synthetic oligonucleotide
  Target: ATXN1; (+) strand; PAM type: NRG; PAM sequence: AAG
cactgagtttcaaagcaaag

SEQ ID NO: 105107 - DNA, 20 bp, Artificial Sequence
  Description of Artificial Sequence: Synthetic oligonucleotide
  Target: ATXN1; (+) strand; PAM type: NRG; PAM sequence: TGG
gtttcaaagcaaagaagaaa

SEQ ID NO: 105108 - DNA, 20 bp, Artificial Sequence
  Description of Artificial Sequence: Synthetic oligonucleotide
  Target: ATXN1; (+) strand; PAM type: NRG; PAM sequence: CAG
aaagcaaagaagaaatggaa

SEQ ID NO: 105109 - DNA, 20 bp, Artificial Sequence
  Description of Artificial Sequence: Synthetic oligonucleotide
  Target: ATXN1; (+) strand; PAM type: NRG; PAM sequence: AGG
aagcaaagaagaaatggaac

SEQ ID NO: 105110 - DNA, 20 bp, Artificial Sequence
  Description of Artificial Sequence: Synthetic oligonucleotide
  Target: ATXN1; (+) strand; PAM type: NRG; PAM sequence: GGG
agcaaagaagaaatggaaca

SEQ ID NO: 105111 - DNA, 20 bp, Artificial Sequence
  Description of Artificial Sequence: Synthetic oligonucleotide
  Target: ATXN1; (+) strand; PAM type: NRG; PAM sequence: TGG
gaatataatctctttgctgt

SEQ ID NO: 105112 - DNA, 20 bp, Artificial Sequence
  Description of Artificial Sequence: Synthetic oligonucleotide
  Target: ATXN1; (+) strand; PAM type: NRG; PAM sequence: TGG
ctttgctgttggcaatgtta

SEQ ID NO: 105113 - DNA, 20 bp, Artificial Sequence
  Description of Artificial Sequence: Synthetic oligonucleotide
  Target: ATXN1; (+) strand; PAM type: NRG; PAM sequence: GGG
tttgctgttggcaatgttat

SEQ ID NO: 105114 - DNA, 20 bp, Artificial Sequence
  Description of Artificial Sequence: Synthetic oligonucleotide
  Target: ATXN1; (+) strand; PAM type: NRG; PAM sequence: TAG
tgttggcaatgttatgggaa

SEQ ID NO: 105115 - DNA, 20 bp, Artificial Sequence
  Description of Artificial Sequence: Synthetic oligonucleotide
  Target: ATXN1; (+) strand; PAM type: NRG; PAM sequence: CAG
ctttccatgaataaattttt

SEQ ID NO: 105116 - DNA, 20 bp, Artificial Sequence
  Description of Artificial Sequence: Synthetic oligonucleotide
  Target: ATXN1; (+) strand; PAM type: NRG; PAM sequence: AAG
aataaatttttcagaatcta

SEQ ID NO: 105117 - DNA, 20 bp, Artificial Sequence
  Description of Artificial Sequence: Synthetic oligonucleotide
  Target: ATXN1; (+) strand; PAM type: NRG; PAM sequence: GAG
atttttcagaatctaaagtt

SEQ ID NO: 105118 - DNA, 20 bp, Artificial Sequence
  Description of Artificial Sequence: Synthetic oligonucleotide
  Target: ATXN1; (+) strand; PAM type: NRG; PAM sequence: AGG
tttttcagaatctaaagttg

SEQ ID NO: 105119 - DNA, 20 bp, Artificial Sequence
  Description of Artificial Sequence: Synthetic oligonucleotide
  Target: ATXN1; (+) strand; PAM type: NRG; PAM sequence: TAG
gttgaggctcacataattgt

SEQ ID NO: 105120 - DNA, 20 bp, Artificial Sequence
  Description of Artificial Sequence: Synthetic oligonucleotide
  Target: ATXN1; (+) strand; PAM type: NRG; PAM sequence: CAG
aattgttagtattttcccca

SEQ ID NO: 105121 - DNA, 20 bp, Artificial Sequence
  Description of Artificial Sequence: Synthetic oligonucleotide
  Target: ATXN1; (+) strand; PAM type: NRG; PAM sequence: TGG
cagtgtttttcaattttcct

SEQ ID NO: 105122 - DNA, 20 bp, Artificial Sequence
  Description of Artificial Sequence: Synthetic oligonucleotide
  Target: ATXN1; (+) strand; PAM type: NRG; PAM sequence: AAG
tgtttttcaattttccttgg

SEQ ID NO: 105123 - DNA, 20 bp, Artificial Sequence
  Description of Artificial Sequence: Synthetic oligonucleotide
  Target: ATXN1; (+) strand; PAM type: NRG; PAM sequence: AGG
gtttttcaattttccttgga

SEQ ID NO: 105124 - DNA, 20 bp, Artificial Sequence
  Description of Artificial Sequence: Synthetic oligonucleotide
  Target: ATXN1; (+) strand; PAM type: NRG; PAM sequence: GGG
tttttcaattttccttggaa

SEQ ID NO: 105125 - DNA, 20 bp, Artificial Sequence
  Description of Artificial Sequence: Synthetic oligonucleotide
  Target: ATXN1; (+) strand; PAM type: NRG; PAM sequence: AAG
ttcaattttccttggaaggg

SEQ ID NO: 105126 - DNA, 20 bp, Artificial Sequence
  Description of Artificial Sequence: Synthetic oligonucleotide
  Target: ATXN1; (+) strand; PAM type: NRG; PAM sequence: TAG
aattttccttggaagggaag

SEQ ID NO: 105127 - DNA, 20 bp, Artificial Sequence
  Description of Artificial Sequence: Synthetic oligonucleotide
  Target: ATXN1; (+) strand; PAM type: NRG; PAM sequence: CAG
tagactgaattacaatacct

SEQ ID NO: 105128 - DNA, 20 bp, Artificial Sequence
  Description of Artificial Sequence: Synthetic oligonucleotide
  Target: ATXN1; (+) strand; PAM type: NRG; PAM sequence: AAG
acctcagtttctcattttgt

SEQ ID NO: 105129 - DNA, 20 bp, Artificial Sequence
  Description of Artificial Sequence: Synthetic oligonucleotide
  Target: ATXN1; (+) strand; PAM type: NRG; PAM sequence: AAG
ttctcattttgtaagctgcc

SEQ ID NO: 105130 - DNA, 20 bp, Artificial Sequence
  Description of Artificial Sequence: Synthetic oligonucleotide
  Target: ATXN1; (+) strand; PAM type: NRG; PAM sequence: CAG
attttgtaagctgccaagaa

SEQ ID NO: 105131 - DNA, 20 bp, Artificial Sequence
  Description of Artificial Sequence: Synthetic oligonucleotide
  Target: ATXN1; (+) strand; PAM type: NRG; PAM sequence: TGG
aagaacagtatgaactgtcc

SEQ ID NO: 105132 - DNA, 20 bp, Artificial Sequence
  Description of Artificial Sequence: Synthetic oligonucleotide
  Target: ATXN1; (+) strand; PAM type: NRG; PAM sequence: AAG
tatgaactgtcctggaacta

SEQ ID NO: 105133 - DNA, 20 bp, Artificial Sequence
  Description of Artificial Sequence: Synthetic oligonucleotide
  Target: ATXN1; (+) strand; PAM type: NRG; PAM sequence: AAG
tcctggaactaaagaaacat

SEQ ID NO: 105134 - DNA, 20 bp, Artificial Sequence
  Description of Artificial Sequence: Synthetic oligonucleotide
  Target: ATXN1; (+) strand; PAM type: NRG; PAM sequence: AGG
cctggaactaaagaaacata

SEQ ID NO: 105135 - DNA, 20 bp, Artificial Sequence
  Description of Artificial Sequence: Synthetic oligonucleotide
  Target: ATXN1; (+) strand; PAM type: NRG; PAM sequence: CAG
aacataaggacaaatgatac

SEQ ID NO: 105136 - DNA, 20 bp, Artificial Sequence
  Description of Artificial Sequence: Synthetic oligonucleotide
  Target: ATXN1; (+) strand; PAM type: NRG; PAM sequence: AGG
acataaggacaaatgatacc

SEQ ID NO: 105137 - DNA, 20 bp, Artificial Sequence
  Description of Artificial Sequence: Synthetic oligonucleotide
  Target: ATXN1; (+) strand; PAM type: NRG; PAM sequence: AAG
aaggacaaatgataccagga

SEQ ID NO: 105138 - DNA, 20 bp, Artificial Sequence
  Description of Artificial Sequence: Synthetic oligonucleotide
  Target: ATXN1; (+) strand; PAM type: NRG; PAM sequence: TGG
gaaagccgtttgaaattctt

SEQ ID NO: 105139 - DNA, 20 bp, Artificial Sequence
  Description of Artificial Sequence: Synthetic oligonucleotide
  Target: ATXN1; (+) strand; PAM type: NRG; PAM sequence: GGG
aaagccgtttgaaattcttt

SEQ ID NO: 105140 - DNA, 20 bp, Artificial Sequence
  Description of Artificial Sequence: Synthetic oligonucleotide
  Target: ATXN1; (+) strand; PAM type: NRG; PAM sequence: GGG
aagccgtttgaaattctttg

SEQ ID NO: 105141 - DNA, 20 bp, Artificial Sequence
  Description of Artificial Sequence: Synthetic oligonucleotide
  Target: ATXN1; (+) strand; PAM type: NRG; PAM sequence: GGG
agccgtttgaaattctttgg

SEQ ID NO: 105142 - DNA, 20 bp, Artificial Sequence
  Description of Artificial Sequence: Synthetic oligonucleotide
  Target: ATXN1; (+) strand; PAM type: NRG; PAM sequence: AAG
tttgaaattctttgggggaa

SEQ ID NO: 105143 - DNA, 20 bp, Artificial Sequence
  Description of Artificial Sequence: Synthetic oligonucleotide
  Target: ATXN1; (+) strand; PAM type: NRG; PAM sequence: CAG
ggaaaagcatataacttatg

SEQ ID NO: 105144 - DNA, 20 bp, Artificial Sequence
  Description of Artificial Sequence: Synthetic oligonucleotide
  Target: ATXN1; (+) strand; PAM type: NRG; PAM sequence: TGG
ataacttatgcagaccaccc

SEQ ID NO: 105145 - DNA, 20 bp, Artificial Sequence
  Description of Artificial Sequence: Synthetic oligonucleotide
  Target: ATXN1; (+) strand; PAM type: NRG; PAM sequence: GGG
taacttatgcagaccaccct

SEQ ID NO: 105146 - DNA, 20 bp, Artificial Sequence
  Description of Artificial Sequence: Synthetic oligonucleotide
  Target: ATXN1; (+) strand; PAM type: NRG; PAM sequence: CAG
gcagaccaccctgggttatc

SEQ ID NO: 105147 - DNA, 20 bp, Artificial Sequence
  Description of Artificial Sequence: Synthetic oligonucleotide
  Target: ATXN1; (+) strand; PAM type: NRG; PAM sequence: TAG
ttttaaaaatccctgcatac

SEQ ID NO: 105148 - DNA, 20 bp, Artificial Sequence
  Description of Artificial Sequence: Synthetic oligonucleotide
  Target: ATXN1; (+) strand; PAM type: NRG; PAM sequence: TGG
catactagacaaacttcttt

SEQ ID NO: 105149 - DNA, 20 bp, Artificial Sequence
  Description of Artificial Sequence: Synthetic oligonucleotide
  Target: ATXN1; (+) strand; PAM type: NRG; PAM sequence: AAG
ttggaccacgtttctttcct

SEQ ID NO: 105150 - DNA, 20 bp, Artificial Sequence
  Description of Artificial Sequence: Synthetic oligonucleotide
  Target: ATXN1; (+) strand; PAM type: NRG; PAM sequence: GAG
ggaccacgtttctttcctaa

SEQ ID NO: 105151 - DNA, 20 bp, Artificial Sequence
  Description of Artificial Sequence: Synthetic oligonucleotide
  Target: ATXN1; (+) strand; PAM type: NRG; PAM sequence: AAG
ccacgtttctttcctaagag

SEQ ID NO: 105152 - DNA, 20 bp, Artificial Sequence
  Description of Artificial Sequence: Synthetic oligonucleotide
  Target: ATXN1; (+) strand; PAM type: NRG; PAM sequence: AAG
tctttcctaagagaagcttg

SEQ ID NO: 105153 - DNA, 20 bp, Artificial Sequence
  Description of Artificial Sequence: Synthetic oligonucleotide
  Target: ATXN1; (+) strand; PAM type: NRG; PAM sequence: CAG
tcctaagagaagcttgaaga

SEQ ID NO: 105154 - DNA, 20 bp, Artificial Sequence
  Description of Artificial Sequence: Synthetic oligonucleotide
  Target: ATXN1; (+) strand; PAM type: NRG; PAM sequence: TAG
cagcaaactaattttcaaat

SEQ ID NO: 105155 - DNA, 20 bp, Artificial Sequence
  Description of Artificial Sequence: Synthetic oligonucleotide
  Target: ATXN1; (+) strand; PAM type: NRG; PAM sequence: AGG
agcaaactaattttcaaatt

SEQ ID NO: 105156 - DNA, 20 bp, Artificial Sequence
  Description of Artificial Sequence: Synthetic oligonucleotide
  Target: ATXN1; (+) strand; PAM type: NRG; PAM sequence: TAG
aggcatttgtcaaacatttt

SEQ ID NO: 105157 - DNA, 20 bp, Artificial Sequence
  Description of Artificial Sequence: Synthetic oligonucleotide
  Target: ATXN1; (+) strand; PAM type: NRG; PAM sequence: AGG
ggcatttgtcaaacattttt

SEQ ID NO: 105158 - DNA, 20 bp, Artificial Sequence
  Description of Artificial Sequence: Synthetic oligonucleotide
  Target: ATXN1; (+) strand; PAM type: NRG; PAM sequence: AAG
atttgtcaaacatttttagg

SEQ ID NO: 105159 - DNA, 20 bp, Artificial Sequence
  Description of Artificial Sequence: Synthetic oligonucleotide
  Target: ATXN1; (+) strand; PAM type: NRG; PAM sequence: GAG
tttttaggaagatgaatctt

SEQ ID NO: 105160 - DNA, 20 bp, Artificial Sequence
  Description of Artificial Sequence: Synthetic oligonucleotide
  Target: ATXN1; (+) strand; PAM type: NRG; PAM sequence: TGG
aaaaaacaccaaaaaaattc

SEQ ID NO: 105161 - DNA, 20 bp, Artificial Sequence
  Description of Artificial Sequence: Synthetic oligonucleotide
  Target: ATXN1; (+) strand; PAM type: NRG; PAM sequence: GAG
aaaacaccaaaaaaattctg

SEQ ID NO: 105162 - DNA, 20 bp, Artificial Sequence
  Description of Artificial Sequence: Synthetic oligonucleotide
  Target: ATXN1; (+) strand; PAM type: NRG; PAM sequence: TAG
ccaaaaaaattctggagatc

SEQ ID NO: 105163 - DNA, 20 bp, Artificial Sequence
  Description of Artificial Sequence: Synthetic oligonucleotide
  Target: ATXN1; (+) strand; PAM type: NRG; PAM sequence: TGG
aaaattctggagatctagat

SEQ ID NO: 105164 - DNA, 20 bp, Artificial Sequence
  Description of Artificial Sequence: Synthetic oligonucleotide
  Target: ATXN1; (+) strand; PAM type: NRG; PAM sequence: GGG
aaattctggagatctagatt

SEQ ID NO: 105165 - DNA, 20 bp, Artificial Sequence
  Description of Artificial Sequence: Synthetic oligonucleotide
  Target: ATXN1; (+) strand; PAM type: NRG; PAM sequence: AAG
tctggagatctagattggga

SEQ ID NO: 105166 - DNA, 20 bp, Artificial Sequence
  Description of Artificial Sequence: Synthetic oligonucleotide
  Target: ATXN1; (+) strand; PAM type: NRG; PAM sequence: CAG
ggagatctagattgggaaag

SEQ ID NO: 105167 - DNA, 20 bp, Artificial Sequence
  Description of Artificial Sequence: Synthetic oligonucleotide
  Target: ATXN1; (+) strand; PAM type: NRG; PAM sequence: AGG
gagatctagattgggaaagc

SEQ ID NO: 105168 - DNA, 20 bp, Artificial Sequence
  Description of Artificial Sequence: Synthetic oligonucleotide
  Target: ATXN1; (+) strand; PAM type: NRG; PAM sequence: GGG
agatctagattgggaaagca

SEQ ID NO: 105169 - DNA, 20 bp, Artificial Sequence
  Description of Artificial Sequence: Synthetic oligonucleotide
  Target: ATXN1; (+) strand; PAM type: NRG; PAM sequence: GGG
gatctagattgggaaagcag

SEQ ID NO: 105170 - DNA, 20 bp, Artificial Sequence
  Description of Artificial Sequence: Synthetic oligonucleotide
  Target: ATXN1; (+) strand; PAM type: NRG; PAM sequence: AAG
gaaagcaggggtcatataaa

SEQ ID NO: 105171 - DNA, 20 bp, Artificial Sequence
  Description of Artificial Sequence: Synthetic oligonucleotide
  Target: ATXN1; (+) strand; PAM type: NRG; PAM sequence: TGG
ggtcatataaaaagctaata

SEQ ID NO: 105172 - DNA, 20 bp, Artificial Sequence
  Description of Artificial Sequence: Synthetic oligonucleotide
  Target: ATXN1; (+) strand; PAM type: NRG; PAM sequence: GAG
tcatataaaaagctaatatg

SEQ ID NO: 105173 - DNA, 20 bp, Artificial Sequence
  Description of Artificial Sequence: Synthetic oligonucleotide
  Target: ATXN1; (+) strand; PAM type: NRG; PAM sequence: AGG
catataaaaagctaatatgg

SEQ ID NO: 105174 - DNA, 20 bp, Artificial Sequence
  Description of Artificial Sequence: Synthetic oligonucleotide
  Target: ATXN1; (+) strand; PAM type: NRG; PAM sequence: TGG
aaagctaatatggaggactg

SEQ ID NO: 105175 - DNA, 20 bp, Artificial Sequence
  Description of Artificial Sequence: Synthetic oligonucleotide
  Target: ATXN1; (+) strand; PAM type: NRG; PAM sequence: CAG
tggaggactgtggtgacaat

SEQ ID NO: 105176 - DNA, 20 bp, Artificial Sequence
  Description of Artificial Sequence: Synthetic oligonucleotide
  Target: ATXN1; (+) strand; PAM type: NRG; PAM sequence: CGG
gtgacaatcagaccataata

SEQ ID NO: 105177 - DNA, 20 bp, Artificial Sequence
  Description of Artificial Sequence: Synthetic oligonucleotide
  Target: ATXN1; (+) strand; PAM type: NRG; PAM sequence: CAG
caatcagaccataatacgga

SEQ ID NO: 105178 - DNA, 20 bp, Artificial Sequence
  Description of Artificial Sequence: Synthetic oligonucleotide
  Target: ATXN1; (+) strand; PAM type: NRG; PAM sequence: CAG
ctttatattcttttcaccaa

SEQ ID NO: 105179 - DNA, 20 bp, Artificial Sequence
  Description of Artificial Sequence: Synthetic oligonucleotide
  Target: ATXN1; (+) strand; PAM type: NRG; PAM sequence: TGG
tcaccaacagtctcaaatgc

SEQ ID NO: 105180 - DNA, 20 bp, Artificial Sequence
  Description of Artificial Sequence: Synthetic oligonucleotide
  Target: ATXN1; (+) strand; PAM type: NRG; PAM sequence: CAG
acagtctcaaatgctggttt

SEQ ID NO: 105181 - DNA, 20 bp, Artificial Sequence
  Description of Artificial Sequence: Synthetic oligonucleotide
  Target: ATXN1; (+) strand; PAM type: NRG; PAM sequence: AAG
tcaaatgctggtttcagcat

SEQ ID NO: 105182 - DNA, 20 bp, Artificial Sequence
  Description of Artificial Sequence: Synthetic oligonucleotide
  Target: ATXN1; (+) strand; PAM type: NRG; PAM sequence: AGG
caaatgctggtttcagcata

SEQ ID NO: 105183 - DNA, 20 bp, Artificial Sequence
  Description of Artificial Sequence: Synthetic oligonucleotide
  Target: ATXN1; (+) strand; PAM type: NRG; PAM sequence: AAG
gctggtttcagcataaggcc

SEQ ID NO: 105184 - DNA, 20 bp, Artificial Sequence
  Description of Artificial Sequence: Synthetic oligonucleotide
  Target: ATXN1; (+) strand; PAM type: NRG; PAM sequence: TGG
ccaagaaacccaaatctata

SEQ ID NO: 105185 - DNA, 20 bp, Artificial Sequence
  Description of Artificial Sequence: Synthetic oligonucleotide
  Target: ATXN1; (+) strand; PAM type: NRG; PAM sequence: TAG
catcgatttatattcattta

SEQ ID NO: 105186 - DNA, 20 bp, Artificial Sequence
  Description of Artificial Sequence: Synthetic oligonucleotide
  Target: ATXN1; (+) strand; PAM type: NRG; PAM sequence: CAG
gttattccatttataaaatg

SEQ ID NO: 105187 - DNA, 20 bp, Artificial Sequence
  Description of Artificial Sequence: Synthetic oligonucleotide
  Target: ATXN1; (+) strand; PAM type: NRG; PAM sequence: TAG
ataaaatgcagcttatttta

SEQ ID NO: 105188 - DNA, 20 bp, Artificial Sequence
  Description of Artificial Sequence: Synthetic oligonucleotide
  Target: ATXN1; (+) strand; PAM type: NRG; PAM sequence: AGG
taaaatgcagcttattttat

SEQ ID NO: 105189 - DNA, 20 bp, Artificial Sequence
  Description of Artificial Sequence: Synthetic oligonucleotide
  Target: ATXN1; (+) strand; PAM type: NRG; PAM sequence: TGG
aatgcagcttattttatagg

SEQ ID NO: 105190 - DNA, 20 bp, Artificial Sequence
  Description of Artificial Sequence: Synthetic oligonucleotide
  Target: ATXN1; (+) strand; PAM type: NRG; PAM sequence: CAG
ttattttataggtggcgaaa

SEQ ID NO: 105191 - DNA, 20 bp, Artificial Sequence
  Description of Artificial Sequence: Synthetic oligonucleotide
  Target: ATXN1; (+) strand; PAM type: NRG; PAM sequence: AGG
tattttataggtggcgaaac

SEQ ID NO: 105192 - DNA, 20 bp, Artificial Sequence
  Description of Artificial Sequence: Synthetic oligonucleotide
  Target: ATXN1; (+) strand; PAM type: NRG; PAM sequence: TAG
tataggtggcgaaacaggcc

SEQ ID NO: 105193 - DNA, 20 bp, Artificial Sequence
  Description of Artificial Sequence: Synthetic oligonucleotide
  Target: ATXN1; (+) strand; PAM type: NRG; PAM sequence: GAG
taggtggcgaaacaggccta

SEQ ID NO: 105194 - DNA, 20 bp, Artificial Sequence
  Description of Artificial Sequence: Synthetic oligonucleotide
  Target: ATXN1; (+) strand; PAM type: NRG; PAM sequence: AAG
agagacaaatatgcactact

SEQ ID NO: 105195 - DNA, 20 bp, Artificial Sequence
  Description of Artificial Sequence: Synthetic oligonucleotide
  Target: ATXN1; (+) strand; PAM type: NRG; PAM sequence: AGG
gagacaaatatgcactacta

SEQ ID NO: 105196 - DNA, 20 bp, Artificial Sequence
  Description of Artificial Sequence: Synthetic oligonucleotide
  Target: ATXN1; (+) strand; PAM type: NRG; PAM sequence: TGG
tatgcactactaaggtccta

SEQ ID NO: 105197 - DNA, 20 bp, Artificial Sequence
  Description of Artificial Sequence: Synthetic oligonucleotide
  Target: ATXN1; (+) strand; PAM type: NRG; PAM sequence: GGG
atgcactactaaggtcctat

SEQ ID NO: 105198 - DNA, 20 bp, Artificial Sequence
  Description of Artificial Sequence: Synthetic oligonucleotide
  Target: ATXN1; (+) strand; PAM type: NRG; PAM sequence: GAG
tactaaggtcctatgggttt

SEQ ID NO: 105199 - DNA, 20 bp, Artificial Sequence
  Description of Artificial Sequence: Synthetic oligonucleotide
  Target: ATXN1; (+) strand; PAM type: NRG; PAM sequence: GAG
tttatttttttttgcttttt

SEQ ID NO: 105200 - DNA, 20 bp, Artificial Sequence
  Description of Artificial Sequence: Synthetic oligonucleotide
  Target: ATXN1; (+) strand; PAM type: NRG; PAM sequence: CAG
tttttttgctttttgagacg

SEQ ID NO: 105201 - DNA, 20 bp, Artificial Sequence
  Description of Artificial Sequence: Synthetic oligonucleotide
  Target: ATXN1; (+) strand; PAM type: NRG; PAM sequence: CAG
cgcagtctcactctgtcacc

SEQ ID NO: 105202 - DNA, 20 bp, Artificial Sequence
  Description of Artificial Sequence: Synthetic oligonucleotide
  Target: ATXN1; (+) strand; PAM type: NRG; PAM sequence: AGG
gcagtctcactctgtcaccc

SEQ ID NO: 105203 - DNA, 20 bp, Artificial Sequence
  Description of Artificial Sequence: Synthetic oligonucleotide
  Target: ATXN1; (+) strand; PAM type: NRG; PAM sequence: TGG
tctcactctgtcacccaggc

SEQ ID NO: 105204 - DNA, 20 bp, Artificial Sequence
  Description of Artificial Sequence: Synthetic oligonucleotide
  Target: ATXN1; (+) strand; PAM type: NRG; PAM sequence: GAG
tcactctgtcacccaggctg

SEQ ID NO: 105205 - DNA, 20 bp, Artificial Sequence
  Description of Artificial Sequence: Synthetic oligonucleotide
  Target: ATXN1; (+) strand; PAM type: NRG; PAM sequence: CAG
ctgtcacccaggctggagtg

SEQ ID NO: 105206 - DNA, 20 bp, Artificial Sequence
  Description of Artificial Sequence: Synthetic oligonucleotide
  Target: ATXN1; (+) strand; PAM type: NRG; PAM sequence: TGG
tcacccaggctggagtgcag

SEQ ID NO: 105207 - DNA, 20 bp, Artificial Sequence
  Description of Artificial Sequence: Synthetic oligonucleotide
  Target: ATXN1; (+) strand; PAM type: NRG; PAM sequence: CGG
ggagtgcagtggcgtgaccc

SEQ ID NO: 105208 - DNA, 20 bp, Artificial Sequence
  Description of Artificial Sequence: Synthetic oligonucleotide
  Target: ATXN1; (+) strand; PAM type: NRG; PAM sequence: CGG
tcactgcaacctctgcctcc

SEQ ID NO: 105209 - DNA, 20 bp, Artificial Sequence
  Description of Artificial Sequence: Synthetic oligonucleotide
  Target: ATXN1; (+) strand; PAM type: NRG; PAM sequence: GGG
cactgcaacctctgcctccc

SEQ ID NO: 105210 - DNA, 20 bp, Artificial Sequence
  Description of Artificial Sequence: Synthetic oligonucleotide
  Target: ATXN1; (+) strand; PAM type: NRG; PAM sequence: AAG
aacctctgcctcccgggttc

SEQ ID NO: 105211 - DNA, 20 bp, Artificial Sequence
  Description of Artificial Sequence: Synthetic oligonucleotide
  Target: ATXN1; (+) strand; PAM type: NRG; PAM sequence: CGG
ctctgcctcccgggttcaag

SEQ ID NO: 105212 - DNA, 20 bp, Artificial Sequence
  Description of Artificial Sequence: Synthetic oligonucleotide
  Target: ATXN1; (+) strand; PAM type: NRG; PAM sequence: CAG
ttcaagcggttcttctgcct

SEQ ID NO: 105213 - DNA, 20 bp, Artificial Sequence
  Description of Artificial Sequence: Synthetic oligonucleotide
  Target: ATXN1; (+) strand; PAM type: NRG; PAM sequence: GAG
ttcttctgcctcagcctcct

SEQ ID NO: 105214 - DNA, 20 bp, Artificial Sequence
  Description of Artificial Sequence: Synthetic oligonucleotide
  Target: ATXN1; (+) strand; PAM type: NRG; PAM sequence: TAG
ttctgcctcagcctcctgag

SEQ ID NO: 105215 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcctgagtagc

SEQ ID NO: 105216 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcctgagtagct

SEQ ID NO: 105217 - DNA, 20 bp, Artificial Sequence
  Description of Artificial Sequence: Synthetic oligonucleotide
  Target: ATXN1; (+) strand; PAM type: NRG; PAM sequence: CAG
ctcctgagtagctgggacta

SEQ ID NO: 105218 - DNA, 20 bp, Artificial Sequence
  Description of Artificial Sequence: Synthetic oligonucleotide
  Target: ATXN1; (+) strand; PAM type: NRG; PAM sequence: AGG
tcctgagtagctgggactac

SEQ ID NO: 105219 - DNA, 20 bp, Artificial Sequence
  Description of Artificial Sequence: Synthetic oligonucleotide
  Target: ATXN1; (+) strand; PAM type: NRG; PAM sequence: CGG
caggtgcccgccaccatgcc

SEQ ID NO: 105220 - DNA, 20 bp, Artificial Sequence
  Description of Artificial Sequence: Synthetic oligonucleotide
  Target: ATXN1; (+) strand; PAM type: NRG; PAM sequence: TGG
ccggctaatttttgtatttt

SEQ ID NO: 105221 - DNA, 20 bp, Artificial Sequence
  Description of Artificial Sequence: Synthetic oligonucleotide
  Target: ATXN1; (+) strand; PAM type: NRG; PAM sequence: TAG
gctaatttttgtatttttgg

SEQ ID NO: 105222 - DNA, 20 bp, Artificial Sequence
  Description of Artificial Sequence: Synthetic oligonucleotide
  Target: ATXN1; (+) strand; PAM type: NRG; PAM sequence: GAG
taatttttgtatttttggta

SEQ ID NO: 105223 - DNA, 20 bp, Artificial Sequence
  Description of Artificial Sequence: Synthetic oligonucleotide
  Target: ATXN1; (+) strand; PAM type: NRG; PAM sequence: AGG
aatttttgtatttttggtag

SEQ ID NO: 105224 - DNA, 20 bp, Artificial Sequence
  Description of Artificial Sequence: Synthetic oligonucleotide
  Target: ATXN1; (+) strand; PAM type: NRG; PAM sequence: GAG
tttgtatttttggtagaggc

SEQ ID NO: 105225 - DNA, 20 bp, Artificial Sequence
  Description of Artificial Sequence: Synthetic oligonucleotide
  Target: ATXN1; (+) strand; PAM type: NRG; PAM sequence: TGG
gaggcgagatttcaccatgt

SEQ ID NO: 105226 - DNA, 20 bp, Artificial Sequence
  Description of Artificial Sequence: Synthetic oligonucleotide
  Target: ATXN1; (+) strand; PAM type: NRG; PAM sequence: CAG
cgagatttcaccatgttggt

SEQ ID NO: 105227 - DNA, 20 bp, Artificial Sequence
  Description of Artificial Sequence: Synthetic oligonucleotide
  Target: ATXN1; (+) strand; PAM type: NRG; PAM sequence: AGG
gagatttcaccatgttggtc

SEQ ID NO: 105228 - DNA, 20 bp, Artificial Sequence
  Description of Artificial Sequence: Synthetic oligonucleotide
  Target: ATXN1; (+) strand; PAM type: NRG; PAM sequence: TGG
tttcaccatgttggtcaggc

SEQ ID NO: 105229 - DNA, 20 bp, Artificial Sequence
  Description of Artificial Sequence: Synthetic oligonucleotide
  Target: ATXN1; (+) strand; PAM type: NRG; PAM sequence: CGG
ctcaaatgatccacccacat

SEQ ID NO: 105230 - DNA, 20 bp, Artificial Sequence
  Description of Artificial Sequence: Synthetic oligonucleotide
  Target: ATXN1; (+) strand; PAM type: NRG; PAM sequence: AAG
ccacccacatcggcctccca

SEQ ID NO: 105231 - DNA, 20 bp, Artificial Sequence
  Description of Artificial Sequence: Synthetic oligonucleotide
  Target: ATXN1; (+) strand; PAM type: NRG; PAM sequence: TGG
acatcggcctcccaaagtgc

SEQ ID NO: 105232 - DNA, 20 bp, Artificial Sequence
  Description of Artificial Sequence: Synthetic oligonucleotide
  Target: ATXN1; (+) strand; PAM type: NRG; PAM sequence: GGG
catcggcctcccaaagtgct

SEQ ID NO: 105233 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 105234 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 105235 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggtgt

SEQ ID NO: 105236 - DNA, 20 bp, Artificial Sequence
  Description of Artificial Sequence: Synthetic oligonucleotide
  Target: ATXN1; (+) strand; PAM type: NRG; PAM sequence: TGG
caggtgtgagccaccatgcc

SEQ ID NO: 105237 - DNA, 20 bp, Artificial Sequence
  Description of Artificial Sequence: Synthetic oligonucleotide
  Target: ATXN1; (+) strand; PAM type: NRG; PAM sequence: AAG
gtgagccaccatgcctggcc

SEQ ID NO: 105238 - DNA, 20 bp, Artificial Sequence
  Description of Artificial Sequence: Synthetic oligonucleotide
  Target: ATXN1; (+) strand; PAM type: NRG; PAM sequence: GAG
ttttaattaaatgcttaacc

SEQ ID NO: 105239 - DNA, 20 bp, Artificial Sequence
  Description of Artificial Sequence: Synthetic oligonucleotide
  Target: ATXN1; (+) strand; PAM type: NRG; PAM sequence: CAG
attaaatgcttaaccgagtc

SEQ ID NO: 105240 - DNA, 20 bp, Artificial Sequence
  Description of Artificial Sequence: Synthetic oligonucleotide
  Target: ATXN1; (+) strand; PAM type: NRG; PAM sequence: TGG
acactttccactctacacca

SEQ ID NO: 105241 - DNA, 20 bp, Artificial Sequence
  Description of Artificial Sequence: Synthetic oligonucleotide
  Target: ATXN1; (+) strand; PAM type: NRG; PAM sequence: CAG
ctacaccatggctccccgtg

SEQ ID NO: 105242 - DNA, 20 bp, Artificial Sequence
  Description of Artificial Sequence: Synthetic oligonucleotide
  Target: ATXN1; (+) strand; PAM type: NRG; PAM sequence: AAG
caccatggctccccgtgcag

SEQ ID NO: 105243 - DNA, 20 bp, Artificial Sequence
  Description of Artificial Sequence: Synthetic oligonucleotide
  Target: ATXN1; (+) strand; PAM type: NRG; PAM sequence: CAG
gcagaagactgcaatccaat

SEQ ID NO: 105244 - DNA, 20 bp, Artificial Sequence
  Description of Artificial Sequence: Synthetic oligonucleotide
  Target: ATXN1; (+) strand; PAM type: NRG; PAM sequence: CAG
agactgcaatccaatcagct

SEQ ID NO: 105245 - DNA, 20 bp, Artificial Sequence
  Description of Artificial Sequence: Synthetic oligonucleotide
  Target: ATXN1; (+) strand; PAM type: NRG; PAM sequence: CAG
aatccaatcagctcagttcc

SEQ ID NO: 105246 - DNA, 20 bp, Artificial Sequence
  Description of Artificial Sequence: Synthetic oligonucleotide
  Target: ATXN1; (+) strand; PAM type: NRG; PAM sequence: GAG
tccaatcagctcagttccca

SEQ ID NO: 105247 - DNA, 20 bp, Artificial Sequence
  Description of Artificial Sequence: Synthetic oligonucleotide
  Target: ATXN1; (+) strand; PAM type: NRG; PAM sequence: AGG
ccaatcagctcagttcccag

SEQ ID NO: 105248 - DNA, 20 bp, Artificial Sequence
  Description of Artificial Sequence: Synthetic oligonucleotide
  Target: ATXN1; (+) strand; PAM type: NRG; PAM sequence: GGG
caatcagctcagttcccaga

SEQ ID NO: 105249 - DNA, 20 bp, Artificial Sequence
  Description of Artificial Sequence: Synthetic oligonucleotide
  Target: ATXN1; (+) strand; PAM type: NRG; PAM sequence: TAG
agctcagttcccagagggtc

SEQ ID NO: 105250 - DNA, 20 bp, Artificial Sequence
  Description of Artificial Sequence: Synthetic oligonucleotide
  Target: ATXN1; (+) strand; PAM type: NRG; PAM sequence: CAG
gttcccagagggtctagact

SEQ ID NO: 105251 - DNA, 20 bp, Artificial Sequence
  Description of Artificial Sequence: Synthetic oligonucleotide
  Target: ATXN1; (+) strand; PAM type: NRG; PAM sequence: AGG
ttcccagagggtctagactc

SEQ ID NO: 105252 - DNA, 20 bp, Artificial Sequence
  Description of Artificial Sequence: Synthetic oligonucleotide
  Target: ATXN1; (+) strand; PAM type: NRG; PAM sequence: TAG
ccagagggtctagactcagg

SEQ ID NO: 105253 - DNA, 20 bp, Artificial Sequence
  Description of Artificial Sequence: Synthetic oligonucleotide
  Target: ATXN1; (+) strand; PAM type: NRG; PAM sequence: TGG
tcaggtagcgacaataaaca

SEQ ID NO: 105254 - DNA, 20 bp, Artificial Sequence
  Description of Artificial Sequence: Synthetic oligonucleotide
  Target: ATXN1; (+) strand; PAM type: NRG; PAM sequence: AAG
ggtagcgacaataaacatgg

SEQ ID NO: 105255 - DNA, 20 bp, Artificial Sequence
  Description of Artificial Sequence: Synthetic oligonucleotide
  Target: ATXN1; (+) strand; PAM type: NRG; PAM sequence: GAG
tagcgacaataaacatggaa

SEQ ID NO: 105256 - DNA, 20 bp, Artificial Sequence
  Description of Artificial Sequence: Synthetic oligonucleotide
  Target: ATXN1; (+) strand; PAM type: NRG; PAM sequence: GAG
gcgacaataaacatggaaga

SEQ ID NO: 105257 - DNA, 20 bp, Artificial Sequence
  Description of Artificial Sequence: Synthetic oligonucleotide
  Target: ATXN1; (+) strand; PAM type: NRG; PAM sequence: TGG
atggaagagagacaaaaaat

SEQ ID NO: 105258 - DNA, 20 bp, Artificial Sequence
  Description of Artificial Sequence: Synthetic oligonucleotide
  Target: ATXN1; (+) strand; PAM type: NRG; PAM sequence: AAG
aagagagacaaaaaattggc

SEQ ID NO: 105259 - DNA, 20 bp, Artificial Sequence
  Description of Artificial Sequence: Synthetic oligonucleotide
  Target: ATXN1; (+) strand; PAM type: NRG; PAM sequence: AGG
agagagacaaaaaattggca

SEQ ID NO: 105260 - DNA, 20 bp, Artificial Sequence
  Description of Artificial Sequence: Synthetic oligonucleotide
  Target: ATXN1; (+) strand; PAM type: NRG; PAM sequence: GAG
acaaaaaattggcaaggctc

SEQ ID NO: 105261 - DNA, 20 bp, Artificial Sequence
  Description of Artificial Sequence: Synthetic oligonucleotide
  Target: ATXN1; (+) strand; PAM type: NRG; PAM sequence: AGG
caaaaaattggcaaggctcg

SEQ ID NO: 105262 - DNA, 20 bp, Artificial Sequence
  Description of Artificial Sequence: Synthetic oligonucleotide
  Target: ATXN1; (+) strand; PAM type: NRG; PAM sequence: TGG
aaggctcgaggaatgattga

SEQ ID NO: 105263 - DNA, 20 bp, Artificial Sequence
  Description of Artificial Sequence: Synthetic oligonucleotide
  Target: ATXN1; (+) strand; PAM type: NRG; PAM sequence: AAG
gctcgaggaatgattgatgg

SEQ ID NO: 105264 - DNA, 20 bp, Artificial Sequence
  Description of Artificial Sequence: Synthetic oligonucleotide
  Target: ATXN1; (+) strand; PAM type: NRG; PAM sequence: TGG
gaggaatgattgatggaagc

SEQ ID NO: 105265 - DNA, 20 bp, Artificial Sequence
  Description of Artificial Sequence: Synthetic oligonucleotide
  Target: ATXN1; (+) strand; PAM type: NRG; PAM sequence: GGG
aggaatgattgatggaagct

SEQ ID NO: 105266 - DNA, 20 bp, Artificial Sequence
  Description of Artificial Sequence: Synthetic oligonucleotide
  Target: ATXN1; (+) strand; PAM type: NRG; PAM sequence: AAG
atggaagctgggttgaacca

SEQ ID NO: 105267 - DNA, 20 bp, Artificial Sequence
  Description of Artificial Sequence: Synthetic oligonucleotide
  Target: ATXN1; (+) strand; PAM type: NRG; PAM sequence: AGG
tggaagctgggttgaaccaa

SEQ ID NO: 105268 - DNA, 20 bp, Artificial Sequence
  Description of Artificial Sequence: Synthetic oligonucleotide
  Target: ATXN1; (+) strand; PAM type: NRG; PAM sequence: GAG
gaagctgggttgaaccaaag

SEQ ID NO: 105269 - DNA, 20 bp, Artificial Sequence
  Description of Artificial Sequence: Synthetic oligonucleotide
  Target: ATXN1; (+) strand; PAM type: NRG; PAM sequence: TGG
gctgggttgaaccaaaggag

SEQ ID NO: 105270 - DNA, 20 bp, Artificial Sequence
  Description of Artificial Sequence: Synthetic oligonucleotide
  Target: ATXN1; (+) strand; PAM type: NRG; PAM sequence: GGG
ctgggttgaaccaaaggagt

SEQ ID NO: 105271 - DNA, 20 bp, Artificial Sequence
  Description of Artificial Sequence: Synthetic oligonucleotide
  Target: ATXN1; (+) strand; PAM type: NRG; PAM sequence: GAG
gggttgaaccaaaggagtgg

SEQ ID NO: 105272 - DNA, 20 bp, Artificial Sequence
  Description of Artificial Sequence: Synthetic oligonucleotide
  Target: ATXN1; (+) strand; PAM type: NRG; PAM sequence: CAG
accaaaggagtgggagctct

SEQ ID NO: 105273 - DNA, 20 bp, Artificial Sequence
  Description of Artificial Sequence: Synthetic oligonucleotide
  Target: ATXN1; (+) strand; PAM type: NRG; PAM sequence: AGG
ccaaaggagtgggagctctc

SEQ ID NO: 105274 - DNA, 20 bp, Artificial Sequence
  Description of Artificial Sequence: Synthetic oligonucleotide
  Target: ATXN1; (+) strand; PAM type: NRG; PAM sequence: TGG
aaggagtgggagctctcagg

SEQ ID NO: 105275 - DNA, 20 bp, Artificial Sequence
  Description of Artificial Sequence: Synthetic oligonucleotide
  Target: ATXN1; (+) strand; PAM type: NRG; PAM sequence: GGG
aggagtgggagctctcaggt

SEQ ID NO: 105276 - DNA, 20 bp, Artificial Sequence
  Description of Artificial Sequence: Synthetic oligonucleotide
  Target: ATXN1; (+) strand; PAM type: NRG; PAM sequence: TAG
tgggagctctcaggtgggaa

SEQ ID NO: 105277 - DNA, 20 bp, Artificial Sequence
  Description of Artificial Sequence: Synthetic oligonucleotide
  Target: ATXN1; (+) strand; PAM type: NRG; PAM sequence: AGG
gggagctctcaggtgggaat

SEQ ID NO: 105278 - DNA, 20 bp, Artificial Sequence
  Description of Artificial Sequence: Synthetic oligonucleotide
  Target: ATXN1; (+) strand; PAM type: NRG; PAM sequence: AAG
gctctcaggtgggaatagga

SEQ ID NO: 105279 - DNA, 20 bp, Artificial Sequence
  Description of Artificial Sequence: Synthetic oligonucleotide
  Target: ATXN1; (+) strand; PAM type: NRG; PAM sequence: AGG
ctctcaggtgggaataggaa

SEQ ID NO: 105280 - DNA, 20 bp, Artificial Sequence
  Description of Artificial Sequence: Synthetic oligonucleotide
  Target: ATXN1; (+) strand; PAM type: NRG; PAM sequence: AAG
aggaaaggtacaactgcaat

SEQ ID NO: 105281 - DNA, 20 bp, Artificial Sequence
  Description of Artificial Sequence: Synthetic oligonucleotide
  Target: ATXN1; (+) strand; PAM type: NRG; PAM sequence: CAG
tacaactgcaataagataca

SEQ ID NO: 105282 - DNA, 20 bp, Artificial Sequence
  Description of Artificial Sequence: Synthetic oligonucleotide
  Target: ATXN1; (+) strand; PAM type: NRG; PAM sequence: TGG
ctgcaataagatacacagaa

SEQ ID NO: 105283 - DNA, 20 bp, Artificial Sequence
  Description of Artificial Sequence: Synthetic oligonucleotide
  Target: ATXN1; (+) strand; PAM type: NRG; PAM sequence: CAG
aataagatacacagaatgga

SEQ ID NO: 105284 - DNA, 20 bp, Artificial Sequence
  Description of Artificial Sequence: Synthetic oligonucleotide
  Target: ATXN1; (+) strand; PAM type: NRG; PAM sequence: GAG
taagatacacagaatggaca

SEQ ID NO: 105285 - DNA, 20 bp, Artificial Sequence
  Description of Artificial Sequence: Synthetic oligonucleotide
  Target: ATXN1; (+) strand; PAM type: NRG; PAM sequence: AAG
cacagaatggacagagtgct

SEQ ID NO: 105286 - DNA, 20 bp, Artificial Sequence
  Description of Artificial Sequence: Synthetic oligonucleotide
  Target: ATXN1; (+) strand; PAM type: NRG; PAM sequence: TAG
gaatggacagagtgctaagc

SEQ ID NO: 105287 - DNA, 20 bp, Artificial Sequence
  Description of Artificial Sequence: Synthetic oligonucleotide
  Target: ATXN1; (+) strand; PAM type: NRG; PAM sequence: GAG
atggacagagtgctaagcta

SEQ ID NO: 105288 - DNA, 20 bp, Artificial Sequence
  Description of Artificial Sequence: Synthetic oligonucleotide
  Target: ATXN1; (+) strand; PAM type: NRG; PAM sequence: AGG
tggacagagtgctaagctag

SEQ ID NO: 105289 - DNA, 20 bp, Artificial Sequence
  Description of Artificial Sequence: Synthetic oligonucleotide
  Target: ATXN1; (+) strand; PAM type: NRG; PAM sequence: GAG
gacagagtgctaagctagag

SEQ ID NO: 105290 - DNA, 20 bp, Artificial Sequence
  Description of Artificial Sequence: Synthetic oligonucleotide
  Target: ATXN1; (+) strand; PAM type: NRG; PAM sequence: AGG
acagagtgctaagctagagg

SEQ ID NO: 105291 - DNA, 20 bp, Artificial Sequence
  Description of Artificial Sequence: Synthetic oligonucleotide
  Target: ATXN1; (+) strand; PAM type: NRG; PAM sequence: GGG
cagagtgctaagctagagga

SEQ ID NO: 105292 - DNA, 20 bp, Artificial Sequence
  Description of Artificial Sequence: Synthetic oligonucleotide
  Target: ATXN1; (+) strand; PAM type: NRG; PAM sequence: GGG
agagtgctaagctagaggag

SEQ ID NO: 105293 - DNA, 20 bp, Artificial Sequence
  Description of Artificial Sequence: Synthetic oligonucleotide
  Target: ATXN1; (+) strand; PAM type: NRG; PAM sequence: CAG
gtgctaagctagaggagggg

SEQ ID NO: 105294 - DNA, 20 bp, Artificial Sequence
  Description of Artificial Sequence: Synthetic oligonucleotide
  Target: ATXN1; (+) strand; PAM type: NRG; PAM sequence: AAG
tagaggaggggcagataata

SEQ ID NO: 105295 - DNA, 20 bp, Artificial Sequence
  Description of Artificial Sequence: Synthetic oligonucleotide
  Target: ATXN1; (+) strand; PAM type: NRG; PAM sequence: AAG
gataataaagctcgttaata

SEQ ID NO: 105296 - DNA, 20 bp, Artificial Sequence
  Description of Artificial Sequence: Synthetic oligonucleotide
  Target: ATXN1; (+) strand; PAM type: NRG; PAM sequence: TAG
ataaagctcgttaataaaga

SEQ ID NO: 105297 - DNA, 20 bp, Artificial Sequence
  Description of Artificial Sequence: Synthetic oligonucleotide
  Target: ATXN1; (+) strand; PAM type: NRG; PAM sequence: AAG
agctcgttaataaagatagt

SEQ ID NO: 105298 - DNA, 20 bp, Artificial Sequence
  Description of Artificial Sequence: Synthetic oligonucleotide
  Target: ATXN1; (+) strand; PAM type: NRG; PAM sequence: TAG
taaagatagtaagacccatt

SEQ ID NO: 105299 - DNA, 20 bp, Artificial Sequence
  Description of Artificial Sequence: Synthetic oligonucleotide
  Target: ATXN1; (+) strand; PAM type: NRG; PAM sequence: TGG
aagacccatttagctttacg

SEQ ID NO: 105300 - DNA, 20 bp, Artificial Sequence
  Description of Artificial Sequence: Synthetic oligonucleotide
  Target: ATXN1; (+) strand; PAM type: NRG; PAM sequence: AAG
atttagctttacgtggctct

SEQ ID NO: 105301 - DNA, 20 bp, Artificial Sequence
  Description of Artificial Sequence: Synthetic oligonucleotide
  Target: ATXN1; (+) strand; PAM type: NRG; PAM sequence: CAG
gtggctctaagataaacata

SEQ ID NO: 105302 - DNA, 20 bp, Artificial Sequence
  Description of Artificial Sequence: Synthetic oligonucleotide
  Target: ATXN1; (+) strand; PAM type: NRG; PAM sequence: AGG
tggctctaagataaacatac

SEQ ID NO: 105303 - DNA, 20 bp, Artificial Sequence
  Description of Artificial Sequence: Synthetic oligonucleotide
  Target: ATXN1; (+) strand; PAM type: NRG; PAM sequence: AAG
acatacaggaactctcctga

SEQ ID NO: 105304 - DNA, 20 bp, Artificial Sequence
  Description of Artificial Sequence: Synthetic oligonucleotide
  Target: ATXN1; (+) strand; PAM type: NRG; PAM sequence: AGG
catacaggaactctcctgaa

SEQ ID NO: 105305 - DNA, 20 bp, Artificial Sequence
  Description of Artificial Sequence: Synthetic oligonucleotide
  Target: ATXN1; (+) strand; PAM type: NRG; PAM sequence: AAG
ggaactctcctgaaaggacc

SEQ ID NO: 105306 - DNA, 20 bp, Artificial Sequence
  Description of Artificial Sequence: Synthetic oligonucleotide
  Target: ATXN1; (+) strand; PAM type: NRG; PAM sequence: GAG
aactctcctgaaaggaccaa

SEQ ID NO: 105307 - DNA, 20 bp, Artificial Sequence
  Description of Artificial Sequence: Synthetic oligonucleotide
  Target: ATXN1; (+) strand; PAM type: NRG; PAM sequence: TAG
tctcctgaaaggaccaagag

SEQ ID NO: 105308 - DNA, 20 bp, Artificial Sequence
  Description of Artificial Sequence: Synthetic oligonucleotide
  Target: ATXN1; (+) strand; PAM type: NRG; PAM sequence: AGG
ctcctgaaaggaccaagagt

SEQ ID NO: 105309 - DNA, 20 bp, Artificial Sequence
  Description of Artificial Sequence: Synthetic oligonucleotide
  Target: ATXN1; (+) strand; PAM type: NRG; PAM sequence: AAG
tgaaaggaccaagagtaggt

SEQ ID NO: 105310 - DNA, 20 bp, Artificial Sequence
  Description of Artificial Sequence: Synthetic oligonucleotide
  Target: ATXN1; (+) strand; PAM type: NRG; PAM sequence: AGG
gaaaggaccaagagtaggta

SEQ ID NO: 105311 - DNA, 20 bp, Artificial Sequence
  Description of Artificial Sequence: Synthetic oligonucleotide
  Target: ATXN1; (+) strand; PAM type: NRG; PAM sequence: GGG
aaaggaccaagagtaggtaa

SEQ ID NO: 105312 - DNA, 20 bp, Artificial Sequence
  Description of Artificial Sequence: Synthetic oligonucleotide
  Target: ATXN1; (+) strand; PAM type: NRG; PAM sequence: CGG
accaagagtaggtaagggaa

SEQ ID NO: 105313 - DNA, 20 bp, Artificial Sequence
  Description of Artificial Sequence: Synthetic oligonucleotide
  Target: ATXN1; (+) strand; PAM type: NRG; PAM sequence: GGG
ccaagagtaggtaagggaac

SEQ ID NO: 105314 - DNA, 20 bp, Artificial Sequence
  Description of Artificial Sequence: Synthetic oligonucleotide
  Target: ATXN1; (+) strand; PAM type: NRG; PAM sequence: GGG
caagagtaggtaagggaacg

SEQ ID NO: 105315 - DNA, 20 bp, Artificial Sequence
  Description of Artificial Sequence: Synthetic oligonucleotide
  Target: ATXN1; (+) strand; PAM type: NRG; PAM sequence: CAG
taggtaagggaacggggtga

SEQ ID NO: 105316 - DNA, 20 bp, Artificial Sequence
  Description of Artificial Sequence: Synthetic oligonucleotide
  Target: ATXN1; (+) strand; PAM type: NRG; PAM sequence: AAG
gtaagggaacggggtgacag

SEQ ID NO: 105317 - DNA, 20 bp, Artificial Sequence
  Description of Artificial Sequence: Synthetic oligonucleotide
  Target: ATXN1; (+) strand; PAM type: NRG; PAM sequence: CAG
agggaacggggtgacagaag

SEQ ID NO: 105318 - DNA, 20 bp, Artificial Sequence
  Description of Artificial Sequence: Synthetic oligonucleotide
  Target: ATXN1; (+) strand; PAM type: NRG; PAM sequence: CAG
cggggtgacagaagcagcac

SEQ ID NO: 105319 - DNA, 20 bp, Artificial Sequence
  Description of Artificial Sequence: Synthetic oligonucleotide
  Target: ATXN1; (+) strand; PAM type: NRG; PAM sequence: CGG
acagaagcagcaccagtacc

SEQ ID NO: 105320 - DNA, 20 bp, Artificial Sequence
  Description of Artificial Sequence: Synthetic oligonucleotide
  Target: ATXN1; (+) strand; PAM type: NRG; PAM sequence: GGG
cagaagcagcaccagtaccc

SEQ ID NO: 105321 - DNA, 20 bp, Artificial Sequence
  Description of Artificial Sequence: Synthetic oligonucleotide
  Target: ATXN1; (+) strand; PAM type: NRG; PAM sequence: GAG
gaagcagcaccagtacccgg

SEQ ID NO: 105322 - DNA, 20 bp, Artificial Sequence
  Description of Artificial Sequence: Synthetic oligonucleotide
  Target: ATXN1; (+) strand; PAM type: NRG; PAM sequence: AGG
aagcagcaccagtacccggg

SEQ ID NO: 105323 - DNA, 20 bp, Artificial Sequence
  Description of Artificial Sequence: Synthetic oligonucleotide
  Target: ATXN1; (+) strand; PAM type: NRG; PAM sequence: GGG
agcagcaccagtacccggga

SEQ ID NO: 105324 - DNA, 20 bp, Artificial Sequence
  Description of Artificial Sequence: Synthetic oligonucleotide
  Target: ATXN1; (+) strand; PAM type: NRG; PAM sequence: AAG
agcaccagtacccgggaggg

SEQ ID NO: 105325 - DNA, 20 bp, Artificial Sequence
  Description of Artificial Sequence: Synthetic oligonucleotide
  Target: ATXN1; (+) strand; PAM type: NRG; PAM sequence: TGG
cccgggagggaagctgacac

SEQ ID NO: 105326 - DNA, 20 bp, Artificial Sequence
  Description of Artificial Sequence: Synthetic oligonucleotide
  Target: ATXN1; (+) strand; PAM type: NRG; PAM sequence: GGG
ccgggagggaagctgacact

SEQ ID NO: 105327 - DNA, 20 bp, Artificial Sequence
  Description of Artificial Sequence: Synthetic oligonucleotide
  Target: ATXN1; (+) strand; PAM type: NRG; PAM sequence: GAG
gggagggaagctgacactgg

SEQ ID NO: 105328 - DNA, 20 bp, Artificial Sequence
  Description of Artificial Sequence: Synthetic oligonucleotide
  Target: ATXN1; (+) strand; PAM type: NRG; PAM sequence: AAG
tgacactgggagaaatatcc

SEQ ID NO: 105329 - DNA, 20 bp, Artificial Sequence
  Description of Artificial Sequence: Synthetic oligonucleotide
  Target: ATXN1; (+) strand; PAM type: NRG; PAM sequence: AAG
actgggagaaatatccaaga

SEQ ID NO: 105330 - DNA, 20 bp, Artificial Sequence
  Description of Artificial Sequence: Synthetic oligonucleotide
  Target: ATXN1; (+) strand; PAM type: NRG; PAM sequence: AGG
ctgggagaaatatccaagaa

SEQ ID NO: 105331 - DNA, 20 bp, Artificial Sequence
  Description of Artificial Sequence: Synthetic oligonucleotide
  Target: ATXN1; (+) strand; PAM type: NRG; PAM sequence: AAG
tatccaagaaaggcaatcaa

SEQ ID NO: 105332 - DNA, 20 bp, Artificial Sequence
  Description of Artificial Sequence: Synthetic oligonucleotide
  Target: ATXN1; (+) strand; PAM type: NRG; PAM sequence: AGG
atccaagaaaggcaatcaaa

SEQ ID NO: 105333 - DNA, 20 bp, Artificial Sequence
  Description of Artificial Sequence: Synthetic oligonucleotide
  Target: ATXN1; (+) strand; PAM type: NRG; PAM sequence: AAG
aagaaaggcaatcaaaaggc

SEQ ID NO: 105334 - DNA, 20 bp, Artificial Sequence
  Description of Artificial Sequence: Synthetic oligonucleotide
  Target: ATXN1; (+) strand; PAM type: NRG; PAM sequence: AAG
aaaggcaatcaaaaggcaag

SEQ ID NO: 105335 - DNA, 20 bp, Artificial Sequence
  Description of Artificial Sequence: Synthetic oligonucleotide
  Target: ATXN1; (+) strand; PAM type: NRG; PAM sequence: GAG
aggcaatcaaaaggcaagaa

SEQ ID NO: 105336 - DNA, 20 bp, Artificial Sequence
  Description of Artificial Sequence: Synthetic oligonucleotide
  Target: ATXN1; (+) strand; PAM type: NRG; PAM sequence: TGG
gcaaacacctaccataattt

SEQ ID NO: 105337 - DNA, 20 bp, Artificial Sequence
  Description of Artificial Sequence: Synthetic oligonucleotide
  Target: ATXN1; (+) strand; PAM type: NRG; PAM sequence: TAG
acacctaccataattttggt

SEQ ID NO: 105338 - DNA, 20 bp, Artificial Sequence
  Description of Artificial Sequence: Synthetic oligonucleotide
  Target: ATXN1; (+) strand; PAM type: NRG; PAM sequence: GAG
acctaccataattttggtta

SEQ ID NO: 105339 - DNA, 20 bp, Artificial Sequence
  Description of Artificial Sequence: Synthetic oligonucleotide
  Target: ATXN1; (+) strand; PAM type: NRG; PAM sequence: GAG
ctaccataattttggttaga

SEQ ID NO: 105340 - DNA, 20 bp, Artificial Sequence
  Description of Artificial Sequence: Synthetic oligonucleotide
  Target: ATXN1; (+) strand; PAM type: NRG; PAM sequence: GAG
accataattttggttagaga

SEQ ID NO: 105341 - DNA, 20 bp, Artificial Sequence
  Description of Artificial Sequence: Synthetic oligonucleotide
  Target: ATXN1; (+) strand; PAM type: NRG; PAM sequence: AGG
ccataattttggttagagag

SEQ ID NO: 105342 - DNA, 20 bp, Artificial Sequence
  Description of Artificial Sequence: Synthetic oligonucleotide
  Target: ATXN1; (+) strand; PAM type: NRG; PAM sequence: AAG
attttggttagagagaggaa

SEQ ID NO: 105343 - DNA, 20 bp, Artificial Sequence
  Description of Artificial Sequence: Synthetic oligonucleotide
  Target: ATXN1; (+) strand; PAM type: NRG; PAM sequence: TAG
ttggttagagagaggaaaag

SEQ ID NO: 105344 - DNA, 20 bp, Artificial Sequence
  Description of Artificial Sequence: Synthetic oligonucleotide
  Target: ATXN1; (+) strand; PAM type: NRG; PAM sequence: AAG
tagagagaggaaaagtagtc

SEQ ID NO: 105345 - DNA, 20 bp, Artificial Sequence
  Description of Artificial Sequence: Synthetic oligonucleotide
  Target: ATXN1; (+) strand; PAM type: NRG; PAM sequence: AAG
agagaggaaaagtagtcaag

SEQ ID NO: 105346 - DNA, 20 bp, Artificial Sequence
  Description of Artificial Sequence: Synthetic oligonucleotide
  Target: ATXN1; (+) strand; PAM type: NRG; PAM sequence: AGG
gagaggaaaagtagtcaaga

SEQ ID NO: 105347 - DNA, 20 bp, Artificial Sequence
  Description of Artificial Sequence: Synthetic oligonucleotide
  Target: ATXN1; (+) strand; PAM type: NRG; PAM sequence: GGG
agaggaaaagtagtcaagaa

SEQ ID NO: 105348 - DNA, 20 bp, Artificial Sequence
  Description of Artificial Sequence: Synthetic oligonucleotide
  Target: ATXN1; (+) strand; PAM type: NRG; PAM sequence: AAG
aaaagtagtcaagaagggcg

SEQ ID NO: 105349 - DNA, 20 bp, Artificial Sequence
  Description of Artificial Sequence: Synthetic oligonucleotide
  Target: ATXN1; (+) strand; PAM type: NRG; PAM sequence: TGG
gaagggcgaagatgcaaaaa

SEQ ID NO: 105350 - DNA, 20 bp, Artificial Sequence
  Description of Artificial Sequence: Synthetic oligonucleotide
  Target: ATXN1; (+) strand; PAM type: NRG; PAM sequence: TAG
ggccataataaaaaaaatga

SEQ ID NO: 105351 - DNA, 20 bp, Artificial Sequence
  Description of Artificial Sequence: Synthetic oligonucleotide
  Target: ATXN1; (+) strand; PAM type: NRG; PAM sequence: TGG
aaaaaaatgatagatattga

SEQ ID NO: 105352 - DNA, 20 bp, Artificial Sequence
  Description of Artificial Sequence: Synthetic oligonucleotide
  Target: ATXN1; (+) strand; PAM type: NRG; PAM sequence: GGG
aaaaaatgatagatattgat

SEQ ID NO: 105353 - DNA, 20 bp, Artificial Sequence
  Description of Artificial Sequence: Synthetic oligonucleotide
  Target: ATXN1; (+) strand; PAM type: NRG; PAM sequence: GGG
aaaaatgatagatattgatg

SEQ ID NO: 105354 - DNA, 20 bp, Artificial Sequence
  Description of Artificial Sequence: Synthetic oligonucleotide
  Target: ATXN1; (+) strand; PAM type: NRG; PAM sequence: TGG
gatagatattgatggggatg

SEQ ID NO: 105355 - DNA, 20 bp, Artificial Sequence
  Description of Artificial Sequence: Synthetic oligonucleotide
  Target: ATXN1; (+) strand; PAM type: NRG; PAM sequence: CGG
ttgatggggatgtggtgaaa

SEQ ID NO: 105356 - DNA, 20 bp, Artificial Sequence
  Description of Artificial Sequence: Synthetic oligonucleotide
  Target: ATXN1; (+) strand; PAM type: NRG; PAM sequence: GGG
tgatggggatgtggtgaaac

SEQ ID NO: 105357 - DNA, 20 bp, Artificial Sequence
  Description of Artificial Sequence: Synthetic oligonucleotide
  Target: ATXN1; (+) strand; PAM type: NRG; PAM sequence: TGG
cgggaacacttttacattgc

SEQ ID NO: 105358 - DNA, 20 bp, Artificial Sequence
  Description of Artificial Sequence: Synthetic oligonucleotide
  Target: ATXN1; (+) strand; PAM type: NRG; PAM sequence: TGG
gaacacttttacattgctgg

SEQ ID NO: 105359 - DNA, 20 bp, Artificial Sequence
  Description of Artificial Sequence: Synthetic oligonucleotide
  Target: ATXN1; (+) strand; PAM type: NRG; PAM sequence: GGG
aacacttttacattgctggt

SEQ ID NO: 105360 - DNA, 20 bp, Artificial Sequence
  Description of Artificial Sequence: Synthetic oligonucleotide
  Target: ATXN1; (+) strand; PAM type: NRG; PAM sequence: TAG
ttacattgctggtgggaatg

SEQ ID NO: 105361 - DNA, 20 bp, Artificial Sequence
  Description of Artificial Sequence: Synthetic oligonucleotide
  Target: ATXN1; (+) strand; PAM type: NRG; PAM sequence: TGG
gtagactaatacaaccacta

SEQ ID NO: 105362 - DNA, 20 bp, Artificial Sequence
  Description of Artificial Sequence: Synthetic oligonucleotide
  Target: ATXN1; (+) strand; PAM type: NRG; PAM sequence: CAG
aatacaaccactatggaaaa

SEQ ID NO: 105363 - DNA, 20 bp, Artificial Sequence
  Description of Artificial Sequence: Synthetic oligonucleotide
  Target: ATXN1; (+) strand; PAM type: NRG; PAM sequence: TGG
aaccactatggaaaacagtg

SEQ ID NO: 105364 - DNA, 20 bp, Artificial Sequence
  Description of Artificial Sequence: Synthetic oligonucleotide
  Target: ATXN1; (+) strand; PAM type: NRG; PAM sequence: GAG
ccactatggaaaacagtgtg

SEQ ID NO: 105365 - DNA, 20 bp, Artificial Sequence
  Description of Artificial Sequence: Synthetic oligonucleotide
  Target: ATXN1; (+) strand; PAM type: NRG; PAM sequence: AAG
aacagtgtggagattcctta

SEQ ID NO: 105366 - DNA, 20 bp, Artificial Sequence
  Description of Artificial Sequence: Synthetic oligonucleotide
  Target: ATXN1; (+) strand; PAM type: NRG; PAM sequence: AAG
gagattccttaaagaactta

SEQ ID NO: 105367 - DNA, 20 bp, Artificial Sequence
  Description of Artificial Sequence: Synthetic oligonucleotide
  Target: ATXN1; (+) strand; PAM type: NRG; PAM sequence: TAG
attccttaaagaacttaaag

SEQ ID NO: 105368 - DNA, 20 bp, Artificial Sequence
  Description of Artificial Sequence: Synthetic oligonucleotide
  Target: ATXN1; (+) strand; PAM type: NRG; PAM sequence: TGG
tgatccaacaatcccactac

SEQ ID NO: 105369 - DNA, 20 bp, Artificial Sequence
  Description of Artificial Sequence: Synthetic oligonucleotide
  Target: ATXN1; (+) strand; PAM type: NRG; PAM sequence: GGG
gatccaacaatcccactact

SEQ ID NO: 105370 - DNA, 20 bp, Artificial Sequence
  Description of Artificial Sequence: Synthetic oligonucleotide
  Target: ATXN1; (+) strand; PAM type: NRG; PAM sequence: CAG
cccactactgggtatctacc

SEQ ID NO: 105371 - DNA, 20 bp, Artificial Sequence
  Description of Artificial Sequence: Synthetic oligonucleotide
  Target: ATXN1; (+) strand; PAM type: NRG; PAM sequence: GAG
cactactgggtatctaccca

SEQ ID NO: 105372 - DNA, 20 bp, Artificial Sequence
  Description of Artificial Sequence: Synthetic oligonucleotide
  Target: ATXN1; (+) strand; PAM type: NRG; PAM sequence: AGG
actactgggtatctacccag

SEQ ID NO: 105373 - DNA, 20 bp, Artificial Sequence
  Description of Artificial Sequence: Synthetic oligonucleotide
  Target: ATXN1; (+) strand; PAM type: NRG; PAM sequence: GAG
tactgggtatctacccagag

SEQ ID NO: 105374 - DNA, 20 bp, Artificial Sequence
  Description of Artificial Sequence: Synthetic oligonucleotide
  Target: ATXN1; (+) strand; PAM type: NRG; PAM sequence: AAG
agaggagacgtcttatgaaa

SEQ ID NO: 105375 - DNA, 20 bp, Artificial Sequence
  Description of Artificial Sequence: Synthetic oligonucleotide
  Target: ATXN1; (+) strand; PAM type: NRG; PAM sequence: CAG
tacttgcacatgcatgttta

SEQ ID NO: 105376 - DNA, 20 bp, Artificial Sequence
  Description of Artificial Sequence: Synthetic oligonucleotide
  Target: ATXN1; (+) strand; PAM type: NRG; PAM sequence: CAG
ttgcacatgcatgtttacag

SEQ ID NO: 105377 - DNA, 20 bp, Artificial Sequence
  Description of Artificial Sequence: Synthetic oligonucleotide
  Target: ATXN1; (+) strand; PAM type: NRG; PAM sequence: CAG
agcagcacaattcgcaattg

SEQ ID NO: 105378 - DNA, 20 bp, Artificial Sequence
  Description of Artificial Sequence: Synthetic oligonucleotide
  Target: ATXN1; (+) strand; PAM type: NRG; PAM sequence: TGG
aattcgcaattgcagaaata

SEQ ID NO: 105379 - DNA, 20 bp, Artificial Sequence
  Description of Artificial Sequence: Synthetic oligonucleotide
  Target: ATXN1; (+) strand; PAM type: NRG; PAM sequence: CAG
caattgcagaaatatggaac

SEQ ID NO: 105380 - DNA, 20 bp, Artificial Sequence
  Description of Artificial Sequence: Synthetic oligonucleotide
  Target: ATXN1; (+) strand; PAM type: NRG; PAM sequence: GAG
ccaaatgcccatcaatcaat

SEQ ID NO: 105381 - DNA, 20 bp, Artificial Sequence
  Description of Artificial Sequence: Synthetic oligonucleotide
  Target: ATXN1; (+) strand; PAM type: NRG; PAM sequence: TGG
aatgcccatcaatcaatgag

SEQ ID NO: 105382 - DNA, 20 bp, Artificial Sequence
  Description of Artificial Sequence: Synthetic oligonucleotide
  Target: ATXN1; (+) strand; PAM type: NRG; PAM sequence: CAG
attattgtatgtatatatca

SEQ ID NO: 105383 - DNA, 20 bp, Artificial Sequence
  Description of Artificial Sequence: Synthetic oligonucleotide
  Target: ATXN1; (+) strand; PAM type: NRG; PAM sequence: CAG
atatatcacagaatactact

SEQ ID NO: 105384 - DNA, 20 bp, Artificial Sequence
  Description of Artificial Sequence: Synthetic oligonucleotide
  Target: ATXN1; (+) strand; PAM type: NRG; PAM sequence: AAG
gaatactactcagccataaa

SEQ ID NO: 105385 - DNA, 20 bp, Artificial Sequence
  Description of Artificial Sequence: Synthetic oligonucleotide
  Target: ATXN1; (+) strand; PAM type: NRG; PAM sequence: AGG
aatactactcagccataaaa

SEQ ID NO: 105386 - DNA, 20 bp, Artificial Sequence
  Description of Artificial Sequence: Synthetic oligonucleotide
  Target: ATXN1; (+) strand; PAM type: NRG; PAM sequence: TAG
cataaaaaggaacaaaataa

SEQ ID NO: 105387 - DNA, 20 bp, Artificial Sequence
  Description of Artificial Sequence: Synthetic oligonucleotide
  Target: ATXN1; (+) strand; PAM type: NRG; PAM sequence: CAG
gaacaaaataatagcattca

SEQ ID NO: 105388 - DNA, 20 bp, Artificial Sequence
  Description of Artificial Sequence: Synthetic oligonucleotide
  Target: ATXN1; (+) strand; PAM type: NRG; PAM sequence: TGG
agcattcacagcaacctgtt

SEQ ID NO: 105389 - DNA, 20 bp, Artificial Sequence
  Description of Artificial Sequence: Synthetic oligonucleotide
  Target: ATXN1; (+) strand; PAM type: NRG; PAM sequence: TGG
cacagcaacctgtttggaac

SEQ ID NO: 105390 - DNA, 20 bp, Artificial Sequence
  Description of Artificial Sequence: Synthetic oligonucleotide
  Target: ATXN1; (+) strand; PAM type: NRG; PAM sequence: AAG
gaactggataccattattct

SEQ ID NO: 105391 - DNA, 20 bp, Artificial Sequence
  Description of Artificial Sequence: Synthetic oligonucleotide
  Target: ATXN1; (+) strand; PAM type: NRG; PAM sequence: AAG
ggataccattattctaagtg

SEQ ID NO: 105392 - DNA, 20 bp, Artificial Sequence
  Description of Artificial Sequence: Synthetic oligonucleotide
  Target: ATXN1; (+) strand; PAM type: NRG; PAM sequence: CAG
ttattctaagtgaagtaact

SEQ ID NO: 105393 - DNA, 20 bp, Artificial Sequence
  Description of Artificial Sequence: Synthetic oligonucleotide
  Target: ATXN1; (+) strand; PAM type: NRG; PAM sequence: AGG
tattctaagtgaagtaactc

SEQ ID NO: 105394 - DNA, 20 bp, Artificial Sequence
  Description of Artificial Sequence: Synthetic oligonucleotide
  Target: ATXN1; (+) strand; PAM type: NRG; PAM sequence: TGG
taagtgaagtaactcaggaa

SEQ ID NO: 105395 - DNA, 20 bp, Artificial Sequence
  Description of Artificial Sequence: Synthetic oligonucleotide
  Target: ATXN1; (+) strand; PAM type: NRG; PAM sequence: TGG
aaaactgaacaccgtaatga

SEQ ID NO: 105396 - DNA, 20 bp, Artificial Sequence
  Description of Artificial Sequence: Synthetic oligonucleotide
  Target: ATXN1; (+) strand; PAM type: NRG; PAM sequence: CAG
actgaacaccgtaatgatgg

SEQ ID NO: 105397 - DNA, 20 bp, Artificial Sequence
  Description of Artificial Sequence: Synthetic oligonucleotide
  Target: ATXN1; (+) strand; PAM type: NRG; PAM sequence: TGG
gaacaccgtaatgatggcag

SEQ ID NO: 105398 - DNA, 20 bp, Artificial Sequence
  Description of Artificial Sequence: Synthetic oligonucleotide
  Target: ATXN1; (+) strand; PAM type: NRG; PAM sequence: AAG
tggcagtggctgctgccatc

SEQ ID NO: 105399 - DNA, 20 bp, Artificial Sequence
  Description of Artificial Sequence: Synthetic oligonucleotide
  Target: ATXN1; (+) strand; PAM type: NRG; PAM sequence: TGG
agtggctgctgccatcaagc

SEQ ID NO: 105400 - DNA, 20 bp, Artificial Sequence
  Description of Artificial Sequence: Synthetic oligonucleotide
  Target: ATXN1; (+) strand; PAM type: NRG; PAM sequence: CGG
ctgccatcaagctggctgcg

SEQ ID NO: 105401 - DNA, 20 bp, Artificial Sequence
  Description of Artificial Sequence: Synthetic oligonucleotide
  Target: ATXN1; (+) strand; PAM type: NRG; PAM sequence: TGG
catcaagctggctgcgcggc

SEQ ID NO: 105402 - DNA, 20 bp, Artificial Sequence
  Description of Artificial Sequence: Synthetic oligonucleotide
  Target: ATXN1; (+) strand; PAM type: NRG; PAM sequence: TGG
ggctggtgctgcatactcca

SEQ ID NO: 105403 - DNA, 20 bp, Artificial Sequence
  Description of Artificial Sequence: Synthetic oligonucleotide
  Target: ATXN1; (+) strand; PAM type: NRG; PAM sequence: GAG
ctggtgctgcatactccatg

SEQ ID NO: 105404 - DNA, 20 bp, Artificial Sequence
  Description of Artificial Sequence: Synthetic oligonucleotide
  Target: ATXN1; (+) strand; PAM type: NRG; PAM sequence: TGG
tgctgcatactccatggagc

SEQ ID NO: 105405 - DNA, 20 bp, Artificial Sequence
  Description of Artificial Sequence: Synthetic oligonucleotide
  Target: ATXN1; (+) strand; PAM type: NRG; PAM sequence: TGG
tgcatactccatggagctgg

SEQ ID NO: 105406 - DNA, 20 bp, Artificial Sequence
  Description of Artificial Sequence: Synthetic oligonucleotide
  Target: ATXN1; (+) strand; PAM type: NRG; PAM sequence: CAG
atactccatggagctggtgg

SEQ ID NO: 105407 - DNA, 20 bp, Artificial Sequence
  Description of Artificial Sequence: Synthetic oligonucleotide
  Target: ATXN1; (+) strand; PAM type: NRG; PAM sequence: GAG
gtggcagccctgttcattcc

SEQ ID NO: 105408 - DNA, 20 bp, Artificial Sequence
  Description of Artificial Sequence: Synthetic oligonucleotide
  Target: ATXN1; (+) strand; PAM type: NRG; PAM sequence: TGG
cagccctgttcattccgagt

SEQ ID NO: 105409 - DNA, 20 bp, Artificial Sequence
  Description of Artificial Sequence: Synthetic oligonucleotide
  Target: ATXN1; (+) strand; PAM type: NRG; PAM sequence: GGG
agccctgttcattccgagtt

SEQ ID NO: 105410 - DNA, 20 bp, Artificial Sequence
  Description of Artificial Sequence: Synthetic oligonucleotide
  Target: ATXN1; (+) strand; PAM type: NRG; PAM sequence: TGG
ctgttcattccgagttggga

SEQ ID NO: 105411 - DNA, 20 bp, Artificial Sequence
  Description of Artificial Sequence: Synthetic oligonucleotide
  Target: ATXN1; (+) strand; PAM type: NRG; PAM sequence: GGG
tgttcattccgagttgggat

SEQ ID NO: 105412 - DNA, 20 bp, Artificial Sequence
  Description of Artificial Sequence: Synthetic oligonucleotide
  Target: ATXN1; (+) strand; PAM type: NRG; PAM sequence: GAG
ttcattccgagttgggatgg

SEQ ID NO: 105413 - DNA, 20 bp, Artificial Sequence
  Description of Artificial Sequence: Synthetic oligonucleotide
  Target: ATXN1; (+) strand; PAM type: NRG; PAM sequence: CAG
gggagctccgcgtgccactg

SEQ ID NO: 105414 - DNA, 20 bp, Artificial Sequence
  Description of Artificial Sequence: Synthetic oligonucleotide
  Target: ATXN1; (+) strand; PAM type: NRG; PAM sequence: CAG
cactgcagccacctgaactg

SEQ ID NO: 105415 - DNA, 20 bp, Artificial Sequence
  Description of Artificial Sequence: Synthetic oligonucleotide
  Target: ATXN1; (+) strand; PAM type: NRG; PAM sequence: CAG
agccacctgaactgcagctg

SEQ ID NO: 105416 - DNA, 20 bp, Artificial Sequence
  Description of Artificial Sequence: Synthetic oligonucleotide
  Target: ATXN1; (+) strand; PAM type: NRG; PAM sequence: CAG
ctgaactgcagctgcagacc

SEQ ID NO: 105417 - DNA, 20 bp, Artificial Sequence
  Description of Artificial Sequence: Synthetic oligonucleotide
  Target: ATXN1; (+) strand; PAM type: NRG; PAM sequence: AGG
tgaactgcagctgcagaccc

SEQ ID NO: 105418 - DNA, 20 bp, Artificial Sequence
  Description of Artificial Sequence: Synthetic oligonucleotide
  Target: ATXN1; (+) strand; PAM type: NRG; PAM sequence: CAG
gacccaggcctcctgctcca

SEQ ID NO: 105419 - DNA, 20 bp, Artificial Sequence
  Description of Artificial Sequence: Synthetic oligonucleotide
  Target: ATXN1; (+) strand; PAM type: NRG; PAM sequence: GAG
cccaggcctcctgctccaca

SEQ ID NO: 105420 - DNA, 20 bp, Artificial Sequence
  Description of Artificial Sequence: Synthetic oligonucleotide
  Target: ATXN1; (+) strand; PAM type: NRG; PAM sequence: AAG
ggcctcctgctccacagagc

SEQ ID NO: 105421 - DNA, 20 bp, Artificial Sequence
  Description of Artificial Sequence: Synthetic oligonucleotide
  Target: ATXN1; (+) strand; PAM type: NRG; PAM sequence: CAG
ctcctgctccacagagcaag

SEQ ID NO: 105422 - DNA, 20 bp, Artificial Sequence
  Description of Artificial Sequence: Synthetic oligonucleotide
  Target: ATXN1; (+) strand; PAM type: NRG; PAM sequence: AGG
tcctgctccacagagcaagc

SEQ ID NO: 105423 - DNA, 20 bp, Artificial Sequence
  Description of Artificial Sequence: Synthetic oligonucleotide
  Target: ATXN1; (+) strand; PAM type: NRG; PAM sequence: GAG
ctgctccacagagcaagcag

SEQ ID NO: 105424 - DNA, 20 bp, Artificial Sequence
  Description of Artificial Sequence: Synthetic oligonucleotide
  Target: ATXN1; (+) strand; PAM type: NRG; PAM sequence: TGG
aagcaggagccccgccctct

SEQ ID NO: 105425 - DNA, 20 bp, Artificial Sequence
  Description of Artificial Sequence: Synthetic oligonucleotide
  Target: ATXN1; (+) strand; PAM type: NRG; PAM sequence: GGG
agcaggagccccgccctctt

SEQ ID NO: 105426 - DNA, 20 bp, Artificial Sequence
  Description of Artificial Sequence: Synthetic oligonucleotide
  Target: ATXN1; (+) strand; PAM type: NRG; PAM sequence: GGG
gcaggagccccgccctcttg

SEQ ID NO: 105427 - DNA, 20 bp, Artificial Sequence
  Description of Artificial Sequence: Synthetic oligonucleotide
  Target: ATXN1; (+) strand; PAM type: NRG; PAM sequence: CAG
gccccgccctcttggggcca

SEQ ID NO: 105428 - DNA, 20 bp, Artificial Sequence
  Description of Artificial Sequence: Synthetic oligonucleotide
  Target: ATXN1; (+) strand; PAM type: NRG; PAM sequence: CAG
ggccacagccacccaaactg

SEQ ID NO: 105429 - DNA, 20 bp, Artificial Sequence
  Description of Artificial Sequence: Synthetic oligonucleotide
  Target: ATXN1; (+) strand; PAM type: NRG; PAM sequence: TAG
agccacccaaactgcagctg

SEQ ID NO: 105430 - DNA, 20 bp, Artificial Sequence
  Description of Artificial Sequence: Synthetic oligonucleotide
  Target: ATXN1; (+) strand; PAM type: NRG; PAM sequence: GAG
caaactgcagctgtagatcc

SEQ ID NO: 105431 - DNA, 20 bp, Artificial Sequence
  Description of Artificial Sequence: Synthetic oligonucleotide
  Target: ATXN1; (+) strand; PAM type: NRG; PAM sequence: TGG
tccgagtctccctgtgctct

SEQ ID NO: 105432 - DNA, 20 bp, Artificial Sequence
  Description of Artificial Sequence: Synthetic oligonucleotide
  Target: ATXN1; (+) strand; PAM type: NRG; PAM sequence: GGG
ccgagtctccctgtgctctt

SEQ ID NO: 105433 - DNA, 20 bp, Artificial Sequence
  Description of Artificial Sequence: Synthetic oligonucleotide
  Target: ATXN1; (+) strand; PAM type: NRG; PAM sequence: GGG
cgagtctccctgtgctcttg

SEQ ID NO: 105434 - DNA, 20 bp, Artificial Sequence
  Description of Artificial Sequence: Synthetic oligonucleotide
  Target: ATXN1; (+) strand; PAM type: NRG; PAM sequence: GGG
gagtctccctgtgctcttgg

SEQ ID NO: 105435 - DNA, 20 bp, Artificial Sequence
  Description of Artificial Sequence: Synthetic oligonucleotide
  Target: ATXN1; (+) strand; PAM type: NRG; PAM sequence: GAG
gtctccctgtgctcttgggg

SEQ ID NO: 105436 - DNA, 20 bp, Artificial Sequence
  Description of Artificial Sequence: Synthetic oligonucleotide
  Target: ATXN1; (+) strand; PAM type: NRG; PAM sequence: TGG
cctgtgctcttgggggagcc

SEQ ID NO: 105437 - DNA, 20 bp, Artificial Sequence
  Description of Artificial Sequence: Synthetic oligonucleotide
  Target: ATXN1; (+) strand; PAM type: NRG; PAM sequence: CAG
gctcttgggggagcctggaa

SEQ ID NO: 105438 - DNA, 20 bp, Artificial Sequence
  Description of Artificial Sequence: Synthetic oligonucleotide
  Target: ATXN1; (+) strand; PAM type: NRG; PAM sequence: AGG
ctcttgggggagcctggaac

SEQ ID NO: 105439 - DNA, 20 bp, Artificial Sequence
  Description of Artificial Sequence: Synthetic oligonucleotide
  Target: ATXN1; (+) strand; PAM type: NRG; PAM sequence: CAG
ttgggggagcctggaacagg

SEQ ID NO: 105440 - DNA, 20 bp, Artificial Sequence
  Description of Artificial Sequence: Synthetic oligonucleotide
  Target: ATXN1; (+) strand; PAM type: NRG; PAM sequence: AGG
tgggggagcctggaacaggc

SEQ ID NO: 105441 - DNA, 20 bp, Artificial Sequence
  Description of Artificial Sequence: Synthetic oligonucleotide
  Target: ATXN1; (+) strand; PAM type: NRG; PAM sequence: CAG
acaggcaggatctgccttcc

SEQ ID NO: 105442 - DNA, 20 bp, Artificial Sequence
  Description of Artificial Sequence: Synthetic oligonucleotide
  Target: ATXN1; (+) strand; PAM type: NRG; PAM sequence: AGG
caggcaggatctgccttccc

SEQ ID NO: 105443 - DNA, 20 bp, Artificial Sequence
  Description of Artificial Sequence: Synthetic oligonucleotide
  Target: ATXN1; (+) strand; PAM type: NRG; PAM sequence: CAG
aggatctgccttcccaggtg

SEQ ID NO: 105444 - DNA, 20 bp, Artificial Sequence
  Description of Artificial Sequence: Synthetic oligonucleotide
  Target: ATXN1; (+) strand; PAM type: NRG; PAM sequence: CAG
tgccttcccaggtgcagctg

SEQ ID NO: 105445 - DNA, 20 bp, Artificial Sequence
  Description of Artificial Sequence: Synthetic oligonucleotide
  Target: ATXN1; (+) strand; PAM type: NRG; PAM sequence: CGG
agctgcagctgccgcaccca

SEQ ID NO: 105446 - DNA, 20 bp, Artificial Sequence
  Description of Artificial Sequence: Synthetic oligonucleotide
  Target: ATXN1; (+) strand; PAM type: NRG; PAM sequence: CAG
agctgccgcacccacggctg

SEQ ID NO: 105447 - DNA, 20 bp, Artificial Sequence
  Description of Artificial Sequence: Synthetic oligonucleotide
  Target: ATXN1; (+) strand; PAM type: NRG; PAM sequence: TGG
cgcacccacggctgcagacc

SEQ ID NO: 105448 - DNA, 20 bp, Artificial Sequence
  Description of Artificial Sequence: Synthetic oligonucleotide
  Target: ATXN1; (+) strand; PAM type: NRG; PAM sequence: GGG
gcacccacggctgcagacct

SEQ ID NO: 105449 - DNA, 20 bp, Artificial Sequence
  Description of Artificial Sequence: Synthetic oligonucleotide
  Target: ATXN1; (+) strand; PAM type: NRG; PAM sequence: CAG
cagacctgggcctcccattc

SEQ ID NO: 105450 - DNA, 20 bp, Artificial Sequence
  Description of Artificial Sequence: Synthetic oligonucleotide
  Target: ATXN1; (+) strand; PAM type: NRG; PAM sequence: AGG
agacctgggcctcccattcc

SEQ ID NO: 105451 - DNA, 20 bp, Artificial Sequence
  Description of Artificial Sequence: Synthetic oligonucleotide
  Target: ATXN1; (+) strand; PAM type: NRG; PAM sequence: AAG
cctgggcctcccattccagg

SEQ ID NO: 105452 - DNA, 20 bp, Artificial Sequence
  Description of Artificial Sequence: Synthetic oligonucleotide
  Target: ATXN1; (+) strand; PAM type: NRG; PAM sequence: CAG
gggcctcccattccaggaag

SEQ ID NO: 105453 - DNA, 20 bp, Artificial Sequence
  Description of Artificial Sequence: Synthetic oligonucleotide
  Target: ATXN1; (+) strand; PAM type: NRG; PAM sequence: AGG
ggcctcccattccaggaagc

SEQ ID NO: 105454 - DNA, 20 bp, Artificial Sequence
  Description of Artificial Sequence: Synthetic oligonucleotide
  Target: ATXN1; (+) strand; PAM type: NRG; PAM sequence: CAG
ctcccattccaggaagcagg

SEQ ID NO: 105455 - DNA, 20 bp, Artificial Sequence
  Description of Artificial Sequence: Synthetic oligonucleotide
  Target: ATXN1; (+) strand; PAM type: NRG; PAM sequence: AGG
tcccattccaggaagcaggc

SEQ ID NO: 105456 - DNA, 20 bp, Artificial Sequence
  Description of Artificial Sequence: Synthetic oligonucleotide
  Target: ATXN1; (+) strand; PAM type: NRG; PAM sequence: GAG
ccattccaggaagcaggcag

SEQ ID NO: 105457 - DNA, 20 bp, Artificial Sequence
  Description of Artificial Sequence: Synthetic oligonucleotide
  Target: ATXN1; (+) strand; PAM type: NRG; PAM sequence: CAG
tccaggaagcaggcaggagc

SEQ ID NO: 105458 - DNA, 20 bp, Artificial Sequence
  Description of Artificial Sequence: Synthetic oligonucleotide
  Target: ATXN1; (+) strand; PAM type: NRG; PAM sequence: AGG
ccaggaagcaggcaggagcc

SEQ ID NO: 105459 - DNA, 20 bp, Artificial Sequence
  Description of Artificial Sequence: Synthetic oligonucleotide
  Target: ATXN1; (+) strand; PAM type: NRG; PAM sequence: AAG
agcaggcaggagccaggaac

SEQ ID NO: 105460 - DNA, 20 bp, Artificial Sequence
  Description of Artificial Sequence: Synthetic oligonucleotide
  Target: ATXN1; (+) strand; PAM type: NRG; PAM sequence: CGG
aggcaggagccaggaacaag

SEQ ID NO: 105461 - DNA, 20 bp, Artificial Sequence
  Description of Artificial Sequence: Synthetic oligonucleotide
  Target: ATXN1; (+) strand; PAM type: NRG; PAM sequence: GGG
ggcaggagccaggaacaagc

SEQ ID NO: 105462 - DNA, 20 bp, Artificial Sequence
  Description of Artificial Sequence: Synthetic oligonucleotide
  Target: ATXN1; (+) strand; PAM type: NRG; PAM sequence: GAG
caggagccaggaacaagcgg

SEQ ID NO: 105463 - DNA, 20 bp, Artificial Sequence
  Description of Artificial Sequence: Synthetic oligonucleotide
  Target: ATXN1; (+) strand; PAM type: NRG; PAM sequence: GAG
gcgggagccctgccccttcc

SEQ ID NO: 105464 - DNA, 20 bp, Artificial Sequence
  Description of Artificial Sequence: Synthetic oligonucleotide
  Target: ATXN1; (+) strand; PAM type: NRG; PAM sequence: CAG
ccctgccccttccgagttgt

SEQ ID NO: 105465 - DNA, 20 bp, Artificial Sequence
  Description of Artificial Sequence: Synthetic oligonucleotide
  Target: ATXN1; (+) strand; PAM type: NRG; PAM sequence: AGG
cctgccccttccgagttgtc

SEQ ID NO: 105466 - DNA, 20 bp, Artificial Sequence
  Description of Artificial Sequence: Synthetic oligonucleotide
  Target: ATXN1; (+) strand; PAM type: NRG; PAM sequence: GGG
ctgccccttccgagttgtca

SEQ ID NO: 105467 - DNA, 20 bp, Artificial Sequence
  Description of Artificial Sequence: Synthetic oligonucleotide
  Target: ATXN1; (+) strand; PAM type: NRG; PAM sequence: CGG
ccccttccgagttgtcaggg

SEQ ID NO: 105468 - DNA, 20 bp, Artificial Sequence
  Description of Artificial Sequence: Synthetic oligonucleotide
  Target: ATXN1; (+) strand; PAM type: NRG; PAM sequence: GGG
cccttccgagttgtcagggc

SEQ ID NO: 105469 - DNA, 20 bp, Artificial Sequence
  Description of Artificial Sequence: Synthetic oligonucleotide
  Target: ATXN1; (+) strand; PAM type: NRG; PAM sequence: GAG
cttccgagttgtcagggcgg

SEQ ID NO: 105470 - DNA, 20 bp, Artificial Sequence
  Description of Artificial Sequence: Synthetic oligonucleotide
  Target: ATXN1; (+) strand; PAM type: NRG; PAM sequence: CGG
gttgtcagggcgggagctcc

SEQ ID NO: 105471 - DNA, 20 bp, Artificial Sequence
  Description of Artificial Sequence: Synthetic oligonucleotide
  Target: ATXN1; (+) strand; PAM type: NRG; PAM sequence: GGG
ttgtcagggcgggagctccc

SEQ ID NO: 105472 - DNA, 20 bp, Artificial Sequence
  Description of Artificial Sequence: Synthetic oligonucleotide
  Target: ATXN1; (+) strand; PAM type: NRG; PAM sequence: CAG
agggcgggagctcccgggtg

SEQ ID NO: 105473 - DNA, 20 bp, Artificial Sequence
  Description of Artificial Sequence: Synthetic oligonucleotide
  Target: ATXN1; (+) strand; PAM type: NRG; PAM sequence: TGG
ggagctcccgggtgcagctg

SEQ ID NO: 105474 - DNA, 20 bp, Artificial Sequence
  Description of Artificial Sequence: Synthetic oligonucleotide
  Target: ATXN1; (+) strand; PAM type: NRG; PAM sequence: CAG
gcagctgtggccaaccctcc

SEQ ID NO: 105475 - DNA, 20 bp, Artificial Sequence
  Description of Artificial Sequence: Synthetic oligonucleotide
  Target: ATXN1; (+) strand; PAM type: NRG; PAM sequence: AGG
cagctgtggccaaccctccc

SEQ ID NO: 105476 - DNA, 20 bp, Artificial Sequence
  Description of Artificial Sequence: Synthetic oligonucleotide
  Target: ATXN1; (+) strand; PAM type: NRG; PAM sequence: CAG
gtggccaaccctcccaggca

SEQ ID NO: 105477 - DNA, 20 bp, Artificial Sequence
  Description of Artificial Sequence: Synthetic oligonucleotide
  Target: ATXN1; (+) strand; PAM type: NRG; PAM sequence: AGG
tggccaaccctcccaggcac

SEQ ID NO: 105478 - DNA, 20 bp, Artificial Sequence
  Description of Artificial Sequence: Synthetic oligonucleotide
  Target: ATXN1; (+) strand; PAM type: NRG; PAM sequence: TGG
accctcccaggcacaggacc

SEQ ID NO: 105479 - DNA, 20 bp, Artificial Sequence
  Description of Artificial Sequence: Synthetic oligonucleotide
  Target: ATXN1; (+) strand; PAM type: NRG; PAM sequence: GGG
ccctcccaggcacaggacct

SEQ ID NO: 105480 - DNA, 20 bp, Artificial Sequence
  Description of Artificial Sequence: Synthetic oligonucleotide
  Target: ATXN1; (+) strand; PAM type: NRG; PAM sequence: CAG
acaggacctgggcgtctctg

SEQ ID NO: 105481 - DNA, 20 bp, Artificial Sequence
  Description of Artificial Sequence: Synthetic oligonucleotide
  Target: ATXN1; (+) strand; PAM type: NRG; PAM sequence: TGG
gtctctgcagcctgcaccct

SEQ ID NO: 105482 - DNA, 20 bp, Artificial Sequence
  Description of Artificial Sequence: Synthetic oligonucleotide
  Target: ATXN1; (+) strand; PAM type: NRG; PAM sequence: GGG
tctctgcagcctgcaccctt

SEQ ID NO: 105483 - DNA, 20 bp, Artificial Sequence
  Description of Artificial Sequence: Synthetic oligonucleotide
  Target: ATXN1; (+) strand; PAM type: NRG; PAM sequence: CAG
gcctgcacccttgggcgccc

SEQ ID NO: 105484 - DNA, 20 bp, Artificial Sequence
  Description of Artificial Sequence: Synthetic oligonucleotide
  Target: ATXN1; (+) strand; PAM type: NRG; PAM sequence: AGG
cctgcacccttgggcgcccc

SEQ ID NO: 105485 - DNA, 20 bp, Artificial Sequence
  Description of Artificial Sequence: Synthetic oligonucleotide
  Target: ATXN1; (+) strand; PAM type: NRG; PAM sequence: AAG
gcacccttgggcgccccagg

SEQ ID NO: 105486 - DNA, 20 bp, Artificial Sequence
  Description of Artificial Sequence: Synthetic oligonucleotide
  Target: ATXN1; (+) strand; PAM type: NRG; PAM sequence: AGG
cacccttgggcgccccagga

SEQ ID NO: 105487 - DNA, 20 bp, Artificial Sequence
  Description of Artificial Sequence: Synthetic oligonucleotide
  Target: ATXN1; (+) strand; PAM type: NRG; PAM sequence: CAG
cctccccatctctgcatgct

SEQ ID NO: 105488 - DNA, 20 bp, Artificial Sequence
  Description of Artificial Sequence: Synthetic oligonucleotide
  Target: ATXN1; (+) strand; PAM type: NRG; PAM sequence: TGG
atgtgtctgcgcccactgcc

SEQ ID NO: 105489 - DNA, 20 bp, Artificial Sequence
  Description of Artificial Sequence: Synthetic oligonucleotide
  Target: ATXN1; (+) strand; PAM type: NRG; PAM sequence: CAG
tgcctggcctctctccgttc

SEQ ID NO: 105490 - DNA, 20 bp, Artificial Sequence
  Description of Artificial Sequence: Synthetic oligonucleotide
  Target: ATXN1; (+) strand; PAM type: NRG; PAM sequence: AGG
gcctggcctctctccgttcc

SEQ ID NO: 105491 - DNA, 20 bp, Artificial Sequence
  Description of Artificial Sequence: Synthetic oligonucleotide
  Target: ATXN1; (+) strand; PAM type: NRG; PAM sequence: CAG
ctccgttccaggcacccact

SEQ ID NO: 105492 - DNA, 20 bp, Artificial Sequence
  Description of Artificial Sequence: Synthetic oligonucleotide
  Target: ATXN1; (+) strand; PAM type: NRG; PAM sequence: CAG
ccaggcacccactcagatct

SEQ ID NO: 105493 - DNA, 20 bp, Artificial Sequence
  Description of Artificial Sequence: Synthetic oligonucleotide
  Target: ATXN1; (+) strand; PAM type: NRG; PAM sequence: GAG
aggcacccactcagatctca

SEQ ID NO: 105494 - DNA, 20 bp, Artificial Sequence
  Description of Artificial Sequence: Synthetic oligonucleotide
  Target: ATXN1; (+) strand; PAM type: NRG; PAM sequence: TGG
acccactcagatctcagagc

SEQ ID NO: 105495 - DNA, 20 bp, Artificial Sequence
  Description of Artificial Sequence: Synthetic oligonucleotide
  Target: ATXN1; (+) strand; PAM type: NRG; PAM sequence: GGG
cccactcagatctcagagct

SEQ ID NO: 105496 - DNA, 20 bp, Artificial Sequence
  Description of Artificial Sequence: Synthetic oligonucleotide
  Target: ATXN1; (+) strand; PAM type: NRG; PAM sequence: TGG
ctcagatctcagagctgggt

SEQ ID NO: 105497 - DNA, 20 bp, Artificial Sequence
  Description of Artificial Sequence: Synthetic oligonucleotide
  Target: ATXN1; (+) strand; PAM type: NRG; PAM sequence: GGG
tcagatctcagagctgggtt

SEQ ID NO: 105498 - DNA, 20 bp, Artificial Sequence
  Description of Artificial Sequence: Synthetic oligonucleotide
  Target: ATXN1; (+) strand; PAM type: NRG; PAM sequence: GGG
cagatctcagagctgggttg

SEQ ID NO: 105499 - DNA, 20 bp, Artificial Sequence
  Description of Artificial Sequence: Synthetic oligonucleotide
  Target: ATXN1; (+) strand; PAM type: NRG; PAM sequence: AAG
ctcagagctgggttggggcc

SEQ ID NO: 105500 - DNA, 20 bp, Artificial Sequence
  Description of Artificial Sequence: Synthetic oligonucleotide
  Target: ATXN1; (+) strand; PAM type: NRG; PAM sequence: CGG
gctgggttggggccaagccc

SEQ ID NO: 105501 - DNA, 20 bp, Artificial Sequence
  Description of Artificial Sequence: Synthetic oligonucleotide
  Target: ATXN1; (+) strand; PAM type: NRG; PAM sequence: GGG
ctgggttggggccaagcccc

SEQ ID NO: 105502 - DNA, 20 bp, Artificial Sequence
  Description of Artificial Sequence: Synthetic oligonucleotide
  Target: ATXN1; (+) strand; PAM type: NRG; PAM sequence: GGG
tgggttggggccaagccccg

SEQ ID NO: 105503 - DNA, 20 bp, Artificial Sequence
  Description of Artificial Sequence: Synthetic oligonucleotide
  Target: ATXN1; (+) strand; PAM type: NRG; PAM sequence: TGG
ccaagccccggggccatgaa

SEQ ID NO: 105504 - DNA, 20 bp, Artificial Sequence
  Description of Artificial Sequence: Synthetic oligonucleotide
  Target: ATXN1; (+) strand; PAM type: NRG; PAM sequence: CAG
agccccggggccatgaatgg

SEQ ID NO: 105505 - DNA, 20 bp, Artificial Sequence
  Description of Artificial Sequence: Synthetic oligonucleotide
  Target: ATXN1; (+) strand; PAM type: NRG; PAM sequence: CAG
cccggggccatgaatggcag

SEQ ID NO: 105506 - DNA, 20 bp, Artificial Sequence
  Description of Artificial Sequence: Synthetic oligonucleotide
  Target: ATXN1; (+) strand; PAM type: NRG; PAM sequence: AGG
ccggggccatgaatggcagc

SEQ ID NO: 105507 - DNA, 20 bp, Artificial Sequence
  Description of Artificial Sequence: Synthetic oligonucleotide
  Target: ATXN1; (+) strand; PAM type: NRG; PAM sequence: GAG
ggggccatgaatggcagcag

SEQ ID NO: 105508 - DNA, 20 bp, Artificial Sequence
  Description of Artificial Sequence: Synthetic oligonucleotide
  Target: ATXN1; (+) strand; PAM type: NRG; PAM sequence: AGG
gggccatgaatggcagcagg

SEQ ID NO: 105509 - DNA, 20 bp, Artificial Sequence
  Description of Artificial Sequence: Synthetic oligonucleotide
  Target: ATXN1; (+) strand; PAM type: NRG; PAM sequence: AAG
ccatgaatggcagcaggagg

SEQ ID NO: 105510 - DNA, 20 bp, Artificial Sequence
  Description of Artificial Sequence: Synthetic oligonucleotide
  Target: ATXN1; (+) strand; PAM type: NRG; PAM sequence: CAG
gaatggcagcaggaggaaga

SEQ ID NO: 105511 - DNA, 20 bp, Artificial Sequence
  Description of Artificial Sequence: Synthetic oligonucleotide
  Target: ATXN1; (+) strand; PAM type: NRG; PAM sequence: AGG
aatggcagcaggaggaagac

SEQ ID NO: 105512 - DNA, 20 bp, Artificial Sequence
  Description of Artificial Sequence: Synthetic oligonucleotide
  Target: ATXN1; (+) strand; PAM type: NRG; PAM sequence: GGG
atggcagcaggaggaagaca

SEQ ID NO: 105513 - DNA, 20 bp, Artificial Sequence
  Description of Artificial Sequence: Synthetic oligonucleotide
  Target: ATXN1; (+) strand; PAM type: NRG; PAM sequence: CGG
agcaggaggaagacagggtc

SEQ ID NO: 105514 - DNA, 20 bp, Artificial Sequence
  Description of Artificial Sequence: Synthetic oligonucleotide
  Target: ATXN1; (+) strand; PAM type: NRG; PAM sequence: GGG
gcaggaggaagacagggtcc

SEQ ID NO: 105515 - DNA, 20 bp, Artificial Sequence
  Description of Artificial Sequence: Synthetic oligonucleotide
  Target: ATXN1; (+) strand; PAM type: NRG; PAM sequence: GGG
caggaggaagacagggtccg

SEQ ID NO: 105516 - DNA, 20 bp, Artificial Sequence
  Description of Artificial Sequence: Synthetic oligonucleotide
  Target: ATXN1; (+) strand; PAM type: NRG; PAM sequence: CAG
gaggaagacagggtccgggg

SEQ ID NO: 105517 - DNA, 20 bp, Artificial Sequence
  Description of Artificial Sequence: Synthetic oligonucleotide
  Target: ATXN1; (+) strand; PAM type: NRG; PAM sequence: AAG
agacagggtccggggcagaa

SEQ ID NO: 105518 - DNA, 20 bp, Artificial Sequence
  Description of Artificial Sequence: Synthetic oligonucleotide
  Target: ATXN1; (+) strand; PAM type: NRG; PAM sequence: GAG
acagggtccggggcagaaaa

SEQ ID NO: 105519 - DNA, 20 bp, Artificial Sequence
  Description of Artificial Sequence: Synthetic oligonucleotide
  Target: ATXN1; (+) strand; PAM type: NRG; PAM sequence: AGG
cagggtccggggcagaaaag

SEQ ID NO: 105520 - DNA, 20 bp, Artificial Sequence
  Description of Artificial Sequence: Synthetic oligonucleotide
  Target: ATXN1; (+) strand; PAM type: NRG; PAM sequence: GGG
agggtccggggcagaaaaga

SEQ ID NO: 105521 - DNA, 20 bp, Artificial Sequence
  Description of Artificial Sequence: Synthetic oligonucleotide
  Target: ATXN1; (+) strand; PAM type: NRG; PAM sequence: GGG
gggtccggggcagaaaagag

SEQ ID NO: 105522 - DNA, 20 bp, Artificial Sequence
  Description of Artificial Sequence: Synthetic oligonucleotide
  Target: ATXN1; (+) strand; PAM type: NRG; PAM sequence: GAG
gtccggggcagaaaagaggg

SEQ ID NO: 105523 - DNA, 20 bp, Artificial Sequence
  Description of Artificial Sequence: Synthetic oligonucleotide
  Target: ATXN1; (+) strand; PAM type: NRG; PAM sequence: TAG
aaaagaggggagtccccaat

SEQ ID NO: 105524 - DNA, 20 bp, Artificial Sequence
  Description of Artificial Sequence: Synthetic oligonucleotide
  Target: ATXN1; (+) strand; PAM type: NRG; PAM sequence: AGG
aaagaggggagtccccaatt

SEQ ID NO: 105525 - DNA, 20 bp, Artificial Sequence
  Description of Artificial Sequence: Synthetic oligonucleotide
  Target: ATXN1; (+) strand; PAM type: NRG; PAM sequence: CAG
ccccaattaggccccacctt

SEQ ID NO: 105526 - DNA, 20 bp, Artificial Sequence
  Description of Artificial Sequence: Synthetic oligonucleotide
  Target: ATXN1; (+) strand; PAM type: NRG; PAM sequence: AGG
cccaattaggccccaccttc

SEQ ID NO: 105527 - DNA, 20 bp, Artificial Sequence
  Description of Artificial Sequence: Synthetic oligonucleotide
  Target: ATXN1; (+) strand; PAM type: NRG; PAM sequence: GAG
attaggccccaccttcaggc

SEQ ID NO: 105528 - DNA, 20 bp, Artificial Sequence
  Description of Artificial Sequence: Synthetic oligonucleotide
  Target: ATXN1; (+) strand; PAM type: NRG; PAM sequence: AGG
ttaggccccaccttcaggcg

SEQ ID NO: 105529 - DNA, 20 bp, Artificial Sequence
  Description of Artificial Sequence: Synthetic oligonucleotide
  Target: ATXN1; (+) strand; PAM type: NRG; PAM sequence: GGG
taggccccaccttcaggcga

SEQ ID NO: 105530 - DNA, 20 bp, Artificial Sequence
  Description of Artificial Sequence: Synthetic oligonucleotide
  Target: ATXN1; (+) strand; PAM type: NRG; PAM sequence: GAG
ggccccaccttcaggcgagg

SEQ ID NO: 105531 - DNA, 20 bp, Artificial Sequence
  Description of Artificial Sequence: Synthetic oligonucleotide
  Target: ATXN1; (+) strand; PAM type: NRG; PAM sequence: AGG
gccccaccttcaggcgaggg

SEQ ID NO: 105532 - DNA, 20 bp, Artificial Sequence
  Description of Artificial Sequence: Synthetic oligonucleotide
  Target: ATXN1; (+) strand; PAM type: NRG; PAM sequence: GGG
ccccaccttcaggcgaggga

SEQ ID NO: 105533 - DNA, 20 bp, Artificial Sequence
  Description of Artificial Sequence: Synthetic oligonucleotide
  Target: ATXN1; (+) strand; PAM type: NRG; PAM sequence: AAG
ttcaggcgagggagggcctg

SEQ ID NO: 105534 - DNA, 20 bp, Artificial Sequence
  Description of Artificial Sequence: Synthetic oligonucleotide
  Target: ATXN1; (+) strand; PAM type: NRG; PAM sequence: AGG
tcaggcgagggagggcctga

SEQ ID NO: 105535 - DNA, 20 bp, Artificial Sequence
  Description of Artificial Sequence: Synthetic oligonucleotide
  Target: ATXN1; (+) strand; PAM type: NRG; PAM sequence: TGG
gcgagggagggcctgaaggc

SEQ ID NO: 105536 - DNA, 20 bp, Artificial Sequence
  Description of Artificial Sequence: Synthetic oligonucleotide
  Target: ATXN1; (+) strand; PAM type: NRG; PAM sequence: GGG
cgagggagggcctgaaggct

SEQ ID NO: 105537 - DNA, 20 bp, Artificial Sequence
  Description of Artificial Sequence: Synthetic oligonucleotide
  Target: ATXN1; (+) strand; PAM type: NRG; PAM sequence: GGG
gagggagggcctgaaggctg

SEQ ID NO: 105538 - DNA, 20 bp, Artificial Sequence
  Description of Artificial Sequence: Synthetic oligonucleotide
  Target: ATXN1; (+) strand; PAM type: NRG; PAM sequence: GGG
agggagggcctgaaggctgg

SEQ ID NO: 105539 - DNA, 20 bp, Artificial Sequence
  Description of Artificial Sequence: Synthetic oligonucleotide
  Target: ATXN1; (+) strand; PAM type: NRG; PAM sequence: CGG
agggcctgaaggctgggggc

SEQ ID NO: 105540 - DNA, 20 bp, Artificial Sequence
  Description of Artificial Sequence: Synthetic oligonucleotide
  Target: ATXN1; (+) strand; PAM type: NRG; PAM sequence: GGG
gggcctgaaggctgggggcc

SEQ ID NO: 105541 - DNA, 20 bp, Artificial Sequence
  Description of Artificial Sequence: Synthetic oligonucleotide
  Target: ATXN1; (+) strand; PAM type: NRG; PAM sequence: CAG
aaggctgggggccgggctgc

SEQ ID NO: 105542 - DNA, 20 bp, Artificial Sequence
  Description of Artificial Sequence: Synthetic oligonucleotide
  Target: ATXN1; (+) strand; PAM type: NRG; PAM sequence: CAG
gggctgccagtcctgccgac

SEQ ID NO: 105543 - DNA, 20 bp, Artificial Sequence
  Description of Artificial Sequence: Synthetic oligonucleotide
  Target: ATXN1; (+) strand; PAM type: NRG; PAM sequence: GAG
gctgccagtcctgccgacca

SEQ ID NO: 105544 - DNA, 20 bp, Artificial Sequence
  Description of Artificial Sequence: Synthetic oligonucleotide
  Target: ATXN1; (+) strand; PAM type: NRG; PAM sequence: TGG
gccagtcctgccgaccagag

SEQ ID NO: 105545 - DNA, 20 bp, Artificial Sequence
  Description of Artificial Sequence: Synthetic oligonucleotide
  Target: ATXN1; (+) strand; PAM type: NRG; PAM sequence: GGG
ccagtcctgccgaccagagt

SEQ ID NO: 105546 - DNA, 20 bp, Artificial Sequence
  Description of Artificial Sequence: Synthetic oligonucleotide
  Target: ATXN1; (+) strand; PAM type: NRG; PAM sequence: GGG
cagtcctgccgaccagagtg

SEQ ID NO: 105547 - DNA, 20 bp, Artificial Sequence
  Description of Artificial Sequence: Synthetic oligonucleotide
  Target: ATXN1; (+) strand; PAM type: NRG; PAM sequence: TGG
ccgaccagagtggggactcg

SEQ ID NO: 105548 - DNA, 20 bp, Artificial Sequence
  Description of Artificial Sequence: Synthetic oligonucleotide
  Target: ATXN1; (+) strand; PAM type: NRG; PAM sequence: TGG
gtgcctcttccgtccaccca

SEQ ID NO: 105549 - DNA, 20 bp, Artificial Sequence
  Description of Artificial Sequence: Synthetic oligonucleotide
  Target: ATXN1; (+) strand; PAM type: NRG; PAM sequence: TGG
cgtccacccatggccaccca

SEQ ID NO: 105550 - DNA, 20 bp, Artificial Sequence
  Description of Artificial Sequence: Synthetic oligonucleotide
  Target: ATXN1; (+) strand; PAM type: NRG; PAM sequence: TGG
atggccacccatggaccaat

SEQ ID NO: 105551 - DNA, 20 bp, Artificial Sequence
  Description of Artificial Sequence: Synthetic oligonucleotide
  Target: ATXN1; (+) strand; PAM type: NRG; PAM sequence: GAG
gcacatacttcctcccctct

SEQ ID NO: 105552 - DNA, 20 bp, Artificial Sequence
  Description of Artificial Sequence: Synthetic oligonucleotide
  Target: ATXN1; (+) strand; PAM type: NRG; PAM sequence: AGG
cacatacttcctcccctctg

SEQ ID NO: 105553 - DNA, 20 bp, Artificial Sequence
  Description of Artificial Sequence: Synthetic oligonucleotide
  Target: ATXN1; (+) strand; PAM type: NRG; PAM sequence: AAG
ctcccctctgaggtccataa

SEQ ID NO: 105554 - DNA, 20 bp, Artificial Sequence
  Description of Artificial Sequence: Synthetic oligonucleotide
  Target: ATXN1; (+) strand; PAM type: NRG; PAM sequence: TGG
tctgaggtccataaaagccc

SEQ ID NO: 105555 - DNA, 20 bp, Artificial Sequence
  Description of Artificial Sequence: Synthetic oligonucleotide
  Target: ATXN1; (+) strand; PAM type: NRG; PAM sequence: GGG
ctgaggtccataaaagccct

SEQ ID NO: 105556 - DNA, 20 bp, Artificial Sequence
  Description of Artificial Sequence: Synthetic oligonucleotide
  Target: ATXN1; (+) strand; PAM type: NRG; PAM sequence: TAG
gtccataaaagccctgggct

SEQ ID NO: 105557 - DNA, 20 bp, Artificial Sequence
  Description of Artificial Sequence: Synthetic oligonucleotide
  Target: ATXN1; (+) strand; PAM type: NRG; PAM sequence: CAG
aaaagccctgggcttagcca

SEQ ID NO: 105558 - DNA, 20 bp, Artificial Sequence
  Description of Artificial Sequence: Synthetic oligonucleotide
  Target: ATXN1; (+) strand; PAM type: NRG; PAM sequence: CAG
agccctgggcttagccacag

SEQ ID NO: 105559 - DNA, 20 bp, Artificial Sequence
  Description of Artificial Sequence: Synthetic oligonucleotide
  Target: ATXN1; (+) strand; PAM type: NRG; PAM sequence: AGG
gccctgggcttagccacagc

SEQ ID NO: 105560 - DNA, 20 bp, Artificial Sequence
  Description of Artificial Sequence: Synthetic oligonucleotide
  Target: ATXN1; (+) strand; PAM type: NRG; PAM sequence: CAG
ctgggcttagccacagcagg

SEQ ID NO: 105561 - DNA, 20 bp, Artificial Sequence
  Description of Artificial Sequence: Synthetic oligonucleotide
  Target: ATXN1; (+) strand; PAM type: NRG; PAM sequence: AGG
tgggcttagccacagcaggc

SEQ ID NO: 105562 - DNA, 20 bp, Artificial Sequence
  Description of Artificial Sequence: Synthetic oligonucleotide
  Target: ATXN1; (+) strand; PAM type: NRG; PAM sequence: GAG
ggcttagccacagcaggcag

SEQ ID NO: 105563 - DNA, 20 bp, Artificial Sequence
  Description of Artificial Sequence: Synthetic oligonucleotide
  Target: ATXN1; (+) strand; PAM type: NRG; PAM sequence: AGG
gcttagccacagcaggcagg

SEQ ID NO: 105564 - DNA, 20 bp, Artificial Sequence
  Description of Artificial Sequence: Synthetic oligonucleotide
  Target: ATXN1; (+) strand; PAM type: NRG; PAM sequence: TGG
agccacagcaggcaggagga

SEQ ID NO: 105565 - DNA, 20 bp, Artificial Sequence
  Description of Artificial Sequence: Synthetic oligonucleotide
  Target: ATXN1; (+) strand; PAM type: NRG; PAM sequence: CAG
acagcaggcaggaggatggc

SEQ ID NO: 105566 - DNA, 20 bp, Artificial Sequence
  Description of Artificial Sequence: Synthetic oligonucleotide
  Target: ATXN1; (+) strand; PAM type: NRG; PAM sequence: AGG
cagcaggcaggaggatggcc

SEQ ID NO: 105567 - DNA, 20 bp, Artificial Sequence
  Description of Artificial Sequence: Synthetic oligonucleotide
  Target: ATXN1; (+) strand; PAM type: NRG; PAM sequence: GGG
agcaggcaggaggatggcca

SEQ ID NO: 105568 - DNA, 20 bp, Artificial Sequence
  Description of Artificial Sequence: Synthetic oligonucleotide
  Target: ATXN1; (+) strand; PAM type: NRG; PAM sequence: AAG
caggaggatggccagggaca

SEQ ID NO: 105569 - DNA, 20 bp, Artificial Sequence
  Description of Artificial Sequence: Synthetic oligonucleotide
  Target: ATXN1; (+) strand; PAM type: NRG; PAM sequence: AGG
aggaggatggccagggacaa

SEQ ID NO: 105570 - DNA, 20 bp, Artificial Sequence
  Description of Artificial Sequence: Synthetic oligonucleotide
  Target: ATXN1; (+) strand; PAM type: NRG; PAM sequence: GGG
ggaggatggccagggacaaa

SEQ ID NO: 105571 - DNA, 20 bp, Artificial Sequence
  Description of Artificial Sequence: Synthetic oligonucleotide
  Target: ATXN1; (+) strand; PAM type: NRG; PAM sequence: GGG
gaggatggccagggacaaag

SEQ ID NO: 105572 - DNA, 20 bp, Artificial Sequence
  Description of Artificial Sequence: Synthetic oligonucleotide
  Target: ATXN1; (+) strand; PAM type: NRG; PAM sequence: GGG
aggatggccagggacaaagg

SEQ ID NO: 105573 - DNA, 20 bp, Artificial Sequence
  Description of Artificial Sequence: Synthetic oligonucleotide
  Target: ATXN1; (+) strand; PAM type: NRG; PAM sequence: CAG
atggccagggacaaaggggg

SEQ ID NO: 105574 - DNA, 20 bp, Artificial Sequence
  Description of Artificial Sequence: Synthetic oligonucleotide
  Target: ATXN1; (+) strand; PAM type: NRG; PAM sequence: GAG
ggccagggacaaagggggca

SEQ ID NO: 105575 - DNA, 20 bp, Artificial Sequence
  Description of Artificial Sequence: Synthetic oligonucleotide
  Target: ATXN1; (+) strand; PAM type: NRG; PAM sequence: GAG
ccagggacaaagggggcaga

SEQ ID NO: 105576 - DNA, 20 bp, Artificial Sequence
  Description of Artificial Sequence: Synthetic oligonucleotide
  Target: ATXN1; (+) strand; PAM type: NRG; PAM sequence: GAG
agggacaaagggggcagaga

SEQ ID NO: 105577 - DNA, 20 bp, Artificial Sequence
  Description of Artificial Sequence: Synthetic oligonucleotide
  Target: ATXN1; (+) strand; PAM type: NRG; PAM sequence: TGG
caaagggggcagagagagaa

SEQ ID NO: 105578 - DNA, 20 bp, Artificial Sequence
  Description of Artificial Sequence: Synthetic oligonucleotide
  Target: ATXN1; (+) strand; PAM type: NRG; PAM sequence: GGG
aaagggggcagagagagaat

SEQ ID NO: 105579 - DNA, 20 bp, Artificial Sequence
  Description of Artificial Sequence: Synthetic oligonucleotide
  Target: ATXN1; (+) strand; PAM type: NRG; PAM sequence: TGG
gggcagagagagaatgggac

SEQ ID NO: 105580 - DNA, 20 bp, Artificial Sequence
  Description of Artificial Sequence: Synthetic oligonucleotide
  Target: ATXN1; (+) strand; PAM type: NRG; PAM sequence: CAG
agagaatgggactggatgac

SEQ ID NO: 105581 - DNA, 20 bp, Artificial Sequence
  Description of Artificial Sequence: Synthetic oligonucleotide
  Target: ATXN1; (+) strand; PAM type: NRG; PAM sequence: CAG
tgggactggatgaccagttg

SEQ ID NO: 105582 - DNA, 20 bp, Artificial Sequence
  Description of Artificial Sequence: Synthetic oligonucleotide
  Target: ATXN1; (+) strand; PAM type: NRG; PAM sequence: GAG
ggactggatgaccagttgca

SEQ ID NO: 105583 - DNA, 20 bp, Artificial Sequence
  Description of Artificial Sequence: Synthetic oligonucleotide
  Target: ATXN1; (+) strand; PAM type: NRG; PAM sequence: GAG
actggatgaccagttgcaga

SEQ ID NO: 105584 - DNA, 20 bp, Artificial Sequence
  Description of Artificial Sequence: Synthetic oligonucleotide
  Target: ATXN1; (+) strand; PAM type: NRG; PAM sequence: AGG
ctggatgaccagttgcagag

SEQ ID NO: 105585 - DNA, 20 bp, Artificial Sequence
  Description of Artificial Sequence: Synthetic oligonucleotide
  Target: ATXN1; (+) strand; PAM type: NRG; PAM sequence: GAG
ggatgaccagttgcagagag

SEQ ID NO: 105586 - DNA, 20 bp, Artificial Sequence
  Description of Artificial Sequence: Synthetic oligonucleotide
  Target: ATXN1; (+) strand; PAM type: NRG; PAM sequence: TAG
aggagtaccctctctgctga

SEQ ID NO: 105587 - DNA, 20 bp, Artificial Sequence
  Description of Artificial Sequence: Synthetic oligonucleotide
  Target: ATXN1; (+) strand; PAM type: NRG; PAM sequence: TGG
gtaccctctctgctgatagc

SEQ ID NO: 105588 - DNA, 20 bp, Artificial Sequence
  Description of Artificial Sequence: Synthetic oligonucleotide
  Target: ATXN1; (+) strand; PAM type: NRG; PAM sequence: GAG
accctctctgctgatagctg

SEQ ID NO: 105589 - DNA, 20 bp, Artificial Sequence
  Description of Artificial Sequence: Synthetic oligonucleotide
  Target: ATXN1; (+) strand; PAM type: NRG; PAM sequence: TGG
ctgctgatagctggagacga

SEQ ID NO: 105590 - DNA, 20 bp, Artificial Sequence
  Description of Artificial Sequence: Synthetic oligonucleotide
  Target: ATXN1; (+) strand; PAM type: NRG; PAM sequence: GGG
tgctgatagctggagacgat

SEQ ID NO: 105591 - DNA, 20 bp, Artificial Sequence
  Description of Artificial Sequence: Synthetic oligonucleotide
  Target: ATXN1; (+) strand; PAM type: NRG; PAM sequence: CAG
gctggagacgatgggacaac

SEQ ID NO: 105592 - DNA, 20 bp, Artificial Sequence
  Description of Artificial Sequence: Synthetic oligonucleotide
  Target: ATXN1; (+) strand; PAM type: NRG; PAM sequence: CAG
gacgatgggacaaccagctg

SEQ ID NO: 105593 - DNA, 20 bp, Artificial Sequence
  Description of Artificial Sequence: Synthetic oligonucleotide
  Target: ATXN1; (+) strand; PAM type: NRG; PAM sequence: GAG
cgatgggacaaccagctgca

SEQ ID NO: 105594 - DNA, 20 bp, Artificial Sequence
  Description of Artificial Sequence: Synthetic oligonucleotide
  Target: ATXN1; (+) strand; PAM type: NRG; PAM sequence: TGG
cagctgcagagatgacctgc

SEQ ID NO: 105595 - DNA, 20 bp, Artificial Sequence
  Description of Artificial Sequence: Synthetic oligonucleotide
  Target: ATXN1; (+) strand; PAM type: NRG; PAM sequence: CAG
ctgcagagatgacctgctgg

SEQ ID NO: 105596 - DNA, 20 bp, Artificial Sequence
  Description of Artificial Sequence: Synthetic oligonucleotide
  Target: ATXN1; (+) strand; PAM type: NRG; PAM sequence: GAG
gcagagatgacctgctggca

SEQ ID NO: 105597 - DNA, 20 bp, Artificial Sequence
  Description of Artificial Sequence: Synthetic oligonucleotide
  Target: ATXN1; (+) strand; PAM type: NRG; PAM sequence: GAG
agagatgacctgctggcaga

SEQ ID NO: 105598 - DNA, 20 bp, Artificial Sequence
  Description of Artificial Sequence: Synthetic oligonucleotide
  Target: ATXN1; (+) strand; PAM type: NRG; PAM sequence: AGG
gagatgacctgctggcagag

SEQ ID NO: 105599 - DNA, 20 bp, Artificial Sequence
  Description of Artificial Sequence: Synthetic oligonucleotide
  Target: ATXN1; (+) strand; PAM type: NRG; PAM sequence: GAG
gatgacctgctggcagagag

SEQ ID NO: 105600 - DNA, 20 bp, Artificial Sequence
  Description of Artificial Sequence: Synthetic oligonucleotide
  Target: ATXN1; (+) strand; PAM type: NRG; PAM sequence: AAG
gaggagctaccctctctgct

SEQ ID NO: 105601 - DNA, 20 bp, Artificial Sequence
  Description of Artificial Sequence: Synthetic oligonucleotide
  Target: ATXN1; (+) strand; PAM type: NRG; PAM sequence: GAG
ggagctaccctctctgctaa

SEQ ID NO: 105602 - DNA, 20 bp, Artificial Sequence
  Description of Artificial Sequence: Synthetic oligonucleotide
  Target: ATXN1; (+) strand; PAM type: NRG; PAM sequence: AGG
gagctaccctctctgctaag

SEQ ID NO: 105603 - DNA, 20 bp, Artificial Sequence
  Description of Artificial Sequence: Synthetic oligonucleotide
  Target: ATXN1; (+) strand; PAM type: NRG; PAM sequence: GAG
gctaccctctctgctaagag

SEQ ID NO: 105604 - DNA, 20 bp, Artificial Sequence
  Description of Artificial Sequence: Synthetic oligonucleotide
  Target: ATXN1; (+) strand; PAM type: NRG; PAM sequence: CAG
ctctgctaagaggagtgctt

SEQ ID NO: 105605 - DNA, 20 bp, Artificial Sequence
  Description of Artificial Sequence: Synthetic oligonucleotide
  Target: ATXN1; (+) strand; PAM type: NRG; PAM sequence: GAG
ctgctaagaggagtgcttca

SEQ ID NO: 105606 - DNA, 20 bp, Artificial Sequence
  Description of Artificial Sequence: Synthetic oligonucleotide
  Target: ATXN1; (+) strand; PAM type: NRG; PAM sequence: CAG
aggagtgcttcagagacctg

SEQ ID NO: 105607 - DNA, 20 bp, Artificial Sequence
  Description of Artificial Sequence: Synthetic oligonucleotide
  Target: ATXN1; (+) strand; PAM type: NRG; PAM sequence: CAG
cctgcagaatgacttgcctg

SEQ ID NO: 105608 - DNA, 20 bp, Artificial Sequence
  Description of Artificial Sequence: Synthetic oligonucleotide
  Target: ATXN1; (+) strand; PAM type: NRG; PAM sequence: GAG
tgcagaatgacttgcctgca

SEQ ID NO: 105609 - DNA, 20 bp, Artificial Sequence
  Description of Artificial Sequence: Synthetic oligonucleotide
  Target: ATXN1; (+) strand; PAM type: NRG; PAM sequence: GAG
cagaatgacttgcctgcaga

SEQ ID NO: 105610 - DNA, 20 bp, Artificial Sequence
  Description of Artificial Sequence: Synthetic oligonucleotide
  Target: ATXN1; (+) strand; PAM type: NRG; PAM sequence: AGG
agaatgacttgcctgcagag

SEQ ID NO: 105611 - DNA, 20 bp, Artificial Sequence
  Description of Artificial Sequence: Synthetic oligonucleotide
  Target: ATXN1; (+) strand; PAM type: NRG; PAM sequence: GAG
aatgacttgcctgcagagag

SEQ ID NO: 105612 - DNA, 20 bp, Artificial Sequence
  Description of Artificial Sequence: Synthetic oligonucleotide
  Target: ATXN1; (+) strand; PAM type: NRG; PAM sequence: CAG
cagagaggagccaccctttc

SEQ ID NO: 105613 - DNA, 20 bp, Artificial Sequence
  Description of Artificial Sequence: Synthetic oligonucleotide
  Target: ATXN1; (+) strand; PAM type: NRG; PAM sequence: AGG
agagaggagccaccctttcc

SEQ ID NO: 105614 - DNA, 20 bp, Artificial Sequence
  Description of Artificial Sequence: Synthetic oligonucleotide
  Target: ATXN1; (+) strand; PAM type: NRG; PAM sequence: GGG
gagaggagccaccctttcca

SEQ ID NO: 105615 - DNA, 20 bp, Artificial Sequence
  Description of Artificial Sequence: Synthetic oligonucleotide
  Target: ATXN1; (+) strand; PAM type: NRG; PAM sequence: GAG
tccagggcctcctctctgct

SEQ ID NO: 105616 - DNA, 20 bp, Artificial Sequence
  Description of Artificial Sequence: Synthetic oligonucleotide
  Target: ATXN1; (+) strand; PAM type: NRG; PAM sequence: GAG
cagggcctcctctctgctga

SEQ ID NO: 105617 - DNA, 20 bp, Artificial Sequence
  Description of Artificial Sequence: Synthetic oligonucleotide
  Target: ATXN1; (+) strand; PAM type: NRG; PAM sequence: TGG
gctgagagctgaacactcaa

SEQ ID NO: 105618 - DNA, 20 bp, Artificial Sequence
  Description of Artificial Sequence: Synthetic oligonucleotide
  Target: ATXN1; (+) strand; PAM type: NRG; PAM sequence: GGG
ctgagagctgaacactcaat

SEQ ID NO: 105619 - DNA, 20 bp, Artificial Sequence
  Description of Artificial Sequence: Synthetic oligonucleotide
  Target: ATXN1; (+) strand; PAM type: NRG; PAM sequence: TAG
tcaatgggacgatctgctta

SEQ ID NO: 105620 - DNA, 20 bp, Artificial Sequence
  Description of Artificial Sequence: Synthetic oligonucleotide
  Target: ATXN1; (+) strand; PAM type: NRG; PAM sequence: GAG
aatgggacgatctgcttata

SEQ ID NO: 105621 - DNA, 20 bp, Artificial Sequence
  Description of Artificial Sequence: Synthetic oligonucleotide
  Target: ATXN1; (+) strand; PAM type: NRG; PAM sequence: GAG
tgggacgatctgcttataga

SEQ ID NO: 105622 - DNA, 20 bp, Artificial Sequence
  Description of Artificial Sequence: Synthetic oligonucleotide
  Target: ATXN1; (+) strand; PAM type: NRG; PAM sequence: AGG
gggacgatctgcttatagag

SEQ ID NO: 105623 - DNA, 20 bp, Artificial Sequence
  Description of Artificial Sequence: Synthetic oligonucleotide
  Target: ATXN1; (+) strand; PAM type: NRG; PAM sequence: GAG
gacgatctgcttatagagag

SEQ ID NO: 105624 - DNA, 20 bp, Artificial Sequence
  Description of Artificial Sequence: Synthetic oligonucleotide
  Target: ATXN1; (+) strand; PAM type: NRG; PAM sequence: GAG
gaggagctccccactcctcc

SEQ ID NO: 105625 - DNA, 20 bp, Artificial Sequence
  Description of Artificial Sequence: Synthetic oligonucleotide
  Target: ATXN1; (+) strand; PAM type: NRG; PAM sequence: TGG
tctgtgtacctcattctttc

SEQ ID NO: 105626 - DNA, 20 bp, Artificial Sequence
  Description of Artificial Sequence: Synthetic oligonucleotide
  Target: ATXN1; (+) strand; PAM type: NRG; PAM sequence: CAG
tacctcattctttctggacg

SEQ ID NO: 105627 - DNA, 20 bp, Artificial Sequence
  Description of Artificial Sequence: Synthetic oligonucleotide
  Target: ATXN1; (+) strand; PAM type: NRG; PAM sequence: AGG
acctcattctttctggacgc

SEQ ID NO: 105628 - DNA, 20 bp, Artificial Sequence
  Description of Artificial Sequence: Synthetic oligonucleotide
  Target: ATXN1; (+) strand; PAM type: NRG; PAM sequence: TGG
ctggacgcaggacaaaaact

SEQ ID NO: 105629 - DNA, 20 bp, Artificial Sequence
  Description of Artificial Sequence: Synthetic oligonucleotide
  Target: ATXN1; (+) strand; PAM type: NRG; PAM sequence: GGG
tggacgcaggacaaaaactt

SEQ ID NO: 105630 - DNA, 20 bp, Artificial Sequence
  Description of Artificial Sequence: Synthetic oligonucleotide
  Target: ATXN1; (+) strand; PAM type: NRG; PAM sequence: AAG
ggacaaaaacttgggcttaa

SEQ ID NO: 105631 - DNA, 20 bp, Artificial Sequence
  Description of Artificial Sequence: Synthetic oligonucleotide
  Target: ATXN1; (+) strand; PAM type: NRG; PAM sequence: AGG
gacaaaaacttgggcttaaa

SEQ ID NO: 105632 - DNA, 20 bp, Artificial Sequence
  Description of Artificial Sequence: Synthetic oligonucleotide
  Target: ATXN1; (+) strand; PAM type: NRG; PAM sequence: CGG
cttgggcttaaaaggcgttg

SEQ ID NO: 105633 - DNA, 20 bp, Artificial Sequence
  Description of Artificial Sequence: Synthetic oligonucleotide
  Target: ATXN1; (+) strand; PAM type: NRG; PAM sequence: CAG
cttaaaaggcgttgcggcca

SEQ ID NO: 105634 - DNA, 20 bp, Artificial Sequence
  Description of Artificial Sequence: Synthetic oligonucleotide
  Target: ATXN1; (+) strand; PAM type: NRG; PAM sequence: AAG
aaaaggcgttgcggccacag

SEQ ID NO: 105635 - DNA, 20 bp, Artificial Sequence
  Description of Artificial Sequence: Synthetic oligonucleotide
  Target: ATXN1; (+) strand; PAM type: NRG; PAM sequence: CAG
cggccacagaagtttcccat

SEQ ID NO: 105636 - DNA, 20 bp, Artificial Sequence
  Description of Artificial Sequence: Synthetic oligonucleotide
  Target: ATXN1; (+) strand; PAM type: NRG; PAM sequence: CAG
catcagaaaaattgacaccc

SEQ ID NO: 105637 - DNA, 20 bp, Artificial Sequence
  Description of Artificial Sequence: Synthetic oligonucleotide
  Target: ATXN1; (+) strand; PAM type: NRG; PAM sequence: GAG
tcagaaaaattgacacccca

SEQ ID NO: 105638 - DNA, 20 bp, Artificial Sequence
  Description of Artificial Sequence: Synthetic oligonucleotide
  Target: ATXN1; (+) strand; PAM type: NRG; PAM sequence: CAG
acaccccagagatcctataa

SEQ ID NO: 105639 - DNA, 20 bp, Artificial Sequence
  Description of Artificial Sequence: Synthetic oligonucleotide
  Target: ATXN1; (+) strand; PAM type: NRG; PAM sequence: AAG
aacagtatgttctcacgcat

SEQ ID NO: 105640 - DNA, 20 bp, Artificial Sequence
  Description of Artificial Sequence: Synthetic oligonucleotide
  Target: ATXN1; (+) strand; PAM type: NRG; PAM sequence: TGG
agtatgttctcacgcataag

SEQ ID NO: 105641 - DNA, 20 bp, Artificial Sequence
  Description of Artificial Sequence: Synthetic oligonucleotide
  Target: ATXN1; (+) strand; PAM type: NRG; PAM sequence: GGG
gtatgttctcacgcataagt

SEQ ID NO: 105642 - DNA, 20 bp, Artificial Sequence
  Description of Artificial Sequence: Synthetic oligonucleotide
  Target: ATXN1; (+) strand; PAM type: NRG; PAM sequence: GAG
atgttctcacgcataagtgg

SEQ ID NO: 105643 - DNA, 20 bp, Artificial Sequence
  Description of Artificial Sequence: Synthetic oligonucleotide
  Target: ATXN1; (+) strand; PAM type: NRG; PAM sequence: AAG
ctcacgcataagtgggagcc

SEQ ID NO: 105644 - DNA, 20 bp, Artificial Sequence
  Description of Artificial Sequence: Synthetic oligonucleotide
  Target: ATXN1; (+) strand; PAM type: NRG; PAM sequence: GAG
ataagtgggagccaagccat

SEQ ID NO: 105645 - DNA, 20 bp, Artificial Sequence
  Description of Artificial Sequence: Synthetic oligonucleotide
  Target: ATXN1; (+) strand; PAM type: NRG; PAM sequence: AGG
taagtgggagccaagccatg

SEQ ID NO: 105646 - DNA, 20 bp, Artificial Sequence
  Description of Artificial Sequence: Synthetic oligonucleotide
  Target: ATXN1; (+) strand; PAM type: NRG; PAM sequence: AAG
agccaagccatgaggatgca

SEQ ID NO: 105647 - DNA, 20 bp, Artificial Sequence
  Description of Artificial Sequence: Synthetic oligonucleotide
  Target: ATXN1; (+) strand; PAM type: NRG; PAM sequence: AGG
gccaagccatgaggatgcaa

SEQ ID NO: 105648 - DNA, 20 bp, Artificial Sequence
  Description of Artificial Sequence: Synthetic oligonucleotide
  Target: ATXN1; (+) strand; PAM type: NRG; PAM sequence: CAG
gcaaaggcctcacaatgata

SEQ ID NO: 105649 - DNA, 20 bp, Artificial Sequence
  Description of Artificial Sequence: Synthetic oligonucleotide
  Target: ATXN1; (+) strand; PAM type: NRG; PAM sequence: TGG
aaggcctcacaatgatacag

SEQ ID NO: 105650 - DNA, 20 bp, Artificial Sequence
  Description of Artificial Sequence: Synthetic oligonucleotide
  Target: ATXN1; (+) strand; PAM type: NRG; PAM sequence: TGG
cacaatgatacagtggactt

SEQ ID NO: 105651 - DNA, 20 bp, Artificial Sequence
  Description of Artificial Sequence: Synthetic oligonucleotide
  Target: ATXN1; (+) strand; PAM type: NRG; PAM sequence: GGG
acaatgatacagtggacttt

SEQ ID NO: 105652 - DNA, 20 bp, Artificial Sequence
  Description of Artificial Sequence: Synthetic oligonucleotide
  Target: ATXN1; (+) strand; PAM type: NRG; PAM sequence: GGG
caatgatacagtggactttg

SEQ ID NO: 105653 - DNA, 20 bp, Artificial Sequence
  Description of Artificial Sequence: Synthetic oligonucleotide
  Target: ATXN1; (+) strand; PAM type: NRG; PAM sequence: TGG
tacagtggactttggggact

SEQ ID NO: 105654 - DNA, 20 bp, Artificial Sequence
  Description of Artificial Sequence: Synthetic oligonucleotide
  Target: ATXN1; (+) strand; PAM type: NRG; PAM sequence: GGG
acagtggactttggggactt

SEQ ID NO: 105655 - DNA, 20 bp, Artificial Sequence
  Description of Artificial Sequence: Synthetic oligonucleotide
  Target: ATXN1; (+) strand; PAM type: NRG; PAM sequence: GAG
agtggactttggggacttgg

SEQ ID NO: 105656 - DNA, 20 bp, Artificial Sequence
  Description of Artificial Sequence: Synthetic oligonucleotide
  Target: ATXN1; (+) strand; PAM type: NRG; PAM sequence: AAG
gactttggggacttgggaga

SEQ ID NO: 105657 - DNA, 20 bp, Artificial Sequence
  Description of Artificial Sequence: Synthetic oligonucleotide
  Target: ATXN1; (+) strand; PAM type: NRG; PAM sequence: AGG
actttggggacttgggagaa

SEQ ID NO: 105658 - DNA, 20 bp, Artificial Sequence
  Description of Artificial Sequence: Synthetic oligonucleotide
  Target: ATXN1; (+) strand; PAM type: NRG; PAM sequence: GGG
ctttggggacttgggagaaa

SEQ ID NO: 105659 - DNA, 20 bp, Artificial Sequence
  Description of Artificial Sequence: Synthetic oligonucleotide
  Target: ATXN1; (+) strand; PAM type: NRG; PAM sequence: TGG
tggggacttgggagaaaggg

SEQ ID NO: 105660 - DNA, 20 bp, Artificial Sequence
  Description of Artificial Sequence: Synthetic oligonucleotide
  Target: ATXN1; (+) strand; PAM type: NRG; PAM sequence: GGG
ggggacttgggagaaagggt

SEQ ID NO: 105661 - DNA, 20 bp, Artificial Sequence
  Description of Artificial Sequence: Synthetic oligonucleotide
  Target: ATXN1; (+) strand; PAM type: NRG; PAM sequence: GAG
ggacttgggagaaagggtgg

SEQ ID NO: 105662 - DNA, 20 bp, Artificial Sequence
  Description of Artificial Sequence: Synthetic oligonucleotide
  Target: ATXN1; (+) strand; PAM type: NRG; PAM sequence: AGG
gacttgggagaaagggtggg

SEQ ID NO: 105663 - DNA, 20 bp, Artificial Sequence
  Description of Artificial Sequence: Synthetic oligonucleotide
  Target: ATXN1; (+) strand; PAM type: NRG; PAM sequence: GGG
acttgggagaaagggtggga

SEQ ID NO: 105664 - DNA, 20 bp, Artificial Sequence
  Description of Artificial Sequence: Synthetic oligonucleotide
  Target: ATXN1; (+) strand; PAM type: NRG; PAM sequence: GGG
cttgggagaaagggtgggag

SEQ ID NO: 105665 - DNA, 20 bp, Artificial Sequence
  Description of Artificial Sequence: Synthetic oligonucleotide
  Target: ATXN1; (+) strand; PAM type: NRG; PAM sequence: GGG
ttgggagaaagggtgggagg

SEQ ID NO: 105666 - DNA, 20 bp, Artificial Sequence
  Description of Artificial Sequence: Synthetic oligonucleotide
  Target: ATXN1; (+) strand; PAM type: NRG; PAM sequence: GGG
tgggagaaagggtgggaggg

SEQ ID NO: 105667 - DNA, 20 bp, Artificial Sequence
  Description of Artificial Sequence: Synthetic oligonucleotide
  Target: ATXN1; (+) strand; PAM type: NRG; PAM sequence: GAG
agaaagggtgggaggggggt

SEQ ID NO: 105668 - DNA, 20 bp, Artificial Sequence
  Description of Artificial Sequence: Synthetic oligonucleotide
  Target: ATXN1; (+) strand; PAM type: NRG; PAM sequence: AGG
gaaagggtgggaggggggtg

SEQ ID NO: 105669 - DNA, 20 bp, Artificial Sequence
  Description of Artificial Sequence: Synthetic oligonucleotide
  Target: ATXN1; (+) strand; PAM type: NRG; PAM sequence: GGG
aaagggtgggaggggggtga

SEQ ID NO: 105670 - DNA, 20 bp, Artificial Sequence
  Description of Artificial Sequence: Synthetic oligonucleotide
  Target: ATXN1; (+) strand; PAM type: NRG; PAM sequence: TGG
agggataaatgactacaaaa

SEQ ID NO: 105671 - DNA, 20 bp, Artificial Sequence
  Description of Artificial Sequence: Synthetic oligonucleotide
  Target: ATXN1; (+) strand; PAM type: NRG; PAM sequence: GGG
gggataaatgactacaaaat

SEQ ID NO: 105672 - DNA, 20 bp, Artificial Sequence
  Description of Artificial Sequence: Synthetic oligonucleotide
  Target: ATXN1; (+) strand; PAM type: NRG; PAM sequence: CAG
aaatgactacaaaatgggta

SEQ ID NO: 105673 - DNA, 20 bp, Artificial Sequence
  Description of Artificial Sequence: Synthetic oligonucleotide
  Target: ATXN1; (+) strand; PAM type: NRG; PAM sequence: TAG
tacaaaatgggtacagtgta

SEQ ID NO: 105674 - DNA, 20 bp, Artificial Sequence
  Description of Artificial Sequence: Synthetic oligonucleotide
  Target: ATXN1; (+) strand; PAM type: NRG; PAM sequence: CGG
tgggtacagtgtatagtgct

SEQ ID NO: 105675 - DNA, 20 bp, Artificial Sequence
  Description of Artificial Sequence: Synthetic oligonucleotide
  Target: ATXN1; (+) strand; PAM type: NRG; PAM sequence: GGG
gggtacagtgtatagtgctc

SEQ ID NO: 105676 - DNA, 20 bp, Artificial Sequence
  Description of Artificial Sequence: Synthetic oligonucleotide
  Target: ATXN1; (+) strand; PAM type: NRG; PAM sequence: TGG
agtgtatagtgctcgggtga

SEQ ID NO: 105677 - DNA, 20 bp, Artificial Sequence
  Description of Artificial Sequence: Synthetic oligonucleotide
  Target: ATXN1; (+) strand; PAM type: NRG; PAM sequence: CAG
gatggctgcaccgaaaatct

SEQ ID NO: 105678 - DNA, 20 bp, Artificial Sequence
  Description of Artificial Sequence: Synthetic oligonucleotide
  Target: ATXN1; (+) strand; PAM type: NRG; PAM sequence: AAG
aatctcagaaatcaccaccg

SEQ ID NO: 105679 - DNA, 20 bp, Artificial Sequence
  Description of Artificial Sequence: Synthetic oligonucleotide
  Target: ATXN1; (+) strand; PAM type: NRG; PAM sequence: TGG
acctgttcccccaaaaccta

SEQ ID NO: 105680 - DNA, 20 bp, Artificial Sequence
  Description of Artificial Sequence: Synthetic oligonucleotide
  Target: ATXN1; (+) strand; PAM type: NRG; PAM sequence: AAG
cgtaaaaaataaaaataaaa

SEQ ID NO: 105681 - DNA, 20 bp, Artificial Sequence
  Description of Artificial Sequence: Synthetic oligonucleotide
  Target: ATXN1; (+) strand; PAM type: NRG; PAM sequence: CAG
aaaaataaaaataaaaaaga

SEQ ID NO: 105682 - DNA, 20 bp, Artificial Sequence
  Description of Artificial Sequence: Synthetic oligonucleotide
  Target: ATXN1; (+) strand; PAM type: NRG; PAM sequence: AAG
aataaaaataaaaaagacag

SEQ ID NO: 105683 - DNA, 20 bp, Artificial Sequence
  Description of Artificial Sequence: Synthetic oligonucleotide
  Target: ATXN1; (+) strand; PAM type: NRG; PAM sequence: AAG
aaaaaagacagaagaaaatt

SEQ ID NO: 105684 - DNA, 20 bp, Artificial Sequence
  Description of Artificial Sequence: Synthetic oligonucleotide
  Target: ATXN1; (+) strand; PAM type: NRG; PAM sequence: CAG
gacatcaattatattaaatg

SEQ ID NO: 105685 - DNA, 20 bp, Artificial Sequence
  Description of Artificial Sequence: Synthetic oligonucleotide
  Target: ATXN1; (+) strand; PAM type: NRG; PAM sequence: CAG
atcaattatattaaatgcag

SEQ ID NO: 105686 - DNA, 20 bp, Artificial Sequence
  Description of Artificial Sequence: Synthetic oligonucleotide
  Target: ATXN1; (+) strand; PAM type: NRG; PAM sequence: GAG
caattatattaaatgcagca

SEQ ID NO: 105687 - DNA, 20 bp, Artificial Sequence
  Description of Artificial Sequence: Synthetic oligonucleotide
  Target: ATXN1; (+) strand; PAM type: NRG; PAM sequence: CAG
tattaaatgcagcagagaaa

SEQ ID NO: 105688 - DNA, 20 bp, Artificial Sequence
  Description of Artificial Sequence: Synthetic oligonucleotide
  Target: ATXN1; (+) strand; PAM type: NRG; PAM sequence: AAG
aaatgcagcagagaaacaga

SEQ ID NO: 105689 - DNA, 20 bp, Artificial Sequence
  Description of Artificial Sequence: Synthetic oligonucleotide
  Target: ATXN1; (+) strand; PAM type: NRG; PAM sequence: AAG
agcagagaaacagaaagact

SEQ ID NO: 105690 - DNA, 20 bp, Artificial Sequence
  Description of Artificial Sequence: Synthetic oligonucleotide
  Target: ATXN1; (+) strand; PAM type: NRG; PAM sequence: TGG
agaaacagaaagactaagaa

SEQ ID NO: 105691 - DNA, 20 bp, Artificial Sequence
  Description of Artificial Sequence: Synthetic oligonucleotide
  Target: ATXN1; (+) strand; PAM type: NRG; PAM sequence: TGG
gaaagactaagaatggccat

SEQ ID NO: 105692 - DNA, 20 bp, Artificial Sequence
  Description of Artificial Sequence: Synthetic oligonucleotide
  Target: ATXN1; (+) strand; PAM type: NRG; PAM sequence: TAG
actaagaatggccattggat

SEQ ID NO: 105693 - DNA, 20 bp, Artificial Sequence
  Description of Artificial Sequence: Synthetic oligonucleotide
  Target: ATXN1; (+) strand; PAM type: NRG; PAM sequence: TGG
atggccattggattagacca

SEQ ID NO: 105694 - DNA, 20 bp, Artificial Sequence
  Description of Artificial Sequence: Synthetic oligonucleotide
  Target: ATXN1; (+) strand; PAM type: NRG; PAM sequence: GGG
tggccattggattagaccat

SEQ ID NO: 105695 - DNA, 20 bp, Artificial Sequence
  Description of Artificial Sequence: Synthetic oligonucleotide
  Target: ATXN1; (+) strand; PAM type: NRG; PAM sequence: TAG
tctcaatatctgctgaatat

SEQ ID NO: 105696 - DNA, 20 bp, Artificial Sequence
  Description of Artificial Sequence: Synthetic oligonucleotide
  Target: ATXN1; (+) strand; PAM type: NRG; PAM sequence: AAG
caatatctgctgaatattag

SEQ ID NO: 105697 - DNA, 20 bp, Artificial Sequence
  Description of Artificial Sequence: Synthetic oligonucleotide
  Target: ATXN1; (+) strand; PAM type: NRG; PAM sequence: CGG
ctgctgaatattagaagcac

SEQ ID NO: 105698 - DNA, 20 bp, Artificial Sequence
  Description of Artificial Sequence: Synthetic oligonucleotide
  Target: ATXN1; (+) strand; PAM type: NRG; PAM sequence: GAG
gctgaatattagaagcaccg

SEQ ID NO: 105699 - DNA, 20 bp, Artificial Sequence
  Description of Artificial Sequence: Synthetic oligonucleotide
  Target: ATXN1; (+) strand; PAM type: NRG; PAM sequence: GAG
tgaatattagaagcaccgga

SEQ ID NO: 105700 - DNA, 20 bp, Artificial Sequence
  Description of Artificial Sequence: Synthetic oligonucleotide
  Target: ATXN1; (+) strand; PAM type: NRG; PAM sequence: AAG
aagcaccggagagcttctac

SEQ ID NO: 105701 - DNA, 20 bp, Artificial Sequence
  Description of Artificial Sequence: Synthetic oligonucleotide
  Target: ATXN1; (+) strand; PAM type: NRG; PAM sequence: CAG
gcttctacaagacactaacc

SEQ ID NO: 105702 - DNA, 20 bp, Artificial Sequence
  Description of Artificial Sequence: Synthetic oligonucleotide
  Target: ATXN1; (+) strand; PAM type: NRG; PAM sequence: TGG
gaatctgaattaatgcccac

SEQ ID NO: 105703 - DNA, 20 bp, Artificial Sequence
  Description of Artificial Sequence: Synthetic oligonucleotide
  Target: ATXN1; (+) strand; PAM type: NRG; PAM sequence: TGG
gcccactggattaaactgta

SEQ ID NO: 105704 - DNA, 20 bp, Artificial Sequence
  Description of Artificial Sequence: Synthetic oligonucleotide
  Target: ATXN1; (+) strand; PAM type: NRG; PAM sequence: CAG
actggattaaactgtatggt

SEQ ID NO: 105705 - DNA, 20 bp, Artificial Sequence
  Description of Artificial Sequence: Synthetic oligonucleotide
  Target: ATXN1; (+) strand; PAM type: NRG; PAM sequence: GAG
tggattaaactgtatggtca

SEQ ID NO: 105706 - DNA, 20 bp, Artificial Sequence
  Description of Artificial Sequence: Synthetic oligonucleotide
  Target: ATXN1; (+) strand; PAM type: NRG; PAM sequence: AAG
tatggtcagagatgacttca

SEQ ID NO: 105707 - DNA, 20 bp, Artificial Sequence
  Description of Artificial Sequence: Synthetic oligonucleotide
  Target: ATXN1; (+) strand; PAM type: NRG; PAM sequence: GAG
tggtcagagatgacttcaaa

SEQ ID NO: 105708 - DNA, 20 bp, Artificial Sequence
  Description of Artificial Sequence: Synthetic oligonucleotide
  Target: ATXN1; (+) strand; PAM type: NRG; PAM sequence: CAG
agagatgacttcaaagagaa

SEQ ID NO: 105709 - DNA, 20 bp, Artificial Sequence
  Description of Artificial Sequence: Synthetic oligonucleotide
  Target: ATXN1; (+) strand; PAM type: NRG; PAM sequence: TAG
cttcaaagagaacagctcta

SEQ ID NO: 105710 - DNA, 20 bp, Artificial Sequence
  Description of Artificial Sequence: Synthetic oligonucleotide
  Target: ATXN1; (+) strand; PAM type: NRG; PAM sequence: AAG
agctctatagtcctatttta

SEQ ID NO: 105711 - DNA, 20 bp, Artificial Sequence
  Description of Artificial Sequence: Synthetic oligonucleotide
  Target: ATXN1; (+) strand; PAM type: NRG; PAM sequence: TAG
tctatagtcctattttaaag

SEQ ID NO: 105712 - DNA, 20 bp, Artificial Sequence
  Description of Artificial Sequence: Synthetic oligonucleotide
  Target: ATXN1; (+) strand; PAM type: NRG; PAM sequence: AGG
ctatagtcctattttaaagt

SEQ ID NO: 105713 - DNA, 20 bp, Artificial Sequence
  Description of Artificial Sequence: Synthetic oligonucleotide
  Target: ATXN1; (+) strand; PAM type: NRG; PAM sequence: GGG
tatagtcctattttaaagta

SEQ ID NO: 105714 - DNA, 20 bp, Artificial Sequence
  Description of Artificial Sequence: Synthetic oligonucleotide
  Target: ATXN1; (+) strand; PAM type: NRG; PAM sequence: GGG
atagtcctattttaaagtag

SEQ ID NO: 105715 - DNA, 20 bp, Artificial Sequence
  Description of Artificial Sequence: Synthetic oligonucleotide
  Target: ATXN1; (+) strand; PAM type: NRG; PAM sequence: CAG
cctattttaaagtaggggaa

SEQ ID NO: 105716 - DNA, 20 bp, Artificial Sequence
  Description of Artificial Sequence: Synthetic oligonucleotide
  Target: ATXN1; (+) strand; PAM type: NRG; PAM sequence: CAG
agtaggggaacagatatacc

SEQ ID NO: 105717 - DNA, 20 bp, Artificial Sequence
  Description of Artificial Sequence: Synthetic oligonucleotide
  Target: ATXN1; (+) strand; PAM type: NRG; PAM sequence: CGG
acagatatacccagtgacat

SEQ ID NO: 105718 - DNA, 20 bp, Artificial Sequence
  Description of Artificial Sequence: Synthetic oligonucleotide
  Target: ATXN1; (+) strand; PAM type: NRG; PAM sequence: AAG
gaaatgtgttttccattccc

SEQ ID NO: 105719 - DNA, 20 bp, Artificial Sequence
  Description of Artificial Sequence: Synthetic oligonucleotide
  Target: ATXN1; (+) strand; PAM type: NRG; PAM sequence: TGG
tttaaatttacatatgtcaa

SEQ ID NO: 105720 - DNA, 20 bp, Artificial Sequence
  Description of Artificial Sequence: Synthetic oligonucleotide
  Target: ATXN1; (+) strand; PAM type: NRG; PAM sequence: GGG
ttaaatttacatatgtcaat

SEQ ID NO: 105721 - DNA, 20 bp, Artificial Sequence
  Description of Artificial Sequence: Synthetic oligonucleotide
  Target: ATXN1; (+) strand; PAM type: NRG; PAM sequence: CAG
atgtgcttgaataacatatt

SEQ ID NO: 105722 - DNA, 20 bp, Artificial Sequence
  Description of Artificial Sequence: Synthetic oligonucleotide
  Target: ATXN1; (+) strand; PAM type: NRG; PAM sequence: TGG
gcatttgaacatctcatgcc

SEQ ID NO: 105723 - DNA, 20 bp, Artificial Sequence
  Description of Artificial Sequence: Synthetic oligonucleotide
  Target: ATXN1; (+) strand; PAM type: NRG; PAM sequence: GGG
catttgaacatctcatgcct

SEQ ID NO: 105724 - DNA, 20 bp, Artificial Sequence
  Description of Artificial Sequence: Synthetic oligonucleotide
  Target: ATXN1; (+) strand; PAM type: NRG; PAM sequence: TGG
tctcatgcctgggattacac

SEQ ID NO: 105725 - DNA, 20 bp, Artificial Sequence
  Description of Artificial Sequence: Synthetic oligonucleotide
  Target: ATXN1; (+) strand; PAM type: NRG; PAM sequence: GAG
tgcctgggattacactggct

SEQ ID NO: 105726 - DNA, 20 bp, Artificial Sequence
  Description of Artificial Sequence: Synthetic oligonucleotide
  Target: ATXN1; (+) strand; PAM type: NRG; PAM sequence: AAG
gctgagcctcccacatcacg

SEQ ID NO: 105727 - DNA, 20 bp, Artificial Sequence
  Description of Artificial Sequence: Synthetic oligonucleotide
  Target: ATXN1; (+) strand; PAM type: NRG; PAM sequence: TGG
caaatgcttgaataaacata

SEQ ID NO: 105728 - DNA, 20 bp, Artificial Sequence
  Description of Artificial Sequence: Synthetic oligonucleotide
  Target: ATXN1; (+) strand; PAM type: NRG; PAM sequence: GGG
aaatgcttgaataaacatat

SEQ ID NO: 105729 - DNA, 20 bp, Artificial Sequence
  Description of Artificial Sequence: Synthetic oligonucleotide
  Target: ATXN1; (+) strand; PAM type: NRG; PAM sequence: GAG
tgaataaacatatgggctct

SEQ ID NO: 105730 - DNA, 20 bp, Artificial Sequence
  Description of Artificial Sequence: Synthetic oligonucleotide
  Target: ATXN1; (+) strand; PAM type: NRG; PAM sequence: AAG
taaacatatgggctctgaga

SEQ ID NO: 105731 - DNA, 20 bp, Artificial Sequence
  Description of Artificial Sequence: Synthetic oligonucleotide
  Target: ATXN1; (+) strand; PAM type: NRG; PAM sequence: CAG
gggctctgagaaagtgccct

SEQ ID NO: 105732 - DNA, 20 bp, Artificial Sequence
  Description of Artificial Sequence: Synthetic oligonucleotide
  Target: ATXN1; (+) strand; PAM type: NRG; PAM sequence: GAG
gctctgagaaagtgccctca

SEQ ID NO: 105733 - DNA, 20 bp, Artificial Sequence
  Description of Artificial Sequence: Synthetic oligonucleotide
  Target: ATXN1; (+) strand; PAM type: NRG; PAM sequence: CAG
tgagaaagtgccctcagagc

SEQ ID NO: 105734 - DNA, 20 bp, Artificial Sequence
  Description of Artificial Sequence: Synthetic oligonucleotide
  Target: ATXN1; (+) strand; PAM type: NRG; PAM sequence: AGG
gagaaagtgccctcagagcc

SEQ ID NO: 105735 - DNA, 20 bp, Artificial Sequence
  Description of Artificial Sequence: Synthetic oligonucleotide
  Target: ATXN1; (+) strand; PAM type: NRG; PAM sequence: GGG
agaaagtgccctcagagcca

SEQ ID NO: 105736 - DNA, 20 bp, Artificial Sequence
  Description of Artificial Sequence: Synthetic oligonucleotide
  Target: ATXN1; (+) strand; PAM type: NRG; PAM sequence: AAG
acatgactatatttcaattt

SEQ ID NO: 105737 - DNA, 20 bp, Artificial Sequence
  Description of Artificial Sequence: Synthetic oligonucleotide
  Target: ATXN1; (+) strand; PAM type: NRG; PAM sequence: GAG
atgactatatttcaatttaa

SEQ ID NO: 105738 - DNA, 20 bp, Artificial Sequence
  Description of Artificial Sequence: Synthetic oligonucleotide
  Target: ATXN1; (+) strand; PAM type: NRG; PAM sequence: AAG
actatatttcaatttaagag

SEQ ID NO: 105739 - DNA, 20 bp, Artificial Sequence
  Description of Artificial Sequence: Synthetic oligonucleotide
  Target: ATXN1; (+) strand; PAM type: NRG; PAM sequence: AAG
tatttcaatttaagagaagt

SEQ ID NO: 105740 - DNA, 20 bp, Artificial Sequence
  Description of Artificial Sequence: Synthetic oligonucleotide
  Target: ATXN1; (+) strand; PAM type: NRG; PAM sequence: TGG
tttaagagaagtaagcctct

SEQ ID NO: 105741 - DNA, 20 bp, Artificial Sequence
  Description of Artificial Sequence: Synthetic oligonucleotide
  Target: ATXN1; (+) strand; PAM type: NRG; PAM sequence: CGG
cttgtttgctccctcttcaa

SEQ ID NO: 105742 - DNA, 20 bp, Artificial Sequence
  Description of Artificial Sequence: Synthetic oligonucleotide
  Target: ATXN1; (+) strand; PAM type: NRG; PAM sequence: GGG
ttgtttgctccctcttcaac

SEQ ID NO: 105743 - DNA, 20 bp, Artificial Sequence
  Description of Artificial Sequence: Synthetic oligonucleotide
  Target: ATXN1; (+) strand; PAM type: NRG; PAM sequence: AAG
tccctcttcaacgggttttt

SEQ ID NO: 105744 - DNA, 20 bp, Artificial Sequence
  Description of Artificial Sequence: Synthetic oligonucleotide
  Target: ATXN1; (+) strand; PAM type: NRG; PAM sequence: CAG
cttcaacgggtttttaagtc

SEQ ID NO: 105745 - DNA, 20 bp, Artificial Sequence
  Description of Artificial Sequence: Synthetic oligonucleotide
  Target: ATXN1; (+) strand; PAM type: NRG; PAM sequence: AGG
ttcaacgggtttttaagtcc

SEQ ID NO: 105746 - DNA, 20 bp, Artificial Sequence
  Description of Artificial Sequence: Synthetic oligonucleotide
  Target: ATXN1; (+) strand; PAM type: NRG; PAM sequence: GGG
tcaacgggtttttaagtcca

SEQ ID NO: 105747 - DNA, 20 bp, Artificial Sequence
  Description of Artificial Sequence: Synthetic oligonucleotide
  Target: ATXN1; (+) strand; PAM type: NRG; PAM sequence: AAG
aagtccagggctcattccaa

SEQ ID NO: 105748 - DNA, 20 bp, Artificial Sequence
  Description of Artificial Sequence: Synthetic oligonucleotide
  Target: ATXN1; (+) strand; PAM type: NRG; PAM sequence: TAG
ggctcattccaaaagtcctt

SEQ ID NO: 105749 - DNA, 20 bp, Artificial Sequence
  Description of Artificial Sequence: Synthetic oligonucleotide
  Target: ATXN1; (+) strand; PAM type: NRG; PAM sequence: TAG
aaaagtcctttagccaatct

SEQ ID NO: 105750 - DNA, 20 bp, Artificial Sequence
  Description of Artificial Sequence: Synthetic oligonucleotide
  Target: ATXN1; (+) strand; PAM type: NRG; PAM sequence: CAG
tcctctaatcgtaacatatt

SEQ ID NO: 105751 - DNA, 20 bp, Artificial Sequence
  Description of Artificial Sequence: Synthetic oligonucleotide
  Target: ATXN1; (+) strand; PAM type: NRG; PAM sequence: GAG
ctaatcgtaacatattcagt

SEQ ID NO: 105752 - DNA, 20 bp, Artificial Sequence
  Description of Artificial Sequence: Synthetic oligonucleotide
  Target: ATXN1; (+) strand; PAM type: NRG; PAM sequence: AAG
tcgtaacatattcagtgaga

SEQ ID NO: 105753 - DNA, 20 bp, Artificial Sequence
  Description of Artificial Sequence: Synthetic oligonucleotide
  Target: ATXN1; (+) strand; PAM type: NRG; PAM sequence: AGG
cgtaacatattcagtgagaa

SEQ ID NO: 105754 - DNA, 20 bp, Artificial Sequence
  Description of Artificial Sequence: Synthetic oligonucleotide
  Target: ATXN1; (+) strand; PAM type: NRG; PAM sequence: GAG
taacatattcagtgagaaag

SEQ ID NO: 105755 - DNA, 20 bp, Artificial Sequence
  Description of Artificial Sequence: Synthetic oligonucleotide
  Target: ATXN1; (+) strand; PAM type: NRG; PAM sequence: AAG
agtgagaaaggagatcctat

SEQ ID NO: 105756 - DNA, 20 bp, Artificial Sequence
  Description of Artificial Sequence: Synthetic oligonucleotide
  Target: ATXN1; (+) strand; PAM type: NRG; PAM sequence: AGG
gtgagaaaggagatcctata

SEQ ID NO: 105757 - DNA, 20 bp, Artificial Sequence
  Description of Artificial Sequence: Synthetic oligonucleotide
  Target: ATXN1; (+) strand; PAM type: NRG; PAM sequence: CAG
gaaaggagatcctataaggt

SEQ ID NO: 105758 - DNA, 20 bp, Artificial Sequence
  Description of Artificial Sequence: Synthetic oligonucleotide
  Target: ATXN1; (+) strand; PAM type: NRG; PAM sequence: AGG
aaaggagatcctataaggtc

SEQ ID NO: 105759 - DNA, 20 bp, Artificial Sequence
  Description of Artificial Sequence: Synthetic oligonucleotide
  Target: ATXN1; (+) strand; PAM type: NRG; PAM sequence: TAG
aaggtcaggcaaattgttgt

SEQ ID NO: 105760 - DNA, 20 bp, Artificial Sequence
  Description of Artificial Sequence: Synthetic oligonucleotide
  Target: ATXN1; (+) strand; PAM type: NRG; PAM sequence: CAG
ttgttgttagaaatgtgatc

SEQ ID NO: 105761 - DNA, 20 bp, Artificial Sequence
  Description of Artificial Sequence: Synthetic oligonucleotide
  Target: ATXN1; (+) strand; PAM type: NRG; PAM sequence: TAG
gaaatgtgatccagcaactt

SEQ ID NO: 105762 - DNA, 20 bp, Artificial Sequence
  Description of Artificial Sequence: Synthetic oligonucleotide
  Target: ATXN1; (+) strand; PAM type: NRG; PAM sequence: AGG
aaatgtgatccagcaacttt

SEQ ID NO: 105763 - DNA, 20 bp, Artificial Sequence
  Description of Artificial Sequence: Synthetic oligonucleotide
  Target: ATXN1; (+) strand; PAM type: NRG; PAM sequence: AAG
atccagcaactttaggtttg

SEQ ID NO: 105764 - DNA, 20 bp, Artificial Sequence
  Description of Artificial Sequence: Synthetic oligonucleotide
  Target: ATXN1; (+) strand; PAM type: NRG; PAM sequence: CAG
actttaggtttgaagaaatc

SEQ ID NO: 105765 - DNA, 20 bp, Artificial Sequence
  Description of Artificial Sequence: Synthetic oligonucleotide
  Target: ATXN1; (+) strand; PAM type: NRG; PAM sequence: TGG
ttaggtttgaagaaatccag

SEQ ID NO: 105766 - DNA, 20 bp, Artificial Sequence
  Description of Artificial Sequence: Synthetic oligonucleotide
  Target: ATXN1; (+) strand; PAM type: NRG; PAM sequence: GAG
aggtttgaagaaatccagtg

SEQ ID NO: 105767 - DNA, 20 bp, Artificial Sequence
  Description of Artificial Sequence: Synthetic oligonucleotide
  Target: ATXN1; (+) strand; PAM type: NRG; PAM sequence: AAG
agtggagaaaacacacacac

SEQ ID NO: 105768 - DNA, 20 bp, Artificial Sequence
  Description of Artificial Sequence: Synthetic oligonucleotide
  Target: ATXN1; (+) strand; PAM type: NRG; PAM sequence: CAG
ccacgtccacacctcacatt

SEQ ID NO: 105769 - DNA, 20 bp, Artificial Sequence
  Description of Artificial Sequence: Synthetic oligonucleotide
  Target: ATXN1; (+) strand; PAM type: NRG; PAM sequence: TGG
ccattatcccaatacaccac

SEQ ID NO: 105770 - DNA, 20 bp, Artificial Sequence
  Description of Artificial Sequence: Synthetic oligonucleotide
  Target: ATXN1; (+) strand; PAM type: NRG; PAM sequence: GGG
cattatcccaatacaccact

SEQ ID NO: 105771 - DNA, 20 bp, Artificial Sequence
  Description of Artificial Sequence: Synthetic oligonucleotide
  Target: ATXN1; (+) strand; PAM type: NRG; PAM sequence: GGG
attatcccaatacaccactg

SEQ ID NO: 105772 - DNA, 20 bp, Artificial Sequence
  Description of Artificial Sequence: Synthetic oligonucleotide
  Target: ATXN1; (+) strand; PAM type: NRG; PAM sequence: CAG
ctggggtctttccctgtatt

SEQ ID NO: 105773 - DNA, 20 bp, Artificial Sequence
  Description of Artificial Sequence: Synthetic oligonucleotide
  Target: ATXN1; (+) strand; PAM type: NRG; PAM sequence: AGG
tggggtctttccctgtattc

SEQ ID NO: 105774 - DNA, 20 bp, Artificial Sequence
  Description of Artificial Sequence: Synthetic oligonucleotide
  Target: ATXN1; (+) strand; PAM type: NRG; PAM sequence: AAG
ggtctttccctgtattcagg

SEQ ID NO: 105775 - DNA, 20 bp, Artificial Sequence
  Description of Artificial Sequence: Synthetic oligonucleotide
  Target: ATXN1; (+) strand; PAM type: NRG; PAM sequence: TGG
ctttccctgtattcaggaag

SEQ ID NO: 105776 - DNA, 20 bp, Artificial Sequence
  Description of Artificial Sequence: Synthetic oligonucleotide
  Target: ATXN1; (+) strand; PAM type: NRG; PAM sequence: GGG
tttccctgtattcaggaagt

SEQ ID NO: 105777 - DNA, 20 bp, Artificial Sequence
  Description of Artificial Sequence: Synthetic oligonucleotide
  Target: ATXN1; (+) strand; PAM type: NRG; PAM sequence: TAG
tgtattcaggaagtgggttc

SEQ ID NO: 105778 - DNA, 20 bp, Artificial Sequence
  Description of Artificial Sequence: Synthetic oligonucleotide
  Target: ATXN1; (+) strand; PAM type: NRG; PAM sequence: CAG
tcaggaagtgggttctagaa

SEQ ID NO: 105779 - DNA, 20 bp, Artificial Sequence
  Description of Artificial Sequence: Synthetic oligonucleotide
  Target: ATXN1; (+) strand; PAM type: NRG; PAM sequence: AAG
gaacagccctgtccatttgt

SEQ ID NO: 105780 - DNA, 20 bp, Artificial Sequence
  Description of Artificial Sequence: Synthetic oligonucleotide
  Target: ATXN1; (+) strand; PAM type: NRG; PAM sequence: AGG
aacagccctgtccatttgta

SEQ ID NO: 105781 - DNA, 20 bp, Artificial Sequence
  Description of Artificial Sequence: Synthetic oligonucleotide
  Target: ATXN1; (+) strand; PAM type: NRG; PAM sequence: AAG
ccatttgtaaggaataacac

SEQ ID NO: 105782 - DNA, 20 bp, Artificial Sequence
  Description of Artificial Sequence: Synthetic oligonucleotide
  Target: ATXN1; (+) strand; PAM type: NRG; PAM sequence: AGG
catttgtaaggaataacaca

SEQ ID NO: 105783 - DNA, 20 bp, Artificial Sequence
  Description of Artificial Sequence: Synthetic oligonucleotide
  Target: ATXN1; (+) strand; PAM type: NRG; PAM sequence: AAG
tgtaaggaataacacaaggt

SEQ ID NO: 105784 - DNA, 20 bp, Artificial Sequence
  Description of Artificial Sequence: Synthetic oligonucleotide
  Target: ATXN1; (+) strand; PAM type: NRG; PAM sequence: TAG
caaggtaagacgcctgaaac

SEQ ID NO: 105785 - DNA, 20 bp, Artificial Sequence
  Description of Artificial Sequence: Synthetic oligonucleotide
  Target: ATXN1; (+) strand; PAM type: NRG; PAM sequence: AAG
gtaagacgcctgaaactagc

SEQ ID NO: 105786 - DNA, 20 bp, Artificial Sequence
  Description of Artificial Sequence: Synthetic oligonucleotide
  Target: ATXN1; (+) strand; PAM type: NRG; PAM sequence: GAG
gacgcctgaaactagcaagt

SEQ ID NO: 105787 - DNA, 20 bp, Artificial Sequence
  Description of Artificial Sequence: Synthetic oligonucleotide
  Target: ATXN1; (+) strand; PAM type: NRG; PAM sequence: AAG
cctgaaactagcaagtgaga

SEQ ID NO: 105788 - DNA, 20 bp, Artificial Sequence
  Description of Artificial Sequence: Synthetic oligonucleotide
  Target: ATXN1; (+) strand; PAM type: NRG; PAM sequence: AAG
agaaagtctttacttattct

SEQ ID NO: 105789 - DNA, 20 bp, Artificial Sequence
  Description of Artificial Sequence: Synthetic oligonucleotide
  Target: ATXN1; (+) strand; PAM type: NRG; PAM sequence: AAG
attctaagtaaatgactccc

SEQ ID NO: 105790 - DNA, 20 bp, Artificial Sequence
  Description of Artificial Sequence: Synthetic oligonucleotide
  Target: ATXN1; (+) strand; PAM type: NRG; PAM sequence: AGG
ttctaagtaaatgactccca

SEQ ID NO: 105791 - DNA, 20 bp, Artificial Sequence
  Description of Artificial Sequence: Synthetic oligonucleotide
  Target: ATXN1; (+) strand; PAM type: NRG; PAM sequence: AAG
agtaaatgactcccaaggac

SEQ ID NO: 105792 - DNA, 20 bp, Artificial Sequence
  Description of Artificial Sequence: Synthetic oligonucleotide
  Target: ATXN1; (+) strand; PAM type: NRG; PAM sequence: TAG
tgactcccaaggacaagatg

SEQ ID NO: 105793 - DNA, 20 bp, Artificial Sequence
  Description of Artificial Sequence: Synthetic oligonucleotide
  Target: ATXN1; (+) strand; PAM type: NRG; PAM sequence: CAG
caaggacaagatgtagctcg

SEQ ID NO: 105794 - DNA, 20 bp, Artificial Sequence
  Description of Artificial Sequence: Synthetic oligonucleotide
  Target: ATXN1; (+) strand; PAM type: NRG; PAM sequence: CAG
gatgtagctcgcagcttctt

SEQ ID NO: 105795 - DNA, 20 bp, Artificial Sequence
  Description of Artificial Sequence: Synthetic oligonucleotide
  Target: ATXN1; (+) strand; PAM type: NRG; PAM sequence: TAG
gacatacatttaatttattt

SEQ ID NO: 105796 - DNA, 20 bp, Artificial Sequence
  Description of Artificial Sequence: Synthetic oligonucleotide
  Target: ATXN1; (+) strand; PAM type: NRG; PAM sequence: TAG
tagctaatgaaaatgctcaa

SEQ ID NO: 105797 - DNA, 20 bp, Artificial Sequence
  Description of Artificial Sequence: Synthetic oligonucleotide
  Target: ATXN1; (+) strand; PAM type: NRG; PAM sequence: GAG
gctcaatagtgaatatgtct

SEQ ID NO: 105798 - DNA, 20 bp, Artificial Sequence
  Description of Artificial Sequence: Synthetic oligonucleotide
  Target: ATXN1; (+) strand; PAM type: NRG; PAM sequence: TGG
tgaatatgtctgagccccta

SEQ ID NO: 105799 - DNA, 20 bp, Artificial Sequence
  Description of Artificial Sequence: Synthetic oligonucleotide
  Target: ATXN1; (+) strand; PAM type: NRG; PAM sequence: GAG
aatatgtctgagcccctatg

SEQ ID NO: 105800 - DNA, 20 bp, Artificial Sequence
  Description of Artificial Sequence: Synthetic oligonucleotide
  Target: ATXN1; (+) strand; PAM type: NRG; PAM sequence: AAG
tctgagcccctatggagaat

SEQ ID NO: 105801 - DNA, 20 bp, Artificial Sequence
  Description of Artificial Sequence: Synthetic oligonucleotide
  Target: ATXN1; (+) strand; PAM type: NRG; PAM sequence: TAG
gagcccctatggagaataag

SEQ ID NO: 105802 - DNA, 20 bp, Artificial Sequence
  Description of Artificial Sequence: Synthetic oligonucleotide
  Target: ATXN1; (+) strand; PAM type: NRG; PAM sequence: AAG
aataagtagtgcaataccca

SEQ ID NO: 105803 - DNA, 20 bp, Artificial Sequence
  Description of Artificial Sequence: Synthetic oligonucleotide
  Target: ATXN1; (+) strand; PAM type: NRG; PAM sequence: GAG
aaagacatttaactgtctct

SEQ ID NO: 105804 - DNA, 20 bp, Artificial Sequence
  Description of Artificial Sequence: Synthetic oligonucleotide
  Target: ATXN1; (+) strand; PAM type: NRG; PAM sequence: GAG
agacatttaactgtctctga

SEQ ID NO: 105805 - DNA, 20 bp, Artificial Sequence
  Description of Artificial Sequence: Synthetic oligonucleotide
  Target: ATXN1; (+) strand; PAM type: NRG; PAM sequence: AGG
gacatttaactgtctctgag

SEQ ID NO: 105806 - DNA, 20 bp, Artificial Sequence
  Description of Artificial Sequence: Synthetic oligonucleotide
  Target: ATXN1; (+) strand; PAM type: NRG; PAM sequence: AAG
tttaactgtctctgagaggc

SEQ ID NO: 105807 - DNA, 20 bp, Artificial Sequence
  Description of Artificial Sequence: Synthetic oligonucleotide
  Target: ATXN1; (+) strand; PAM type: NRG; PAM sequence: AAG
aactgtctctgagaggcaag

SEQ ID NO: 105808 - DNA, 20 bp, Artificial Sequence
  Description of Artificial Sequence: Synthetic oligonucleotide
  Target: ATXN1; (+) strand; PAM type: NRG; PAM sequence: TAG
gaggcaagaagaatctgtgt

SEQ ID NO: 105809 - DNA, 20 bp, Artificial Sequence
  Description of Artificial Sequence: Synthetic oligonucleotide
  Target: ATXN1; (+) strand; PAM type: NRG; PAM sequence: AGG
aggcaagaagaatctgtgtt

SEQ ID NO: 105810 - DNA, 20 bp, Artificial Sequence
  Description of Artificial Sequence: Synthetic oligonucleotide
  Target: ATXN1; (+) strand; PAM type: NRG; PAM sequence: GGG
ggcaagaagaatctgtgtta

SEQ ID NO: 105811 - DNA, 20 bp, Artificial Sequence
  Description of Artificial Sequence: Synthetic oligonucleotide
  Target: ATXN1; (+) strand; PAM type: NRG; PAM sequence: GGG
gcaagaagaatctgtgttag

SEQ ID NO: 105812 - DNA, 20 bp, Artificial Sequence
  Description of Artificial Sequence: Synthetic oligonucleotide
  Target: ATXN1; (+) strand; PAM type: NRG; PAM sequence: TGG
aagaatctgtgttaggggtg

SEQ ID NO: 105813 - DNA, 20 bp, Artificial Sequence
  Description of Artificial Sequence: Synthetic oligonucleotide
  Target: ATXN1; (+) strand; PAM type: NRG; PAM sequence: TAG
taggggtgtggctctatata

SEQ ID NO: 105814 - DNA, 20 bp, Artificial Sequence
  Description of Artificial Sequence: Synthetic oligonucleotide
  Target: ATXN1; (+) strand; PAM type: NRG; PAM sequence: GAG
ggggtgtggctctatatata

SEQ ID NO: 105815 - DNA, 20 bp, Artificial Sequence
  Description of Artificial Sequence: Synthetic oligonucleotide
  Target: ATXN1; (+) strand; PAM type: NRG; PAM sequence: TAG
atatagagacattaaattca

SEQ ID NO: 105816 - DNA, 20 bp, Artificial Sequence
  Description of Artificial Sequence: Synthetic oligonucleotide
  Target: ATXN1; (+) strand; PAM type: NRG; PAM sequence: AAG
gacattaaattcatagccaa

SEQ ID NO: 105817 - DNA, 20 bp, Artificial Sequence
  Description of Artificial Sequence: Synthetic oligonucleotide
  Target: ATXN1; (+) strand; PAM type: NRG; PAM sequence: AGG
acattaaattcatagccaaa

SEQ ID NO: 105818 - DNA, 20 bp, Artificial Sequence
  Description of Artificial Sequence: Synthetic oligonucleotide
  Target: ATXN1; (+) strand; PAM type: NRG; PAM sequence: GGG
cattaaattcatagccaaaa

SEQ ID NO: 105819 - DNA, 20 bp, Artificial Sequence
  Description of Artificial Sequence: Synthetic oligonucleotide
  Target: ATXN1; (+) strand; PAM type: NRG; PAM sequence: TAG
attcatagccaaaagggtaa

SEQ ID NO: 105820 - DNA, 20 bp, Artificial Sequence
  Description of Artificial Sequence: Synthetic oligonucleotide
  Target: ATXN1; (+) strand; PAM type: NRG; PAM sequence: CAG
atagtgattattacaaaatt

SEQ ID NO: 105821 - DNA, 20 bp, Artificial Sequence
  Description of Artificial Sequence: Synthetic oligonucleotide
  Target: ATXN1; (+) strand; PAM type: NRG; PAM sequence: AGG
tagtgattattacaaaattc

SEQ ID NO: 105822 - DNA, 20 bp, Artificial Sequence
  Description of Artificial Sequence: Synthetic oligonucleotide
  Target: ATXN1; (+) strand; PAM type: NRG; PAM sequence: GGG
agtgattattacaaaattca

SEQ ID NO: 105823 - DNA, 20 bp, Artificial Sequence
  Description of Artificial Sequence: Synthetic oligonucleotide
  Target: ATXN1; (+) strand; PAM type: NRG; PAM sequence: GGG
gtgattattacaaaattcag

SEQ ID NO: 105824 - DNA, 20 bp, Artificial Sequence
  Description of Artificial Sequence: Synthetic oligonucleotide
  Target: ATXN1; (+) strand; PAM type: NRG; PAM sequence: AAG
ttacaaaattcaggggtaac

SEQ ID NO: 105825 - DNA, 20 bp, Artificial Sequence
  Description of Artificial Sequence: Synthetic oligonucleotide
  Target: ATXN1; (+) strand; PAM type: NRG; PAM sequence: AGG
tacaaaattcaggggtaaca

SEQ ID NO: 105826 - DNA, 20 bp, Artificial Sequence
  Description of Artificial Sequence: Synthetic oligonucleotide
  Target: ATXN1; (+) strand; PAM type: NRG; PAM sequence: GGG
acaaaattcaggggtaacaa

SEQ ID NO: 105827 - DNA, 20 bp, Artificial Sequence
  Description of Artificial Sequence: Synthetic oligonucleotide
  Target: ATXN1; (+) strand; PAM type: NRG; PAM sequence: AAG
ttcaggggtaacaagggtga

SEQ ID NO: 105828 - DNA, 20 bp, Artificial Sequence
  Description of Artificial Sequence: Synthetic oligonucleotide
  Target: ATXN1; (+) strand; PAM type: NRG; PAM sequence: GAG
caggggtaacaagggtgaaa

SEQ ID NO: 105829 - DNA, 20 bp, Artificial Sequence
  Description of Artificial Sequence: Synthetic oligonucleotide
  Target: ATXN1; (+) strand; PAM type: NRG; PAM sequence: AAG
gtaacaagggtgaaagagaa

SEQ ID NO: 105830 - DNA, 20 bp, Artificial Sequence
  Description of Artificial Sequence: Synthetic oligonucleotide
  Target: ATXN1; (+) strand; PAM type: NRG; PAM sequence: GAG
aacaagggtgaaagagaaaa

SEQ ID NO: 105831 - DNA, 20 bp, Artificial Sequence
  Description of Artificial Sequence: Synthetic oligonucleotide
  Target: ATXN1; (+) strand; PAM type: NRG; PAM sequence: GAG
caagggtgaaagagaaaaga

SEQ ID NO: 105832 - DNA, 20 bp, Artificial Sequence
  Description of Artificial Sequence: Synthetic oligonucleotide
  Target: ATXN1; (+) strand; PAM type: NRG; PAM sequence: AGG
aagggtgaaagagaaaagag

SEQ ID NO: 105833 - DNA, 20 bp, Artificial Sequence
  Description of Artificial Sequence: Synthetic oligonucleotide
  Target: ATXN1; (+) strand; PAM type: NRG; PAM sequence: GGG
agggtgaaagagaaaagaga

SEQ ID NO: 105834 - DNA, 20 bp, Artificial Sequence
  Description of Artificial Sequence: Synthetic oligonucleotide
  Target: ATXN1; (+) strand; PAM type: NRG; PAM sequence: GAG
gaaagagaaaagagagggat

SEQ ID NO: 105835 - DNA, 20 bp, Artificial Sequence
  Description of Artificial Sequence: Synthetic oligonucleotide
  Target: ATXN1; (+) strand; PAM type: NRG; PAM sequence: GAG
aagagaaaagagagggatga

SEQ ID NO: 105836 - DNA, 20 bp, Artificial Sequence
  Description of Artificial Sequence: Synthetic oligonucleotide
  Target: ATXN1; (+) strand; PAM type: NRG; PAM sequence: CAG
ttcacattctgtttctgaaa

SEQ ID NO: 105837 - DNA, 20 bp, Artificial Sequence
  Description of Artificial Sequence: Synthetic oligonucleotide
  Target: ATXN1; (+) strand; PAM type: NRG; PAM sequence: AGG
tcacattctgtttctgaaac

SEQ ID NO: 105838 - DNA, 20 bp, Artificial Sequence
  Description of Artificial Sequence: Synthetic oligonucleotide
  Target: ATXN1; (+) strand; PAM type: NRG; PAM sequence: AAG
ctgtttctgaaacaggattc

SEQ ID NO: 105839 - DNA, 20 bp, Artificial Sequence
  Description of Artificial Sequence: Synthetic oligonucleotide
  Target: ATXN1; (+) strand; PAM type: NRG; PAM sequence: CAG
tttctgaaacaggattcaag

SEQ ID NO: 105840 - DNA, 20 bp, Artificial Sequence
  Description of Artificial Sequence: Synthetic oligonucleotide
  Target: ATXN1; (+) strand; PAM type: NRG; PAM sequence: AGG
ttctgaaacaggattcaagc

SEQ ID NO: 105841 - DNA, 20 bp, Artificial Sequence
  Description of Artificial Sequence: Synthetic oligonucleotide
  Target: ATXN1; (+) strand; PAM type: NRG; PAM sequence: TGG
aagcaggacattgtaccatt

SEQ ID NO: 105842 - DNA, 20 bp, Artificial Sequence
  Description of Artificial Sequence: Synthetic oligonucleotide
  Target: ATXN1; (+) strand; PAM type: NRG; PAM sequence: TGG
attattttcgttcacgcaca

SEQ ID NO: 105843 - DNA, 20 bp, Artificial Sequence
  Description of Artificial Sequence: Synthetic oligonucleotide
  Target: ATXN1; (+) strand; PAM type: NRG; PAM sequence: CAG
cacatggctaattatttcta

SEQ ID NO: 105844 - DNA, 20 bp, Artificial Sequence
  Description of Artificial Sequence: Synthetic oligonucleotide
  Target: ATXN1; (+) strand; PAM type: NRG; PAM sequence: CAG
ctaattatttctacagcatt

SEQ ID NO: 105845 - DNA, 20 bp, Artificial Sequence
  Description of Artificial Sequence: Synthetic oligonucleotide
  Target: ATXN1; (+) strand; PAM type: NRG; PAM sequence: CAG
gccttttatccccttttcca

SEQ ID NO: 105846 - DNA, 20 bp, Artificial Sequence
  Description of Artificial Sequence: Synthetic oligonucleotide
  Target: ATXN1; (+) strand; PAM type: NRG; PAM sequence: GAG
atccccttttccacagcctt

SEQ ID NO: 105847 - DNA, 20 bp, Artificial Sequence
  Description of Artificial Sequence: Synthetic oligonucleotide
  Target: ATXN1; (+) strand; PAM type: NRG; PAM sequence: AGG
tccccttttccacagccttg

SEQ ID NO: 105848 - DNA, 20 bp, Artificial Sequence
  Description of Artificial Sequence: Synthetic oligonucleotide
  Target: ATXN1; (+) strand; PAM type: NRG; PAM sequence: TGG
agccttgaggaaatatctga

SEQ ID NO: 105849 - DNA, 20 bp, Artificial Sequence
  Description of Artificial Sequence: Synthetic oligonucleotide
  Target: ATXN1; (+) strand; PAM type: NRG; PAM sequence: CAG
aaatatctgatggattgtct

SEQ ID NO: 105850 - DNA, 20 bp, Artificial Sequence
  Description of Artificial Sequence: Synthetic oligonucleotide
  Target: ATXN1; (+) strand; PAM type: NRG; PAM sequence: AGG
aatatctgatggattgtctc

SEQ ID NO: 105851 - DNA, 20 bp, Artificial Sequence
  Description of Artificial Sequence: Synthetic oligonucleotide
  Target: ATXN1; (+) strand; PAM type: NRG; PAM sequence: GAG
tatctgatggattgtctcag

SEQ ID NO: 105852 - DNA, 20 bp, Artificial Sequence
  Description of Artificial Sequence: Synthetic oligonucleotide
  Target: ATXN1; (+) strand; PAM type: NRG; PAM sequence: CAG
ctgatggattgtctcaggag

SEQ ID NO: 105853 - DNA, 20 bp, Artificial Sequence
  Description of Artificial Sequence: Synthetic oligonucleotide
  Target: ATXN1; (+) strand; PAM type: NRG; PAM sequence: TGG
ttgtctcaggagcagtgttt

SEQ ID NO: 105854 - DNA, 20 bp, Artificial Sequence
  Description of Artificial Sequence: Synthetic oligonucleotide
  Target: ATXN1; (+) strand; PAM type: NRG; PAM sequence: GGG
tgtctcaggagcagtgtttt

SEQ ID NO: 105855 - DNA, 20 bp, Artificial Sequence
  Description of Artificial Sequence: Synthetic oligonucleotide
  Target: ATXN1; (+) strand; PAM type: NRG; PAM sequence: TAG
cagtgttttgggaataaatg

SEQ ID NO: 105856 - DNA, 20 bp, Artificial Sequence
  Description of Artificial Sequence: Synthetic oligonucleotide
  Target: ATXN1; (+) strand; PAM type: NRG; PAM sequence: AAG
aaacttgcataaacaaatca

SEQ ID NO: 105857 - DNA, 20 bp, Artificial Sequence
  Description of Artificial Sequence: Synthetic oligonucleotide
  Target: ATXN1; (+) strand; PAM type: NRG; PAM sequence: AGG
aacttgcataaacaaatcaa

SEQ ID NO: 105858 - DNA, 20 bp, Artificial Sequence
  Description of Artificial Sequence: Synthetic oligonucleotide
  Target: ATXN1; (+) strand; PAM type: NRG; PAM sequence: TAG
aaacaaatcaaaggacattg

SEQ ID NO: 105859 - DNA, 20 bp, Artificial Sequence
  Description of Artificial Sequence: Synthetic oligonucleotide
  Target: ATXN1; (+) strand; PAM type: NRG; PAM sequence: GAG
aaaggacattgtagcatttc

SEQ ID NO: 105860 - DNA, 20 bp, Artificial Sequence
  Description of Artificial Sequence: Synthetic oligonucleotide
  Target: ATXN1; (+) strand; PAM type: NRG; PAM sequence: CAG
atgactctcaacttaacttg

SEQ ID NO: 105861 - DNA, 20 bp, Artificial Sequence
  Description of Artificial Sequence: Synthetic oligonucleotide
  Target: ATXN1; (+) strand; PAM type: NRG; PAM sequence: CAG
gcagatctttttttaatgtt

SEQ ID NO: 105862 - DNA, 20 bp, Artificial Sequence
  Description of Artificial Sequence: Synthetic oligonucleotide
  Target: ATXN1; (+) strand; PAM type: NRG; PAM sequence: CAG
tcagtaataaattttactcc

SEQ ID NO: 105863 - DNA, 20 bp, Artificial Sequence
  Description of Artificial Sequence: Synthetic oligonucleotide
  Target: ATXN1; (+) strand; PAM type: NRG; PAM sequence: AAG
gtaataaattttactcccag

SEQ ID NO: 105864 - DNA, 20 bp, Artificial Sequence
  Description of Artificial Sequence: Synthetic oligonucleotide
  Target: ATXN1; (+) strand; PAM type: NRG; PAM sequence: CAG
ctcctcctcctacaatcccc

SEQ ID NO: 105865 - DNA, 20 bp, Artificial Sequence
  Description of Artificial Sequence: Synthetic oligonucleotide
  Target: ATXN1; (+) strand; PAM type: NRG; PAM sequence: CAG
tcccccagttgttttaatgt

SEQ ID NO: 105866 - DNA, 20 bp, Artificial Sequence
  Description of Artificial Sequence: Synthetic oligonucleotide
  Target: ATXN1; (+) strand; PAM type: NRG; PAM sequence: CAG
ttaatgtcagatgcataatt

SEQ ID NO: 105867 - DNA, 20 bp, Artificial Sequence
  Description of Artificial Sequence: Synthetic oligonucleotide
  Target: ATXN1; (+) strand; PAM type: NRG; PAM sequence: TGG
agatgcataattcagttgtc

SEQ ID NO: 105868 - DNA, 20 bp, Artificial Sequence
  Description of Artificial Sequence: Synthetic oligonucleotide
  Target: ATXN1; (+) strand; PAM type: NRG; PAM sequence: TGG
tgtctggcttgaactcatta

SEQ ID NO: 105869 - DNA, 20 bp, Artificial Sequence
  Description of Artificial Sequence: Synthetic oligonucleotide
  Target: ATXN1; (+) strand; PAM type: NRG; PAM sequence: GGG
gtctggcttgaactcattat

SEQ ID NO: 105870 - DNA, 20 bp, Artificial Sequence
  Description of Artificial Sequence: Synthetic oligonucleotide
  Target: ATXN1; (+) strand; PAM type: NRG; PAM sequence: GAG
attacatttgattttcctgt

SEQ ID NO: 105871 - DNA, 20 bp, Artificial Sequence
  Description of Artificial Sequence: Synthetic oligonucleotide
  Target: ATXN1; (+) strand; PAM type: NRG; PAM sequence: AGG
ttacatttgattttcctgtg

SEQ ID NO: 105872 - DNA, 20 bp, Artificial Sequence
  Description of Artificial Sequence: Synthetic oligonucleotide
  Target: ATXN1; (+) strand; PAM type: NRG; PAM sequence: CAG
atttgattttcctgtgaggc

SEQ ID NO: 105873 - DNA, 20 bp, Artificial Sequence
  Description of Artificial Sequence: Synthetic oligonucleotide
  Target: ATXN1; (+) strand; PAM type: NRG; PAM sequence: GAG
ctgtgaggccagccttgact

SEQ ID NO: 105874 - DNA, 20 bp, Artificial Sequence
  Description of Artificial Sequence: Synthetic oligonucleotide
  Target: ATXN1; (+) strand; PAM type: NRG; PAM sequence: AGG
tgtgaggccagccttgactg

SEQ ID NO: 105875 - DNA, 20 bp, Artificial Sequence
  Description of Artificial Sequence: Synthetic oligonucleotide
  Target: ATXN1; (+) strand; PAM type: NRG; PAM sequence: GGG
gtgaggccagccttgactga

SEQ ID NO: 105876 - DNA, 20 bp, Artificial Sequence
  Description of Artificial Sequence: Synthetic oligonucleotide
  Target: ATXN1; (+) strand; PAM type: NRG; PAM sequence: TGG
gagggtcttctgattctaaa

SEQ ID NO: 105877 - DNA, 20 bp, Artificial Sequence
  Description of Artificial Sequence: Synthetic oligonucleotide
  Target: ATXN1; (+) strand; PAM type: NRG; PAM sequence: TAG
ctaaatggtcaatgtttctg

SEQ ID NO: 105878 - DNA, 20 bp, Artificial Sequence
  Description of Artificial Sequence: Synthetic oligonucleotide
  Target: ATXN1; (+) strand; PAM type: NRG; PAM sequence: CAG
ggtcaatgtttctgtagtgt

SEQ ID NO: 105879 - DNA, 20 bp, Artificial Sequence
  Description of Artificial Sequence: Synthetic oligonucleotide
  Target: ATXN1; (+) strand; PAM type: NRG; PAM sequence: AGG
gtcaatgtttctgtagtgtc

SEQ ID NO: 105880 - DNA, 20 bp, Artificial Sequence
  Description of Artificial Sequence: Synthetic oligonucleotide
  Target: ATXN1; (+) strand; PAM type: NRG; PAM sequence: GAG
tgaaaatgcttcaccttctt

SEQ ID NO: 105881 - DNA, 20 bp, Artificial Sequence
  Description of Artificial Sequence: Synthetic oligonucleotide
  Target: ATXN1; (+) strand; PAM type: NRG; PAM sequence: AGG
gaaaatgcttcaccttcttg

SEQ ID NO: 105882 - DNA, 20 bp, Artificial Sequence
  Description of Artificial Sequence: Synthetic oligonucleotide
  Target: ATXN1; (+) strand; PAM type: NRG; PAM sequence: TGG
gcttcaccttcttgaggctg

SEQ ID NO: 105883 - DNA, 20 bp, Artificial Sequence
  Description of Artificial Sequence: Synthetic oligonucleotide
  Target: ATXN1; (+) strand; PAM type: NRG; PAM sequence: GGG
cttcaccttcttgaggctgt

SEQ ID NO: 105884 - DNA, 20 bp, Artificial Sequence
  Description of Artificial Sequence: Synthetic oligonucleotide
  Target: ATXN1; (+) strand; PAM type: NRG; PAM sequence: TGG
ttcttgaggctgtgggcatg

SEQ ID NO: 105885 - DNA, 20 bp, Artificial Sequence
  Description of Artificial Sequence: Synthetic oligonucleotide
  Target: ATXN1; (+) strand; PAM type: NRG; PAM sequence: TGG
aaacatgttgtgtgattatc

SEQ ID NO: 105886 - DNA, 20 bp, Artificial Sequence
  Description of Artificial Sequence: Synthetic oligonucleotide
  Target: ATXN1; (+) strand; PAM type: NRG; PAM sequence: TGG
gtgtgattatctggtgaaat

SEQ ID NO: 105887 - DNA, 20 bp, Artificial Sequence
  Description of Artificial Sequence: Synthetic oligonucleotide
  Target: ATXN1; (+) strand; PAM type: NRG; PAM sequence: GGG
tgtgattatctggtgaaatt

SEQ ID NO: 105888 - DNA, 20 bp, Artificial Sequence
  Description of Artificial Sequence: Synthetic oligonucleotide
  Target: ATXN1; (+) strand; PAM type: NRG; PAM sequence: GGG
gtgattatctggtgaaattg

SEQ ID NO: 105889 - DNA, 20 bp, Artificial Sequence
  Description of Artificial Sequence: Synthetic oligonucleotide
  Target: ATXN1; (+) strand; PAM type: NRG; PAM sequence: GGG
tgattatctggtgaaattgg

SEQ ID NO: 105890 - DNA, 20 bp, Artificial Sequence
  Description of Artificial Sequence: Synthetic oligonucleotide
  Target: ATXN1; (+) strand; PAM type: NRG; PAM sequence: CAG
aaattgggggactcctcatc

SEQ ID NO: 105891 - DNA, 20 bp, Artificial Sequence
  Description of Artificial Sequence: Synthetic oligonucleotide
  Target: ATXN1; (+) strand; PAM type: NRG; PAM sequence: TAG
ggactcctcatccagcgaac

SEQ ID NO: 105892 - DNA, 20 bp, Artificial Sequence
  Description of Artificial Sequence: Synthetic oligonucleotide
  Target: ATXN1; (+) strand; PAM type: NRG; PAM sequence: AGG
gactcctcatccagcgaact

SEQ ID NO: 105893 - DNA, 20 bp, Artificial Sequence
  Description of Artificial Sequence: Synthetic oligonucleotide
  Target: ATXN1; (+) strand; PAM type: NRG; PAM sequence: GAG
ctcctcatccagcgaactag

SEQ ID NO: 105894 - DNA, 20 bp, Artificial Sequence
  Description of Artificial Sequence: Synthetic oligonucleotide
  Target: ATXN1; (+) strand; PAM type: NRG; PAM sequence: AGG
tcctcatccagcgaactagg

SEQ ID NO: 105895 - DNA, 20 bp, Artificial Sequence
  Description of Artificial Sequence: Synthetic oligonucleotide
  Target: ATXN1; (+) strand; PAM type: NRG; PAM sequence: TGG
tgttccttcacctgaattgc

SEQ ID NO: 105896 - DNA, 20 bp, Artificial Sequence
  Description of Artificial Sequence: Synthetic oligonucleotide
  Target: ATXN1; (+) strand; PAM type: NRG; PAM sequence: GGG
gttccttcacctgaattgct

SEQ ID NO: 105897 - DNA, 20 bp, Artificial Sequence
  Description of Artificial Sequence: Synthetic oligonucleotide
  Target: ATXN1; (+) strand; PAM type: NRG; PAM sequence: TGG
gaattgctgggtctgacgtg

SEQ ID NO: 105898 - DNA, 20 bp, Artificial Sequence
  Description of Artificial Sequence: Synthetic oligonucleotide
  Target: ATXN1; (+) strand; PAM type: NRG; PAM sequence: TGG
tgctgggtctgacgtgtgga

SEQ ID NO: 105899 - DNA, 20 bp, Artificial Sequence
  Description of Artificial Sequence: Synthetic oligonucleotide
  Target: ATXN1; (+) strand; PAM type: NRG; PAM sequence: TGG
gatggcctttgttcccttgc

SEQ ID NO: 105900 - DNA, 20 bp, Artificial Sequence
  Description of Artificial Sequence: Synthetic oligonucleotide
  Target: ATXN1; (+) strand; PAM type: NRG; PAM sequence: GGG
atggcctttgttcccttgct

SEQ ID NO: 105901 - DNA, 20 bp, Artificial Sequence
  Description of Artificial Sequence: Synthetic oligonucleotide
  Target: ATXN1; (+) strand; PAM type: NRG; PAM sequence: GAG
cctttgttcccttgctgggt

SEQ ID NO: 105902 - DNA, 20 bp, Artificial Sequence
  Description of Artificial Sequence: Synthetic oligonucleotide
  Target: ATXN1; (+) strand; PAM type: NRG; PAM sequence: CGG
tgttcccttgctgggtgagc

SEQ ID NO: 105903 - DNA, 20 bp, Artificial Sequence
  Description of Artificial Sequence: Synthetic oligonucleotide
  Target: ATXN1; (+) strand; PAM type: NRG; PAM sequence: GGG
gttcccttgctgggtgagcc

SEQ ID NO: 105904 - DNA, 20 bp, Artificial Sequence
  Description of Artificial Sequence: Synthetic oligonucleotide
  Target: ATXN1; (+) strand; PAM type: NRG; PAM sequence: CAG
ccttgctgggtgagccgggt

SEQ ID NO: 105905 - DNA, 20 bp, Artificial Sequence
  Description of Artificial Sequence: Synthetic oligonucleotide
  Target: ATXN1; (+) strand; PAM type: NRG; PAM sequence: TAG
gctgtgtcttgtcataactg

SEQ ID NO: 105906 - DNA, 20 bp, Artificial Sequence
  Description of Artificial Sequence: Synthetic oligonucleotide
  Target: ATXN1; (+) strand; PAM type: NRG; PAM sequence: TGG
aactgtagacattccgtaac

SEQ ID NO: 105907 - DNA, 20 bp, Artificial Sequence
  Description of Artificial Sequence: Synthetic oligonucleotide
  Target: ATXN1; (+) strand; PAM type: NRG; PAM sequence: TGG
actggtgttcatgtaactgc

SEQ ID NO: 105908 - DNA, 20 bp, Artificial Sequence
  Description of Artificial Sequence: Synthetic oligonucleotide
  Target: ATXN1; (+) strand; PAM type: NRG; PAM sequence: GAG
tggtgttcatgtaactgctg

SEQ ID NO: 105909 - DNA, 20 bp, Artificial Sequence
  Description of Artificial Sequence: Synthetic oligonucleotide
  Target: ATXN1; (+) strand; PAM type: NRG; PAM sequence: AAG
gctggagcttgcttcaaacc

SEQ ID NO: 105910 - DNA, 20 bp, Artificial Sequence
  Description of Artificial Sequence: Synthetic oligonucleotide
  Target: ATXN1; (+) strand; PAM type: NRG; PAM sequence: AGG
ctggagcttgcttcaaacca

SEQ ID NO: 105911 - DNA, 20 bp, Artificial Sequence
  Description of Artificial Sequence: Synthetic oligonucleotide
  Target: ATXN1; (+) strand; PAM type: NRG; PAM sequence: CAG
gagcttgcttcaaaccaagg

SEQ ID NO: 105912 - DNA, 20 bp, Artificial Sequence
  Description of Artificial Sequence: Synthetic oligonucleotide
  Target: ATXN1; (+) strand; PAM type: NRG; PAM sequence: TGG
aaggcagaaacccgtgacga

SEQ ID NO: 105913 - DNA, 20 bp, Artificial Sequence
  Description of Artificial Sequence: Synthetic oligonucleotide
  Target: ATXN1; (+) strand; PAM type: NRG; PAM sequence: GAG
ggcagaaacccgtgacgatg

SEQ ID NO: 105914 - DNA, 20 bp, Artificial Sequence
  Description of Artificial Sequence: Synthetic oligonucleotide
  Target: ATXN1; (+) strand; PAM type: NRG; PAM sequence: CAG
tgccttcccctcacattaac

SEQ ID NO: 105915 - DNA, 20 bp, Artificial Sequence
  Description of Artificial Sequence: Synthetic oligonucleotide
  Target: ATXN1; (+) strand; PAM type: NRG; PAM sequence: TGG
cattaaccagttcgtgacta

SEQ ID NO: 105916 - DNA, 20 bp, Artificial Sequence
  Description of Artificial Sequence: Synthetic oligonucleotide
  Target: ATXN1; (+) strand; PAM type: NRG; PAM sequence: GAG
ttaaccagttcgtgactatg

SEQ ID NO: 105917 - DNA, 20 bp, Artificial Sequence
  Description of Artificial Sequence: Synthetic oligonucleotide
  Target: ATXN1; (+) strand; PAM type: NRG; PAM sequence: CAG
agttcgtgactatggagaaa

SEQ ID NO: 105918 - DNA, 20 bp, Artificial Sequence
  Description of Artificial Sequence: Synthetic oligonucleotide
  Target: ATXN1; (+) strand; PAM type: NRG; PAM sequence: AGG
gttcgtgactatggagaaac

SEQ ID NO: 105919 - DNA, 20 bp, Artificial Sequence
  Description of Artificial Sequence: Synthetic oligonucleotide
  Target: ATXN1; (+) strand; PAM type: NRG; PAM sequence: GGG
ttcgtgactatggagaaaca

SEQ ID NO: 105920 - DNA, 20 bp, Artificial Sequence
  Description of Artificial Sequence: Synthetic oligonucleotide
  Target: ATXN1; (+) strand; PAM type: NRG; PAM sequence: AAG
tgactatggagaaacagggc

SEQ ID NO: 105921 - DNA, 20 bp, Artificial Sequence
  Description of Artificial Sequence: Synthetic oligonucleotide
  Target: ATXN1; (+) strand; PAM type: NRG; PAM sequence: TAG
ctatggagaaacagggcaag

SEQ ID NO: 105922 - DNA, 20 bp, Artificial Sequence
  Description of Artificial Sequence: Synthetic oligonucleotide
  Target: ATXN1; (+) strand; PAM type: NRG; PAM sequence: TGG
caagtagctcttgatctgac

SEQ ID NO: 105923 - DNA, 20 bp, Artificial Sequence
  Description of Artificial Sequence: Synthetic oligonucleotide
  Target: ATXN1; (+) strand; PAM type: NRG; PAM sequence: CGG
tagctcttgatctgactgga

SEQ ID NO: 105924 - DNA, 20 bp, Artificial Sequence
  Description of Artificial Sequence: Synthetic oligonucleotide
  Target: ATXN1; (+) strand; PAM type: NRG; PAM sequence: TGG
tcttgatctgactggacgga

SEQ ID NO: 105925 - DNA, 20 bp, Artificial Sequence
  Description of Artificial Sequence: Synthetic oligonucleotide
  Target: ATXN1; (+) strand; PAM type: NRG; PAM sequence: TGG
tctgactggacggatggctt

SEQ ID NO: 105926 - DNA, 20 bp, Artificial Sequence
  Description of Artificial Sequence: Synthetic oligonucleotide
  Target: ATXN1; (+) strand; PAM type: NRG; PAM sequence: GAG
tgactggacggatggctttg

SEQ ID NO: 105927 - DNA, 20 bp, Artificial Sequence
  Description of Artificial Sequence: Synthetic oligonucleotide
  Target: ATXN1; (+) strand; PAM type: NRG; PAM sequence: CAG
ggacggatggctttggagac

SEQ ID NO: 105928 - DNA, 20 bp, Artificial Sequence
  Description of Artificial Sequence: Synthetic oligonucleotide
  Target: ATXN1; (+) strand; PAM type: NRG; PAM sequence: AGG
gacggatggctttggagacc

SEQ ID NO: 105929 - DNA, 20 bp, Artificial Sequence
  Description of Artificial Sequence: Synthetic oligonucleotide
  Target: ATXN1; (+) strand; PAM type: NRG; PAM sequence: AAG
gctttggagaccaggctctg

SEQ ID NO: 105930 - DNA, 20 bp, Artificial Sequence
  Description of Artificial Sequence: Synthetic oligonucleotide
  Target: ATXN1; (+) strand; PAM type: NRG; PAM sequence: GAG
tttggagaccaggctctgaa

SEQ ID NO: 105931 - DNA, 20 bp, Artificial Sequence
  Description of Artificial Sequence: Synthetic oligonucleotide
  Target: ATXN1; (+) strand; PAM type: NRG; PAM sequence: TGG
aagagatgcttgtaaaaatc

SEQ ID NO: 105932 - DNA, 20 bp, Artificial Sequence
  Description of Artificial Sequence: Synthetic oligonucleotide
  Target: ATXN1; (+) strand; PAM type: NRG; PAM sequence: GAG
gagatgcttgtaaaaatctg

SEQ ID NO: 105933 - DNA, 20 bp, Artificial Sequence
  Description of Artificial Sequence: Synthetic oligonucleotide
  Target: ATXN1; (+) strand; PAM type: NRG; PAM sequence: AAG
aaaaatctggagcttaacac

SEQ ID NO: 105934 - DNA, 20 bp, Artificial Sequence
  Description of Artificial Sequence: Synthetic oligonucleotide
  Target: ATXN1; (+) strand; PAM type: NRG; PAM sequence: AAG
aatctggagcttaacacaag

SEQ ID NO: 105935 - DNA, 20 bp, Artificial Sequence
  Description of Artificial Sequence: Synthetic oligonucleotide
  Target: ATXN1; (+) strand; PAM type: NRG; PAM sequence: AAG
taacacaagaagcttaaaac

SEQ ID NO: 105936 - DNA, 20 bp, Artificial Sequence
  Description of Artificial Sequence: Synthetic oligonucleotide
  Target: ATXN1; (+) strand; PAM type: NRG; PAM sequence: AAG
cacaagaagcttaaaacaag

SEQ ID NO: 105937 - DNA, 20 bp, Artificial Sequence
  Description of Artificial Sequence: Synthetic oligonucleotide
  Target: ATXN1; (+) strand; PAM type: NRG; PAM sequence: AAG
ttaaaacaagaagctccttt

SEQ ID NO: 105938 - DNA, 20 bp, Artificial Sequence
  Description of Artificial Sequence: Synthetic oligonucleotide
  Target: ATXN1; (+) strand; PAM type: NRG; PAM sequence: TGG
caagaagctcctttaagtgt

SEQ ID NO: 105939 - DNA, 20 bp, Artificial Sequence
  Description of Artificial Sequence: Synthetic oligonucleotide
  Target: ATXN1; (+) strand; PAM type: NRG; PAM sequence: GAG
agaagctcctttaagtgttg

SEQ ID NO: 105940 - DNA, 20 bp, Artificial Sequence
  Description of Artificial Sequence: Synthetic oligonucleotide
  Target: ATXN1; (+) strand; PAM type: NRG; PAM sequence: CAG
tcctttaagtgttggagctt

SEQ ID NO: 105941 - DNA, 20 bp, Artificial Sequence
  Description of Artificial Sequence: Synthetic oligonucleotide
  Target: ATXN1; (+) strand; PAM type: NRG; PAM sequence: GAG
ctttaagtgttggagcttca

SEQ ID NO: 105942 - DNA, 20 bp, Artificial Sequence
  Description of Artificial Sequence: Synthetic oligonucleotide
  Target: ATXN1; (+) strand; PAM type: NRG; PAM sequence: AAG
aagtgttggagcttcagaga

SEQ ID NO: 105943 - DNA, 20 bp, Artificial Sequence
  Description of Artificial Sequence: Synthetic oligonucleotide
  Target: ATXN1; (+) strand; PAM type: NRG; PAM sequence: AGG
agtgttggagcttcagagaa

SEQ ID NO: 105944 - DNA, 20 bp, Artificial Sequence
  Description of Artificial Sequence: Synthetic oligonucleotide
  Target: ATXN1; (+) strand; PAM type: NRG; PAM sequence: GAG
tgttggagcttcagagaaag

SEQ ID NO: 105945 - DNA, 20 bp, Artificial Sequence
  Description of Artificial Sequence: Synthetic oligonucleotide
  Target: ATXN1; (+) strand; PAM type: NRG; PAM sequence: CAG
aggagccacgttacccattt

SEQ ID NO: 105946 - DNA, 20 bp, Artificial Sequence
  Description of Artificial Sequence: Synthetic oligonucleotide
  Target: ATXN1; (+) strand; PAM type: NRG; PAM sequence: GAG
gagccacgttacccatttca

SEQ ID NO: 105947 - DNA, 20 bp, Artificial Sequence
  Description of Artificial Sequence: Synthetic oligonucleotide
  Target: ATXN1; (+) strand; PAM type: NRG; PAM sequence: CAG
ccacgttacccatttcagag

SEQ ID NO: 105948 - DNA, 20 bp, Artificial Sequence
  Description of Artificial Sequence: Synthetic oligonucleotide
  Target: ATXN1; (+) strand; PAM type: NRG; PAM sequence: AGG
cacgttacccatttcagagc

SEQ ID NO: 105949 - DNA, 20 bp, Artificial Sequence
  Description of Artificial Sequence: Synthetic oligonucleotide
  Target: ATXN1; (+) strand; PAM type: NRG; PAM sequence: GGG
acgttacccatttcagagca

SEQ ID NO: 105950 - DNA, 20 bp, Artificial Sequence
  Description of Artificial Sequence: Synthetic oligonucleotide
  Target: ATXN1; (+) strand; PAM type: NRG; PAM sequence: GAG
gttacccatttcagagcagg

SEQ ID NO: 105951 - DNA, 20 bp, Artificial Sequence
  Description of Artificial Sequence: Synthetic oligonucleotide
  Target: ATXN1; (+) strand; PAM type: NRG; PAM sequence: CAG
atttcagagcagggagattc

SEQ ID NO: 105952 - DNA, 20 bp, Artificial Sequence
  Description of Artificial Sequence: Synthetic oligonucleotide
  Target: ATXN1; (+) strand; PAM type: NRG; PAM sequence: GAG
ttcagagcagggagattcca

SEQ ID NO: 105953 - DNA, 20 bp, Artificial Sequence
  Description of Artificial Sequence: Synthetic oligonucleotide
  Target: ATXN1; (+) strand; PAM type: NRG; PAM sequence: AAG
agagcagggagattccagag

SEQ ID NO: 105954 - DNA, 20 bp, Artificial Sequence
  Description of Artificial Sequence: Synthetic oligonucleotide
  Target: ATXN1; (+) strand; PAM type: NRG; PAM sequence: TGG
gagattccagagaagtcacc

SEQ ID NO: 105955 - DNA, 20 bp, Artificial Sequence
  Description of Artificial Sequence: Synthetic oligonucleotide
  Target: ATXN1; (+) strand; PAM type: NRG; PAM sequence: GGG
agattccagagaagtcacct

SEQ ID NO: 105956 - DNA, 20 bp, Artificial Sequence
  Description of Artificial Sequence: Synthetic oligonucleotide
  Target: ATXN1; (+) strand; PAM type: NRG; PAM sequence: CGG
cagagaagtcacctgggtgt

SEQ ID NO: 105957 - DNA, 20 bp, Artificial Sequence
  Description of Artificial Sequence: Synthetic oligonucleotide
  Target: ATXN1; (+) strand; PAM type: NRG; PAM sequence: GAG
tcacctgggtgtcggcttct

SEQ ID NO: 105958 - DNA, 20 bp, Artificial Sequence
  Description of Artificial Sequence: Synthetic oligonucleotide
  Target: ATXN1; (+) strand; PAM type: NRG; PAM sequence: TGG
gctcacactcctcctgttcc

SEQ ID NO: 105959 - DNA, 20 bp, Artificial Sequence
  Description of Artificial Sequence: Synthetic oligonucleotide
  Target: ATXN1; (+) strand; PAM type: NRG; PAM sequence: CAG
ggcccccaccctcccgctct

SEQ ID NO: 105960 - DNA, 20 bp, Artificial Sequence
  Description of Artificial Sequence: Synthetic oligonucleotide
  Target: ATXN1; (+) strand; PAM type: NRG; PAM sequence: CAG
ccccaccctcccgctctcag

SEQ ID NO: 105961 - DNA, 20 bp, Artificial Sequence
  Description of Artificial Sequence: Synthetic oligonucleotide
  Target: ATXN1; (+) strand; PAM type: NRG; PAM sequence: CGG
atcatcacttcgctcccgcc

SEQ ID NO: 105962 - DNA, 20 bp, Artificial Sequence
  Description of Artificial Sequence: Synthetic oligonucleotide
  Target: ATXN1; (+) strand; PAM type: NRG; PAM sequence: CGG
tcctgtcatcacccccgctc

SEQ ID NO: 105963 - DNA, 20 bp, Artificial Sequence
  Description of Artificial Sequence: Synthetic oligonucleotide
  Target: ATXN1; (+) strand; PAM type: NRG; PAM sequence: GAG
ctgtcatcacccccgctccg

SEQ ID NO: 105964 - DNA, 20 bp, Artificial Sequence
  Description of Artificial Sequence: Synthetic oligonucleotide
  Target: ATXN1; (+) strand; PAM type: NRG; PAM sequence: AAG
tcacccccgctccggagtga

SEQ ID NO: 105965 - DNA, 20 bp, Artificial Sequence
  Description of Artificial Sequence: Synthetic oligonucleotide
  Target: ATXN1; (+) strand; PAM type: NRG; PAM sequence: AAG
ccccgctccggagtgaaaga

SEQ ID NO: 105966 - DNA, 20 bp, Artificial Sequence
  Description of Artificial Sequence: Synthetic oligonucleotide
  Target: ATXN1; (+) strand; PAM type: NRG; PAM sequence: AGG
cccgctccggagtgaaagaa

SEQ ID NO: 105967 - DNA, 20 bp, Artificial Sequence
  Description of Artificial Sequence: Synthetic oligonucleotide
  Target: ATXN1; (+) strand; PAM type: NRG; PAM sequence: GAG
cgctccggagtgaaagaaag

SEQ ID NO: 105968 - DNA, 20 bp, Artificial Sequence
  Description of Artificial Sequence: Synthetic oligonucleotide
  Target: ATXN1; (+) strand; PAM type: NRG; PAM sequence: CGG
agaaaggagacaccttacca

SEQ ID NO: 105969 - DNA, 20 bp, Artificial Sequence
  Description of Artificial Sequence: Synthetic oligonucleotide
  Target: ATXN1; (+) strand; PAM type: NRG; PAM sequence: CAG
cttaccacggctcttcccac

SEQ ID NO: 105970 - DNA, 20 bp, Artificial Sequence
  Description of Artificial Sequence: Synthetic oligonucleotide
  Target: ATXN1; (+) strand; PAM type: NRG; PAM sequence: CAG
accacggctcttcccaccag

SEQ ID NO: 105971 - DNA, 20 bp, Artificial Sequence
  Description of Artificial Sequence: Synthetic oligonucleotide
  Target: ATXN1; (+) strand; PAM type: NRG; PAM sequence: CAG
gctcttcccaccagcagcac

SEQ ID NO: 105972 - DNA, 20 bp, Artificial Sequence
  Description of Artificial Sequence: Synthetic oligonucleotide
  Target: ATXN1; (+) strand; PAM type: NRG; PAM sequence: AGG
ctcttcccaccagcagcacc

SEQ ID NO: 105973 - DNA, 20 bp, Artificial Sequence
  Description of Artificial Sequence: Synthetic oligonucleotide
  Target: ATXN1; (+) strand; PAM type: NRG; PAM sequence: AAG
ttcccaccagcagcaccagg

SEQ ID NO: 105974 - DNA, 20 bp, Artificial Sequence
  Description of Artificial Sequence: Synthetic oligonucleotide
  Target: ATXN1; (+) strand; PAM type: NRG; PAM sequence: TGG
tactgccatttctatttaaa

SEQ ID NO: 105975 - DNA, 20 bp, Artificial Sequence
  Description of Artificial Sequence: Synthetic oligonucleotide
  Target: ATXN1; (+) strand; PAM type: NRG; PAM sequence: TAG
gccatttctatttaaatgga

SEQ ID NO: 105976 - DNA, 20 bp, Artificial Sequence
  Description of Artificial Sequence: Synthetic oligonucleotide
  Target: ATXN1; (+) strand; PAM type: NRG; PAM sequence: AGG
ccatttctatttaaatggat

SEQ ID NO: 105977 - DNA, 20 bp, Artificial Sequence
  Description of Artificial Sequence: Synthetic oligonucleotide
  Target: ATXN1; (+) strand; PAM type: NRG; PAM sequence: GGG
catttctatttaaatggata

SEQ ID NO: 105978 - DNA, 20 bp, Artificial Sequence
  Description of Artificial Sequence: Synthetic oligonucleotide
  Target: ATXN1; (+) strand; PAM type: NRG; PAM sequence: TGG
atttaaatggatagggatgt

SEQ ID NO: 105979 - DNA, 20 bp, Artificial Sequence
  Description of Artificial Sequence: Synthetic oligonucleotide
  Target: ATXN1; (+) strand; PAM type: NRG; PAM sequence: GGG
tttaaatggatagggatgtt

SEQ ID NO: 105980 - DNA, 20 bp, Artificial Sequence
  Description of Artificial Sequence: Synthetic oligonucleotide
  Target: ATXN1; (+) strand; PAM type: NRG; PAM sequence: CAG
aaatggatagggatgttggg

SEQ ID NO: 105981 - DNA, 20 bp, Artificial Sequence
  Description of Artificial Sequence: Synthetic oligonucleotide
  Target: ATXN1; (+) strand; PAM type: NRG; PAM sequence: GAG
atggatagggatgttgggca

SEQ ID NO: 105982 - DNA, 20 bp, Artificial Sequence
  Description of Artificial Sequence: Synthetic oligonucleotide
  Target: ATXN1; (+) strand; PAM type: NRG; PAM sequence: GAG
ggatagggatgttgggcaga

SEQ ID NO: 105983 - DNA, 20 bp, Artificial Sequence
  Description of Artificial Sequence: Synthetic oligonucleotide
  Target: ATXN1; (+) strand; PAM type: NRG; PAM sequence: CGG
gttgggcagagagacacttt

SEQ ID NO: 105984 - DNA, 20 bp, Artificial Sequence
  Description of Artificial Sequence: Synthetic oligonucleotide
  Target: ATXN1; (+) strand; PAM type: NRG; PAM sequence: GAG
tgggcagagagacactttcg

SEQ ID NO: 105985 - DNA, 20 bp, Artificial Sequence
  Description of Artificial Sequence: Synthetic oligonucleotide
  Target: ATXN1; (+) strand; PAM type: NRG; PAM sequence: AAG
gagacactttcggagcctgt

SEQ ID NO: 105986 - DNA, 20 bp, Artificial Sequence
  Description of Artificial Sequence: Synthetic oligonucleotide
  Target: ATXN1; (+) strand; PAM type: NRG; PAM sequence: AAG
ctttcggagcctgtaagttt

SEQ ID NO: 105987 - DNA, 20 bp, Artificial Sequence
  Description of Artificial Sequence: Synthetic oligonucleotide
  Target: ATXN1; (+) strand; PAM type: NRG; PAM sequence: CAG
agcctgtaagtttaagtgtt

SEQ ID NO: 105988 - DNA, 20 bp, Artificial Sequence
  Description of Artificial Sequence: Synthetic oligonucleotide
  Target: ATXN1; (+) strand; PAM type: NRG; PAM sequence: CAG
agtgttcagatcattctttg

SEQ ID NO: 105989 - DNA, 20 bp, Artificial Sequence
  Description of Artificial Sequence: Synthetic oligonucleotide
  Target: ATXN1; (+) strand; PAM type: NRG; PAM sequence: AAG
tgctcttgcttgtactgtaa

SEQ ID NO: 105990 - DNA, 20 bp, Artificial Sequence
  Description of Artificial Sequence: Synthetic oligonucleotide
  Target: ATXN1; (+) strand; PAM type: NRG; PAM sequence: AGG
gctcttgcttgtactgtaaa

SEQ ID NO: 105991 - DNA, 20 bp, Artificial Sequence
  Description of Artificial Sequence: Synthetic oligonucleotide
  Target: ATXN1; (+) strand; PAM type: NRG; PAM sequence: TAG
taaaaggttctctattcata

SEQ ID NO: 105992 - DNA, 20 bp, Artificial Sequence
  Description of Artificial Sequence: Synthetic oligonucleotide
  Target: ATXN1; (+) strand; PAM type: NRG; PAM sequence: CAG
attcatatagatgtgatatt

SEQ ID NO: 105993 - DNA, 20 bp, Artificial Sequence
  Description of Artificial Sequence: Synthetic oligonucleotide
  Target: ATXN1; (+) strand; PAM type: NRG; PAM sequence: TAG
tgtgatattcagtttatgta

SEQ ID NO: 105994 - DNA, 20 bp, Artificial Sequence
  Description of Artificial Sequence: Synthetic oligonucleotide
  Target: ATXN1; (+) strand; PAM type: NRG; PAM sequence: AGG
gtgatattcagtttatgtat

SEQ ID NO: 105995 - DNA, 20 bp, Artificial Sequence
  Description of Artificial Sequence: Synthetic oligonucleotide
  Target: ATXN1; (+) strand; PAM type: NRG; PAM sequence: CAG
ttatgtataggtttacattt

SEQ ID NO: 105996 - DNA, 20 bp, Artificial Sequence
  Description of Artificial Sequence: Synthetic oligonucleotide
  Target: ATXN1; (+) strand; PAM type: NRG; PAM sequence: TGG
actcatgtcgcaaaccttta

SEQ ID NO: 105997 - DNA, 20 bp, Artificial Sequence
  Description of Artificial Sequence: Synthetic oligonucleotide
  Target: ATXN1; (+) strand; PAM type: NRG; PAM sequence: GAG
tcatgtcgcaaacctttatg

SEQ ID NO: 105998 - DNA, 20 bp, Artificial Sequence
  Description of Artificial Sequence: Synthetic oligonucleotide
  Target: ATXN1; (+) strand; PAM type: NRG; PAM sequence: TAG
atggagtgcctactacatat

SEQ ID NO: 105999 - DNA, 20 bp, Artificial Sequence
  Description of Artificial Sequence: Synthetic oligonucleotide
  Target: ATXN1; (+) strand; PAM type: NRG; PAM sequence: GAG
gcctactacatattagtgat

SEQ ID NO: 106000 - DNA, 20 bp, Artificial Sequence
  Description of Artificial Sequence: Synthetic oligonucleotide
  Target: ATXN1; (+) strand; PAM type: NRG; PAM sequence: CAG
tactacatattagtgatgag

SEQ ID NO: 106001 - DNA, 20 bp, Artificial Sequence
  Description of Artificial Sequence: Synthetic oligonucleotide
  Target: ATXN1; (+) strand; PAM type: NRG; PAM sequence: TAG
tacatattagtgatgagcag

SEQ ID NO: 106002 - DNA, 20 bp, Artificial Sequence
  Description of Artificial Sequence: Synthetic oligonucleotide
  Target: ATXN1; (+) strand; PAM type: NRG; PAM sequence: AGG
acatattagtgatgagcagt

SEQ ID NO: 106003 - DNA, 20 bp, Artificial Sequence
  Description of Artificial Sequence: Synthetic oligonucleotide
  Target: ATXN1; (+) strand; PAM type: NRG; PAM sequence: CAG
atgagcagtaggaataataa

SEQ ID NO: 106004 - DNA, 20 bp, Artificial Sequence
  Description of Artificial Sequence: Synthetic oligonucleotide
  Target: ATXN1; (+) strand; PAM type: NRG; PAM sequence: AAG
aataacagctaatacctaca

SEQ ID NO: 106005 - DNA, 20 bp, Artificial Sequence
  Description of Artificial Sequence: Synthetic oligonucleotide
  Target: ATXN1; (+) strand; PAM type: NRG; PAM sequence: CAG
taatacctacaaagcacttt

SEQ ID NO: 106006 - DNA, 20 bp, Artificial Sequence
  Description of Artificial Sequence: Synthetic oligonucleotide
  Target: ATXN1; (+) strand; PAM type: NRG; PAM sequence: TAG
acaaagcactttcagtctgc

SEQ ID NO: 106007 - DNA, 20 bp, Artificial Sequence
  Description of Artificial Sequence: Synthetic oligonucleotide
  Target: ATXN1; (+) strand; PAM type: NRG; PAM sequence: AGG
caaagcactttcagtctgct

SEQ ID NO: 106008 - DNA, 20 bp, Artificial Sequence
  Description of Artificial Sequence: Synthetic oligonucleotide
  Target: ATXN1; (+) strand; PAM type: NRG; PAM sequence: GGG
aaagcactttcagtctgcta

SEQ ID NO: 106009 - DNA, 20 bp, Artificial Sequence
  Description of Artificial Sequence: Synthetic oligonucleotide
  Target: ATXN1; (+) strand; PAM type: NRG; PAM sequence: TGG
cagtctgctagggctttgca

SEQ ID NO: 106010 - DNA, 20 bp, Artificial Sequence
  Description of Artificial Sequence: Synthetic oligonucleotide
  Target: ATXN1; (+) strand; PAM type: NRG; PAM sequence: GAG
gtctgctagggctttgcatg

SEQ ID NO: 106011 - DNA, 20 bp, Artificial Sequence
  Description of Artificial Sequence: Synthetic oligonucleotide
  Target: ATXN1; (+) strand; PAM type: NRG; PAM sequence: AAG
ttgcatggagccgctcattt

SEQ ID NO: 106012 - DNA, 20 bp, Artificial Sequence
  Description of Artificial Sequence: Synthetic oligonucleotide
  Target: ATXN1; (+) strand; PAM type: NRG; PAM sequence: AAG
atggagccgctcatttaagt

SEQ ID NO: 106013 - DNA, 20 bp, Artificial Sequence
  Description of Artificial Sequence: Synthetic oligonucleotide
  Target: ATXN1; (+) strand; PAM type: NRG; PAM sequence: TAG
catttaagtaagcactcttc

SEQ ID NO: 106014 - DNA, 20 bp, Artificial Sequence
  Description of Artificial Sequence: Synthetic oligonucleotide
  Target: ATXN1; (+) strand; PAM type: NRG; PAM sequence: GAG
atgataccatctaattaaat

SEQ ID NO: 106015 - DNA, 20 bp, Artificial Sequence
  Description of Artificial Sequence: Synthetic oligonucleotide
  Target: ATXN1; (+) strand; PAM type: NRG; PAM sequence: AGG
tgataccatctaattaaatg

SEQ ID NO: 106016 - DNA, 20 bp, Artificial Sequence
  Description of Artificial Sequence: Synthetic oligonucleotide
  Target: ATXN1; (+) strand; PAM type: NRG; PAM sequence: CAG
taattaaatgaggtgcttca

SEQ ID NO: 106017 - DNA, 20 bp, Artificial Sequence
  Description of Artificial Sequence: Synthetic oligonucleotide
  Target: ATXN1; (+) strand; PAM type: NRG; PAM sequence: CAG
gcttcacagacacaaatata

SEQ ID NO: 106018 - DNA, 20 bp, Artificial Sequence
  Description of Artificial Sequence: Synthetic oligonucleotide
  Target: ATXN1; (+) strand; PAM type: NRG; PAM sequence: CGG
tgtatgctgttcctttataa

SEQ ID NO: 106019 - DNA, 20 bp, Artificial Sequence
  Description of Artificial Sequence: Synthetic oligonucleotide
  Target: ATXN1; (+) strand; PAM type: NRG; PAM sequence: CAG
cctaccctgcctacttttct

SEQ ID NO: 106020 - DNA, 20 bp, Artificial Sequence
  Description of Artificial Sequence: Synthetic oligonucleotide
  Target: ATXN1; (+) strand; PAM type: NRG; PAM sequence: CAG
atcatgttatttcaccccaa

SEQ ID NO: 106021 - DNA, 20 bp, Artificial Sequence
  Description of Artificial Sequence: Synthetic oligonucleotide
  Target: ATXN1; (+) strand; PAM type: NRG; PAM sequence: TGG
tcaccccaacagactttttc

SEQ ID NO: 106022 - DNA, 20 bp, Artificial Sequence
  Description of Artificial Sequence: Synthetic oligonucleotide
  Target: ATXN1; (+) strand; PAM type: NRG; PAM sequence: CAG
aatgattgcttactacatgt

SEQ ID NO: 106023 - DNA, 20 bp, Artificial Sequence
  Description of Artificial Sequence: Synthetic oligonucleotide
  Target: ATXN1; (+) strand; PAM type: NRG; PAM sequence: TGG
attgcttactacatgtcagt

SEQ ID NO: 106024 - DNA, 20 bp, Artificial Sequence
  Description of Artificial Sequence: Synthetic oligonucleotide
  Target: ATXN1; (+) strand; PAM type: NRG; PAM sequence: CAG
acatgtcagttggctgttca

SEQ ID NO: 106025 - DNA, 20 bp, Artificial Sequence
  Description of Artificial Sequence: Synthetic oligonucleotide
  Target: ATXN1; (+) strand; PAM type: NRG; PAM sequence: CAG
cagttggctgttcacagttt

SEQ ID NO: 106026 - DNA, 20 bp, Artificial Sequence
  Description of Artificial Sequence: Synthetic oligonucleotide
  Target: ATXN1; (+) strand; PAM type: NRG; PAM sequence: AAG
gttcacagtttcagaaatac

SEQ ID NO: 106027 - DNA, 20 bp, Artificial Sequence
  Description of Artificial Sequence: Synthetic oligonucleotide
  Target: ATXN1; (+) strand; PAM type: NRG; PAM sequence: TGG
cacagtttcagaaatacaag

SEQ ID NO: 106028 - DNA, 20 bp, Artificial Sequence
  Description of Artificial Sequence: Synthetic oligonucleotide
  Target: ATXN1; (+) strand; PAM type: NRG; PAM sequence: GAG
cagtttcagaaatacaagtg

SEQ ID NO: 106029 - DNA, 20 bp, Artificial Sequence
  Description of Artificial Sequence: Synthetic oligonucleotide
  Target: ATXN1; (+) strand; PAM type: NRG; PAM sequence: TGG
gaaatacaagtggagaaact

SEQ ID NO: 106030 - DNA, 20 bp, Artificial Sequence
  Description of Artificial Sequence: Synthetic oligonucleotide
  Target: ATXN1; (+) strand; PAM type: NRG; PAM sequence: CAG
aagtggagaaacttggaaaa

SEQ ID NO: 106031 - DNA, 20 bp, Artificial Sequence
  Description of Artificial Sequence: Synthetic oligonucleotide
  Target: ATXN1; (+) strand; PAM type: NRG; PAM sequence: TAG
aaacagcatctatcaacttc

SEQ ID NO: 106032 - DNA, 20 bp, Artificial Sequence
  Description of Artificial Sequence: Synthetic oligonucleotide
  Target: ATXN1; (+) strand; PAM type: NRG; PAM sequence: AAG
atctatcaacttctagatct

SEQ ID NO: 106033 - DNA, 20 bp, Artificial Sequence
  Description of Artificial Sequence: Synthetic oligonucleotide
  Target: ATXN1; (+) strand; PAM type: NRG; PAM sequence: GAG
cttctagatctaagctctct

SEQ ID NO: 106034 - DNA, 20 bp, Artificial Sequence
  Description of Artificial Sequence: Synthetic oligonucleotide
  Target: ATXN1; (+) strand; PAM type: NRG; PAM sequence: GAG
tctagatctaagctctctga

SEQ ID NO: 106035 - DNA, 20 bp, Artificial Sequence
  Description of Artificial Sequence: Synthetic oligonucleotide
  Target: ATXN1; (+) strand; PAM type: NRG; PAM sequence: AAG
gatctaagctctctgagagc

SEQ ID NO: 106036 - DNA, 20 bp, Artificial Sequence
  Description of Artificial Sequence: Synthetic oligonucleotide
  Target: ATXN1; (+) strand; PAM type: NRG; PAM sequence: AAG
tgttttttcttctccatcct

SEQ ID NO: 106037 - DNA, 20 bp, Artificial Sequence
  Description of Artificial Sequence: Synthetic oligonucleotide
  Target: ATXN1; (+) strand; PAM type: NRG; PAM sequence: AGG
gttttttcttctccatccta

SEQ ID NO: 106038 - DNA, 20 bp, Artificial Sequence
  Description of Artificial Sequence: Synthetic oligonucleotide
  Target: ATXN1; (+) strand; PAM type: NRG; PAM sequence: TGG
tcttctccatcctaaggccg

SEQ ID NO: 106039 - DNA, 20 bp, Artificial Sequence
  Description of Artificial Sequence: Synthetic oligonucleotide
  Target: ATXN1; (+) strand; PAM type: NRG; PAM sequence: TAG
tgtgcctgatacatatttga

SEQ ID NO: 106040 - DNA, 20 bp, Artificial Sequence
  Description of Artificial Sequence: Synthetic oligonucleotide
  Target: ATXN1; (+) strand; PAM type: NRG; PAM sequence: AGG
gtgcctgatacatatttgat

SEQ ID NO: 106041 - DNA, 20 bp, Artificial Sequence
  Description of Artificial Sequence: Synthetic oligonucleotide
  Target: ATXN1; (+) strand; PAM type: NRG; PAM sequence: AAG
atatttgataggtgcatgct

SEQ ID NO: 106042 - DNA, 20 bp, Artificial Sequence
  Description of Artificial Sequence: Synthetic oligonucleotide
  Target: ATXN1; (+) strand; PAM type: NRG; PAM sequence: TAG
ccatatgctaatatcctgtc

SEQ ID NO: 106043 - DNA, 20 bp, Artificial Sequence
  Description of Artificial Sequence: Synthetic oligonucleotide
  Target: ATXN1; (+) strand; PAM type: NRG; PAM sequence: GAG
cctgtctagtaataactgct

SEQ ID NO: 106044 - DNA, 20 bp, Artificial Sequence
  Description of Artificial Sequence: Synthetic oligonucleotide
  Target: ATXN1; (+) strand; PAM type: NRG; PAM sequence: AGG
ctgtctagtaataactgctg

SEQ ID NO: 106045 - DNA, 20 bp, Artificial Sequence
  Description of Artificial Sequence: Synthetic oligonucleotide
  Target: ATXN1; (+) strand; PAM type: NRG; PAM sequence: CAG
gtaataactgctgaggactt

SEQ ID NO: 106046 - DNA, 20 bp, Artificial Sequence
  Description of Artificial Sequence: Synthetic oligonucleotide
  Target: ATXN1; (+) strand; PAM type: NRG; PAM sequence: CAG
acttcagaatatttgctgac

SEQ ID NO: 106047 - DNA, 20 bp, Artificial Sequence
  Description of Artificial Sequence: Synthetic oligonucleotide
  Target: ATXN1; (+) strand; PAM type: NRG; PAM sequence: AGG
cttcagaatatttgctgacc

SEQ ID NO: 106048 - DNA, 20 bp, Artificial Sequence
  Description of Artificial Sequence: Synthetic oligonucleotide
  Target: ATXN1; (+) strand; PAM type: NRG; PAM sequence: TGG
atttgctgaccaggttgtcc

SEQ ID NO: 106049 - DNA, 20 bp, Artificial Sequence
  Description of Artificial Sequence: Synthetic oligonucleotide
  Target: ATXN1; (+) strand; PAM type: NRG; PAM sequence: AAG
tggtgtctgatactccactg

SEQ ID NO: 106050 - DNA, 20 bp, Artificial Sequence
  Description of Artificial Sequence: Synthetic oligonucleotide
  Target: ATXN1; (+) strand; PAM type: NRG; PAM sequence: AGG
ggtgtctgatactccactga

SEQ ID NO: 106051 - DNA, 20 bp, Artificial Sequence
  Description of Artificial Sequence: Synthetic oligonucleotide
  Target: ATXN1; (+) strand; PAM type: NRG; PAM sequence: AAG
acaaaattgatcattgattc

SEQ ID NO: 106052 - DNA, 20 bp, Artificial Sequence
  Description of Artificial Sequence: Synthetic oligonucleotide
  Target: ATXN1; (+) strand; PAM type: NRG; PAM sequence: AGG
caaaattgatcattgattca

SEQ ID NO: 106053 - DNA, 20 bp, Artificial Sequence
  Description of Artificial Sequence: Synthetic oligonucleotide
  Target: ATXN1; (+) strand; PAM type: NRG; PAM sequence: AAG
cattgattcaaggttccact

SEQ ID NO: 106054 - DNA, 20 bp, Artificial Sequence
  Description of Artificial Sequence: Synthetic oligonucleotide
  Target: ATXN1; (+) strand; PAM type: NRG; PAM sequence: GAG
ttgattcaaggttccactaa

SEQ ID NO: 106055 - DNA, 20 bp, Artificial Sequence
  Description of Artificial Sequence: Synthetic oligonucleotide
  Target: ATXN1; (+) strand; PAM type: NRG; PAM sequence: AAG
ggttccactaagagtaaata

SEQ ID NO: 106056 - DNA, 20 bp, Artificial Sequence
  Description of Artificial Sequence: Synthetic oligonucleotide
  Target: ATXN1; (+) strand; PAM type: NRG; PAM sequence: TGG
agagtaaataaagtgtgatg

SEQ ID NO: 106057 - DNA, 20 bp, Artificial Sequence
  Description of Artificial Sequence: Synthetic oligonucleotide
  Target: ATXN1; (+) strand; PAM type: NRG; PAM sequence: TGG
aaataaagtgtgatgtggta

SEQ ID NO: 106058 - DNA, 20 bp, Artificial Sequence
  Description of Artificial Sequence: Synthetic oligonucleotide
  Target: ATXN1; (+) strand; PAM type: NRG; PAM sequence: AAG
taaagtgtgatgtggtatgg

SEQ ID NO: 106059 - DNA, 20 bp, Artificial Sequence
  Description of Artificial Sequence: Synthetic oligonucleotide
  Target: ATXN1; (+) strand; PAM type: NRG; PAM sequence: TGG
gtgatgtggtatggaagcca

SEQ ID NO: 106060 - DNA, 20 bp, Artificial Sequence
  Description of Artificial Sequence: Synthetic oligonucleotide
  Target: ATXN1; (+) strand; PAM type: NRG; PAM sequence: AAG
atggaagccatggcataaat

SEQ ID NO: 106061 - DNA, 20 bp, Artificial Sequence
  Description of Artificial Sequence: Synthetic oligonucleotide
  Target: ATXN1; (+) strand; PAM type: NRG; PAM sequence: AAG
agccatggcataaataagaa

SEQ ID NO: 106062 - DNA, 20 bp, Artificial Sequence
  Description of Artificial Sequence: Synthetic oligonucleotide
  Target: ATXN1; (+) strand; PAM type: NRG; PAM sequence: CAG
ttgacatgaattgatctgtt

SEQ ID NO: 106063 - DNA, 20 bp, Artificial Sequence
  Description of Artificial Sequence: Synthetic oligonucleotide
  Target: ATXN1; (+) strand; PAM type: NRG; PAM sequence: AAG
tgttcagcacaatctaacca

SEQ ID NO: 106064 - DNA, 20 bp, Artificial Sequence
  Description of Artificial Sequence: Synthetic oligonucleotide
  Target: ATXN1; (+) strand; PAM type: NRG; PAM sequence: AAG
gcacaatctaaccaaagaac

SEQ ID NO: 106065 - DNA, 20 bp, Artificial Sequence
  Description of Artificial Sequence: Synthetic oligonucleotide
  Target: ATXN1; (+) strand; PAM type: NRG; PAM sequence: AGG
cacaatctaaccaaagaaca

SEQ ID NO: 106066 - DNA, 20 bp, Artificial Sequence
  Description of Artificial Sequence: Synthetic oligonucleotide
  Target: ATXN1; (+) strand; PAM type: NRG; PAM sequence: AAG
tctaaccaaagaacaaggca

SEQ ID NO: 106067 - DNA, 20 bp, Artificial Sequence
  Description of Artificial Sequence: Synthetic oligonucleotide
  Target: ATXN1; (+) strand; PAM type: NRG; PAM sequence: AAG
acaaggcaaagttttccttc

SEQ ID NO: 106068 - DNA, 20 bp, Artificial Sequence
  Description of Artificial Sequence: Synthetic oligonucleotide
  Target: ATXN1; (+) strand; PAM type: NRG; PAM sequence: TAG
gcaaagttttccttcaagca

SEQ ID NO: 106069 - DNA, 20 bp, Artificial Sequence
  Description of Artificial Sequence: Synthetic oligonucleotide
  Target: ATXN1; (+) strand; PAM type: NRG; PAM sequence: GAG
ttttccttcaagcatagaat

SEQ ID NO: 106070 - DNA, 20 bp, Artificial Sequence
  Description of Artificial Sequence: Synthetic oligonucleotide
  Target: ATXN1; (+) strand; PAM type: NRG; PAM sequence: TGG
agcatagaatgagttccctc

SEQ ID NO: 106071 - DNA, 20 bp, Artificial Sequence
  Description of Artificial Sequence: Synthetic oligonucleotide
  Target: ATXN1; (+) strand; PAM type: NRG; PAM sequence: GGG
gcatagaatgagttccctct

SEQ ID NO: 106072 - DNA, 20 bp, Artificial Sequence
  Description of Artificial Sequence: Synthetic oligonucleotide
  Target: ATXN1; (+) strand; PAM type: NRG; PAM sequence: AAG
agttccctctgggatttata

SEQ ID NO: 106073 - DNA, 20 bp, Artificial Sequence
  Description of Artificial Sequence: Synthetic oligonucleotide
  Target: ATXN1; (+) strand; PAM type: NRG; PAM sequence: TGG
tccctctgggatttataaag

SEQ ID NO: 106074 - DNA, 20 bp, Artificial Sequence
  Description of Artificial Sequence: Synthetic oligonucleotide
  Target: ATXN1; (+) strand; PAM type: NRG; PAM sequence: CAG
ctgggatttataaagtggac

SEQ ID NO: 106075 - DNA, 20 bp, Artificial Sequence
  Description of Artificial Sequence: Synthetic oligonucleotide
  Target: ATXN1; (+) strand; PAM type: NRG; PAM sequence: CAG
atttataaagtggaccagta

SEQ ID NO: 106076 - DNA, 20 bp, Artificial Sequence
  Description of Artificial Sequence: Synthetic oligonucleotide
  Target: ATXN1; (+) strand; PAM type: NRG; PAM sequence: GAG
ttataaagtggaccagtaca

SEQ ID NO: 106077 - DNA, 20 bp, Artificial Sequence
  Description of Artificial Sequence: Synthetic oligonucleotide
  Target: ATXN1; (+) strand; PAM type: NRG; PAM sequence: AGG
tataaagtggaccagtacag

SEQ ID NO: 106078 - DNA, 20 bp, Artificial Sequence
  Description of Artificial Sequence: Synthetic oligonucleotide
  Target: ATXN1; (+) strand; PAM type: NRG; PAM sequence: GGG
ataaagtggaccagtacaga

SEQ ID NO: 106079 - DNA, 20 bp, Artificial Sequence
  Description of Artificial Sequence: Synthetic oligonucleotide
  Target: ATXN1; (+) strand; PAM type: NRG; PAM sequence: GGG
taaagtggaccagtacagag

SEQ ID NO: 106080 - DNA, 20 bp, Artificial Sequence
  Description of Artificial Sequence: Synthetic oligonucleotide
  Target: ATXN1; (+) strand; PAM type: NRG; PAM sequence: GGG
aaagtggaccagtacagagg

SEQ ID NO: 106081 - DNA, 20 bp, Artificial Sequence
  Description of Artificial Sequence: Synthetic oligonucleotide
  Target: ATXN1; (+) strand; PAM type: NRG; PAM sequence: TGG
ggaccagtacagagggggca

SEQ ID NO: 106082 - DNA, 20 bp, Artificial Sequence
  Description of Artificial Sequence: Synthetic oligonucleotide
  Target: ATXN1; (+) strand; PAM type: NRG; PAM sequence: TAG
ccacccgtaccgtttaaaac

SEQ ID NO: 106083 - DNA, 20 bp, Artificial Sequence
  Description of Artificial Sequence: Synthetic oligonucleotide
  Target: ATXN1; (+) strand; PAM type: NRG; PAM sequence: TAG
gtttaaaactagttgatttt

SEQ ID NO: 106084 - DNA, 20 bp, Artificial Sequence
  Description of Artificial Sequence: Synthetic oligonucleotide
  Target: ATXN1; (+) strand; PAM type: NRG; PAM sequence: CAG
ttcacctatcttccccctct

SEQ ID NO: 106085 - DNA, 20 bp, Artificial Sequence
  Description of Artificial Sequence: Synthetic oligonucleotide
  Target: ATXN1; (+) strand; PAM type: NRG; PAM sequence: CGG
cccctctcagcaatctatta

SEQ ID NO: 106086 - DNA, 20 bp, Artificial Sequence
  Description of Artificial Sequence: Synthetic oligonucleotide
  Target: ATXN1; (+) strand; PAM type: NRG; PAM sequence: TGG
tctattacggatttgtttgc

SEQ ID NO: 106087 - DNA, 20 bp, Artificial Sequence
  Description of Artificial Sequence: Synthetic oligonucleotide
  Target: ATXN1; (+) strand; PAM type: NRG; PAM sequence: TGG
atttgtttgctggaatgact

SEQ ID NO: 106088 - DNA, 20 bp, Artificial Sequence
  Description of Artificial Sequence: Synthetic oligonucleotide
  Target: ATXN1; (+) strand; PAM type: NRG; PAM sequence: GAG
ttgtttgctggaatgacttg

SEQ ID NO: 106089 - DNA, 20 bp, Artificial Sequence
  Description of Artificial Sequence: Synthetic oligonucleotide
  Target: ATXN1; (+) strand; PAM type: NRG; PAM sequence: TGG
tttgctggaatgacttggag

SEQ ID NO: 106090 - DNA, 20 bp, Artificial Sequence
  Description of Artificial Sequence: Synthetic oligonucleotide
  Target: ATXN1; (+) strand; PAM type: NRG; PAM sequence: CAG
gctggaatgacttggagtgg

SEQ ID NO: 106091 - DNA, 20 bp, Artificial Sequence
  Description of Artificial Sequence: Synthetic oligonucleotide
  Target: ATXN1; (+) strand; PAM type: NRG; PAM sequence: AGG
ctggaatgacttggagtggc

SEQ ID NO: 106092 - DNA, 20 bp, Artificial Sequence
  Description of Artificial Sequence: Synthetic oligonucleotide
  Target: ATXN1; (+) strand; PAM type: NRG; PAM sequence: TGG
gaatgacttggagtggcagg

SEQ ID NO: 106093 - DNA, 20 bp, Artificial Sequence
  Description of Artificial Sequence: Synthetic oligonucleotide
  Target: ATXN1; (+) strand; PAM type: NRG; PAM sequence: GGG
aatgacttggagtggcaggt

SEQ ID NO: 106094 - DNA, 20 bp, Artificial Sequence
  Description of Artificial Sequence: Synthetic oligonucleotide
  Target: ATXN1; (+) strand; PAM type: NRG; PAM sequence: GGG
atgacttggagtggcaggtg

SEQ ID NO: 106095 - DNA, 20 bp, Artificial Sequence
  Description of Artificial Sequence: Synthetic oligonucleotide
  Target: ATXN1; (+) strand; PAM type: NRG; PAM sequence: CAG
cttggagtggcaggtggggt

SEQ ID NO: 106096 - DNA, 20 bp, Artificial Sequence
  Description of Artificial Sequence: Synthetic oligonucleotide
  Target: ATXN1; (+) strand; PAM type: NRG; PAM sequence: AGG
ttggagtggcaggtggggtc

SEQ ID NO: 106097 - DNA, 20 bp, Artificial Sequence
  Description of Artificial Sequence: Synthetic oligonucleotide
  Target: ATXN1; (+) strand; PAM type: NRG; PAM sequence: GAG
ggagtggcaggtggggtcag

SEQ ID NO: 106098 - DNA, 20 bp, Artificial Sequence
  Description of Artificial Sequence: Synthetic oligonucleotide
  Target: ATXN1; (+) strand; PAM type: NRG; PAM sequence: GAG
tggcaggtggggtcaggagt

SEQ ID NO: 106099 - DNA, 20 bp, Artificial Sequence
  Description of Artificial Sequence: Synthetic oligonucleotide
  Target: ATXN1; (+) strand; PAM type: NRG; PAM sequence: TAG
aggtggggtcaggagtgagt

SEQ ID NO: 106100 - DNA, 20 bp, Artificial Sequence
  Description of Artificial Sequence: Synthetic oligonucleotide
  Target: ATXN1; (+) strand; PAM type: NRG; PAM sequence: AAG
ggggtcaggagtgagttagt

SEQ ID NO: 106101 - DNA, 20 bp, Artificial Sequence
  Description of Artificial Sequence: Synthetic oligonucleotide
  Target: ATXN1; (+) strand; PAM type: NRG; PAM sequence: CAG
taagcatttcgtttcatccc

SEQ ID NO: 106102 - DNA, 20 bp, Artificial Sequence
  Description of Artificial Sequence: Synthetic oligonucleotide
  Target: ATXN1; (+) strand; PAM type: NRG; PAM sequence: AAG
atttcgtttcatccccagta

SEQ ID NO: 106103 - DNA, 20 bp, Artificial Sequence
  Description of Artificial Sequence: Synthetic oligonucleotide
  Target: ATXN1; (+) strand; PAM type: NRG; PAM sequence: AGG
tttcgtttcatccccagtaa

SEQ ID NO: 106104 - DNA, 20 bp, Artificial Sequence
  Description of Artificial Sequence: Synthetic oligonucleotide
  Target: ATXN1; (+) strand; PAM type: NRG; PAM sequence: GGG
ttcgtttcatccccagtaaa

SEQ ID NO: 106105 - DNA, 20 bp, Artificial Sequence
  Description of Artificial Sequence: Synthetic oligonucleotide
  Target: ATXN1; (+) strand; PAM type: NRG; PAM sequence: AAG
tttcatccccagtaaagggt

SEQ ID NO: 106106 - DNA, 20 bp, Artificial Sequence
  Description of Artificial Sequence: Synthetic oligonucleotide
  Target: ATXN1; (+) strand; PAM type: NRG; PAM sequence: CAG
aaagggtaagatgattgaat

SEQ ID NO: 106107 - DNA, 20 bp, Artificial Sequence
  Description of Artificial Sequence: Synthetic oligonucleotide
  Target: ATXN1; (+) strand; PAM type: NRG; PAM sequence: CAG
ggtaagatgattgaatcagt

SEQ ID NO: 106108 - DNA, 20 bp, Artificial Sequence
  Description of Artificial Sequence: Synthetic oligonucleotide
  Target: ATXN1; (+) strand; PAM type: NRG; PAM sequence: GAG
attgaatcagtcagtctgct

SEQ ID NO: 106109 - DNA, 20 bp, Artificial Sequence
  Description of Artificial Sequence: Synthetic oligonucleotide
  Target: ATXN1; (+) strand; PAM type: NRG; PAM sequence: TGG
aatcagtcagtctgctgaga

SEQ ID NO: 106110 - DNA, 20 bp, Artificial Sequence
  Description of Artificial Sequence: Synthetic oligonucleotide
  Target: ATXN1; (+) strand; PAM type: NRG; PAM sequence: GGG
atcagtcagtctgctgagat

SEQ ID NO: 106111 - DNA, 20 bp, Artificial Sequence
  Description of Artificial Sequence: Synthetic oligonucleotide
  Target: ATXN1; (+) strand; PAM type: NRG; PAM sequence: GGG
tcagtcagtctgctgagatg

SEQ ID NO: 106112 - DNA, 20 bp, Artificial Sequence
  Description of Artificial Sequence: Synthetic oligonucleotide
  Target: ATXN1; (+) strand; PAM type: NRG; PAM sequence: CAG
tcagtctgctgagatggggc

SEQ ID NO: 106113 - DNA, 20 bp, Artificial Sequence
  Description of Artificial Sequence: Synthetic oligonucleotide
  Target: ATXN1; (+) strand; PAM type: NRG; PAM sequence: GAG
agtctgctgagatggggcca

SEQ ID NO: 106114 - DNA, 20 bp, Artificial Sequence
  Description of Artificial Sequence: Synthetic oligonucleotide
  Target: ATXN1; (+) strand; PAM type: NRG; PAM sequence: TGG
cagagttacctgataaatat

SEQ ID NO: 106115 - DNA, 20 bp, Artificial Sequence
  Description of Artificial Sequence: Synthetic oligonucleotide
  Target: ATXN1; (+) strand; PAM type: NRG; PAM sequence: GGG
agagttacctgataaatatt

SEQ ID NO: 106116 - DNA, 20 bp, Artificial Sequence
  Description of Artificial Sequence: Synthetic oligonucleotide
  Target: ATXN1; (+) strand; PAM type: NRG; PAM sequence: GGG
gagttacctgataaatattg

SEQ ID NO: 106117 - DNA, 20 bp, Artificial Sequence
  Description of Artificial Sequence: Synthetic oligonucleotide
  Target: ATXN1; (+) strand; PAM type: NRG; PAM sequence: TAG
aaatattggggccatgccac

SEQ ID NO: 106118 - DNA, 20 bp, Artificial Sequence
  Description of Artificial Sequence: Synthetic oligonucleotide
  Target: ATXN1; (+) strand; PAM type: NRG; PAM sequence: AGG
aatattggggccatgccact

SEQ ID NO: 106119 - DNA, 20 bp, Artificial Sequence
  Description of Artificial Sequence: Synthetic oligonucleotide
  Target: ATXN1; (+) strand; PAM type: NRG; PAM sequence: AAG
ctaggtgaaatcttttcgtt

SEQ ID NO: 106120 - DNA, 20 bp, Artificial Sequence
  Description of Artificial Sequence: Synthetic oligonucleotide
  Target: ATXN1; (+) strand; PAM type: NRG; PAM sequence: GAG
aatcccaacctaaaattgct

SEQ ID NO: 106121 - DNA, 20 bp, Artificial Sequence
  Description of Artificial Sequence: Synthetic oligonucleotide
  Target: ATXN1; (+) strand; PAM type: NRG; PAM sequence: CAG
ccaacctaaaattgctgagt

SEQ ID NO: 106122 - DNA, 20 bp, Artificial Sequence
  Description of Artificial Sequence: Synthetic oligonucleotide
  Target: ATXN1; (+) strand; PAM type: NRG; PAM sequence: TGG
acctaaaattgctgagtcag

SEQ ID NO: 106123 - DNA, 20 bp, Artificial Sequence
  Description of Artificial Sequence: Synthetic oligonucleotide
  Target: ATXN1; (+) strand; PAM type: NRG; PAM sequence: GGG
cctaaaattgctgagtcagt

SEQ ID NO: 106124 - DNA, 20 bp, Artificial Sequence
  Description of Artificial Sequence: Synthetic oligonucleotide
  Target: ATXN1; (+) strand; PAM type: NRG; PAM sequence: CAG
ctgagtcagtgggaatttct

SEQ ID NO: 106125 - DNA, 20 bp, Artificial Sequence
  Description of Artificial Sequence: Synthetic oligonucleotide
  Target: ATXN1; (+) strand; PAM type: NRG; PAM sequence: AGG
tgagtcagtgggaatttctc

SEQ ID NO: 106126 - DNA, 20 bp, Artificial Sequence
  Description of Artificial Sequence: Synthetic oligonucleotide
  Target: ATXN1; (+) strand; PAM type: NRG; PAM sequence: GGG
gagtcagtgggaatttctca

SEQ ID NO: 106127 - DNA, 20 bp, Artificial Sequence
  Description of Artificial Sequence: Synthetic oligonucleotide
  Target: ATXN1; (+) strand; PAM type: NRG; PAM sequence: TGG
tcagggaatccatgttccgc

SEQ ID NO: 106128 - DNA, 20 bp, Artificial Sequence
  Description of Artificial Sequence: Synthetic oligonucleotide
  Target: ATXN1; (+) strand; PAM type: NRG; PAM sequence: TAG
aatccatgttccgctggctc

SEQ ID NO: 106129 - DNA, 20 bp, Artificial Sequence
  Description of Artificial Sequence: Synthetic oligonucleotide
  Target: ATXN1; (+) strand; PAM type: NRG; PAM sequence: GAG
ctagaaatgattttgattat

SEQ ID NO: 106130 - DNA, 20 bp, Artificial Sequence
  Description of Artificial Sequence: Synthetic oligonucleotide
  Target: ATXN1; (+) strand; PAM type: NRG; PAM sequence: AAG
aatgattttgattatgagac

SEQ ID NO: 106131 - DNA, 20 bp, Artificial Sequence
  Description of Artificial Sequence: Synthetic oligonucleotide
  Target: ATXN1; (+) strand; PAM type: NRG; PAM sequence: AGG
atgattttgattatgagaca

SEQ ID NO: 106132 - DNA, 20 bp, Artificial Sequence
  Description of Artificial Sequence: Synthetic oligonucleotide
  Target: ATXN1; (+) strand; PAM type: NRG; PAM sequence: TGG
gattatgagacaaggtattt

SEQ ID NO: 106133 - DNA, 20 bp, Artificial Sequence
  Description of Artificial Sequence: Synthetic oligonucleotide
  Target: ATXN1; (+) strand; PAM type: NRG; PAM sequence: CAG
tatgagacaaggtattttgg

SEQ ID NO: 106134 - DNA, 20 bp, Artificial Sequence
  Description of Artificial Sequence: Synthetic oligonucleotide
  Target: ATXN1; (+) strand; PAM type: NRG; PAM sequence: CAG
gagacaaggtattttggcag

SEQ ID NO: 106135 - DNA, 20 bp, Artificial Sequence
  Description of Artificial Sequence: Synthetic oligonucleotide
  Target: ATXN1; (+) strand; PAM type: NRG; PAM sequence: AGG
agacaaggtattttggcagc

SEQ ID NO: 106136 - DNA, 20 bp, Artificial Sequence
  Description of Artificial Sequence: Synthetic oligonucleotide
  Target: ATXN1; (+) strand; PAM type: NRG; PAM sequence: TGG
ggtattttggcagcaggtgc

SEQ ID NO: 106137 - DNA, 20 bp, Artificial Sequence
  Description of Artificial Sequence: Synthetic oligonucleotide
  Target: ATXN1; (+) strand; PAM type: NRG; PAM sequence: CAG
tggcttttatttaccatgtt

SEQ ID NO: 106138 - DNA, 20 bp, Artificial Sequence
  Description of Artificial Sequence: Synthetic oligonucleotide
  Target: ATXN1; (+) strand; PAM type: NRG; PAM sequence: AAG
ttaccatgttcagaacttga

SEQ ID NO: 106139 - DNA, 20 bp, Artificial Sequence
  Description of Artificial Sequence: Synthetic oligonucleotide
  Target: ATXN1; (+) strand; PAM type: NRG; PAM sequence: CAG
gttcagaacttgaaagtgtc

SEQ ID NO: 106140 - DNA, 20 bp, Artificial Sequence
  Description of Artificial Sequence: Synthetic oligonucleotide
  Target: ATXN1; (+) strand; PAM type: NRG; PAM sequence: AAG
ttgaaagtgtccagttcatt

SEQ ID NO: 106141 - DNA, 20 bp, Artificial Sequence
  Description of Artificial Sequence: Synthetic oligonucleotide
  Target: ATXN1; (+) strand; PAM type: NRG; PAM sequence: AAG
gtgtccagttcattaagttc

SEQ ID NO: 106142 - DNA, 20 bp, Artificial Sequence
  Description of Artificial Sequence: Synthetic oligonucleotide
  Target: ATXN1; (+) strand; PAM type: NRG; PAM sequence: GAG
gtccagttcattaagttcaa

SEQ ID NO: 106143 - DNA, 20 bp, Artificial Sequence
  Description of Artificial Sequence: Synthetic oligonucleotide
  Target: ATXN1; (+) strand; PAM type: NRG; PAM sequence: TGG
agttcattaagttcaagagc

SEQ ID NO: 106144 - DNA, 20 bp, Artificial Sequence
  Description of Artificial Sequence: Synthetic oligonucleotide
  Target: ATXN1; (+) strand; PAM type: NRG; PAM sequence: GAG
ttcattaagttcaagagctg

SEQ ID NO: 106145 - DNA, 20 bp, Artificial Sequence
  Description of Artificial Sequence: Synthetic oligonucleotide
  Target: ATXN1; (+) strand; PAM type: NRG; PAM sequence: AAG
tcaagagctggagtcgctta

SEQ ID NO: 106146 - DNA, 20 bp, Artificial Sequence
  Description of Artificial Sequence: Synthetic oligonucleotide
  Target: ATXN1; (+) strand; PAM type: NRG; PAM sequence: AGG
caagagctggagtcgcttaa

SEQ ID NO: 106147 - DNA, 20 bp, Artificial Sequence
  Description of Artificial Sequence: Synthetic oligonucleotide
  Target: ATXN1; (+) strand; PAM type: NRG; PAM sequence: TAG
gagctggagtcgcttaaagg

SEQ ID NO: 106148 - DNA, 20 bp, Artificial Sequence
  Description of Artificial Sequence: Synthetic oligonucleotide
  Target: ATXN1; (+) strand; PAM type: NRG; PAM sequence: AAG
tagaccctgaatgatgcctt

SEQ ID NO: 106149 - DNA, 20 bp, Artificial Sequence
  Description of Artificial Sequence: Synthetic oligonucleotide
  Target: ATXN1; (+) strand; PAM type: NRG; PAM sequence: AGG
agaccctgaatgatgcctta

SEQ ID NO: 106150 - DNA, 20 bp, Artificial Sequence
  Description of Artificial Sequence: Synthetic oligonucleotide
  Target: ATXN1; (+) strand; PAM type: NRG; PAM sequence: TGG
attttcattacactaaacca

SEQ ID NO: 106151 - DNA, 20 bp, Artificial Sequence
  Description of Artificial Sequence: Synthetic oligonucleotide
  Target: ATXN1; (+) strand; PAM type: NRG; PAM sequence: TAG
ttacactaaaccatggcact

SEQ ID NO: 106152 - DNA, 20 bp, Artificial Sequence
  Description of Artificial Sequence: Synthetic oligonucleotide
  Target: ATXN1; (+) strand; PAM type: NRG; PAM sequence: AGG
tacactaaaccatggcactt

SEQ ID NO: 106153 - DNA, 20 bp, Artificial Sequence
  Description of Artificial Sequence: Synthetic oligonucleotide
  Target: ATXN1; (+) strand; PAM type: NRG; PAM sequence: CAG
actaaaccatggcacttagg

SEQ ID NO: 106154 - DNA, 20 bp, Artificial Sequence
  Description of Artificial Sequence: Synthetic oligonucleotide
  Target: ATXN1; (+) strand; PAM type: NRG; PAM sequence: CAG
aaccatggcacttaggcagc

SEQ ID NO: 106155 - DNA, 20 bp, Artificial Sequence
  Description of Artificial Sequence: Synthetic oligonucleotide
  Target: ATXN1; (+) strand; PAM type: NRG; PAM sequence: AAG
tggcacttaggcagccagta

SEQ ID NO: 106156 - DNA, 20 bp, Artificial Sequence
  Description of Artificial Sequence: Synthetic oligonucleotide
  Target: ATXN1; (+) strand; PAM type: NRG; PAM sequence: TGG
acttaggcagccagtaaagc

SEQ ID NO: 106157 - DNA, 20 bp, Artificial Sequence
  Description of Artificial Sequence: Synthetic oligonucleotide
  Target: ATXN1; (+) strand; PAM type: NRG; PAM sequence: GAG
ttaggcagccagtaaagctg

SEQ ID NO: 106158 - DNA, 20 bp, Artificial Sequence
  Description of Artificial Sequence: Synthetic oligonucleotide
  Target: ATXN1; (+) strand; PAM type: NRG; PAM sequence: CAG
gcagccagtaaagctggagt

SEQ ID NO: 106159 - DNA, 20 bp, Artificial Sequence
  Description of Artificial Sequence: Synthetic oligonucleotide
  Target: ATXN1; (+) strand; PAM type: NRG; PAM sequence: CAG
ctggagtcagaactctgatt

SEQ ID NO: 106160 - DNA, 20 bp, Artificial Sequence
  Description of Artificial Sequence: Synthetic oligonucleotide
  Target: ATXN1; (+) strand; PAM type: NRG; PAM sequence: GAG
ggagtcagaactctgattca

SEQ ID NO: 106161 - DNA, 20 bp, Artificial Sequence
  Description of Artificial Sequence: Synthetic oligonucleotide
  Target: ATXN1; (+) strand; PAM type: NRG; PAM sequence: CAG
gattcagagcacctcattta

SEQ ID NO: 106162 - DNA, 20 bp, Artificial Sequence
  Description of Artificial Sequence: Synthetic oligonucleotide
  Target: ATXN1; (+) strand; PAM type: NRG; PAM sequence: AAG
tgaattgcctgaatttgact

SEQ ID NO: 106163 - DNA, 20 bp, Artificial Sequence
  Description of Artificial Sequence: Synthetic oligonucleotide
  Target: ATXN1; (+) strand; PAM type: NRG; PAM sequence: TAG
tgcctgaatttgactaagta

SEQ ID NO: 106164 - DNA, 20 bp, Artificial Sequence
  Description of Artificial Sequence: Synthetic oligonucleotide
  Target: ATXN1; (+) strand; PAM type: NRG; PAM sequence: AGG
gcctgaatttgactaagtat

SEQ ID NO: 106165 - DNA, 20 bp, Artificial Sequence
  Description of Artificial Sequence: Synthetic oligonucleotide
  Target: ATXN1; (+) strand; PAM type: NRG; PAM sequence: GGG
cctgaatttgactaagtata

SEQ ID NO: 106166 - DNA, 20 bp, Artificial Sequence
  Description of Artificial Sequence: Synthetic oligonucleotide
  Target: ATXN1; (+) strand; PAM type: NRG; PAM sequence: TGG
atagggcaccattttaaaaa

SEQ ID NO: 106167 - DNA, 20 bp, Artificial Sequence
  Description of Artificial Sequence: Synthetic oligonucleotide
  Target: ATXN1; (+) strand; PAM type: NRG; PAM sequence: GAG
tttaaaaatggcttcatgct

SEQ ID NO: 106168 - DNA, 20 bp, Artificial Sequence
  Description of Artificial Sequence: Synthetic oligonucleotide
  Target: ATXN1; (+) strand; PAM type: NRG; PAM sequence: AGG
ttaaaaatggcttcatgctg

SEQ ID NO: 106169 - DNA, 20 bp, Artificial Sequence
  Description of Artificial Sequence: Synthetic oligonucleotide
  Target: ATXN1; (+) strand; PAM type: NRG; PAM sequence: TAG
atggcttcatgctgaggttc

SEQ ID NO: 106170 - DNA, 20 bp, Artificial Sequence
  Description of Artificial Sequence: Synthetic oligonucleotide
  Target: ATXN1; (+) strand; PAM type: NRG; PAM sequence: TGG
ggttctagattttttttttt

SEQ ID NO: 106171 - DNA, 20 bp, Artificial Sequence
  Description of Artificial Sequence: Synthetic oligonucleotide
  Target: ATXN1; (+) strand; PAM type: NRG; PAM sequence: GAG
ttctagattttttttttttg

SEQ ID NO: 106172 - DNA, 20 bp, Artificial Sequence
  Description of Artificial Sequence: Synthetic oligonucleotide
  Target: ATXN1; (+) strand; PAM type: NRG; PAM sequence: TGG
agattttttttttttggaga

SEQ ID NO: 106173 - DNA, 20 bp, Artificial Sequence
  Description of Artificial Sequence: Synthetic oligonucleotide
  Target: ATXN1; (+) strand; PAM type: NRG; PAM sequence: GAG
attttttttttttggagatg

SEQ ID NO: 106174 - DNA, 20 bp, Artificial Sequence
  Description of Artificial Sequence: Synthetic oligonucleotide
  Target: ATXN1; (+) strand; PAM type: NRG; PAM sequence: AGG
ttttttttttttggagatgg

SEQ ID NO: 106175 - DNA, 20 bp, Artificial Sequence
  Description of Artificial Sequence: Synthetic oligonucleotide
  Target: ATXN1; (+) strand; PAM type: NRG; PAM sequence: CAG
atggaggctcgttctgtcgc

SEQ ID NO: 106176 - DNA, 20 bp, Artificial Sequence
  Description of Artificial Sequence: Synthetic oligonucleotide
  Target: ATXN1; (+) strand; PAM type: NRG; PAM sequence: AGG
tggaggctcgttctgtcgcc

SEQ ID NO: 106177 - DNA, 20 bp, Artificial Sequence
  Description of Artificial Sequence: Synthetic oligonucleotide
  Target: ATXN1; (+) strand; PAM type: NRG; PAM sequence: TGG
ggctcgttctgtcgccaggc

SEQ ID NO: 106178 - DNA, 20 bp, Artificial Sequence
  Description of Artificial Sequence: Synthetic oligonucleotide
  Target: ATXN1; (+) strand; PAM type: NRG; PAM sequence: GAG
ctcgttctgtcgccaggctg

SEQ ID NO: 106179 - DNA, 20 bp, Artificial Sequence
  Description of Artificial Sequence: Synthetic oligonucleotide
  Target: ATXN1; (+) strand; PAM type: NRG; PAM sequence: CAG
tctgtcgccaggctggagtg

SEQ ID NO: 106180 - DNA, 20 bp, Artificial Sequence
  Description of Artificial Sequence: Synthetic oligonucleotide
  Target: ATXN1; (+) strand; PAM type: NRG; PAM sequence: TGG
gtcgccaggctggagtgcag

SEQ ID NO: 106181 - DNA, 20 bp, Artificial Sequence
  Description of Artificial Sequence: Synthetic oligonucleotide
  Target: ATXN1; (+) strand; PAM type: NRG; PAM sequence: CAG
ggagtgcagtggcgcgatct

SEQ ID NO: 106182 - DNA, 20 bp, Artificial Sequence
  Description of Artificial Sequence: Synthetic oligonucleotide
  Target: ATXN1; (+) strand; PAM type: NRG; PAM sequence: AAG
gcgcgatctcagctcactgc

SEQ ID NO: 106183 - DNA, 20 bp, Artificial Sequence
  Description of Artificial Sequence: Synthetic oligonucleotide
  Target: ATXN1; (+) strand; PAM type: NRG; PAM sequence: CAG
ttcacaccattctcctgcct

SEQ ID NO: 106184 - DNA, 20 bp, Artificial Sequence
  Description of Artificial Sequence: Synthetic oligonucleotide
  Target: ATXN1; (+) strand; PAM type: NRG; PAM sequence: GAG
ttctcctgcctcagcctccc

SEQ ID NO: 106185 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccgagtatc

SEQ ID NO: 106186 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccgagtatct

SEQ ID NO: 106187 - DNA, 20 bp, Artificial Sequence
  Description of Artificial Sequence: Synthetic oligonucleotide
  Target: ATXN1; (+) strand; PAM type: NRG; PAM sequence: CAG
ctcccgagtatctgggacta

SEQ ID NO: 106188 - DNA, 20 bp, Artificial Sequence
  Description of Artificial Sequence: Synthetic oligonucleotide
  Target: ATXN1; (+) strand; PAM type: NRG; PAM sequence: AGG
tcccgagtatctgggactac

SEQ ID NO: 106189 - DNA, 20 bp, Artificial Sequence
  Description of Artificial Sequence: Synthetic oligonucleotide
  Target: ATXN1; (+) strand; PAM type: NRG; PAM sequence: TGG
caggcacccgccaccacgcc

SEQ ID NO: 106190 - DNA, 20 bp, Artificial Sequence
  Description of Artificial Sequence: Synthetic oligonucleotide
  Target: ATXN1; (+) strand; PAM type: NRG; PAM sequence: TAG
tggctaattttttgtatttt

SEQ ID NO: 106191 - DNA, 20 bp, Artificial Sequence
  Description of Artificial Sequence: Synthetic oligonucleotide
  Target: ATXN1; (+) strand; PAM type: NRG; PAM sequence: TAG
ctaattttttgtatttttag

SEQ ID NO: 106192 - DNA, 20 bp, Artificial Sequence
  Description of Artificial Sequence: Synthetic oligonucleotide
  Target: ATXN1; (+) strand; PAM type: NRG; PAM sequence: GAG
aattttttgtatttttagta

SEQ ID NO: 106193 - DNA, 20 bp, Artificial Sequence
  Description of Artificial Sequence: Synthetic oligonucleotide
  Target: ATXN1; (+) strand; PAM type: NRG; PAM sequence: TAG
ttttgtatttttagtagaga

SEQ ID NO: 106194 - DNA, 20 bp, Artificial Sequence
  Description of Artificial Sequence: Synthetic oligonucleotide
  Target: ATXN1; (+) strand; PAM type: NRG; PAM sequence: AGG
tttgtatttttagtagagat

SEQ ID NO: 106195 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagata

SEQ ID NO: 106196 - DNA, 20 bp, Artificial Sequence
  Description of Artificial Sequence: Synthetic oligonucleotide
  Target: ATXN1; (+) strand; PAM type: NRG; PAM sequence: TAG
gagatagggtttcactgtgt

SEQ ID NO: 106197 - DNA, 20 bp, Artificial Sequence
  Description of Artificial Sequence: Synthetic oligonucleotide
  Target: ATXN1; (+) strand; PAM type: NRG; PAM sequence: CAG
tagggtttcactgtgttagc

SEQ ID NO: 106198 - DNA, 20 bp, Artificial Sequence
  Description of Artificial Sequence: Synthetic oligonucleotide
  Target: ATXN1; (+) strand; PAM type: NRG; PAM sequence: AGG
agggtttcactgtgttagcc

SEQ ID NO: 106199 - DNA, 20 bp, Artificial Sequence
  Description of Artificial Sequence: Synthetic oligonucleotide
  Target: ATXN1; (+) strand; PAM type: NRG; PAM sequence: TGG
tttcactgtgttagccagga

SEQ ID NO: 106200 - DNA, 20 bp, Artificial Sequence
  Description of Artificial Sequence: Synthetic oligonucleotide
  Target: ATXN1; (+) strand; PAM type: NRG; PAM sequence: CAG
acctcgtgatctgcccgcct

SEQ ID NO: 106201 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaatgtgc

SEQ ID NO: 106202 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaatgtgct

SEQ ID NO: 106203 - DNA, 20 bp, Artificial Sequence
  Description of Artificial Sequence: Synthetic oligonucleotide
  Target: ATXN1; (+) strand; PAM type: NRG; PAM sequence: CAG
ctcccaatgtgctgggatta

SEQ ID NO: 106204 - DNA, 20 bp, Artificial Sequence
  Description of Artificial Sequence: Synthetic oligonucleotide
  Target: ATXN1; (+) strand; PAM type: NRG; PAM sequence: AGG
tcccaatgtgctgggattac

SEQ ID NO: 106205 - DNA, 20 bp, Artificial Sequence
  Description of Artificial Sequence: Synthetic oligonucleotide
  Target: ATXN1; (+) strand; PAM type: NRG; PAM sequence: GAG
tgtgctgggattacaggcat

SEQ ID NO: 106206 - DNA, 20 bp, Artificial Sequence
  Description of Artificial Sequence: Synthetic oligonucleotide
  Target: ATXN1; (+) strand; PAM type: NRG; PAM sequence: CAG
caggcatgagccaccgcacc

SEQ ID NO: 106207 - DNA, 20 bp, Artificial Sequence
  Description of Artificial Sequence: Synthetic oligonucleotide
  Target: ATXN1; (+) strand; PAM type: NRG; PAM sequence: CAG
catgagccaccgcacccagc

SEQ ID NO: 106208 - DNA, 20 bp, Artificial Sequence
  Description of Artificial Sequence: Synthetic oligonucleotide
  Target: ATXN1; (+) strand; PAM type: NRG; PAM sequence: TAG
ccaccgcacccagccagttc

SEQ ID NO: 106209 - DNA, 20 bp, Artificial Sequence
  Description of Artificial Sequence: Synthetic oligonucleotide
  Target: ATXN1; (+) strand; PAM type: NRG; PAM sequence: GAG
cagccagttctagatatttt

SEQ ID NO: 106210 - DNA, 20 bp, Artificial Sequence
  Description of Artificial Sequence: Synthetic oligonucleotide
  Target: ATXN1; (+) strand; PAM type: NRG; PAM sequence: AGG
agccagttctagatattttg

SEQ ID NO: 106211 - DNA, 20 bp, Artificial Sequence
  Description of Artificial Sequence: Synthetic oligonucleotide
  Target: ATXN1; (+) strand; PAM type: NRG; PAM sequence: TGG
cagttctagatattttgagg

SEQ ID NO: 106212 - DNA, 20 bp, Artificial Sequence
  Description of Artificial Sequence: Synthetic oligonucleotide
  Target: ATXN1; (+) strand; PAM type: NRG; PAM sequence: AAG
tctagatattttgaggtggt

SEQ ID NO: 106213 - DNA, 20 bp, Artificial Sequence
  Description of Artificial Sequence: Synthetic oligonucleotide
  Target: ATXN1; (+) strand; PAM type: NRG; PAM sequence: AAG
tattttgaggtggtaagaat

SEQ ID NO: 106214 - DNA, 20 bp, Artificial Sequence
  Description of Artificial Sequence: Synthetic oligonucleotide
  Target: ATXN1; (+) strand; PAM type: NRG; PAM sequence: AGG
attttgaggtggtaagaata

SEQ ID NO: 106215 - DNA, 20 bp, Artificial Sequence
  Description of Artificial Sequence: Synthetic oligonucleotide
  Target: ATXN1; (+) strand; PAM type: NRG; PAM sequence: TGG
gaggtggtaagaataaggta

SEQ ID NO: 106216 - DNA, 20 bp, Artificial Sequence
  Description of Artificial Sequence: Synthetic oligonucleotide
  Target: ATXN1; (+) strand; PAM type: NRG; PAM sequence: AAG
gtatggttcccctactgctc

SEQ ID NO: 106217 - DNA, 20 bp, Artificial Sequence
  Description of Artificial Sequence: Synthetic oligonucleotide
  Target: ATXN1; (+) strand; PAM type: NRG; PAM sequence: AGG
tatggttcccctactgctca

SEQ ID NO: 106218 - DNA, 20 bp, Artificial Sequence
  Description of Artificial Sequence: Synthetic oligonucleotide
  Target: ATXN1; (+) strand; PAM type: NRG; PAM sequence: CAG
gatacttgtttctcatgtgc

SEQ ID NO: 106219 - DNA, 20 bp, Artificial Sequence
  Description of Artificial Sequence: Synthetic oligonucleotide
  Target: ATXN1; (+) strand; PAM type: NRG; PAM sequence: AGG
atacttgtttctcatgtgcc

SEQ ID NO: 106220 - DNA, 20 bp, Artificial Sequence
  Description of Artificial Sequence: Synthetic oligonucleotide
  Target: ATXN1; (+) strand; PAM type: NRG; PAM sequence: GGG
tacttgtttctcatgtgcca

SEQ ID NO: 106221 - DNA, 20 bp, Artificial Sequence
  Description of Artificial Sequence: Synthetic oligonucleotide
  Target: ATXN1; (+) strand; PAM type: NRG; PAM sequence: CAG
tttctcatgtgccagggacc

SEQ ID NO: 106222 - DNA, 20 bp, Artificial Sequence
  Description of Artificial Sequence: Synthetic oligonucleotide
  Target: ATXN1; (+) strand; PAM type: NRG; PAM sequence: AGG
ttctcatgtgccagggaccc

SEQ ID NO: 106223 - DNA, 20 bp, Artificial Sequence
  Description of Artificial Sequence: Synthetic oligonucleotide
  Target: ATXN1; (+) strand; PAM type: NRG; PAM sequence: GAG
gtgccagggacccaggcatt

SEQ ID NO: 106224 - DNA, 20 bp, Artificial Sequence
  Description of Artificial Sequence: Synthetic oligonucleotide
  Target: ATXN1; (+) strand; PAM type: NRG; PAM sequence: TAG
gacccaggcattgagcccaa

SEQ ID NO: 106225 - DNA, 20 bp, Artificial Sequence
  Description of Artificial Sequence: Synthetic oligonucleotide
  Target: ATXN1; (+) strand; PAM type: NRG; PAM sequence: AAG
caggcattgagcccaataga

SEQ ID NO: 106226 - DNA, 20 bp, Artificial Sequence
  Description of Artificial Sequence: Synthetic oligonucleotide
  Target: ATXN1; (+) strand; PAM type: NRG; PAM sequence: TAG
ttgagcccaatagaaagcca

SEQ ID NO: 106227 - DNA, 20 bp, Artificial Sequence
  Description of Artificial Sequence: Synthetic oligonucleotide
  Target: ATXN1; (+) strand; PAM type: NRG; PAM sequence: AAG
caatagaaagccatagaaat

SEQ ID NO: 106228 - DNA, 20 bp, Artificial Sequence
  Description of Artificial Sequence: Synthetic oligonucleotide
  Target: ATXN1; (+) strand; PAM type: NRG; PAM sequence: TGG
gaaagccatagaaataagcc

SEQ ID NO: 106229 - DNA, 20 bp, Artificial Sequence
  Description of Artificial Sequence: Synthetic oligonucleotide
  Target: ATXN1; (+) strand; PAM type: NRG; PAM sequence: CAG
gatgctattcatgaatgtca

SEQ ID NO: 106230 - DNA, 20 bp, Artificial Sequence
  Description of Artificial Sequence: Synthetic oligonucleotide
  Target: ATXN1; (+) strand; PAM type: NRG; PAM sequence: CAG
ccccattttattaaactgtt

SEQ ID NO: 106231 - DNA, 20 bp, Artificial Sequence
  Description of Artificial Sequence: Synthetic oligonucleotide
  Target: ATXN1; (+) strand; PAM type: NRG; PAM sequence: AGG
cccattttattaaactgttc

SEQ ID NO: 106232 - DNA, 20 bp, Artificial Sequence
  Description of Artificial Sequence: Synthetic oligonucleotide
  Target: ATXN1; (+) strand; PAM type: NRG; PAM sequence: GGG
ccattttattaaactgttca

SEQ ID NO: 106233 - DNA, 20 bp, Artificial Sequence
  Description of Artificial Sequence: Synthetic oligonucleotide
  Target: ATXN1; (+) strand; PAM type: NRG; PAM sequence: CAG
tgttcagggatccactcgtt

SEQ ID NO: 106234 - DNA, 20 bp, Artificial Sequence
  Description of Artificial Sequence: Synthetic oligonucleotide
  Target: ATXN1; (+) strand; PAM type: NRG; PAM sequence: CAG
attattcaacatttacgtgc

SEQ ID NO: 106235 - DNA, 20 bp, Artificial Sequence
  Description of Artificial Sequence: Synthetic oligonucleotide
  Target: ATXN1; (+) strand; PAM type: NRG; PAM sequence: AGG
ttattcaacatttacgtgcc

SEQ ID NO: 106236 - DNA, 20 bp, Artificial Sequence
  Description of Artificial Sequence: Synthetic oligonucleotide
  Target: ATXN1; (+) strand; PAM type: NRG; PAM sequence: TGG
tttacgtgccaggcacatca

SEQ ID NO: 106237 - DNA, 20 bp, Artificial Sequence
  Description of Artificial Sequence: Synthetic oligonucleotide
  Target: ATXN1; (+) strand; PAM type: NRG; PAM sequence: TGG
acgtgccaggcacatcatgg

SEQ ID NO: 106238 - DNA, 20 bp, Artificial Sequence
  Description of Artificial Sequence: Synthetic oligonucleotide
  Target: ATXN1; (+) strand; PAM type: NRG; PAM sequence: TGG
tgccaggcacatcatggtgg

SEQ ID NO: 106239 - DNA, 20 bp, Artificial Sequence
  Description of Artificial Sequence: Synthetic oligonucleotide
  Target: ATXN1; (+) strand; PAM type: NRG; PAM sequence: GGG
gccaggcacatcatggtggt

SEQ ID NO: 106240 - DNA, 20 bp, Artificial Sequence
  Description of Artificial Sequence: Synthetic oligonucleotide
  Target: ATXN1; (+) strand; PAM type: NRG; PAM sequence: AAG
catcatggtggtgggatatg

SEQ ID NO: 106241 - DNA, 20 bp, Artificial Sequence
  Description of Artificial Sequence: Synthetic oligonucleotide
  Target: ATXN1; (+) strand; PAM type: NRG; PAM sequence: TGG
atatgaagtaaaatgtgact

SEQ ID NO: 106242 - DNA, 20 bp, Artificial Sequence
  Description of Artificial Sequence: Synthetic oligonucleotide
  Target: ATXN1; (+) strand; PAM type: NRG; PAM sequence: AAG
cttggtgccttgtctccttc

SEQ ID NO: 106243 - DNA, 20 bp, Artificial Sequence
  Description of Artificial Sequence: Synthetic oligonucleotide
  Target: ATXN1; (+) strand; PAM type: NRG; PAM sequence: AGG
ttggtgccttgtctccttca

SEQ ID NO: 106244 - DNA, 20 bp, Artificial Sequence
  Description of Artificial Sequence: Synthetic oligonucleotide
  Target: ATXN1; (+) strand; PAM type: NRG; PAM sequence: GAG
ggtgccttgtctccttcaag

SEQ ID NO: 106245 - DNA, 20 bp, Artificial Sequence
  Description of Artificial Sequence: Synthetic oligonucleotide
  Target: ATXN1; (+) strand; PAM type: NRG; PAM sequence: CAG
tgtctccttcaaggagcttc

SEQ ID NO: 106246 - DNA, 20 bp, Artificial Sequence
  Description of Artificial Sequence: Synthetic oligonucleotide
  Target: ATXN1; (+) strand; PAM type: NRG; PAM sequence: AAG
tcaaggagcttccagtccac

SEQ ID NO: 106247 - DNA, 20 bp, Artificial Sequence
  Description of Artificial Sequence: Synthetic oligonucleotide
  Target: ATXN1; (+) strand; PAM type: NRG; PAM sequence: AGG
caaggagcttccagtccaca

SEQ ID NO: 106248 - DNA, 20 bp, Artificial Sequence
  Description of Artificial Sequence: Synthetic oligonucleotide
  Target: ATXN1; (+) strand; PAM type: NRG; PAM sequence: GGG
aaggagcttccagtccacaa

SEQ ID NO: 106249 - DNA, 20 bp, Artificial Sequence
  Description of Artificial Sequence: Synthetic oligonucleotide
  Target: ATXN1; (+) strand; PAM type: NRG; PAM sequence: GGG
aggagcttccagtccacaag

SEQ ID NO: 106250 - DNA, 20 bp, Artificial Sequence
  Description of Artificial Sequence: Synthetic oligonucleotide
  Target: ATXN1; (+) strand; PAM type: NRG; PAM sequence: CAG
tccagtccacaaggggctaa

SEQ ID NO: 106251 - DNA, 20 bp, Artificial Sequence
  Description of Artificial Sequence: Synthetic oligonucleotide
  Target: ATXN1; (+) strand; PAM type: NRG; PAM sequence: AGG
ccagtccacaaggggctaac

SEQ ID NO: 106252 - DNA, 20 bp, Artificial Sequence
  Description of Artificial Sequence: Synthetic oligonucleotide
  Target: ATXN1; (+) strand; PAM type: NRG; PAM sequence: GGG
cagtccacaaggggctaaca

SEQ ID NO: 106253 - DNA, 20 bp, Artificial Sequence
  Description of Artificial Sequence: Synthetic oligonucleotide
  Target: ATXN1; (+) strand; PAM type: NRG; PAM sequence: GAG
caaggggctaacagggaaat

SEQ ID NO: 106254 - DNA, 20 bp, Artificial Sequence
  Description of Artificial Sequence: Synthetic oligonucleotide
  Target: ATXN1; (+) strand; PAM type: NRG; PAM sequence: TGG
ggggctaacagggaaatgag

SEQ ID NO: 106255 - DNA, 20 bp, Artificial Sequence
  Description of Artificial Sequence: Synthetic oligonucleotide
  Target: ATXN1; (+) strand; PAM type: NRG; PAM sequence: CAG
agggaaatgagtggtgacta

SEQ ID NO: 106256 - DNA, 20 bp, Artificial Sequence
  Description of Artificial Sequence: Synthetic oligonucleotide
  Target: ATXN1; (+) strand; PAM type: NRG; PAM sequence: AAG
tgagtggtgactacagctaa

SEQ ID NO: 106257 - DNA, 20 bp, Artificial Sequence
  Description of Artificial Sequence: Synthetic oligonucleotide
  Target: ATXN1; (+) strand; PAM type: NRG; PAM sequence: AGG
gagtggtgactacagctaaa

SEQ ID NO: 106258 - DNA, 20 bp, Artificial Sequence
  Description of Artificial Sequence: Synthetic oligonucleotide
  Target: ATXN1; (+) strand; PAM type: NRG; PAM sequence: CAG
tggtgactacagctaaaagg

SEQ ID NO: 106259 - DNA, 20 bp, Artificial Sequence
  Description of Artificial Sequence: Synthetic oligonucleotide
  Target: ATXN1; (+) strand; PAM type: NRG; PAM sequence: CAG
ggcagttgctcctgtcttcc

SEQ ID NO: 106260 - DNA, 20 bp, Artificial Sequence
  Description of Artificial Sequence: Synthetic oligonucleotide
  Target: ATXN1; (+) strand; PAM type: NRG; PAM sequence: TGG
ttgctcctgtcttcccagaa

SEQ ID NO: 106261 - DNA, 20 bp, Artificial Sequence
  Description of Artificial Sequence: Synthetic oligonucleotide
  Target: ATXN1; (+) strand; PAM type: NRG; PAM sequence: CGG
ctcctgtcttcccagaatgg

SEQ ID NO: 106262 - DNA, 20 bp, Artificial Sequence
  Description of Artificial Sequence: Synthetic oligonucleotide
  Target: ATXN1; (+) strand; PAM type: NRG; PAM sequence: AAG
cttcccagaatggcggtgat

SEQ ID NO: 106263 - DNA, 20 bp, Artificial Sequence
  Description of Artificial Sequence: Synthetic oligonucleotide
  Target: ATXN1; (+) strand; PAM type: NRG; PAM sequence: TAG
ccagaatggcggtgataagc

SEQ ID NO: 106264 - DNA, 20 bp, Artificial Sequence
  Description of Artificial Sequence: Synthetic oligonucleotide
  Target: ATXN1; (+) strand; PAM type: NRG; PAM sequence: GAG
agaatggcggtgataagcta

SEQ ID NO: 106265 - DNA, 20 bp, Artificial Sequence
  Description of Artificial Sequence: Synthetic oligonucleotide
  Target: ATXN1; (+) strand; PAM type: NRG; PAM sequence: AGG
gaatggcggtgataagctag

SEQ ID NO: 106266 - DNA, 20 bp, Artificial Sequence
  Description of Artificial Sequence: Synthetic oligonucleotide
  Target: ATXN1; (+) strand; PAM type: NRG; PAM sequence: CAG
tgataagctagaggtatacc

SEQ ID NO: 106267 - DNA, 20 bp, Artificial Sequence
  Description of Artificial Sequence: Synthetic oligonucleotide
  Target: ATXN1; (+) strand; PAM type: NRG; PAM sequence: AGG
gataagctagaggtataccc

SEQ ID NO: 106268 - DNA, 20 bp, Artificial Sequence
  Description of Artificial Sequence: Synthetic oligonucleotide
  Target: ATXN1; (+) strand; PAM type: NRG; PAM sequence: GAG
taagctagaggtatacccag

SEQ ID NO: 106269 - DNA, 20 bp, Artificial Sequence
  Description of Artificial Sequence: Synthetic oligonucleotide
  Target: ATXN1; (+) strand; PAM type: NRG; PAM sequence: GAG
agctagaggtatacccagga

SEQ ID NO: 106270 - DNA, 20 bp, Artificial Sequence
  Description of Artificial Sequence: Synthetic oligonucleotide
  Target: ATXN1; (+) strand; PAM type: NRG; PAM sequence: CAG
gtatacccaggagagacaac

SEQ ID NO: 106271 - DNA, 20 bp, Artificial Sequence
  Description of Artificial Sequence: Synthetic oligonucleotide
  Target: ATXN1; (+) strand; PAM type: NRG; PAM sequence: AAG
ccaggagagacaaccagcaa

SEQ ID NO: 106272 - DNA, 20 bp, Artificial Sequence
  Description of Artificial Sequence: Synthetic oligonucleotide
  Target: ATXN1; (+) strand; PAM type: NRG; PAM sequence: CAG
caaaagtgtgacacctcaat

SEQ ID NO: 106273 - DNA, 20 bp, Artificial Sequence
  Description of Artificial Sequence: Synthetic oligonucleotide
  Target: ATXN1; (+) strand; PAM type: NRG; PAM sequence: AAG
tatatattttattacacttt

SEQ ID NO: 106274 - DNA, 20 bp, Artificial Sequence
  Description of Artificial Sequence: Synthetic oligonucleotide
  Target: ATXN1; (+) strand; PAM type: NRG; PAM sequence: TAG
ttttattacactttaagttc

SEQ ID NO: 106275 - DNA, 20 bp, Artificial Sequence
  Description of Artificial Sequence: Synthetic oligonucleotide
  Target: ATXN1; (+) strand; PAM type: NRG; PAM sequence: AGG
tttattacactttaagttct

SEQ ID NO: 106276 - DNA, 20 bp, Artificial Sequence
  Description of Artificial Sequence: Synthetic oligonucleotide
  Target: ATXN1; (+) strand; PAM type: NRG; PAM sequence: GGG
ttattacactttaagttcta

SEQ ID NO: 106277 - DNA, 20 bp, Artificial Sequence
  Description of Artificial Sequence: Synthetic oligonucleotide
  Target: ATXN1; (+) strand; PAM type: NRG; PAM sequence: TAG
acatatgtatacatgtgcca

SEQ ID NO: 106278 - DNA, 20 bp, Artificial Sequence
  Description of Artificial Sequence: Synthetic oligonucleotide
  Target: ATXN1; (+) strand; PAM type: NRG; PAM sequence: CAG
tatgtatacatgtgccatag

SEQ ID NO: 106279 - DNA, 20 bp, Artificial Sequence
  Description of Artificial Sequence: Synthetic oligonucleotide
  Target: ATXN1; (+) strand; PAM type: NRG; PAM sequence: GAG
tgtatacatgtgccatagca

SEQ ID NO: 106280 - DNA, 20 bp, Artificial Sequence
  Description of Artificial Sequence: Synthetic oligonucleotide
  Target: ATXN1; (+) strand; PAM type: NRG; PAM sequence: AAG
tacatgtgccatagcagagc

SEQ ID NO: 106281 - DNA, 20 bp, Artificial Sequence
  Description of Artificial Sequence: Synthetic oligonucleotide
  Target: ATXN1; (+) strand; PAM type: NRG; PAM sequence: AGG
acatgtgccatagcagagca

SEQ ID NO: 106282 - DNA, 20 bp, Artificial Sequence
  Description of Artificial Sequence: Synthetic oligonucleotide
  Target: ATXN1; (+) strand; PAM type: NRG; PAM sequence: GAG
atgtgccatagcagagcaag

SEQ ID NO: 106283 - DNA, 20 bp, Artificial Sequence
  Description of Artificial Sequence: Synthetic oligonucleotide
  Target: ATXN1; (+) strand; PAM type: NRG; PAM sequence: CAG
cagagcaaggagttccaaaa

SEQ ID NO: 106284 - DNA, 20 bp, Artificial Sequence
  Description of Artificial Sequence: Synthetic oligonucleotide
  Target: ATXN1; (+) strand; PAM type: NRG; PAM sequence: CGG
gagttccaaaacagaattac

SEQ ID NO: 106285 - DNA, 20 bp, Artificial Sequence
  Description of Artificial Sequence: Synthetic oligonucleotide
  Target: ATXN1; (+) strand; PAM type: NRG; PAM sequence: GAG
gttttcttttttttcttatt

SEQ ID NO: 106286 - DNA, 20 bp, Artificial Sequence
  Description of Artificial Sequence: Synthetic oligonucleotide
  Target: ATXN1; (+) strand; PAM type: NRG; PAM sequence: AAG
ttttttttcttattgagaca

SEQ ID NO: 106287 - DNA, 20 bp, Artificial Sequence
  Description of Artificial Sequence: Synthetic oligonucleotide
  Target: ATXN1; (+) strand; PAM type: NRG; PAM sequence: CAG
caaagtctcactctgttgcc

SEQ ID NO: 106288 - DNA, 20 bp, Artificial Sequence
  Description of Artificial Sequence: Synthetic oligonucleotide
  Target: ATXN1; (+) strand; PAM type: NRG; PAM sequence: AGG
aaagtctcactctgttgccc

SEQ ID NO: 106289 - DNA, 20 bp, Artificial Sequence
  Description of Artificial Sequence: Synthetic oligonucleotide
  Target: ATXN1; (+) strand; PAM type: NRG; PAM sequence: TGG
tctcactctgttgcccaggc

SEQ ID NO: 106290 - DNA, 20 bp, Artificial Sequence
  Description of Artificial Sequence: Synthetic oligonucleotide
  Target: ATXN1; (+) strand; PAM type: NRG; PAM sequence: GAG
tcactctgttgcccaggctg

SEQ ID NO: 106291 - DNA, 20 bp, Artificial Sequence
  Description of Artificial Sequence: Synthetic oligonucleotide
  Target: ATXN1; (+) strand; PAM type: NRG; PAM sequence: CAG
ctgttgcccaggctggagtg

SEQ ID NO: 106292 - DNA, 20 bp, Artificial Sequence
  Description of Artificial Sequence: Synthetic oligonucleotide
  Target: ATXN1; (+) strand; PAM type: NRG; PAM sequence: TGG
ttgcccaggctggagtgcag

SEQ ID NO: 106293 - DNA, 20 bp, Artificial Sequence
  Description of Artificial Sequence: Synthetic oligonucleotide
  Target: ATXN1; (+) strand; PAM type: NRG; PAM sequence: TGG
ggagtgcagtggtgcaacct

SEQ ID NO: 106294 - DNA, 20 bp, Artificial Sequence
  Description of Artificial Sequence: Synthetic oligonucleotide
  Target: ATXN1; (+) strand; PAM type: NRG; PAM sequence: AAG
tactgcaacctctgcctccc

SEQ ID NO: 106295 - DNA, 20 bp, Artificial Sequence
  Description of Artificial Sequence: Synthetic oligonucleotide
  Target: ATXN1; (+) strand; PAM type: NRG; PAM sequence: AAG
aacctctgcctcccaagttc

SEQ ID NO: 106296 - DNA, 20 bp, Artificial Sequence
  Description of Artificial Sequence: Synthetic oligonucleotide
  Target: ATXN1; (+) strand; PAM type: NRG; PAM sequence: CAG
ttcaagtgattcttctgcct

SEQ ID NO: 106297 - DNA, 20 bp, Artificial Sequence
  Description of Artificial Sequence: Synthetic oligonucleotide
  Target: ATXN1; (+) strand; PAM type: NRG; PAM sequence: GAG
ttcttctgcctcagcctcct

SEQ ID NO: 106298 - DNA, 20 bp, Artificial Sequence
  Description of Artificial Sequence: Synthetic oligonucleotide
  Target: ATXN1; (+) strand; PAM type: NRG; PAM sequence: TAG
ttctgcctcagcctcctgag

SEQ ID NO: 106299 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcctgagtagc

SEQ ID NO: 106300 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcctgagtagct

SEQ ID NO: 106301 - DNA, 20 bp, Artificial Sequence
  Description of Artificial Sequence: Synthetic oligonucleotide
  Target: ATXN1; (+) strand; PAM type: NRG; PAM sequence: CAG
ctcctgagtagctgggactg

SEQ ID NO: 106302 - DNA, 20 bp, Artificial Sequence
  Description of Artificial Sequence: Synthetic oligonucleotide
  Target: ATXN1; (+) strand; PAM type: NRG; PAM sequence: AGG
tcctgagtagctgggactgc

SEQ ID NO: 106303 - DNA, 20 bp, Artificial Sequence
  Description of Artificial Sequence: Synthetic oligonucleotide
  Target: ATXN1; (+) strand; PAM type: NRG; PAM sequence: TAG
tgcctaactttttgtatttt

SEQ ID NO: 106304 - DNA, 20 bp, Artificial Sequence
  Description of Artificial Sequence: Synthetic oligonucleotide
  Target: ATXN1; (+) strand; PAM type: NRG; PAM sequence: TAG
ctaactttttgtatttttag

SEQ ID NO: 106305 - DNA, 20 bp, Artificial Sequence
  Description of Artificial Sequence: Synthetic oligonucleotide
  Target: ATXN1; (+) strand; PAM type: NRG; PAM sequence: GAG
aactttttgtatttttagta

SEQ ID NO: 106306 - DNA, 20 bp, Artificial Sequence
  Description of Artificial Sequence: Synthetic oligonucleotide
  Target: ATXN1; (+) strand; PAM type: NRG; PAM sequence: TGG
ttttgtatttttagtagaga

SEQ ID NO: 106307 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtagagat

SEQ ID NO: 106308 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagatg

SEQ ID NO: 106309 - DNA, 20 bp, Artificial Sequence
  Description of Artificial Sequence: Synthetic oligonucleotide
  Target: ATXN1; (+) strand; PAM type: NRG; PAM sequence: TGG
gagatggggtttcaccatgt

SEQ ID NO: 106310 - DNA, 20 bp, Artificial Sequence
  Description of Artificial Sequence: Synthetic oligonucleotide
  Target: ATXN1; (+) strand; PAM type: NRG; PAM sequence: CAG
tggggtttcaccatgttggc

SEQ ID NO: 106311 - DNA, 20 bp, Artificial Sequence
  Description of Artificial Sequence: Synthetic oligonucleotide
  Target: ATXN1; (+) strand; PAM type: NRG; PAM sequence: AGG
ggggtttcaccatgttggcc

SEQ ID NO: 106312 - DNA, 20 bp, Artificial Sequence
  Description of Artificial Sequence: Synthetic oligonucleotide
  Target: ATXN1; (+) strand; PAM type: NRG; PAM sequence: TGG
tttcaccatgttggccaggc

SEQ ID NO: 106313 - DNA, 20 bp, Artificial Sequence
  Description of Artificial Sequence: Synthetic oligonucleotide
  Target: ATXN1; (+) strand; PAM type: NRG; PAM sequence: CAG
tggtctcgaactcctgacct

SEQ ID NO: 106314 - DNA, 20 bp, Artificial Sequence
  Description of Artificial Sequence: Synthetic oligonucleotide
  Target: ATXN1; (+) strand; PAM type: NRG; PAM sequence: AGG
ggtctcgaactcctgacctc

SEQ ID NO: 106315 - DNA, 20 bp, Artificial Sequence
  Description of Artificial Sequence: Synthetic oligonucleotide
  Target: ATXN1; (+) strand; PAM type: NRG; PAM sequence: TGG
ctcaggtgatccacccacat

SEQ ID NO: 106316 - DNA, 20 bp, Artificial Sequence
  Description of Artificial Sequence: Synthetic oligonucleotide
  Target: ATXN1; (+) strand; PAM type: NRG; PAM sequence: AAG
ccacccacattggcctccca

SEQ ID NO: 106317 - DNA, 20 bp, Artificial Sequence
  Description of Artificial Sequence: Synthetic oligonucleotide
  Target: ATXN1; (+) strand; PAM type: NRG; PAM sequence: TGG
acattggcctcccaaagtgc

SEQ ID NO: 106318 - DNA, 20 bp, Artificial Sequence
  Description of Artificial Sequence: Synthetic oligonucleotide
  Target: ATXN1; (+) strand; PAM type: NRG; PAM sequence: GGG
cattggcctcccaaagtgct

SEQ ID NO: 106319 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 106320 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 106321 - DNA, 20 bp, Artificial Sequence
  Description of Artificial Sequence: Synthetic oligonucleotide
  Target: ATXN1; (+) strand; PAM type: NRG; PAM sequence: GAG
gtgctgggattacaggcatt

SEQ ID NO: 106322 - DNA, 20 bp, Artificial Sequence
  Description of Artificial Sequence: Synthetic oligonucleotide
  Target: ATXN1; (+) strand; PAM type: NRG; PAM sequence: TGG
aggcattgagccactgcgcc

SEQ ID NO: 106323 - DNA, 20 bp, Artificial Sequence
  Description of Artificial Sequence: Synthetic oligonucleotide
  Target: ATXN1; (+) strand; PAM type: NRG; PAM sequence: TGG
actgcgcctggccgaattat

SEQ ID NO: 106324 - DNA, 20 bp, Artificial Sequence
  Description of Artificial Sequence: Synthetic oligonucleotide
  Target: ATXN1; (+) strand; PAM type: NRG; PAM sequence: AAG
ggccgaattattggttttca

SEQ ID NO: 106325 - DNA, 20 bp, Artificial Sequence
  Description of Artificial Sequence: Synthetic oligonucleotide
  Target: ATXN1; (+) strand; PAM type: NRG; PAM sequence: AAG
cttcctcttcttcatactgt

SEQ ID NO: 106326 - DNA, 20 bp, Artificial Sequence
  Description of Artificial Sequence: Synthetic oligonucleotide
  Target: ATXN1; (+) strand; PAM type: NRG; PAM sequence: TGG
aagaacattcaaatgacatt

SEQ ID NO: 106327 - DNA, 20 bp, Artificial Sequence
  Description of Artificial Sequence: Synthetic oligonucleotide
  Target: ATXN1; (+) strand; PAM type: NRG; PAM sequence: GGG
agaacattcaaatgacattt

SEQ ID NO: 106328 - DNA, 20 bp, Artificial Sequence
  Description of Artificial Sequence: Synthetic oligonucleotide
  Target: ATXN1; (+) strand; PAM type: NRG; PAM sequence: GGG
gaacattcaaatgacatttg

SEQ ID NO: 106329 - DNA, 20 bp, Artificial Sequence
  Description of Artificial Sequence: Synthetic oligonucleotide
  Target: ATXN1; (+) strand; PAM type: NRG; PAM sequence: GGG
aacattcaaatgacatttgg

SEQ ID NO: 106330 - DNA, 20 bp, Artificial Sequence
  Description of Artificial Sequence: Synthetic oligonucleotide
  Target: ATXN1; (+) strand; PAM type: NRG; PAM sequence: TGG
tttgggggcttaacacccct

SEQ ID NO: 106331 - DNA, 20 bp, Artificial Sequence
  Description of Artificial Sequence: Synthetic oligonucleotide
  Target: ATXN1; (+) strand; PAM type: NRG; PAM sequence: TAG
ggcttaacaccccttggctt

SEQ ID NO: 106332 - DNA, 20 bp, Artificial Sequence
  Description of Artificial Sequence: Synthetic oligonucleotide
  Target: ATXN1; (+) strand; PAM type: NRG; PAM sequence: CAG
taacaccccttggctttagc

SEQ ID NO: 106333 - DNA, 20 bp, Artificial Sequence
  Description of Artificial Sequence: Synthetic oligonucleotide
  Target: ATXN1; (+) strand; PAM type: NRG; PAM sequence: TGG
gctttagccagatgtgtcca

SEQ ID NO: 106334 - DNA, 20 bp, Artificial Sequence
  Description of Artificial Sequence: Synthetic oligonucleotide
  Target: ATXN1; (+) strand; PAM type: NRG; PAM sequence: TAG
aaaaaaatgacataaccaaa

SEQ ID NO: 106335 - DNA, 20 bp, Artificial Sequence
  Description of Artificial Sequence: Synthetic oligonucleotide
  Target: ATXN1; (+) strand; PAM type: NRG; PAM sequence: TAG
ataaccaaatagaaaatctc

SEQ ID NO: 106336 - DNA, 20 bp, Artificial Sequence
  Description of Artificial Sequence: Synthetic oligonucleotide
  Target: ATXN1; (+) strand; PAM type: NRG; PAM sequence: CAG
tttacttttcatctgtttgt

SEQ ID NO: 106337 - DNA, 20 bp, Artificial Sequence
  Description of Artificial Sequence: Synthetic oligonucleotide
  Target: ATXN1; (+) strand; PAM type: NRG; PAM sequence: TAG
tttcatctgtttgtcagttc

SEQ ID NO: 106338 - DNA, 20 bp, Artificial Sequence
  Description of Artificial Sequence: Synthetic oligonucleotide
  Target: ATXN1; (+) strand; PAM type: NRG; PAM sequence: AAG
tgtcagttctagtcaatgta

SEQ ID NO: 106339 - DNA, 20 bp, Artificial Sequence
  Description of Artificial Sequence: Synthetic oligonucleotide
  Target: ATXN1; (+) strand; PAM type: NRG; PAM sequence: TAG
gttctagtcaatgtaaagca

SEQ ID NO: 106340 - DNA, 20 bp, Artificial Sequence
  Description of Artificial Sequence: Synthetic oligonucleotide
  Target: ATXN1; (+) strand; PAM type: NRG; PAM sequence: CAG
tcaatgtaaagcatagacta

SEQ ID NO: 106341 - DNA, 20 bp, Artificial Sequence
  Description of Artificial Sequence: Synthetic oligonucleotide
  Target: ATXN1; (+) strand; PAM type: NRG; PAM sequence: AAG
taaagcatagactacagtca

SEQ ID NO: 106342 - DNA, 20 bp, Artificial Sequence
  Description of Artificial Sequence: Synthetic oligonucleotide
  Target: ATXN1; (+) strand; PAM type: NRG; PAM sequence: AGG
aaagcatagactacagtcaa

SEQ ID NO: 106343 - DNA, 20 bp, Artificial Sequence
  Description of Artificial Sequence: Synthetic oligonucleotide
  Target: ATXN1; (+) strand; PAM type: NRG; PAM sequence: GGG
aagcatagactacagtcaaa

SEQ ID NO: 106344 - DNA, 20 bp, Artificial Sequence
  Description of Artificial Sequence: Synthetic oligonucleotide
  Target: ATXN1; (+) strand; PAM type: NRG; PAM sequence: CAG
ctacagtcaaagggtgcatt

SEQ ID NO: 106345 - DNA, 20 bp, Artificial Sequence
  Description of Artificial Sequence: Synthetic oligonucleotide
  Target: ATXN1; (+) strand; PAM type: NRG; PAM sequence: AAG
tcagtcccaaaactgtttac

SEQ ID NO: 106346 - DNA, 20 bp, Artificial Sequence
  Description of Artificial Sequence: Synthetic oligonucleotide
  Target: ATXN1; (+) strand; PAM type: NRG; PAM sequence: CAG
gtcccaaaactgtttacaag

SEQ ID NO: 106347 - DNA, 20 bp, Artificial Sequence
  Description of Artificial Sequence: Synthetic oligonucleotide
  Target: ATXN1; (+) strand; PAM type: NRG; PAM sequence: TAG
aactgtttacaagcagtgtt

SEQ ID NO: 106348 - DNA, 20 bp, Artificial Sequence
  Description of Artificial Sequence: Synthetic oligonucleotide
  Target: ATXN1; (+) strand; PAM type: NRG; PAM sequence: AGG
actgtttacaagcagtgttt

SEQ ID NO: 106349 - DNA, 20 bp, Artificial Sequence
  Description of Artificial Sequence: Synthetic oligonucleotide
  Target: ATXN1; (+) strand; PAM type: NRG; PAM sequence: GGG
ctgtttacaagcagtgttta

SEQ ID NO: 106350 - DNA, 20 bp, Artificial Sequence
  Description of Artificial Sequence: Synthetic oligonucleotide
  Target: ATXN1; (+) strand; PAM type: NRG; PAM sequence: GAG
gtttacaagcagtgtttagg

SEQ ID NO: 106351 - DNA, 20 bp, Artificial Sequence
  Description of Artificial Sequence: Synthetic oligonucleotide
  Target: ATXN1; (+) strand; PAM type: NRG; PAM sequence: AGG
tttacaagcagtgtttaggg

SEQ ID NO: 106352 - DNA, 20 bp, Artificial Sequence
  Description of Artificial Sequence: Synthetic oligonucleotide
  Target: ATXN1; (+) strand; PAM type: NRG; PAM sequence: TGG
gcagtgtttagggaggacaa

SEQ ID NO: 106353 - DNA, 20 bp, Artificial Sequence
  Description of Artificial Sequence: Synthetic oligonucleotide
  Target: ATXN1; (+) strand; PAM type: NRG; PAM sequence: GGG
cagtgtttagggaggacaat

SEQ ID NO: 106354 - DNA, 20 bp, Artificial Sequence
  Description of Artificial Sequence: Synthetic oligonucleotide
  Target: ATXN1; (+) strand; PAM type: NRG; PAM sequence: TGG
gaggacaatgggaatctgcc

SEQ ID NO: 106355 - DNA, 20 bp, Artificial Sequence
  Description of Artificial Sequence: Synthetic oligonucleotide
  Target: ATXN1; (+) strand; PAM type: NRG; PAM sequence: CAG
aaaaattaccttttccttcc

SEQ ID NO: 106356 - DNA, 20 bp, Artificial Sequence
  Description of Artificial Sequence: Synthetic oligonucleotide
  Target: ATXN1; (+) strand; PAM type: NRG; PAM sequence: TAG
taccttttccttcccagctg

SEQ ID NO: 106357 - DNA, 20 bp, Artificial Sequence
  Description of Artificial Sequence: Synthetic oligonucleotide
  Target: ATXN1; (+) strand; PAM type: NRG; PAM sequence: TAG
gctgctcttccacatttata

SEQ ID NO: 106358 - DNA, 20 bp, Artificial Sequence
  Description of Artificial Sequence: Synthetic oligonucleotide
  Target: ATXN1; (+) strand; PAM type: NRG; PAM sequence: TGG
acttacatgcctgcctgtaa

SEQ ID NO: 106359 - DNA, 20 bp, Artificial Sequence
  Description of Artificial Sequence: Synthetic oligonucleotide
  Target: ATXN1; (+) strand; PAM type: NRG; PAM sequence: GGG
cttacatgcctgcctgtaat

SEQ ID NO: 106360 - DNA, 20 bp, Artificial Sequence
  Description of Artificial Sequence: Synthetic oligonucleotide
  Target: ATXN1; (+) strand; PAM type: NRG; PAM sequence: CAG
ctgcctgtaatgggtctatt

SEQ ID NO: 106361 - DNA, 20 bp, Artificial Sequence
  Description of Artificial Sequence: Synthetic oligonucleotide
  Target: ATXN1; (+) strand; PAM type: NRG; PAM sequence: GAG
gcctgtaatgggtctattca

SEQ ID NO: 106362 - DNA, 20 bp, Artificial Sequence
  Description of Artificial Sequence: Synthetic oligonucleotide
  Target: ATXN1; (+) strand; PAM type: NRG; PAM sequence: TAG
cagagtcctatatatctata

SEQ ID NO: 106363 - DNA, 20 bp, Artificial Sequence
  Description of Artificial Sequence: Synthetic oligonucleotide
  Target: ATXN1; (+) strand; PAM type: NRG; PAM sequence: CAG
aactcattctgatctcttct

SEQ ID NO: 106364 - DNA, 20 bp, Artificial Sequence
  Description of Artificial Sequence: Synthetic oligonucleotide
  Target: ATXN1; (+) strand; PAM type: NRG; PAM sequence: CAG
ttctgatctcttctcagcat

SEQ ID NO: 106365 - DNA, 20 bp, Artificial Sequence
  Description of Artificial Sequence: Synthetic oligonucleotide
  Target: ATXN1; (+) strand; PAM type: NRG; PAM sequence: GAG
ctgatctcttctcagcatca

SEQ ID NO: 106366 - DNA, 20 bp, Artificial Sequence
  Description of Artificial Sequence: Synthetic oligonucleotide
  Target: ATXN1; (+) strand; PAM type: NRG; PAM sequence: TGG
agagattatgtttatttttg

SEQ ID NO: 106367 - DNA, 20 bp, Artificial Sequence
  Description of Artificial Sequence: Synthetic oligonucleotide
  Target: ATXN1; (+) strand; PAM type: NRG; PAM sequence: TGG
ttatttttgtggctaaatct

SEQ ID NO: 106368 - DNA, 20 bp, Artificial Sequence
  Description of Artificial Sequence: Synthetic oligonucleotide
  Target: ATXN1; (+) strand; PAM type: NRG; PAM sequence: CAG
ctaaatcttggtctgcccaa

SEQ ID NO: 106369 - DNA, 20 bp, Artificial Sequence
  Description of Artificial Sequence: Synthetic oligonucleotide
  Target: ATXN1; (+) strand; PAM type: NRG; PAM sequence: AAG
ctgcccaacagcaatcttta

SEQ ID NO: 106370 - DNA, 20 bp, Artificial Sequence
  Description of Artificial Sequence: Synthetic oligonucleotide
  Target: ATXN1; (+) strand; PAM type: NRG; PAM sequence: TGG
aatctttaaagaaacaatct

SEQ ID NO: 106371 - DNA, 20 bp, Artificial Sequence
  Description of Artificial Sequence: Synthetic oligonucleotide
  Target: ATXN1; (+) strand; PAM type: NRG; PAM sequence: GAG
gtttaccttttcttacctat

SEQ ID NO: 106372 - DNA, 20 bp, Artificial Sequence
  Description of Artificial Sequence: Synthetic oligonucleotide
  Target: ATXN1; (+) strand; PAM type: NRG; PAM sequence: AGG
tttaccttttcttacctatg

SEQ ID NO: 106373 - DNA, 20 bp, Artificial Sequence
  Description of Artificial Sequence: Synthetic oligonucleotide
  Target: ATXN1; (+) strand; PAM type: NRG; PAM sequence: TGG
ttttcttacctatgaggctt

SEQ ID NO: 106374 - DNA, 20 bp, Artificial Sequence
  Description of Artificial Sequence: Synthetic oligonucleotide
  Target: ATXN1; (+) strand; PAM type: NRG; PAM sequence: TGG
tatgaggctttggtgatata

SEQ ID NO: 106375 - DNA, 20 bp, Artificial Sequence
  Description of Artificial Sequence: Synthetic oligonucleotide
  Target: ATXN1; (+) strand; PAM type: NRG; PAM sequence: AAG
ggctttggtgatatatggaa

SEQ ID NO: 106376 - DNA, 20 bp, Artificial Sequence
  Description of Artificial Sequence: Synthetic oligonucleotide
  Target: ATXN1; (+) strand; PAM type: NRG; PAM sequence: AGG
gctttggtgatatatggaaa

SEQ ID NO: 106377 - DNA, 20 bp, Artificial Sequence
  Description of Artificial Sequence: Synthetic oligonucleotide
  Target: ATXN1; (+) strand; PAM type: NRG; PAM sequence: GGG
ctttggtgatatatggaaaa

SEQ ID NO: 106378 - DNA, 20 bp, Artificial Sequence
  Description of Artificial Sequence: Synthetic oligonucleotide
  Target: ATXN1; (+) strand; PAM type: NRG; PAM sequence: GGG
tttggtgatatatggaaaag

SEQ ID NO: 106379 - DNA, 20 bp, Artificial Sequence
  Description of Artificial Sequence: Synthetic oligonucleotide
  Target: ATXN1; (+) strand; PAM type: NRG; PAM sequence: TGG
tatggaaaaggggacctcta

SEQ ID NO: 106380 - DNA, 20 bp, Artificial Sequence
  Description of Artificial Sequence: Synthetic oligonucleotide
  Target: ATXN1; (+) strand; PAM type: NRG; PAM sequence: AAG
gaaaaggggacctctatggc

SEQ ID NO: 106381 - DNA, 20 bp, Artificial Sequence
  Description of Artificial Sequence: Synthetic oligonucleotide
  Target: ATXN1; (+) strand; PAM type: NRG; PAM sequence: CAG
ctctatggcaagtttcatga

SEQ ID NO: 106382 - DNA, 20 bp, Artificial Sequence
  Description of Artificial Sequence: Synthetic oligonucleotide
  Target: ATXN1; (+) strand; PAM type: NRG; PAM sequence: AGG
tctatggcaagtttcatgac

SEQ ID NO: 106383 - DNA, 20 bp, Artificial Sequence
  Description of Artificial Sequence: Synthetic oligonucleotide
  Target: ATXN1; (+) strand; PAM type: NRG; PAM sequence: CAG
aaaaacaacaacaataataa

SEQ ID NO: 106384 - DNA, 20 bp, Artificial Sequence
  Description of Artificial Sequence: Synthetic oligonucleotide
  Target: ATXN1; (+) strand; PAM type: NRG; PAM sequence: TGG
ttcctgaccacttgtcctct

SEQ ID NO: 106385 - DNA, 20 bp, Artificial Sequence
  Description of Artificial Sequence: Synthetic oligonucleotide
  Target: ATXN1; (+) strand; PAM type: NRG; PAM sequence: GAG
cctgaccacttgtcctcttg

SEQ ID NO: 106386 - DNA, 20 bp, Artificial Sequence
  Description of Artificial Sequence: Synthetic oligonucleotide
  Target: ATXN1; (+) strand; PAM type: NRG; PAM sequence: AGG
ctgaccacttgtcctcttgg

SEQ ID NO: 106387 - DNA, 20 bp, Artificial Sequence
  Description of Artificial Sequence: Synthetic oligonucleotide
  Target: ATXN1; (+) strand; PAM type: NRG; PAM sequence: CAG
ccacttgtcctcttggaggt

SEQ ID NO: 106388 - DNA, 20 bp, Artificial Sequence
  Description of Artificial Sequence: Synthetic oligonucleotide
  Target: ATXN1; (+) strand; PAM type: NRG; PAM sequence: TAG
ttgtcctcttggaggtcagc

SEQ ID NO: 106389 - DNA, 20 bp, Artificial Sequence
  Description of Artificial Sequence: Synthetic oligonucleotide
  Target: ATXN1; (+) strand; PAM type: NRG; PAM sequence: TGG
cttggaggtcagctagatgc

SEQ ID NO: 106390 - DNA, 20 bp, Artificial Sequence
  Description of Artificial Sequence: Synthetic oligonucleotide
  Target: ATXN1; (+) strand; PAM type: NRG; PAM sequence: CAG
ggaggtcagctagatgctgg

SEQ ID NO: 106391 - DNA, 20 bp, Artificial Sequence
  Description of Artificial Sequence: Synthetic oligonucleotide
  Target: ATXN1; (+) strand; PAM type: NRG; PAM sequence: TAG
gctagatgctggcagttccc

SEQ ID NO: 106392 - DNA, 20 bp, Artificial Sequence
  Description of Artificial Sequence: Synthetic oligonucleotide
  Target: ATXN1; (+) strand; PAM type: NRG; PAM sequence: AGG
ctagatgctggcagttccct

SEQ ID NO: 106393 - DNA, 20 bp, Artificial Sequence
  Description of Artificial Sequence: Synthetic oligonucleotide
  Target: ATXN1; (+) strand; PAM type: NRG; PAM sequence: CAG
ggaaatgacattatattacc

SEQ ID NO: 106394 - DNA, 20 bp, Artificial Sequence
  Description of Artificial Sequence: Synthetic oligonucleotide
  Target: ATXN1; (+) strand; PAM type: NRG; PAM sequence: CAG
cccagaataccacattaatt

SEQ ID NO: 106395 - DNA, 20 bp, Artificial Sequence
  Description of Artificial Sequence: Synthetic oligonucleotide
  Target: ATXN1; (+) strand; PAM type: NRG; PAM sequence: TAG
ttaattcagaacctgccacc

SEQ ID NO: 106396 - DNA, 20 bp, Artificial Sequence
  Description of Artificial Sequence: Synthetic oligonucleotide
  Target: ATXN1; (+) strand; PAM type: NRG; PAM sequence: TGG
cctgccacctagctaacttc

SEQ ID NO: 106397 - DNA, 20 bp, Artificial Sequence
  Description of Artificial Sequence: Synthetic oligonucleotide
  Target: ATXN1; (+) strand; PAM type: NRG; PAM sequence: TGG
acctagctaacttctggctc

SEQ ID NO: 106398 - DNA, 20 bp, Artificial Sequence
  Description of Artificial Sequence: Synthetic oligonucleotide
  Target: ATXN1; (+) strand; PAM type: NRG; PAM sequence: CAG
gctgacccctttgcaacaat

SEQ ID NO: 106399 - DNA, 20 bp, Artificial Sequence
  Description of Artificial Sequence: Synthetic oligonucleotide
  Target: ATXN1; (+) strand; PAM type: NRG; PAM sequence: AAG
gacccctttgcaacaatcag

SEQ ID NO: 106400 - DNA, 20 bp, Artificial Sequence
  Description of Artificial Sequence: Synthetic oligonucleotide
  Target: ATXN1; (+) strand; PAM type: NRG; PAM sequence: CAG
ccctttgcaacaatcagaag

SEQ ID NO: 106401 - DNA, 20 bp, Artificial Sequence
  Description of Artificial Sequence: Synthetic oligonucleotide
  Target: ATXN1; (+) strand; PAM type: NRG; PAM sequence: AGG
cctttgcaacaatcagaagc

SEQ ID NO: 106402 - DNA, 20 bp, Artificial Sequence
  Description of Artificial Sequence: Synthetic oligonucleotide
  Target: ATXN1; (+) strand; PAM type: NRG; PAM sequence: TAG
atcagaagcaggaatgaatt

SEQ ID NO: 106403 - DNA, 20 bp, Artificial Sequence
  Description of Artificial Sequence: Synthetic oligonucleotide
  Target: ATXN1; (+) strand; PAM type: NRG; PAM sequence: AAG
atgaatttagaatataacaa

SEQ ID NO: 106404 - DNA, 20 bp, Artificial Sequence
  Description of Artificial Sequence: Synthetic oligonucleotide
  Target: ATXN1; (+) strand; PAM type: NRG; PAM sequence: AGG
tgaatttagaatataacaaa

SEQ ID NO: 106405 - DNA, 20 bp, Artificial Sequence
  Description of Artificial Sequence: Synthetic oligonucleotide
  Target: ATXN1; (+) strand; PAM type: NRG; PAM sequence: GGG
gaatttagaatataacaaaa

SEQ ID NO: 106406 - DNA, 20 bp, Artificial Sequence
  Description of Artificial Sequence: Synthetic oligonucleotide
  Target: ATXN1; (+) strand; PAM type: NRG; PAM sequence: TGG
aatataacaaaagggcctct

SEQ ID NO: 106407 - DNA, 20 bp, Artificial Sequence
  Description of Artificial Sequence: Synthetic oligonucleotide
  Target: ATXN1; (+) strand; PAM type: NRG; PAM sequence: TAG
aagggcctcttggattttgt

SEQ ID NO: 106408 - DNA, 20 bp, Artificial Sequence
  Description of Artificial Sequence: Synthetic oligonucleotide
  Target: ATXN1; (+) strand; PAM type: NRG; PAM sequence: AAG
ttggattttgttagttgatc

SEQ ID NO: 106409 - DNA, 20 bp, Artificial Sequence
  Description of Artificial Sequence: Synthetic oligonucleotide
  Target: ATXN1; (+) strand; PAM type: NRG; PAM sequence: CAG
tgttagttgatcaagaatct

SEQ ID NO: 106410 - DNA, 20 bp, Artificial Sequence
  Description of Artificial Sequence: Synthetic oligonucleotide
  Target: ATXN1; (+) strand; PAM type: NRG; PAM sequence: GAG
ttagttgatcaagaatctca

SEQ ID NO: 106411 - DNA, 20 bp, Artificial Sequence
  Description of Artificial Sequence: Synthetic oligonucleotide
  Target: ATXN1; (+) strand; PAM type: NRG; PAM sequence: TAG
tatatatgcatgaaataaaa

SEQ ID NO: 106412 - DNA, 20 bp, Artificial Sequence
  Description of Artificial Sequence: Synthetic oligonucleotide
  Target: ATXN1; (+) strand; PAM type: NRG; PAM sequence: AGG
atatatgcatgaaataaaat

SEQ ID NO: 106413 - DNA, 20 bp, Artificial Sequence
  Description of Artificial Sequence: Synthetic oligonucleotide
  Target: ATXN1; (+) strand; PAM type: NRG; PAM sequence: CAG
atgcatgaaataaaataggc

SEQ ID NO: 106414 - DNA, 20 bp, Artificial Sequence
  Description of Artificial Sequence: Synthetic oligonucleotide
  Target: ATXN1; (+) strand; PAM type: NRG; PAM sequence: AGG
tgcatgaaataaaataggcc

SEQ ID NO: 106415 - DNA, 20 bp, Artificial Sequence
  Description of Artificial Sequence: Synthetic oligonucleotide
  Target: ATXN1; (+) strand; PAM type: NRG; PAM sequence: TGG
tgaaataaaataggccaggc

SEQ ID NO: 106416 - DNA, 20 bp, Artificial Sequence
  Description of Artificial Sequence: Synthetic oligonucleotide
  Target: ATXN1; (+) strand; PAM type: NRG; PAM sequence: GGG
gaaataaaataggccaggct

SEQ ID NO: 106417 - DNA, 20 bp, Artificial Sequence
  Description of Artificial Sequence: Synthetic oligonucleotide
  Target: ATXN1; (+) strand; PAM type: NRG; PAM sequence: CGG
aaaataggccaggctgggca

SEQ ID NO: 106418 - DNA, 20 bp, Artificial Sequence
  Description of Artificial Sequence: Synthetic oligonucleotide
  Target: ATXN1; (+) strand; PAM type: NRG; PAM sequence: TGG
ataggccaggctgggcacgg

SEQ ID NO: 106419 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgtaatcc

SEQ ID NO: 106420 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagcactt

SEQ ID NO: 106421 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 106422 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 106423 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 106424 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggcc

SEQ ID NO: 106425 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggccg

SEQ ID NO: 106426 - DNA, 20 bp, Artificial Sequence
  Description of Artificial Sequence: Synthetic oligonucleotide
  Target: ATXN1; (+) strand; PAM type: NRG; PAM sequence: CAG
agcactttgggaggccgagg

SEQ ID NO: 106427 - DNA, 20 bp, Artificial Sequence
  Description of Artificial Sequence: Synthetic oligonucleotide
  Target: ATXN1; (+) strand; PAM type: NRG; PAM sequence: AGG
gcactttgggaggccgaggc

SEQ ID NO: 106428 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccgaggcagg

SEQ ID NO: 106429 - DNA, 20 bp, Artificial Sequence
  Description of Artificial Sequence: Synthetic oligonucleotide
  Target: ATXN1; (+) strand; PAM type: NRG; PAM sequence: GAG
ccgaggcaggtggatcactt

SEQ ID NO: 106430 - DNA, 20 bp, Artificial Sequence
  Description of Artificial Sequence: Synthetic oligonucleotide
  Target: ATXN1; (+) strand; PAM type: NRG; PAM sequence: AGG
cgaggcaggtggatcacttg

SEQ ID NO: 106431 - DNA, 20 bp, Artificial Sequence
  Description of Artificial Sequence: Synthetic oligonucleotide
  Target: ATXN1; (+) strand; PAM type: NRG; PAM sequence: CAG
gcaggtggatcacttgaggt

SEQ ID NO: 106432 - DNA, 20 bp, Artificial Sequence
  Description of Artificial Sequence: Synthetic oligonucleotide
  Target: ATXN1; (+) strand; PAM type: NRG; PAM sequence: AGG
caggtggatcacttgaggtc

SEQ ID NO: 106433 - DNA, 20 bp, Artificial Sequence
  Description of Artificial Sequence: Synthetic oligonucleotide
  Target: ATXN1; (+) strand; PAM type: NRG; PAM sequence: TGG
gatcacttgaggtcaggtgt

SEQ ID NO: 106434 - DNA, 20 bp, Artificial Sequence
  Description of Artificial Sequence: Synthetic oligonucleotide
  Target: ATXN1; (+) strand; PAM type: NRG; PAM sequence: GAG
tcacttgaggtcaggtgttg

SEQ ID NO: 106435 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggtgttggagac

SEQ ID NO: 106436 - DNA, 20 bp, Artificial Sequence
  Description of Artificial Sequence: Synthetic oligonucleotide
  Target: ATXN1; (+) strand; PAM type: NRG; PAM sequence: TAG
tcaggtgttggagaccagac

SEQ ID NO: 106437 - DNA, 20 bp, Artificial Sequence
  Description of Artificial Sequence: Synthetic oligonucleotide
  Target: ATXN1; (+) strand; PAM type: NRG; PAM sequence: TAG
tctattaaaaatacaaaaat

SEQ ID NO: 106438 - DNA, 20 bp, Artificial Sequence
  Description of Artificial Sequence: Synthetic oligonucleotide
  Target: ATXN1; (+) strand; PAM type: NRG; PAM sequence: CGG
ttaaaaatacaaaaattagc

SEQ ID NO: 106439 - DNA, 20 bp, Artificial Sequence
  Description of Artificial Sequence: Synthetic oligonucleotide
  Target: ATXN1; (+) strand; PAM type: NRG; PAM sequence: GGG
taaaaatacaaaaattagcc

SEQ ID NO: 106440 - DNA, 20 bp, Artificial Sequence
  Description of Artificial Sequence: Synthetic oligonucleotide
  Target: ATXN1; (+) strand; PAM type: NRG; PAM sequence: TGG
caaaaattagccgggcatga

SEQ ID NO: 106441 - DNA, 20 bp, Artificial Sequence
  Description of Artificial Sequence: Synthetic oligonucleotide
  Target: ATXN1; (+) strand; PAM type: NRG; PAM sequence: CGG
aaattagccgggcatgatgg

SEQ ID NO: 106442 - DNA, 20 bp, Artificial Sequence
  Description of Artificial Sequence: Synthetic oligonucleotide
  Target: ATXN1; (+) strand; PAM type: NRG; PAM sequence: GGG
aattagccgggcatgatggc

SEQ ID NO: 106443 - DNA, 20 bp, Artificial Sequence
  Description of Artificial Sequence: Synthetic oligonucleotide
  Target: ATXN1; (+) strand; PAM type: NRG; PAM sequence: CAG
atggcgggcacctgtaatcc

SEQ ID NO: 106444 - DNA, 20 bp, Artificial Sequence
  Description of Artificial Sequence: Synthetic oligonucleotide
  Target: ATXN1; (+) strand; PAM type: NRG; PAM sequence: CGG
cacctgtaatcccagctact

SEQ ID NO: 106445 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccagctactc

SEQ ID NO: 106446 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctactcgg

SEQ ID NO: 106447 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctactcggg

SEQ ID NO: 106448 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcgggaggct

SEQ ID NO: 106449 - DNA, 20 bp, Artificial Sequence
  Description of Artificial Sequence: Synthetic oligonucleotide
  Target: ATXN1; (+) strand; PAM type: NRG; PAM sequence: CAG
agctactcgggaggctgaga

SEQ ID NO: 106450 - DNA, 20 bp, Artificial Sequence
  Description of Artificial Sequence: Synthetic oligonucleotide
  Target: ATXN1; (+) strand; PAM type: NRG; PAM sequence: AGG
gctactcgggaggctgagac

SEQ ID NO: 106451 - DNA, 20 bp, Artificial Sequence
  Description of Artificial Sequence: Synthetic oligonucleotide
  Target: ATXN1; (+) strand; PAM type: NRG; PAM sequence: GAG
tactcgggaggctgagacag

SEQ ID NO: 106452 - DNA, 20 bp, Artificial Sequence
  Description of Artificial Sequence: Synthetic oligonucleotide
  Target: ATXN1; (+) strand; PAM type: NRG; PAM sequence: CGG
acaggagaatcacttgaacc

SEQ ID NO: 106453 - DNA, 20 bp, Artificial Sequence
  Description of Artificial Sequence: Synthetic oligonucleotide
  Target: ATXN1; (+) strand; PAM type: NRG; PAM sequence: GGG
caggagaatcacttgaaccc

SEQ ID NO: 106454 - DNA, 20 bp, Artificial Sequence
  Description of Artificial Sequence: Synthetic oligonucleotide
  Target: ATXN1; (+) strand; PAM type: NRG; PAM sequence: GAG
ggagaatcacttgaacccgg

SEQ ID NO: 106455 - DNA, 20 bp, Artificial Sequence
  Description of Artificial Sequence: Synthetic oligonucleotide
  Target: ATXN1; (+) strand; PAM type: NRG; PAM sequence: AGG
gagaatcacttgaacccggg

SEQ ID NO: 106456 - DNA, 20 bp, Artificial Sequence
  Description of Artificial Sequence: Synthetic oligonucleotide
  Target: ATXN1; (+) strand; PAM type: NRG; PAM sequence: TGG
aatcacttgaacccgggagg

SEQ ID NO: 106457 - DNA, 20 bp, Artificial Sequence
  Description of Artificial Sequence: Synthetic oligonucleotide
  Target: ATXN1; (+) strand; PAM type: NRG; PAM sequence: GAG
tcacttgaacccgggaggtg

SEQ ID NO: 106458 - DNA, 20 bp, Artificial Sequence
  Description of Artificial Sequence: Synthetic oligonucleotide
  Target: ATXN1; (+) strand; PAM type: NRG; PAM sequence: AGG
cacttgaacccgggaggtgg

SEQ ID NO: 106459 - DNA, 20 bp, Artificial Sequence
  Description of Artificial Sequence: Synthetic oligonucleotide
  Target: ATXN1; (+) strand; PAM type: NRG; PAM sequence: CAG
aacccgggaggtggaggttg

SEQ ID NO: 106460 - DNA, 20 bp, Artificial Sequence
  Description of Artificial Sequence: Synthetic oligonucleotide
  Target: ATXN1; (+) strand; PAM type: NRG; PAM sequence: GAG
cgggaggtggaggttgcagt

SEQ ID NO: 106461 - DNA, 20 bp, Artificial Sequence
  Description of Artificial Sequence: Synthetic oligonucleotide
  Target: ATXN1; (+) strand; PAM type: NRG; PAM sequence: GAG
ggtggaggttgcagtgagcc

SEQ ID NO: 106462 - DNA, 20 bp, Artificial Sequence
  Description of Artificial Sequence: Synthetic oligonucleotide
  Target: ATXN1; (+) strand; PAM type: NRG; PAM sequence: CAG
gagactacaccactacactc

SEQ ID NO: 106463 - DNA, 20 bp, Artificial Sequence
  Description of Artificial Sequence: Synthetic oligonucleotide
  Target: ATXN1; (+) strand; PAM type: NRG; PAM sequence: TGG
tacaccactacactccagcc

SEQ ID NO: 106464 - DNA, 20 bp, Artificial Sequence
  Description of Artificial Sequence: Synthetic oligonucleotide
  Target: ATXN1; (+) strand; PAM type: NRG; PAM sequence: GGG
acaccactacactccagcct

SEQ ID NO: 106465 - DNA, 20 bp, Artificial Sequence
  Description of Artificial Sequence: Synthetic oligonucleotide
  Target: ATXN1; (+) strand; PAM type: NRG; PAM sequence: CAG
ctacactccagcctgggtga

SEQ ID NO: 106466 - DNA, 20 bp, Artificial Sequence
  Description of Artificial Sequence: Synthetic oligonucleotide
  Target: ATXN1; (+) strand; PAM type: NRG; PAM sequence: GAG
acactccagcctgggtgaca

SEQ ID NO: 106467 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggtgacagagt

SEQ ID NO: 106468 - DNA, 20 bp, Artificial Sequence
  Description of Artificial Sequence: Synthetic oligonucleotide
  Target: ATXN1; (+) strand; PAM type: NRG; PAM sequence: AAG
ctgtctgaaaaaaaaaaaaa

SEQ ID NO: 106469 - DNA, 20 bp, Artificial Sequence
  Description of Artificial Sequence: Synthetic oligonucleotide
  Target: ATXN1; (+) strand; PAM type: NRG; PAM sequence: AAG
gaaaaaaaaaaaaaaagaaa

SEQ ID NO: 106470 - DNA, 20 bp, Artificial Sequence
  Description of Artificial Sequence: Synthetic oligonucleotide
  Target: ATXN1; (+) strand; PAM type: NRG; PAM sequence: CAG
aaaaaagaaaaagaaaaaaa

SEQ ID NO: 106471 - DNA, 20 bp, Artificial Sequence
  Description of Artificial Sequence: Synthetic oligonucleotide
  Target: ATXN1; (+) strand; PAM type: NRG; PAM sequence: AGG
aaaaagaaaaagaaaaaaac

SEQ ID NO: 106472 - DNA, 20 bp, Artificial Sequence
  Description of Artificial Sequence: Synthetic oligonucleotide
  Target: ATXN1; (+) strand; PAM type: NRG; PAM sequence: TGG
atgttcacaaaaatatccaa

SEQ ID NO: 106473 - DNA, 20 bp, Artificial Sequence
  Description of Artificial Sequence: Synthetic oligonucleotide
  Target: ATXN1; (+) strand; PAM type: NRG; PAM sequence: GGG
tgttcacaaaaatatccaat

SEQ ID NO: 106474 - DNA, 20 bp, Artificial Sequence
  Description of Artificial Sequence: Synthetic oligonucleotide
  Target: ATXN1; (+) strand; PAM type: NRG; PAM sequence: GGG
gttcacaaaaatatccaatg

SEQ ID NO: 106475 - DNA, 20 bp, Artificial Sequence
  Description of Artificial Sequence: Synthetic oligonucleotide
  Target: ATXN1; (+) strand; PAM type: NRG; PAM sequence: GGG
ttcacaaaaatatccaatgg

SEQ ID NO: 106476 - DNA, 20 bp, Artificial Sequence
  Description of Artificial Sequence: Synthetic oligonucleotide
  Target: ATXN1; (+) strand; PAM type: NRG; PAM sequence: CAG
atccaatgggggttctgacc

SEQ ID NO: 106477 - DNA, 20 bp, Artificial Sequence
  Description of Artificial Sequence: Synthetic oligonucleotide
  Target: ATXN1; (+) strand; PAM type: NRG; PAM sequence: AAG
ggttctgacccagaatatta

SEQ ID NO: 106478 - DNA, 20 bp, Artificial Sequence
  Description of Artificial Sequence: Synthetic oligonucleotide
  Target: ATXN1; (+) strand; PAM type: NRG; PAM sequence: TGG
gacccagaatattaaagtcc

SEQ ID NO: 106479 - DNA, 20 bp, Artificial Sequence
  Description of Artificial Sequence: Synthetic oligonucleotide
  Target: ATXN1; (+) strand; PAM type: NRG; PAM sequence: GAG
attaaagtcctggttttaat

SEQ ID NO: 106480 - DNA, 20 bp, Artificial Sequence
  Description of Artificial Sequence: Synthetic oligonucleotide
  Target: ATXN1; (+) strand; PAM type: NRG; PAM sequence: TGG
ggttttaatgagctatgaaa

SEQ ID NO: 106481 - DNA, 20 bp, Artificial Sequence
  Description of Artificial Sequence: Synthetic oligonucleotide
  Target: ATXN1; (+) strand; PAM type: NRG; PAM sequence: GGG
gttttaatgagctatgaaat

SEQ ID NO: 106482 - DNA, 20 bp, Artificial Sequence
  Description of Artificial Sequence: Synthetic oligonucleotide
  Target: ATXN1; (+) strand; PAM type: NRG; PAM sequence: GGG
ttttaatgagctatgaaatg

SEQ ID NO: 106483 - DNA, 20 bp, Artificial Sequence
  Description of Artificial Sequence: Synthetic oligonucleotide
  Target: ATXN1; (+) strand; PAM type: NRG; PAM sequence: AAG
tttatatttctttgactttt

SEQ ID NO: 106484 - DNA, 20 bp, Artificial Sequence
  Description of Artificial Sequence: Synthetic oligonucleotide
  Target: ATXN1; (+) strand; PAM type: NRG; PAM sequence: TAG
tttaagaacaatctcatgca

SEQ ID NO: 106485 - DNA, 20 bp, Artificial Sequence
  Description of Artificial Sequence: Synthetic oligonucleotide
  Target: ATXN1; (+) strand; PAM type: NRG; PAM sequence: GAG
taagaacaatctcatgcata

SEQ ID NO: 106486 - DNA, 20 bp, Artificial Sequence
  Description of Artificial Sequence: Synthetic oligonucleotide
  Target: ATXN1; (+) strand; PAM type: NRG; PAM sequence: TGG
ctcatgcatagagcccaaac

SEQ ID NO: 106487 - DNA, 20 bp, Artificial Sequence
  Description of Artificial Sequence: Synthetic oligonucleotide
  Target: ATXN1; (+) strand; PAM type: NRG; PAM sequence: GAG
catgcatagagcccaaactg

SEQ ID NO: 106488 - DNA, 20 bp, Artificial Sequence
  Description of Artificial Sequence: Synthetic oligonucleotide
  Target: ATXN1; (+) strand; PAM type: NRG; PAM sequence: TAG
gagcccaaactggagatctg

SEQ ID NO: 106489 - DNA, 20 bp, Artificial Sequence
  Description of Artificial Sequence: Synthetic oligonucleotide
  Target: ATXN1; (+) strand; PAM type: NRG; PAM sequence: TAG
aactggagatctgtagcttt

SEQ ID NO: 106490 - DNA, 20 bp, Artificial Sequence
  Description of Artificial Sequence: Synthetic oligonucleotide
  Target: ATXN1; (+) strand; PAM type: NRG; PAM sequence: TGG
actttgtctctcaattaccc

SEQ ID NO: 106491 - DNA, 20 bp, Artificial Sequence
  Description of Artificial Sequence: Synthetic oligonucleotide
  Target: ATXN1; (+) strand; PAM type: NRG; PAM sequence: GGG
ctttgtctctcaattaccct

SEQ ID NO: 106492 - DNA, 20 bp, Artificial Sequence
  Description of Artificial Sequence: Synthetic oligonucleotide
  Target: ATXN1; (+) strand; PAM type: NRG; PAM sequence: GGG
tttgtctctcaattaccctg

SEQ ID NO: 106493 - DNA, 20 bp, Artificial Sequence
  Description of Artificial Sequence: Synthetic oligonucleotide
  Target: ATXN1; (+) strand; PAM type: NRG; PAM sequence: GGG
ttgtctctcaattaccctgg

SEQ ID NO: 106494 - DNA, 20 bp, Artificial Sequence
  Description of Artificial Sequence: Synthetic oligonucleotide
  Target: ATXN1; (+) strand; PAM type: NRG; PAM sequence: AAG
tctctcaattaccctggggg

SEQ ID NO: 106495 - DNA, 20 bp, Artificial Sequence
  Description of Artificial Sequence: Synthetic oligonucleotide
  Target: ATXN1; (+) strand; PAM type: NRG; PAM sequence: CAG
tgtcctccgacctgtcttaa

SEQ ID NO: 106496 - DNA, 20 bp, Artificial Sequence
  Description of Artificial Sequence: Synthetic oligonucleotide
  Target: ATXN1; (+) strand; PAM type: NRG; PAM sequence: CAG
ccgacctgtcttaacagaca

SEQ ID NO: 106497 - DNA, 20 bp, Artificial Sequence
  Description of Artificial Sequence: Synthetic oligonucleotide
  Target: ATXN1; (+) strand; PAM type: NRG; PAM sequence: TAG
tcttaacagacacagacaca

SEQ ID NO: 106498 - DNA, 20 bp, Artificial Sequence
  Description of Artificial Sequence: Synthetic oligonucleotide
  Target: ATXN1; (+) strand; PAM type: NRG; PAM sequence: TAG
agacacatagcataattcaa

SEQ ID NO: 106499 - DNA, 20 bp, Artificial Sequence
  Description of Artificial Sequence: Synthetic oligonucleotide
  Target: ATXN1; (+) strand; PAM type: NRG; PAM sequence: TAG
ttcaatagtgctgctgttat

SEQ ID NO: 106500 - DNA, 20 bp, Artificial Sequence
  Description of Artificial Sequence: Synthetic oligonucleotide
  Target: ATXN1; (+) strand; PAM type: NRG; PAM sequence: CAG
aatagtgctgctgttattag

SEQ ID NO: 106501 - DNA, 20 bp, Artificial Sequence
  Description of Artificial Sequence: Synthetic oligonucleotide
  Target: ATXN1; (+) strand; PAM type: NRG; PAM sequence: GAG
ttagcagcctctgtgaaccc

SEQ ID NO: 106502 - DNA, 20 bp, Artificial Sequence
  Description of Artificial Sequence: Synthetic oligonucleotide
  Target: ATXN1; (+) strand; PAM type: NRG; PAM sequence: AAG
acccgagtaaccttgcatac

SEQ ID NO: 106503 - DNA, 20 bp, Artificial Sequence
  Description of Artificial Sequence: Synthetic oligonucleotide
  Target: ATXN1; (+) strand; PAM type: NRG; PAM sequence: TGG
aaccttgcatacaagtctca

SEQ ID NO: 106504 - DNA, 20 bp, Artificial Sequence
  Description of Artificial Sequence: Synthetic oligonucleotide
  Target: ATXN1; (+) strand; PAM type: NRG; PAM sequence: AAG
ttgcatacaagtctcatgga

SEQ ID NO: 106505 - DNA, 20 bp, Artificial Sequence
  Description of Artificial Sequence: Synthetic oligonucleotide
  Target: ATXN1; (+) strand; PAM type: NRG; PAM sequence: CAG
catggaaagcacacatttgc

SEQ ID NO: 106506 - DNA, 20 bp, Artificial Sequence
  Description of Artificial Sequence: Synthetic oligonucleotide
  Target: ATXN1; (+) strand; PAM type: NRG; PAM sequence: TAG
attaatcattgacatattga

SEQ ID NO: 106507 - DNA, 20 bp, Artificial Sequence
  Description of Artificial Sequence: Synthetic oligonucleotide
  Target: ATXN1; (+) strand; PAM type: NRG; PAM sequence: TGG
tcattgacatattgatagtg

SEQ ID NO: 106508 - DNA, 20 bp, Artificial Sequence
  Description of Artificial Sequence: Synthetic oligonucleotide
  Target: ATXN1; (+) strand; PAM type: NRG; PAM sequence: GGG
cattgacatattgatagtgt

SEQ ID NO: 106509 - DNA, 20 bp, Artificial Sequence
  Description of Artificial Sequence: Synthetic oligonucleotide
  Target: ATXN1; (+) strand; PAM type: NRG; PAM sequence: GGG
attgacatattgatagtgtg

SEQ ID NO: 106510 - DNA, 20 bp, Artificial Sequence
  Description of Artificial Sequence: Synthetic oligonucleotide
  Target: ATXN1; (+) strand; PAM type: NRG; PAM sequence: GGG
ttgacatattgatagtgtgg

SEQ ID NO: 106511 - DNA, 20 bp, Artificial Sequence
  Description of Artificial Sequence: Synthetic oligonucleotide
  Target: ATXN1; (+) strand; PAM type: NRG; PAM sequence: TGG
aacactgcgtatgctgatac

SEQ ID NO: 106512 - DNA, 20 bp, Artificial Sequence
  Description of Artificial Sequence: Synthetic oligonucleotide
  Target: ATXN1; (+) strand; PAM type: NRG; PAM sequence: GGG
acactgcgtatgctgatact

SEQ ID NO: 106513 - DNA, 20 bp, Artificial Sequence
  Description of Artificial Sequence: Synthetic oligonucleotide
  Target: ATXN1; (+) strand; PAM type: NRG; PAM sequence: GGG
cactgcgtatgctgatactg

SEQ ID NO: 106514 - DNA, 20 bp, Artificial Sequence
  Description of Artificial Sequence: Synthetic oligonucleotide
  Target: ATXN1; (+) strand; PAM type: NRG; PAM sequence: GAG
ctgcgtatgctgatactggg

SEQ ID NO: 106515 - DNA, 20 bp, Artificial Sequence
  Description of Artificial Sequence: Synthetic oligonucleotide
  Target: ATXN1; (+) strand; PAM type: NRG; PAM sequence: AGG
tgcgtatgctgatactgggg

SEQ ID NO: 106516 - DNA, 20 bp, Artificial Sequence
  Description of Artificial Sequence: Synthetic oligonucleotide
  Target: ATXN1; (+) strand; PAM type: NRG; PAM sequence: GGG
gcgtatgctgatactgggga

SEQ ID NO: 106517 - DNA, 20 bp, Artificial Sequence
  Description of Artificial Sequence: Synthetic oligonucleotide
  Target: ATXN1; (+) strand; PAM type: NRG; PAM sequence: GGG
cgtatgctgatactggggag

SEQ ID NO: 106518 - DNA, 20 bp, Artificial Sequence
  Description of Artificial Sequence: Synthetic oligonucleotide
  Target: ATXN1; (+) strand; PAM type: NRG; PAM sequence: GGG
gtatgctgatactggggagg

SEQ ID NO: 106519 - DNA, 20 bp, Artificial Sequence
  Description of Artificial Sequence: Synthetic oligonucleotide
  Target: ATXN1; (+) strand; PAM type: NRG; PAM sequence: CAG
tgctgatactggggaggggg

SEQ ID NO: 106520 - DNA, 20 bp, Artificial Sequence
  Description of Artificial Sequence: Synthetic oligonucleotide
  Target: ATXN1; (+) strand; PAM type: NRG; PAM sequence: GAG
ctgatactggggagggggca

SEQ ID NO: 106521 - DNA, 20 bp, Artificial Sequence
  Description of Artificial Sequence: Synthetic oligonucleotide
  Target: ATXN1; (+) strand; PAM type: NRG; PAM sequence: TGG
tactggggagggggcagaga

SEQ ID NO: 106522 - DNA, 20 bp, Artificial Sequence
  Description of Artificial Sequence: Synthetic oligonucleotide
  Target: ATXN1; (+) strand; PAM type: NRG; PAM sequence: GGG
actggggagggggcagagat

SEQ ID NO: 106523 - DNA, 20 bp, Artificial Sequence
  Description of Artificial Sequence: Synthetic oligonucleotide
  Target: ATXN1; (+) strand; PAM type: NRG; PAM sequence: AAG
gggagggggcagagatggga

SEQ ID NO: 106524 - DNA, 20 bp, Artificial Sequence
  Description of Artificial Sequence: Synthetic oligonucleotide
  Target: ATXN1; (+) strand; PAM type: NRG; PAM sequence: AGG
ggagggggcagagatgggaa

SEQ ID NO: 106525 - DNA, 20 bp, Artificial Sequence
  Description of Artificial Sequence: Synthetic oligonucleotide
  Target: ATXN1; (+) strand; PAM type: NRG; PAM sequence: GGG
gagggggcagagatgggaaa

SEQ ID NO: 106526 - DNA, 20 bp, Artificial Sequence
  Description of Artificial Sequence: Synthetic oligonucleotide
  Target: ATXN1; (+) strand; PAM type: NRG; PAM sequence: GGG
agggggcagagatgggaaag

SEQ ID NO: 106527 - DNA, 20 bp, Artificial Sequence
  Description of Artificial Sequence: Synthetic oligonucleotide
  Target: ATXN1; (+) strand; PAM type: NRG; PAM sequence: CAG
gggcagagatgggaaagggg

SEQ ID NO: 106528 - DNA, 20 bp, Artificial Sequence
  Description of Artificial Sequence: Synthetic oligonucleotide
  Target: ATXN1; (+) strand; PAM type: NRG; PAM sequence: AAG
aggggcagttataaattgct

SEQ ID NO: 106529 - DNA, 20 bp, Artificial Sequence
  Description of Artificial Sequence: Synthetic oligonucleotide
  Target: ATXN1; (+) strand; PAM type: NRG; PAM sequence: CAG
taagttattgtgtttatatt

SEQ ID NO: 106530 - DNA, 20 bp, Artificial Sequence
  Description of Artificial Sequence: Synthetic oligonucleotide
  Target: ATXN1; (+) strand; PAM type: NRG; PAM sequence: CAG
tttatattcagcacatcttg

SEQ ID NO: 106531 - DNA, 20 bp, Artificial Sequence
  Description of Artificial Sequence: Synthetic oligonucleotide
  Target: ATXN1; (+) strand; PAM type: NRG; PAM sequence: AAG
attcagcacatcttgcagcc

SEQ ID NO: 106532 - DNA, 20 bp, Artificial Sequence
  Description of Artificial Sequence: Synthetic oligonucleotide
  Target: ATXN1; (+) strand; PAM type: NRG; PAM sequence: CAG
cacacacacacacacacata

SEQ ID NO: 106533 - DNA, 20 bp, Artificial Sequence
  Description of Artificial Sequence: Synthetic oligonucleotide
  Target: ATXN1; (+) strand; PAM type: NRG; PAM sequence: CAG
catacagacacacacacaat

SEQ ID NO: 106534 - DNA, 20 bp, Artificial Sequence
  Description of Artificial Sequence: Synthetic oligonucleotide
  Target: ATXN1; (+) strand; PAM type: NRG; PAM sequence: AAG
acacacacacaatcagtgta

SEQ ID NO: 106535 - DNA, 20 bp, Artificial Sequence
  Description of Artificial Sequence: Synthetic oligonucleotide
  Target: ATXN1; (+) strand; PAM type: NRG; PAM sequence: TGG
taaagattctgacctatgcc

SEQ ID NO: 106536 - DNA, 20 bp, Artificial Sequence
  Description of Artificial Sequence: Synthetic oligonucleotide
  Target: ATXN1; (+) strand; PAM type: NRG; PAM sequence: AAG
atgcctggaaatacaatcct

SEQ ID NO: 106537 - DNA, 20 bp, Artificial Sequence
  Description of Artificial Sequence: Synthetic oligonucleotide
  Target: ATXN1; (+) strand; PAM type: NRG; PAM sequence: TAG
tggaaatacaatcctaagtc

SEQ ID NO: 106538 - DNA, 20 bp, Artificial Sequence
  Description of Artificial Sequence: Synthetic oligonucleotide
  Target: ATXN1; (+) strand; PAM type: NRG; PAM sequence: AAG
tacaatcctaagtctagata

SEQ ID NO: 106539 - DNA, 20 bp, Artificial Sequence
  Description of Artificial Sequence: Synthetic oligonucleotide
  Target: ATXN1; (+) strand; PAM type: NRG; PAM sequence: AGG
acaatcctaagtctagataa

SEQ ID NO: 106540 - DNA, 20 bp, Artificial Sequence
  Description of Artificial Sequence: Synthetic oligonucleotide
  Target: ATXN1; (+) strand; PAM type: NRG; PAM sequence: GGG
caatcctaagtctagataaa

SEQ ID NO: 106541 - DNA, 20 bp, Artificial Sequence
  Description of Artificial Sequence: Synthetic oligonucleotide
  Target: ATXN1; (+) strand; PAM type: NRG; PAM sequence: GGG
aatcctaagtctagataaag

SEQ ID NO: 106542 - DNA, 20 bp, Artificial Sequence
  Description of Artificial Sequence: Synthetic oligonucleotide
  Target: ATXN1; (+) strand; PAM type: NRG; PAM sequence: GAG
tcctaagtctagataaaggg

SEQ ID NO: 106543 - DNA, 20 bp, Artificial Sequence
  Description of Artificial Sequence: Synthetic oligonucleotide
  Target: ATXN1; (+) strand; PAM type: NRG; PAM sequence: GAG
ctaagtctagataaagggga

SEQ ID NO: 106544 - DNA, 20 bp, Artificial Sequence
  Description of Artificial Sequence: Synthetic oligonucleotide
  Target: ATXN1; (+) strand; PAM type: NRG; PAM sequence: AAG
gataaaggggagagctaatg

SEQ ID NO: 106545 - DNA, 20 bp, Artificial Sequence
  Description of Artificial Sequence: Synthetic oligonucleotide
  Target: ATXN1; (+) strand; PAM type: NRG; PAM sequence: AGG
ataaaggggagagctaatga

SEQ ID NO: 106546 - DNA, 20 bp, Artificial Sequence
  Description of Artificial Sequence: Synthetic oligonucleotide
  Target: ATXN1; (+) strand; PAM type: NRG; PAM sequence: CAG
ggagagctaatgaaggctca

SEQ ID NO: 106547 - DNA, 20 bp, Artificial Sequence
  Description of Artificial Sequence: Synthetic oligonucleotide
  Target: ATXN1; (+) strand; PAM type: NRG; PAM sequence: AAG
ctaatgaaggctcacagttg

SEQ ID NO: 106548 - DNA, 20 bp, Artificial Sequence
  Description of Artificial Sequence: Synthetic oligonucleotide
  Target: ATXN1; (+) strand; PAM type: NRG; PAM sequence: CAG
ttgtctgatttgtacacacc

SEQ ID NO: 106549 - DNA, 20 bp, Artificial Sequence
  Description of Artificial Sequence: Synthetic oligonucleotide
  Target: ATXN1; (+) strand; PAM type: NRG; PAM sequence: CAG
gtacacacccagcacacatt

SEQ ID NO: 106550 - DNA, 20 bp, Artificial Sequence
  Description of Artificial Sequence: Synthetic oligonucleotide
  Target: ATXN1; (+) strand; PAM type: NRG; PAM sequence: TAG
cacattcagactcgattgta

SEQ ID NO: 106551 - DNA, 20 bp, Artificial Sequence
  Description of Artificial Sequence: Synthetic oligonucleotide
  Target: ATXN1; (+) strand; PAM type: NRG; PAM sequence: AGG
acattcagactcgattgtat

SEQ ID NO: 106552 - DNA, 20 bp, Artificial Sequence
  Description of Artificial Sequence: Synthetic oligonucleotide
  Target: ATXN1; (+) strand; PAM type: NRG; PAM sequence: CAG
ttgtataggtcaaattttcc

SEQ ID NO: 106553 - DNA, 20 bp, Artificial Sequence
  Description of Artificial Sequence: Synthetic oligonucleotide
  Target: ATXN1; (+) strand; PAM type: NRG; PAM sequence: CGG
ttcccagaaacatgcgatca

SEQ ID NO: 106554 - DNA, 20 bp, Artificial Sequence
  Description of Artificial Sequence: Synthetic oligonucleotide
  Target: ATXN1; (+) strand; PAM type: NRG; PAM sequence: GAG
acatgcgatcacggcttttt

SEQ ID NO: 106555 - DNA, 20 bp, Artificial Sequence
  Description of Artificial Sequence: Synthetic oligonucleotide
  Target: ATXN1; (+) strand; PAM type: NRG; PAM sequence: TGG
ctttttgagctcaaaacctg

SEQ ID NO: 106556 - DNA, 20 bp, Artificial Sequence
  Description of Artificial Sequence: Synthetic oligonucleotide
  Target: ATXN1; (+) strand; PAM type: NRG; PAM sequence: TAG
cccactttccttcttttcct

SEQ ID NO: 106557 - DNA, 20 bp, Artificial Sequence
  Description of Artificial Sequence: Synthetic oligonucleotide
  Target: ATXN1; (+) strand; PAM type: NRG; PAM sequence: AAG
actttccttcttttccttag

SEQ ID NO: 106558 - DNA, 20 bp, Artificial Sequence
  Description of Artificial Sequence: Synthetic oligonucleotide
  Target: ATXN1; (+) strand; PAM type: NRG; PAM sequence: TAG
ttccttcttttccttagaag

SEQ ID NO: 106559 - DNA, 20 bp, Artificial Sequence
  Description of Artificial Sequence: Synthetic oligonucleotide
  Target: ATXN1; (+) strand; PAM type: NRG; PAM sequence: TGG
ttccttagaagtagaaacct

SEQ ID NO: 106560 - DNA, 20 bp, Artificial Sequence
  Description of Artificial Sequence: Synthetic oligonucleotide
  Target: ATXN1; (+) strand; PAM type: NRG; PAM sequence: GAG
gaagtagaaaccttggtttt

SEQ ID NO: 106561 - DNA, 20 bp, Artificial Sequence
  Description of Artificial Sequence: Synthetic oligonucleotide
  Target: ATXN1; (+) strand; PAM type: NRG; PAM sequence: AGG
aagtagaaaccttggttttg

SEQ ID NO: 106562 - DNA, 20 bp, Artificial Sequence
  Description of Artificial Sequence: Synthetic oligonucleotide
  Target: ATXN1; (+) strand; PAM type: NRG; PAM sequence: TAG
tagaaaccttggttttgagg

SEQ ID NO: 106563 - DNA, 20 bp, Artificial Sequence
  Description of Artificial Sequence: Synthetic oligonucleotide
  Target: ATXN1; (+) strand; PAM type: NRG; PAM sequence: AAG
tgatcttcttcttgccttgc

SEQ ID NO: 106564 - DNA, 20 bp, Artificial Sequence
  Description of Artificial Sequence: Synthetic oligonucleotide
  Target: ATXN1; (+) strand; PAM type: NRG; PAM sequence: AAG
tcttcttcttgccttgcaag

SEQ ID NO: 106565 - DNA, 20 bp, Artificial Sequence
  Description of Artificial Sequence: Synthetic oligonucleotide
  Target: ATXN1; (+) strand; PAM type: NRG; PAM sequence: AGG
cttcttcttgccttgcaaga

SEQ ID NO: 106566 - DNA, 20 bp, Artificial Sequence
  Description of Artificial Sequence: Synthetic oligonucleotide
  Target: ATXN1; (+) strand; PAM type: NRG; PAM sequence: TAG
gccttgcaagaaggtatgcc

SEQ ID NO: 106567 - DNA, 20 bp, Artificial Sequence
  Description of Artificial Sequence: Synthetic oligonucleotide
  Target: ATXN1; (+) strand; PAM type: NRG; PAM sequence: AAG
gaaggtatgcctagacttgc

SEQ ID NO: 106568 - DNA, 20 bp, Artificial Sequence
  Description of Artificial Sequence: Synthetic oligonucleotide
  Target: ATXN1; (+) strand; PAM type: NRG; PAM sequence: AAG
ggtatgcctagacttgcaag

SEQ ID NO: 106569 - DNA, 20 bp, Artificial Sequence
  Description of Artificial Sequence: Synthetic oligonucleotide
  Target: ATXN1; (+) strand; PAM type: NRG; PAM sequence: AGG
gtatgcctagacttgcaaga

SEQ ID NO: 106570 - DNA, 20 bp, Artificial Sequence
  Description of Artificial Sequence: Synthetic oligonucleotide
  Target: ATXN1; (+) strand; PAM type: NRG; PAM sequence: TAG
gacttgcaagaaggtatgcc

SEQ ID NO: 106571 - DNA, 20 bp, Artificial Sequence
  Description of Artificial Sequence: Synthetic oligonucleotide
  Target: ATXN1; (+) strand; PAM type: NRG; PAM sequence: CAG
agaaggtatgcctagccttg

SEQ ID NO: 106572 - DNA, 20 bp, Artificial Sequence
  Description of Artificial Sequence: Synthetic oligonucleotide
  Target: ATXN1; (+) strand; PAM type: NRG; PAM sequence: TAG
ggtatgcctagccttgcagc

SEQ ID NO: 106573 - DNA, 20 bp, Artificial Sequence
  Description of Artificial Sequence: Synthetic oligonucleotide
  Target: ATXN1; (+) strand; PAM type: NRG; PAM sequence: AGG
gtatgcctagccttgcagct

SEQ ID NO: 106574 - DNA, 20 bp, Artificial Sequence
  Description of Artificial Sequence: Synthetic oligonucleotide
  Target: ATXN1; (+) strand; PAM type: NRG; PAM sequence: TAG
gccttgcagctaggtatgcc

SEQ ID NO: 106575 - DNA, 20 bp, Artificial Sequence
  Description of Artificial Sequence: Synthetic oligonucleotide
  Target: ATXN1; (+) strand; PAM type: NRG; PAM sequence: AAG
actaaattcttgttgacatg

SEQ ID NO: 106576 - DNA, 20 bp, Artificial Sequence
  Description of Artificial Sequence: Synthetic oligonucleotide
  Target: ATXN1; (+) strand; PAM type: NRG; PAM sequence: TGG
acatgaagtaaacaaaaatg

SEQ ID NO: 106577 - DNA, 20 bp, Artificial Sequence
  Description of Artificial Sequence: Synthetic oligonucleotide
  Target: ATXN1; (+) strand; PAM type: NRG; PAM sequence: TGG
aagtaaacaaaaatgtggta

SEQ ID NO: 106578 - DNA, 20 bp, Artificial Sequence
  Description of Artificial Sequence: Synthetic oligonucleotide
  Target: ATXN1; (+) strand; PAM type: NRG; PAM sequence: TGG
aaaatgtggtatggttcctc

SEQ ID NO: 106579 - DNA, 20 bp, Artificial Sequence
  Description of Artificial Sequence: Synthetic oligonucleotide
  Target: ATXN1; (+) strand; PAM type: NRG; PAM sequence: AAG
tgtggtatggttcctctggc

SEQ ID NO: 106580 - DNA, 20 bp, Artificial Sequence
  Description of Artificial Sequence: Synthetic oligonucleotide
  Target: ATXN1; (+) strand; PAM type: NRG; PAM sequence: TGG
gttcctctggcaagtgtctt

SEQ ID NO: 106581 - DNA, 20 bp, Artificial Sequence
  Description of Artificial Sequence: Synthetic oligonucleotide
  Target: ATXN1; (+) strand; PAM type: NRG; PAM sequence: AAG
ctctggcaagtgtctttgga

SEQ ID NO: 106582 - DNA, 20 bp, Artificial Sequence
  Description of Artificial Sequence: Synthetic oligonucleotide
  Target: ATXN1; (+) strand; PAM type: NRG; PAM sequence: AGG
tctggcaagtgtctttggaa

SEQ ID NO: 106583 - DNA, 20 bp, Artificial Sequence
  Description of Artificial Sequence: Synthetic oligonucleotide
  Target: ATXN1; (+) strand; PAM type: NRG; PAM sequence: GGG
ctggcaagtgtctttggaaa

SEQ ID NO: 106584 - DNA, 20 bp, Artificial Sequence
  Description of Artificial Sequence: Synthetic oligonucleotide
  Target: ATXN1; (+) strand; PAM type: NRG; PAM sequence: GGG
tggcaagtgtctttggaaag

SEQ ID NO: 106585 - DNA, 20 bp, Artificial Sequence
  Description of Artificial Sequence: Synthetic oligonucleotide
  Target: ATXN1; (+) strand; PAM type: NRG; PAM sequence: GGG
ggcaagtgtctttggaaagg

SEQ ID NO: 106586 - DNA, 20 bp, Artificial Sequence
  Description of Artificial Sequence: Synthetic oligonucleotide
  Target: ATXN1; (+) strand; PAM type: NRG; PAM sequence: TAG
aagtgtctttggaaaggggg

SEQ ID NO: 106587 - DNA, 20 bp, Artificial Sequence
  Description of Artificial Sequence: Synthetic oligonucleotide
  Target: ATXN1; (+) strand; PAM type: NRG; PAM sequence: AGG
agtgtctttggaaagggggt

SEQ ID NO: 106588 - DNA, 20 bp, Artificial Sequence
  Description of Artificial Sequence: Synthetic oligonucleotide
  Target: ATXN1; (+) strand; PAM type: NRG; PAM sequence: TGG
tcttcctcctttctgctttc

SEQ ID NO: 106589 - DNA, 20 bp, Artificial Sequence
  Description of Artificial Sequence: Synthetic oligonucleotide
  Target: ATXN1; (+) strand; PAM type: NRG; PAM sequence: TGG
ctcctttctgctttctggaa

SEQ ID NO: 106590 - DNA, 20 bp, Artificial Sequence
  Description of Artificial Sequence: Synthetic oligonucleotide
  Target: ATXN1; (+) strand; PAM type: NRG; PAM sequence: AAG
tttctggaatggtaatgtta

SEQ ID NO: 106591 - DNA, 20 bp, Artificial Sequence
  Description of Artificial Sequence: Synthetic oligonucleotide
  Target: ATXN1; (+) strand; PAM type: NRG; PAM sequence: AGG
ttctggaatggtaatgttaa

SEQ ID NO: 106592 - DNA, 20 bp, Artificial Sequence
  Description of Artificial Sequence: Synthetic oligonucleotide
  Target: ATXN1; (+) strand; PAM type: NRG; PAM sequence: TAG
ggaatggtaatgttaaaggc

SEQ ID NO: 106593 - DNA, 20 bp, Artificial Sequence
  Description of Artificial Sequence: Synthetic oligonucleotide
  Target: ATXN1; (+) strand; PAM type: NRG; PAM sequence: GAG
aatggtaatgttaaaggcta

SEQ ID NO: 106594 - DNA, 20 bp, Artificial Sequence
  Description of Artificial Sequence: Synthetic oligonucleotide
  Target: ATXN1; (+) strand; PAM type: NRG; PAM sequence: CAG
tgttaaaggctagagctatg

SEQ ID NO: 106595 - DNA, 20 bp, Artificial Sequence
  Description of Artificial Sequence: Synthetic oligonucleotide
  Target: ATXN1; (+) strand; PAM type: NRG; PAM sequence: GAG
tatgcagccatcttgtatgt

SEQ ID NO: 106596 - DNA, 20 bp, Artificial Sequence
  Description of Artificial Sequence: Synthetic oligonucleotide
  Target: ATXN1; (+) strand; PAM type: NRG; PAM sequence: TAG
gccatcttgtatgtgagaca

SEQ ID NO: 106597 - DNA, 20 bp, Artificial Sequence
  Description of Artificial Sequence: Synthetic oligonucleotide
  Target: ATXN1; (+) strand; PAM type: NRG; PAM sequence: AGG
ccatcttgtatgtgagacat

SEQ ID NO: 106598 - DNA, 20 bp, Artificial Sequence
  Description of Artificial Sequence: Synthetic oligonucleotide
  Target: ATXN1; (+) strand; PAM type: NRG; PAM sequence: GAG
ttgtatgtgagacataggct

SEQ ID NO: 106599 - DNA, 20 bp, Artificial Sequence
  Description of Artificial Sequence: Synthetic oligonucleotide
  Target: ATXN1; (+) strand; PAM type: NRG; PAM sequence: AGG
tgtatgtgagacataggctg

SEQ ID NO: 106600 - DNA, 20 bp, Artificial Sequence
  Description of Artificial Sequence: Synthetic oligonucleotide
  Target: ATXN1; (+) strand; PAM type: NRG; PAM sequence: CGG
atgtgagacataggctgagg

SEQ ID NO: 106601 - DNA, 20 bp, Artificial Sequence
  Description of Artificial Sequence: Synthetic oligonucleotide
  Target: ATXN1; (+) strand; PAM type: NRG; PAM sequence: GGG
tgtgagacataggctgaggc

SEQ ID NO: 106602 - DNA, 20 bp, Artificial Sequence
  Description of Artificial Sequence: Synthetic oligonucleotide
  Target: ATXN1; (+) strand; PAM type: NRG; PAM sequence: GAG
ctgaggcgggtgcatcactt

SEQ ID NO: 106603 - DNA, 20 bp, Artificial Sequence
  Description of Artificial Sequence: Synthetic oligonucleotide
  Target: ATXN1; (+) strand; PAM type: NRG; PAM sequence: AGG
tgaggcgggtgcatcacttg

SEQ ID NO: 106604 - DNA, 20 bp, Artificial Sequence
  Description of Artificial Sequence: Synthetic oligonucleotide
  Target: ATXN1; (+) strand; PAM type: NRG; PAM sequence: CAG
gcgggtgcatcacttgaggt

SEQ ID NO: 106605 - DNA, 20 bp, Artificial Sequence
  Description of Artificial Sequence: Synthetic oligonucleotide
  Target: ATXN1; (+) strand; PAM type: NRG; PAM sequence: AGG
cgggtgcatcacttgaggtc

SEQ ID NO: 106606 - DNA, 20 bp, Artificial Sequence
  Description of Artificial Sequence: Synthetic oligonucleotide
  Target: ATXN1; (+) strand; PAM type: NRG; PAM sequence: GAG
ggtgcatcacttgaggtcag

SEQ ID NO: 106607 - DNA, 20 bp, Artificial Sequence
  Description of Artificial Sequence: Synthetic oligonucleotide
  Target: ATXN1; (+) strand; PAM type: NRG; PAM sequence: GAG
tcacttgaggtcaggagttc

SEQ ID NO: 106608 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagttcgagac

SEQ ID NO: 106609 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcgagaccagct

SEQ ID NO: 106610 - DNA, 20 bp, Artificial Sequence
  Description of Artificial Sequence: Synthetic oligonucleotide
  Target: ATXN1; (+) strand; PAM type: NRG; PAM sequence: TAG
actaaaaaatacataaaaat

SEQ ID NO: 106611 - DNA, 20 bp, Artificial Sequence
  Description of Artificial Sequence: Synthetic oligonucleotide
  Target: ATXN1; (+) strand; PAM type: NRG; PAM sequence: CAG
aaaaatacataaaaattagc

SEQ ID NO: 106612 - DNA, 20 bp, Artificial Sequence
  Description of Artificial Sequence: Synthetic oligonucleotide
  Target: ATXN1; (+) strand; PAM type: NRG; PAM sequence: TGG
taaaaattagccagacatgt

SEQ ID NO: 106613 - DNA, 20 bp, Artificial Sequence
  Description of Artificial Sequence: Synthetic oligonucleotide
  Target: ATXN1; (+) strand; PAM type: NRG; PAM sequence: TAG
gacatgttggtgcgcacctg

SEQ ID NO: 106614 - DNA, 20 bp, Artificial Sequence
  Description of Artificial Sequence: Synthetic oligonucleotide
  Target: ATXN1; (+) strand; PAM type: NRG; PAM sequence: CAG
ttggtgcgcacctgtagtcc

SEQ ID NO: 106615 - DNA, 20 bp, Artificial Sequence
  Description of Artificial Sequence: Synthetic oligonucleotide
  Target: ATXN1; (+) strand; PAM type: NRG; PAM sequence: CGG
cacctgtagtcccagttact

SEQ ID NO: 106616 - DNA, 20 bp, Artificial Sequence
  Description of Artificial Sequence: Synthetic oligonucleotide
  Target: ATXN1; (+) strand; PAM type: NRG; PAM sequence: GGG
acctgtagtcccagttactc

SEQ ID NO: 106617 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagttactcgg

SEQ ID NO: 106618 - DNA, 20 bp, Artificial Sequence
  Description of Artificial Sequence: Synthetic oligonucleotide
  Target: ATXN1; (+) strand; PAM type: NRG; PAM sequence: GAG
tcccagttactcgggagcct

SEQ ID NO: 106619 - DNA, 20 bp, Artificial Sequence
  Description of Artificial Sequence: Synthetic oligonucleotide
  Target: ATXN1; (+) strand; PAM type: NRG; PAM sequence: AGG
cccagttactcgggagcctg

SEQ ID NO: 106620 - DNA, 20 bp, Artificial Sequence
  Description of Artificial Sequence: Synthetic oligonucleotide
  Target: ATXN1; (+) strand; PAM type: NRG; PAM sequence: CAG
agttactcgggagcctgagg

SEQ ID NO: 106621 - DNA, 20 bp, Artificial Sequence
  Description of Artificial Sequence: Synthetic oligonucleotide
  Target: ATXN1; (+) strand; PAM type: NRG; PAM sequence: AGG
gttactcgggagcctgaggc

SEQ ID NO: 106622 - DNA, 20 bp, Artificial Sequence
  Description of Artificial Sequence: Synthetic oligonucleotide
  Target: ATXN1; (+) strand; PAM type: NRG; PAM sequence: AAG
caggacaattgctcgaaccc

SEQ ID NO: 106623 - DNA, 20 bp, Artificial Sequence
  Description of Artificial Sequence: Synthetic oligonucleotide
  Target: ATXN1; (+) strand; PAM type: NRG; PAM sequence: GAG
ggacaattgctcgaacccaa

SEQ ID NO: 106624 - DNA, 20 bp, Artificial Sequence
  Description of Artificial Sequence: Synthetic oligonucleotide
  Target: ATXN1; (+) strand; PAM type: NRG; PAM sequence: AGG
gacaattgctcgaacccaag

SEQ ID NO: 106625 - DNA, 20 bp, Artificial Sequence
  Description of Artificial Sequence: Synthetic oligonucleotide
  Target: ATXN1; (+) strand; PAM type: NRG; PAM sequence: AAG
aattgctcgaacccaagagg

SEQ ID NO: 106626 - DNA, 20 bp, Artificial Sequence
  Description of Artificial Sequence: Synthetic oligonucleotide
  Target: ATXN1; (+) strand; PAM type: NRG; PAM sequence: GAG
ttgctcgaacccaagaggaa

SEQ ID NO: 106627 - DNA, 20 bp, Artificial Sequence
  Description of Artificial Sequence: Synthetic oligonucleotide
  Target: ATXN1; (+) strand; PAM type: NRG; PAM sequence: AGG
tgctcgaacccaagaggaag

SEQ ID NO: 106628 - DNA, 20 bp, Artificial Sequence
  Description of Artificial Sequence: Synthetic oligonucleotide
  Target: ATXN1; (+) strand; PAM type: NRG; PAM sequence: CAG
aacccaagaggaagaggttg

SEQ ID NO: 106629 - DNA, 20 bp, Artificial Sequence
  Description of Artificial Sequence: Synthetic oligonucleotide
  Target: ATXN1; (+) strand; PAM type: NRG; PAM sequence: GAG
caagaggaagaggttgcagt

SEQ ID NO: 106630 - DNA, 20 bp, Artificial Sequence
  Description of Artificial Sequence: Synthetic oligonucleotide
  Target: ATXN1; (+) strand; PAM type: NRG; PAM sequence: CAG
gaaatcatgccactgcactc

SEQ ID NO: 106631 - DNA, 20 bp, Artificial Sequence
  Description of Artificial Sequence: Synthetic oligonucleotide
  Target: ATXN1; (+) strand; PAM type: NRG; PAM sequence: TGG
catgccactgcactccagcc

SEQ ID NO: 106632 - DNA, 20 bp, Artificial Sequence
  Description of Artificial Sequence: Synthetic oligonucleotide
  Target: ATXN1; (+) strand; PAM type: NRG; PAM sequence: GGG
atgccactgcactccagcct

SEQ ID NO: 106633 - DNA, 20 bp, Artificial Sequence
  Description of Artificial Sequence: Synthetic oligonucleotide
  Target: ATXN1; (+) strand; PAM type: NRG; PAM sequence: GAG
gccactgcactccagcctgg

SEQ ID NO: 106634 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggaga

SEQ ID NO: 106635 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggagaca

SEQ ID NO: 106636 - DNA, 20 bp, Artificial Sequence
  Description of Artificial Sequence: Synthetic oligonucleotide
  Target: ATXN1; (+) strand; PAM type: NRG; PAM sequence: AAG
tccagcctgggagacagagc

SEQ ID NO: 106637 - DNA, 20 bp, Artificial Sequence
  Description of Artificial Sequence: Synthetic oligonucleotide
  Target: ATXN1; (+) strand; PAM type: NRG; PAM sequence: AAG
gaatctgtctcaaaaaaaaa

SEQ ID NO: 106638 - DNA, 20 bp, Artificial Sequence
  Description of Artificial Sequence: Synthetic oligonucleotide
  Target: ATXN1; (+) strand; PAM type: NRG; PAM sequence: AAG
ctgtctcaaaaaaaaaaaga

SEQ ID NO: 106639 - DNA, 20 bp, Artificial Sequence
  Description of Artificial Sequence: Synthetic oligonucleotide
  Target: ATXN1; (+) strand; PAM type: NRG; PAM sequence: AAG
tcaaaaaaaaaaagaaagaa

SEQ ID NO: 106640 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaagaaagaaaagaa

SEQ ID NO: 106641 - DNA, 20 bp, Artificial Sequence
  Description of Artificial Sequence: Synthetic oligonucleotide
  Target: ATXN1; (+) strand; PAM type: NRG; PAM sequence: CAG
aaaagaaaagaaatatacta

SEQ ID NO: 106642 - DNA, 20 bp, Artificial Sequence
  Description of Artificial Sequence: Synthetic oligonucleotide
  Target: ATXN1; (+) strand; PAM type: NRG; PAM sequence: TGG
aaaagaaatatactacagca

SEQ ID NO: 106643 - DNA, 20 bp, Artificial Sequence
  Description of Artificial Sequence: Synthetic oligonucleotide
  Target: ATXN1; (+) strand; PAM type: NRG; PAM sequence: CAG
agaaatatactacagcatgg

SEQ ID NO: 106644 - DNA, 20 bp, Artificial Sequence
  Description of Artificial Sequence: Synthetic oligonucleotide
  Target: ATXN1; (+) strand; PAM type: NRG; PAM sequence: TAG
tatactacagcatggcagaa

SEQ ID NO: 106645 - DNA, 20 bp, Artificial Sequence
  Description of Artificial Sequence: Synthetic oligonucleotide
  Target: ATXN1; (+) strand; PAM type: NRG; PAM sequence: AAG
ctacagcatggcagaataga

SEQ ID NO: 106646 - DNA, 20 bp, Artificial Sequence
  Description of Artificial Sequence: Synthetic oligonucleotide
  Target: ATXN1; (+) strand; PAM type: NRG; PAM sequence: AGG
tacagcatggcagaatagaa

SEQ ID NO: 106647 - DNA, 20 bp, Artificial Sequence
  Description of Artificial Sequence: Synthetic oligonucleotide
  Target: ATXN1; (+) strand; PAM type: NRG; PAM sequence: GAG
agaaaggtgacaatgtttct

SEQ ID NO: 106648 - DNA, 20 bp, Artificial Sequence
  Description of Artificial Sequence: Synthetic oligonucleotide
  Target: ATXN1; (+) strand; PAM type: NRG; PAM sequence: CAG
acaatgtttctgagcctgtg

SEQ ID NO: 106649 - DNA, 20 bp, Artificial Sequence
  Description of Artificial Sequence: Synthetic oligonucleotide
  Target: ATXN1; (+) strand; PAM type: NRG; PAM sequence: TGG
tgcagtgaccataatcaccc

SEQ ID NO: 106650 - DNA, 20 bp, Artificial Sequence
  Description of Artificial Sequence: Synthetic oligonucleotide
  Target: ATXN1; (+) strand; PAM type: NRG; PAM sequence: GAG
tctcaaaaccacttttatgt

SEQ ID NO: 106651 - DNA, 20 bp, Artificial Sequence
  Description of Artificial Sequence: Synthetic oligonucleotide
  Target: ATXN1; (+) strand; PAM type: NRG; PAM sequence: GAG
tcaaaaccacttttatgtga

SEQ ID NO: 106652 - DNA, 20 bp, Artificial Sequence
  Description of Artificial Sequence: Synthetic oligonucleotide
  Target: ATXN1; (+) strand; PAM type: NRG; PAM sequence: TGG
aaaataaatgtctatttctt

SEQ ID NO: 106653 - DNA, 20 bp, Artificial Sequence
  Description of Artificial Sequence: Synthetic oligonucleotide
  Target: ATXN1; (+) strand; PAM type: NRG; PAM sequence: TGG
tttttttttttttttttttt

SEQ ID NO: 106654 - DNA, 20 bp, Artificial Sequence
  Description of Artificial Sequence: Synthetic oligonucleotide
  Target: ATXN1; (+) strand; PAM type: NRG; PAM sequence: TGG
tttttttttttttggtgata

SEQ ID NO: 106655 - DNA, 20 bp, Artificial Sequence
  Description of Artificial Sequence: Synthetic oligonucleotide
  Target: ATXN1; (+) strand; PAM type: NRG; PAM sequence: TAG
ctaatcctaactgttacaaa

SEQ ID NO: 106656 - DNA, 20 bp, Artificial Sequence
  Description of Artificial Sequence: Synthetic oligonucleotide
  Target: ATXN1; (+) strand; PAM type: NRG; PAM sequence: TAG
taactgttacaaatagacct

SEQ ID NO: 106657 - DNA, 20 bp, Artificial Sequence
  Description of Artificial Sequence: Synthetic oligonucleotide
  Target: ATXN1; (+) strand; PAM type: NRG; PAM sequence: GAG
actgttacaaatagacctta

SEQ ID NO: 106658 - DNA, 20 bp, Artificial Sequence
  Description of Artificial Sequence: Synthetic oligonucleotide
  Target: ATXN1; (+) strand; PAM type: NRG; PAM sequence: AGG
ctgttacaaatagaccttag

SEQ ID NO: 106659 - DNA, 20 bp, Artificial Sequence
  Description of Artificial Sequence: Synthetic oligonucleotide
  Target: ATXN1; (+) strand; PAM type: NRG; PAM sequence: TAG
atagaccttagaggtcataa

SEQ ID NO: 106660 - DNA, 20 bp, Artificial Sequence
  Description of Artificial Sequence: Synthetic oligonucleotide
  Target: ATXN1; (+) strand; PAM type: NRG; PAM sequence: CAG
tcataatagacttcatttta

SEQ ID NO: 106661 - DNA, 20 bp, Artificial Sequence
  Description of Artificial Sequence: Synthetic oligonucleotide
  Target: ATXN1; (+) strand; PAM type: NRG; PAM sequence: TAG
atagacttcattttacagat

SEQ ID NO: 106662 - DNA, 20 bp, Artificial Sequence
  Description of Artificial Sequence: Synthetic oligonucleotide
  Target: ATXN1; (+) strand; PAM type: NRG; PAM sequence: AGG
tagacttcattttacagatt

SEQ ID NO: 106663 - DNA, 20 bp, Artificial Sequence
  Description of Artificial Sequence: Synthetic oligonucleotide
  Target: ATXN1; (+) strand; PAM type: NRG; PAM sequence: AAG
gattaggaaactaatgatta

SEQ ID NO: 106664 - DNA, 20 bp, Artificial Sequence
  Description of Artificial Sequence: Synthetic oligonucleotide
  Target: ATXN1; (+) strand; PAM type: NRG; PAM sequence: CGG
actttgataaatgtctcaat

SEQ ID NO: 106665 - DNA, 20 bp, Artificial Sequence
  Description of Artificial Sequence: Synthetic oligonucleotide
  Target: ATXN1; (+) strand; PAM type: NRG; PAM sequence: GGG
ctttgataaatgtctcaatc

SEQ ID NO: 106666 - DNA, 20 bp, Artificial Sequence
  Description of Artificial Sequence: Synthetic oligonucleotide
  Target: ATXN1; (+) strand; PAM type: NRG; PAM sequence: AAG
tgataaatgtctcaatcggg

SEQ ID NO: 106667 - DNA, 20 bp, Artificial Sequence
  Description of Artificial Sequence: Synthetic oligonucleotide
  Target: ATXN1; (+) strand; PAM type: NRG; PAM sequence: CAG
taaatgtctcaatcgggaag

SEQ ID NO: 106668 - DNA, 20 bp, Artificial Sequence
  Description of Artificial Sequence: Synthetic oligonucleotide
  Target: ATXN1; (+) strand; PAM type: NRG; PAM sequence: GAG
aatgtctcaatcgggaagca

SEQ ID NO: 106669 - DNA, 20 bp, Artificial Sequence
  Description of Artificial Sequence: Synthetic oligonucleotide
  Target: ATXN1; (+) strand; PAM type: NRG; PAM sequence: TGG
tctcaatcgggaagcagagt

SEQ ID NO: 106670 - DNA, 20 bp, Artificial Sequence
  Description of Artificial Sequence: Synthetic oligonucleotide
  Target: ATXN1; (+) strand; PAM type: NRG; PAM sequence: AAG
tgtttaatcttctttttcta

SEQ ID NO: 106671 - DNA, 20 bp, Artificial Sequence
  Description of Artificial Sequence: Synthetic oligonucleotide
  Target: ATXN1; (+) strand; PAM type: NRG; PAM sequence: TAG
taatcttctttttctaaaga

SEQ ID NO: 106672 - DNA, 20 bp, Artificial Sequence
  Description of Artificial Sequence: Synthetic oligonucleotide
  Target: ATXN1; (+) strand; PAM type: NRG; PAM sequence: AAG
ttttctaaagatagatgatg

SEQ ID NO: 106673 - DNA, 20 bp, Artificial Sequence
  Description of Artificial Sequence: Synthetic oligonucleotide
  Target: ATXN1; (+) strand; PAM type: NRG; PAM sequence: AGG
tttctaaagatagatgatga

SEQ ID NO: 106674 - DNA, 20 bp, Artificial Sequence
  Description of Artificial Sequence: Synthetic oligonucleotide
  Target: ATXN1; (+) strand; PAM type: NRG; PAM sequence: CAG
gttctattttatatgcctat

SEQ ID NO: 106675 - DNA, 20 bp, Artificial Sequence
  Description of Artificial Sequence: Synthetic oligonucleotide
  Target: ATXN1; (+) strand; PAM type: NRG; PAM sequence: CGG
cagtatctgctaaatgaata

SEQ ID NO: 106676 - DNA, 20 bp, Artificial Sequence
  Description of Artificial Sequence: Synthetic oligonucleotide
  Target: ATXN1; (+) strand; PAM type: NRG; PAM sequence: GAG
ctgtgaatttctgaacctct

SEQ ID NO: 106677 - DNA, 20 bp, Artificial Sequence
  Description of Artificial Sequence: Synthetic oligonucleotide
  Target: ATXN1; (+) strand; PAM type: NRG; PAM sequence: AGG
tgtgaatttctgaacctctg

SEQ ID NO: 106678 - DNA, 20 bp, Artificial Sequence
  Description of Artificial Sequence: Synthetic oligonucleotide
  Target: ATXN1; (+) strand; PAM type: NRG; PAM sequence: TGG
aacctctgaggtcttccaac

SEQ ID NO: 106679 - DNA, 20 bp, Artificial Sequence
  Description of Artificial Sequence: Synthetic oligonucleotide
  Target: ATXN1; (+) strand; PAM type: NRG; PAM sequence: AAG
caactggcacatctaatccc

SEQ ID NO: 106680 - DNA, 20 bp, Artificial Sequence
  Description of Artificial Sequence: Synthetic oligonucleotide
  Target: ATXN1; (+) strand; PAM type: NRG; PAM sequence: AAG
atcccaagtcacacatattc

SEQ ID NO: 106681 - DNA, 20 bp, Artificial Sequence
  Description of Artificial Sequence: Synthetic oligonucleotide
  Target: ATXN1; (+) strand; PAM type: NRG; PAM sequence: AGG
tcccaagtcacacatattca

SEQ ID NO: 106682 - DNA, 20 bp, Artificial Sequence
  Description of Artificial Sequence: Synthetic oligonucleotide
  Target: ATXN1; (+) strand; PAM type: NRG; PAM sequence: AAG
gtcacacatattcaaggaat

SEQ ID NO: 106683 - DNA, 20 bp, Artificial Sequence
  Description of Artificial Sequence: Synthetic oligonucleotide
  Target: ATXN1; (+) strand; PAM type: NRG; PAM sequence: GAG
taaataataaaaaatgtgat

SEQ ID NO: 106684 - DNA, 20 bp, Artificial Sequence
  Description of Artificial Sequence: Synthetic oligonucleotide
  Target: ATXN1; (+) strand; PAM type: NRG; PAM sequence: AGG
aaataataaaaaatgtgatg

SEQ ID NO: 106685 - DNA, 20 bp, Artificial Sequence
  Description of Artificial Sequence: Synthetic oligonucleotide
  Target: ATXN1; (+) strand; PAM type: NRG; PAM sequence: TAG
ataaaaaatgtgatgaggaa

SEQ ID NO: 106686 - DNA, 20 bp, Artificial Sequence
  Description of Artificial Sequence: Synthetic oligonucleotide
  Target: ATXN1; (+) strand; PAM type: NRG; PAM sequence: CAG
tgatgaggaatagtaatgaa

SEQ ID NO: 106687 - DNA, 20 bp, Artificial Sequence
  Description of Artificial Sequence: Synthetic oligonucleotide
  Target: ATXN1; (+) strand; PAM type: NRG; PAM sequence: GAG
gaatagtaatgaacagactt

SEQ ID NO: 106688 - DNA, 20 bp, Artificial Sequence
  Description of Artificial Sequence: Synthetic oligonucleotide
  Target: ATXN1; (+) strand; PAM type: NRG; PAM sequence: TAG
tcttttcctgctatgttcat

SEQ ID NO: 106689 - DNA, 20 bp, Artificial Sequence
  Description of Artificial Sequence: Synthetic oligonucleotide
  Target: ATXN1; (+) strand; PAM type: NRG; PAM sequence: TAG
acatgtcttaatctgcatct

SEQ ID NO: 106690 - DNA, 20 bp, Artificial Sequence
  Description of Artificial Sequence: Synthetic oligonucleotide
  Target: ATXN1; (+) strand; PAM type: NRG; PAM sequence: TGG
aaaactatattaattttcac

SEQ ID NO: 106691 - DNA, 20 bp, Artificial Sequence
  Description of Artificial Sequence: Synthetic oligonucleotide
  Target: ATXN1; (+) strand; PAM type: NRG; PAM sequence: TAG
attaattttcactggtattt

SEQ ID NO: 106692 - DNA, 20 bp, Artificial Sequence
  Description of Artificial Sequence: Synthetic oligonucleotide
  Target: ATXN1; (+) strand; PAM type: NRG; PAM sequence: AAG
attttcactggtattttaga

SEQ ID NO: 106693 - DNA, 20 bp, Artificial Sequence
  Description of Artificial Sequence: Synthetic oligonucleotide
  Target: ATXN1; (+) strand; PAM type: NRG; PAM sequence: TGG
gtattttagaaagtgctaaa

SEQ ID NO: 106694 - DNA, 20 bp, Artificial Sequence
  Description of Artificial Sequence: Synthetic oligonucleotide
  Target: ATXN1; (+) strand; PAM type: NRG; PAM sequence: GAG
attttagaaagtgctaaatg

SEQ ID NO: 106695 - DNA, 20 bp, Artificial Sequence
  Description of Artificial Sequence: Synthetic oligonucleotide
  Target: ATXN1; (+) strand; PAM type: NRG; PAM sequence: TGG
taaatggagattttcaaatt

SEQ ID NO: 106696 - DNA, 20 bp, Artificial Sequence
  Description of Artificial Sequence: Synthetic oligonucleotide
  Target: ATXN1; (+) strand; PAM type: NRG; PAM sequence: GGG
aaatggagattttcaaattt

SEQ ID NO: 106697 - DNA, 20 bp, Artificial Sequence
  Description of Artificial Sequence: Synthetic oligonucleotide
  Target: ATXN1; (+) strand; PAM type: NRG; PAM sequence: AAG
gattttcaaatttgggtgaa

SEQ ID NO: 106698 - DNA, 20 bp, Artificial Sequence
  Description of Artificial Sequence: Synthetic oligonucleotide
  Target: ATXN1; (+) strand; PAM type: NRG; PAM sequence: CAG
ttcaaatttgggtgaaaagt

SEQ ID NO: 106699 - DNA, 20 bp, Artificial Sequence
  Description of Artificial Sequence: Synthetic oligonucleotide
  Target: ATXN1; (+) strand; PAM type: NRG; PAM sequence: TGG
ttgggtgaaaagtcagtatc

SEQ ID NO: 106700 - DNA, 20 bp, Artificial Sequence
  Description of Artificial Sequence: Synthetic oligonucleotide
  Target: ATXN1; (+) strand; PAM type: NRG; PAM sequence: AAG
gtcagtatctggaatgttga

SEQ ID NO: 106701 - DNA, 20 bp, Artificial Sequence
  Description of Artificial Sequence: Synthetic oligonucleotide
  Target: ATXN1; (+) strand; PAM type: NRG; PAM sequence: AGG
tcagtatctggaatgttgaa

SEQ ID NO: 106702 - DNA, 20 bp, Artificial Sequence
  Description of Artificial Sequence: Synthetic oligonucleotide
  Target: ATXN1; (+) strand; PAM type: NRG; PAM sequence: AAG
ctttacttcaatatgtgtgc

SEQ ID NO: 106703 - DNA, 20 bp, Artificial Sequence
  Description of Artificial Sequence: Synthetic oligonucleotide
  Target: ATXN1; (+) strand; PAM type: NRG; PAM sequence: TAG
gtgcaagataatctatgctg

SEQ ID NO: 106704 - DNA, 20 bp, Artificial Sequence
  Description of Artificial Sequence: Synthetic oligonucleotide
  Target: ATXN1; (+) strand; PAM type: NRG; PAM sequence: TGG
gtagctgtaaaatatatccc

SEQ ID NO: 106705 - DNA, 20 bp, Artificial Sequence
  Description of Artificial Sequence: Synthetic oligonucleotide
  Target: ATXN1; (+) strand; PAM type: NRG; PAM sequence: CAG
tatatccctggatgctttta

SEQ ID NO: 106706 - DNA, 20 bp, Artificial Sequence
  Description of Artificial Sequence: Synthetic oligonucleotide
  Target: ATXN1; (+) strand; PAM type: NRG; PAM sequence: TGG
gaaacactctctgaaactaa

SEQ ID NO: 106707 - DNA, 20 bp, Artificial Sequence
  Description of Artificial Sequence: Synthetic oligonucleotide
  Target: ATXN1; (+) strand; PAM type: NRG; PAM sequence: TGG
cacttattaaattcaattaa

SEQ ID NO: 106708 - DNA, 20 bp, Artificial Sequence
  Description of Artificial Sequence: Synthetic oligonucleotide
  Target: ATXN1; (+) strand; PAM type: NRG; PAM sequence: GGG
acttattaaattcaattaat

SEQ ID NO: 106709 - DNA, 20 bp, Artificial Sequence
  Description of Artificial Sequence: Synthetic oligonucleotide
  Target: ATXN1; (+) strand; PAM type: NRG; PAM sequence: GGG
cttattaaattcaattaatg

SEQ ID NO: 106710 - DNA, 20 bp, Artificial Sequence
  Description of Artificial Sequence: Synthetic oligonucleotide
  Target: ATXN1; (+) strand; PAM type: NRG; PAM sequence: TGG
ataaattaaccgcctcttcc

SEQ ID NO: 106711 - DNA, 20 bp, Artificial Sequence
  Description of Artificial Sequence: Synthetic oligonucleotide
  Target: ATXN1; (+) strand; PAM type: NRG; PAM sequence: TAG
cactcccacaaatcatgcac

SEQ ID NO: 106712 - DNA, 20 bp, Artificial Sequence
  Description of Artificial Sequence: Synthetic oligonucleotide
  Target: ATXN1; (+) strand; PAM type: NRG; PAM sequence: TAG
catgcactagccattaaaaa

SEQ ID NO: 106713 - DNA, 20 bp, Artificial Sequence
  Description of Artificial Sequence: Synthetic oligonucleotide
  Target: ATXN1; (+) strand; PAM type: NRG; PAM sequence: AAG
gcactagccattaaaaatag

SEQ ID NO: 106714 - DNA, 20 bp, Artificial Sequence
  Description of Artificial Sequence: Synthetic oligonucleotide
  Target: ATXN1; (+) strand; PAM type: NRG; PAM sequence: AGG
cactagccattaaaaataga

SEQ ID NO: 106715 - DNA, 20 bp, Artificial Sequence
  Description of Artificial Sequence: Synthetic oligonucleotide
  Target: ATXN1; (+) strand; PAM type: NRG; PAM sequence: AAG
aactttcttcctctatgtta

SEQ ID NO: 106716 - DNA, 20 bp, Artificial Sequence
  Description of Artificial Sequence: Synthetic oligonucleotide
  Target: ATXN1; (+) strand; PAM type: NRG; PAM sequence: TGG
ttgctttctaaatatccaaa

SEQ ID NO: 106717 - DNA, 20 bp, Artificial Sequence
  Description of Artificial Sequence: Synthetic oligonucleotide
  Target: ATXN1; (+) strand; PAM type: NRG; PAM sequence: TGG
atccaaatggaaaatgatcc

SEQ ID NO: 106718 - DNA, 20 bp, Artificial Sequence
  Description of Artificial Sequence: Synthetic oligonucleotide
  Target: ATXN1; (+) strand; PAM type: NRG; PAM sequence: GAG
ccaaatggaaaatgatcctg

SEQ ID NO: 106719 - DNA, 20 bp, Artificial Sequence
  Description of Artificial Sequence: Synthetic oligonucleotide
  Target: ATXN1; (+) strand; PAM type: NRG; PAM sequence: AGG
caaatggaaaatgatcctgg

SEQ ID NO: 106720 - DNA, 20 bp, Artificial Sequence
  Description of Artificial Sequence: Synthetic oligonucleotide
  Target: ATXN1; (+) strand; PAM type: NRG; PAM sequence: TGG
ggaaaatgatcctggaggaa

SEQ ID NO: 106721 - DNA, 20 bp, Artificial Sequence
  Description of Artificial Sequence: Synthetic oligonucleotide
  Target: ATXN1; (+) strand; PAM type: NRG; PAM sequence: GGG
gaaaatgatcctggaggaat

SEQ ID NO: 106722 - DNA, 20 bp, Artificial Sequence
  Description of Artificial Sequence: Synthetic oligonucleotide
  Target: ATXN1; (+) strand; PAM type: NRG; PAM sequence: CAG
aatgatcctggaggaatggg

SEQ ID NO: 106723 - DNA, 20 bp, Artificial Sequence
  Description of Artificial Sequence: Synthetic oligonucleotide
  Target: ATXN1; (+) strand; PAM type: NRG; PAM sequence: TGG
ctggaggaatgggcagtatg

SEQ ID NO: 106724 - DNA, 20 bp, Artificial Sequence
  Description of Artificial Sequence: Synthetic oligonucleotide
  Target: ATXN1; (+) strand; PAM type: NRG; PAM sequence: TAG
tgtggtttcccctattctac

SEQ ID NO: 106725 - DNA, 20 bp, Artificial Sequence
  Description of Artificial Sequence: Synthetic oligonucleotide
  Target: ATXN1; (+) strand; PAM type: NRG; PAM sequence: CAG
ctactagtctccaacccaca

SEQ ID NO: 106726 - DNA, 20 bp, Artificial Sequence
  Description of Artificial Sequence: Synthetic oligonucleotide
  Target: ATXN1; (+) strand; PAM type: NRG; PAM sequence: AAG
gtctccaacccacacagaca

SEQ ID NO: 106727 - DNA, 20 bp, Artificial Sequence
  Description of Artificial Sequence: Synthetic oligonucleotide
  Target: ATXN1; (+) strand; PAM type: NRG; PAM sequence: CAG
caaagaaacccgatatccaa

SEQ ID NO: 106728 - DNA, 20 bp, Artificial Sequence
  Description of Artificial Sequence: Synthetic oligonucleotide
  Target: ATXN1; (+) strand; PAM type: NRG; PAM sequence: GAG
aagaaacccgatatccaaca

SEQ ID NO: 106729 - DNA, 20 bp, Artificial Sequence
  Description of Artificial Sequence: Synthetic oligonucleotide
  Target: ATXN1; (+) strand; PAM type: NRG; PAM sequence: AGG
agaaacccgatatccaacag

SEQ ID NO: 106730 - DNA, 20 bp, Artificial Sequence
  Description of Artificial Sequence: Synthetic oligonucleotide
  Target: ATXN1; (+) strand; PAM type: NRG; PAM sequence: TGG
ccttcgtacctccacccaca

SEQ ID NO: 106731 - DNA, 20 bp, Artificial Sequence
  Description of Artificial Sequence: Synthetic oligonucleotide
  Target: ATXN1; (+) strand; PAM type: NRG; PAM sequence: CAG
tgaataaacctgatctccaa

SEQ ID NO: 106732 - DNA, 20 bp, Artificial Sequence
  Description of Artificial Sequence: Synthetic oligonucleotide
  Target: ATXN1; (+) strand; PAM type: NRG; PAM sequence: GAG
aataaacctgatctccaaca

SEQ ID NO: 106733 - DNA, 20 bp, Artificial Sequence
  Description of Artificial Sequence: Synthetic oligonucleotide
  Target: ATXN1; (+) strand; PAM type: NRG; PAM sequence: AGG
ataaacctgatctccaacag

SEQ ID NO: 106734 - DNA, 20 bp, Artificial Sequence
  Description of Artificial Sequence: Synthetic oligonucleotide
  Target: ATXN1; (+) strand; PAM type: NRG; PAM sequence: TGG
tccaacagaggttcttcctt

SEQ ID NO: 106735 - DNA, 20 bp, Artificial Sequence
  Description of Artificial Sequence: Synthetic oligonucleotide
  Target: ATXN1; (+) strand; PAM type: NRG; PAM sequence: GGG
ccaacagaggttcttccttt

SEQ ID NO: 106736 - DNA, 20 bp, Artificial Sequence
  Description of Artificial Sequence: Synthetic oligonucleotide
  Target: ATXN1; (+) strand; PAM type: NRG; PAM sequence: CGG
ttcctttgggccttccctca

SEQ ID NO: 106737 - DNA, 20 bp, Artificial Sequence
  Description of Artificial Sequence: Synthetic oligonucleotide
  Target: ATXN1; (+) strand; PAM type: NRG; PAM sequence: TGG
tgggccttccctcacggtta

SEQ ID NO: 106738 - DNA, 20 bp, Artificial Sequence
  Description of Artificial Sequence: Synthetic oligonucleotide
  Target: ATXN1; (+) strand; PAM type: NRG; PAM sequence: AAG
cctcacggttatggcccaaa

SEQ ID NO: 106739 - DNA, 20 bp, Artificial Sequence
  Description of Artificial Sequence: Synthetic oligonucleotide
  Target: ATXN1; (+) strand; PAM type: NRG; PAM sequence: TAG
acggttatggcccaaaaagc

SEQ ID NO: 106740 - DNA, 20 bp, Artificial Sequence
  Description of Artificial Sequence: Synthetic oligonucleotide
  Target: ATXN1; (+) strand; PAM type: NRG; PAM sequence: AAG
ttatggcccaaaaagctaga

SEQ ID NO: 106741 - DNA, 20 bp, Artificial Sequence
  Description of Artificial Sequence: Synthetic oligonucleotide
  Target: ATXN1; (+) strand; PAM type: NRG; PAM sequence: AGG
tatggcccaaaaagctagaa

SEQ ID NO: 106742 - DNA, 20 bp, Artificial Sequence
  Description of Artificial Sequence: Synthetic oligonucleotide
  Target: ATXN1; (+) strand; PAM type: NRG; PAM sequence: TGG
caaaaagctagaaaggacaa

SEQ ID NO: 106743 - DNA, 20 bp, Artificial Sequence
  Description of Artificial Sequence: Synthetic oligonucleotide
  Target: ATXN1; (+) strand; PAM type: NRG; PAM sequence: GGG
aaaaagctagaaaggacaat

SEQ ID NO: 106744 - DNA, 20 bp, Artificial Sequence
  Description of Artificial Sequence: Synthetic oligonucleotide
  Target: ATXN1; (+) strand; PAM type: NRG; PAM sequence: CAG
aaggacaatgggcatccttt

SEQ ID NO: 106745 - DNA, 20 bp, Artificial Sequence
  Description of Artificial Sequence: Synthetic oligonucleotide
  Target: ATXN1; (+) strand; PAM type: NRG; PAM sequence: AAG
aatgggcatcctttcagata

SEQ ID NO: 106746 - DNA, 20 bp, Artificial Sequence
  Description of Artificial Sequence: Synthetic oligonucleotide
  Target: ATXN1; (+) strand; PAM type: NRG; PAM sequence: CAG
tcagataaagaaatacgcta

SEQ ID NO: 106747 - DNA, 20 bp, Artificial Sequence
  Description of Artificial Sequence: Synthetic oligonucleotide
  Target: ATXN1; (+) strand; PAM type: NRG; PAM sequence: GAG
aagaaatacgctacagaaat

SEQ ID NO: 106748 - DNA, 20 bp, Artificial Sequence
  Description of Artificial Sequence: Synthetic oligonucleotide
  Target: ATXN1; (+) strand; PAM type: NRG; PAM sequence: CAG
aaatacgctacagaaatgag

SEQ ID NO: 106749 - DNA, 20 bp, Artificial Sequence
  Description of Artificial Sequence: Synthetic oligonucleotide
  Target: ATXN1; (+) strand; PAM type: NRG; PAM sequence: CAG
tacgctacagaaatgagcag

SEQ ID NO: 106750 - DNA, 20 bp, Artificial Sequence
  Description of Artificial Sequence: Synthetic oligonucleotide
  Target: ATXN1; (+) strand; PAM type: NRG; PAM sequence: CAG
agaaatgagcagcagaatca

SEQ ID NO: 106751 - DNA, 20 bp, Artificial Sequence
  Description of Artificial Sequence: Synthetic oligonucleotide
  Target: ATXN1; (+) strand; PAM type: NRG; PAM sequence: CGG
gcaataaatttttactcatg

SEQ ID NO: 106752 - DNA, 20 bp, Artificial Sequence
  Description of Artificial Sequence: Synthetic oligonucleotide
  Target: ATXN1; (+) strand; PAM type: NRG; PAM sequence: TGG
actcatgcggtaaatgccca

SEQ ID NO: 106753 - DNA, 20 bp, Artificial Sequence
  Description of Artificial Sequence: Synthetic oligonucleotide
  Target: ATXN1; (+) strand; PAM type: NRG; PAM sequence: CAG
atgcggtaaatgcccatgga

SEQ ID NO: 106754 - DNA, 20 bp, Artificial Sequence
  Description of Artificial Sequence: Synthetic oligonucleotide
  Target: ATXN1; (+) strand; PAM type: NRG; PAM sequence: AGG
tgcggtaaatgcccatggac

SEQ ID NO: 106755 - DNA, 20 bp, Artificial Sequence
  Description of Artificial Sequence: Synthetic oligonucleotide
  Target: ATXN1; (+) strand; PAM type: NRG; PAM sequence: GGG
gcggtaaatgcccatggaca

SEQ ID NO: 106756 - DNA, 20 bp, Artificial Sequence
  Description of Artificial Sequence: Synthetic oligonucleotide
  Target: ATXN1; (+) strand; PAM type: NRG; PAM sequence: GGG
cggtaaatgcccatggacag

SEQ ID NO: 106757 - DNA, 20 bp, Artificial Sequence
  Description of Artificial Sequence: Synthetic oligonucleotide
  Target: ATXN1; (+) strand; PAM type: NRG; PAM sequence: TAG
catggacaggggttaacctc

SEQ ID NO: 106758 - DNA, 20 bp, Artificial Sequence
  Description of Artificial Sequence: Synthetic oligonucleotide
  Target: ATXN1; (+) strand; PAM type: NRG; PAM sequence: CAG
taacctctagcatttgcacg

SEQ ID NO: 106759 - DNA, 20 bp, Artificial Sequence
  Description of Artificial Sequence: Synthetic oligonucleotide
  Target: ATXN1; (+) strand; PAM type: NRG; PAM sequence: TGG
cgcagccacccgttcgctct

SEQ ID NO: 106760 - DNA, 20 bp, Artificial Sequence
  Description of Artificial Sequence: Synthetic oligonucleotide
  Target: ATXN1; (+) strand; PAM type: NRG; PAM sequence: TGG
acccgttcgctcttggctcc

SEQ ID NO: 106761 - DNA, 20 bp, Artificial Sequence
  Description of Artificial Sequence: Synthetic oligonucleotide
  Target: ATXN1; (+) strand; PAM type: NRG; PAM sequence: AAG
gttcgctcttggctcctggt

SEQ ID NO: 106762 - DNA, 20 bp, Artificial Sequence
  Description of Artificial Sequence: Synthetic oligonucleotide
  Target: ATXN1; (+) strand; PAM type: NRG; PAM sequence: CAG
tggctcctggtaagcactta

SEQ ID NO: 106763 - DNA, 20 bp, Artificial Sequence
  Description of Artificial Sequence: Synthetic oligonucleotide
  Target: ATXN1; (+) strand; PAM type: NRG; PAM sequence: AGG
ggctcctggtaagcacttac

SEQ ID NO: 106764 - DNA, 20 bp, Artificial Sequence
  Description of Artificial Sequence: Synthetic oligonucleotide
  Target: ATXN1; (+) strand; PAM type: NRG; PAM sequence: AAG
taagcacttacaggcattta

SEQ ID NO: 106765 - DNA, 20 bp, Artificial Sequence
  Description of Artificial Sequence: Synthetic oligonucleotide
  Target: ATXN1; (+) strand; PAM type: NRG; PAM sequence: AAG
caggcatttaaagatgtgca

SEQ ID NO: 106766 - DNA, 20 bp, Artificial Sequence
  Description of Artificial Sequence: Synthetic oligonucleotide
  Target: ATXN1; (+) strand; PAM type: NRG; PAM sequence: AGG
aggcatttaaagatgtgcaa

SEQ ID NO: 106767 - DNA, 20 bp, Artificial Sequence
  Description of Artificial Sequence: Synthetic oligonucleotide
  Target: ATXN1; (+) strand; PAM type: NRG; PAM sequence: GGG
ggcatttaaagatgtgcaaa

SEQ ID NO: 106768 - DNA, 20 bp, Artificial Sequence
  Description of Artificial Sequence: Synthetic oligonucleotide
  Target: ATXN1; (+) strand; PAM type: NRG; PAM sequence: AAG
taaagatgtgcaaagggtat

SEQ ID NO: 106769 - DNA, 20 bp, Artificial Sequence
  Description of Artificial Sequence: Synthetic oligonucleotide
  Target: ATXN1; (+) strand; PAM type: NRG; PAM sequence: AAG
caatgctctctgcccctcat

SEQ ID NO: 106770 - DNA, 20 bp, Artificial Sequence
  Description of Artificial Sequence: Synthetic oligonucleotide
  Target: ATXN1; (+) strand; PAM type: NRG; PAM sequence: TAG
tccaacatctacttaaatgc

SEQ ID NO: 106771 - DNA, 20 bp, Artificial Sequence
  Description of Artificial Sequence: Synthetic oligonucleotide
  Target: ATXN1; (+) strand; PAM type: NRG; PAM sequence: AAG
ttaaatgctagcttacctta

SEQ ID NO: 106772 - DNA, 20 bp, Artificial Sequence
  Description of Artificial Sequence: Synthetic oligonucleotide
  Target: ATXN1; (+) strand; PAM type: NRG; PAM sequence: CAG
ccttctttatttcattccac

SEQ ID NO: 106773 - DNA, 20 bp, Artificial Sequence
  Description of Artificial Sequence: Synthetic oligonucleotide
  Target: ATXN1; (+) strand; PAM type: NRG; PAM sequence: AGG
cttctttatttcattccacc

SEQ ID NO: 106774 - DNA, 20 bp, Artificial Sequence
  Description of Artificial Sequence: Synthetic oligonucleotide
  Target: ATXN1; (+) strand; PAM type: NRG; PAM sequence: TGG
accaggactgaaccctgact

SEQ ID NO: 106775 - DNA, 20 bp, Artificial Sequence
  Description of Artificial Sequence: Synthetic oligonucleotide
  Target: ATXN1; (+) strand; PAM type: NRG; PAM sequence: GGG
ccaggactgaaccctgactt

SEQ ID NO: 106776 - DNA, 20 bp, Artificial Sequence
  Description of Artificial Sequence: Synthetic oligonucleotide
  Target: ATXN1; (+) strand; PAM type: NRG; PAM sequence: GAG
gactatttgccttgaaaaat

SEQ ID NO: 106777 - DNA, 20 bp, Artificial Sequence
  Description of Artificial Sequence: Synthetic oligonucleotide
  Target: ATXN1; (+) strand; PAM type: NRG; PAM sequence: CAG
cttgaaaaatgagttttctc

SEQ ID NO: 106778 - DNA, 20 bp, Artificial Sequence
  Description of Artificial Sequence: Synthetic oligonucleotide
  Target: ATXN1; (+) strand; PAM type: NRG; PAM sequence: CAG
atgagttttctccagctctg

SEQ ID NO: 106779 - DNA, 20 bp, Artificial Sequence
  Description of Artificial Sequence: Synthetic oligonucleotide
  Target: ATXN1; (+) strand; PAM type: NRG; PAM sequence: GAG
gagttttctccagctctgca

SEQ ID NO: 106780 - DNA, 20 bp, Artificial Sequence
  Description of Artificial Sequence: Synthetic oligonucleotide
  Target: ATXN1; (+) strand; PAM type: NRG; PAM sequence: AGG
agttttctccagctctgcag

SEQ ID NO: 106781 - DNA, 20 bp, Artificial Sequence
  Description of Artificial Sequence: Synthetic oligonucleotide
  Target: ATXN1; (+) strand; PAM type: NRG; PAM sequence: TGG
ttctccagctctgcagagga

SEQ ID NO: 106782 - DNA, 20 bp, Artificial Sequence
  Description of Artificial Sequence: Synthetic oligonucleotide
  Target: ATXN1; (+) strand; PAM type: NRG; PAM sequence: TGG
aggatggctgctgtgtataa

SEQ ID NO: 106783 - DNA, 20 bp, Artificial Sequence
  Description of Artificial Sequence: Synthetic oligonucleotide
  Target: ATXN1; (+) strand; PAM type: NRG; PAM sequence: CGG
aatggtctctgaaatgctaa

SEQ ID NO: 106784 - DNA, 20 bp, Artificial Sequence
  Description of Artificial Sequence: Synthetic oligonucleotide
  Target: ATXN1; (+) strand; PAM type: NRG; PAM sequence: AAG
ggtctctgaaatgctaacgg

SEQ ID NO: 106785 - DNA, 20 bp, Artificial Sequence
  Description of Artificial Sequence: Synthetic oligonucleotide
  Target: ATXN1; (+) strand; PAM type: NRG; PAM sequence: AAG
ctgaaatgctaacggaagcc

SEQ ID NO: 106786 - DNA, 20 bp, Artificial Sequence
  Description of Artificial Sequence: Synthetic oligonucleotide
  Target: ATXN1; (+) strand; PAM type: NRG; PAM sequence: AAG
atcacctgacatgaactatg

SEQ ID NO: 106787 - DNA, 20 bp, Artificial Sequence
  Description of Artificial Sequence: Synthetic oligonucleotide
  Target: ATXN1; (+) strand; PAM type: NRG; PAM sequence: TAG
gacatgaactatgaagctat

SEQ ID NO: 106788 - DNA, 20 bp, Artificial Sequence
  Description of Artificial Sequence: Synthetic oligonucleotide
  Target: ATXN1; (+) strand; PAM type: NRG; PAM sequence: AAG
atgaagctattagttatgaa

SEQ ID NO: 106789 - DNA, 20 bp, Artificial Sequence
  Description of Artificial Sequence: Synthetic oligonucleotide
  Target: ATXN1; (+) strand; PAM type: NRG; PAM sequence: TGG
taccttctaactcttcatgc

SEQ ID NO: 106790 - DNA, 20 bp, Artificial Sequence
  Description of Artificial Sequence: Synthetic oligonucleotide
  Target: ATXN1; (+) strand; PAM type: NRG; PAM sequence: GAG
ccttctaactcttcatgctg

SEQ ID NO: 106791 - DNA, 20 bp, Artificial Sequence
  Description of Artificial Sequence: Synthetic oligonucleotide
  Target: ATXN1; (+) strand; PAM type: NRG; PAM sequence: AGG
cttctaactcttcatgctgg

SEQ ID NO: 106792 - DNA, 20 bp, Artificial Sequence
  Description of Artificial Sequence: Synthetic oligonucleotide
  Target: ATXN1; (+) strand; PAM type: NRG; PAM sequence: GGG
ttctaactcttcatgctgga

SEQ ID NO: 106793 - DNA, 20 bp, Artificial Sequence
  Description of Artificial Sequence: Synthetic oligonucleotide
  Target: ATXN1; (+) strand; PAM type: NRG; PAM sequence: AAG
actcttcatgctggagggta

SEQ ID NO: 106794 - DNA, 20 bp, Artificial Sequence
  Description of Artificial Sequence: Synthetic oligonucleotide
  Target: ATXN1; (+) strand; PAM type: NRG; PAM sequence: CAG
cttcatgctggagggtaaag

SEQ ID NO: 106795 - DNA, 20 bp, Artificial Sequence
  Description of Artificial Sequence: Synthetic oligonucleotide
  Target: ATXN1; (+) strand; PAM type: NRG; PAM sequence: TGG
gagggtaaagcagcacaacc

SEQ ID NO: 106796 - DNA, 20 bp, Artificial Sequence
  Description of Artificial Sequence: Synthetic oligonucleotide
  Target: ATXN1; (+) strand; PAM type: NRG; PAM sequence: TGG
cagcacaacctggacgtgcc

SEQ ID NO: 106797 - DNA, 20 bp, Artificial Sequence
  Description of Artificial Sequence: Synthetic oligonucleotide
  Target: ATXN1; (+) strand; PAM type: NRG; PAM sequence: GAG
acctggacgtgcctggtgcc

SEQ ID NO: 106798 - DNA, 20 bp, Artificial Sequence
  Description of Artificial Sequence: Synthetic oligonucleotide
  Target: ATXN1; (+) strand; PAM type: NRG; PAM sequence: AAG
cctggtgccgagccaacata

SEQ ID NO: 106799 - DNA, 20 bp, Artificial Sequence
  Description of Artificial Sequence: Synthetic oligonucleotide
  Target: ATXN1; (+) strand; PAM type: NRG; PAM sequence: GAG
tggtgccgagccaacataaa

SEQ ID NO: 106800 - DNA, 20 bp, Artificial Sequence
  Description of Artificial Sequence: Synthetic oligonucleotide
  Target: ATXN1; (+) strand; PAM type: NRG; PAM sequence: TGG
ctcctctaccatttttgaaa

SEQ ID NO: 106801 - DNA, 20 bp, Artificial Sequence
  Description of Artificial Sequence: Synthetic oligonucleotide
  Target: ATXN1; (+) strand; PAM type: NRG; PAM sequence: TGG
tgaaatggaaataatgctta

SEQ ID NO: 106802 - DNA, 20 bp, Artificial Sequence
  Description of Artificial Sequence: Synthetic oligonucleotide
  Target: ATXN1; (+) strand; PAM type: NRG; PAM sequence: TGG
aatggaaataatgcttatgg

SEQ ID NO: 106803 - DNA, 20 bp, Artificial Sequence
  Description of Artificial Sequence: Synthetic oligonucleotide
  Target: ATXN1; (+) strand; PAM type: NRG; PAM sequence: TGG
tgcttatggtggtaataatg

SEQ ID NO: 106804 - DNA, 20 bp, Artificial Sequence
  Description of Artificial Sequence: Synthetic oligonucleotide
  Target: ATXN1; (+) strand; PAM type: NRG; PAM sequence: AAG
aatgtggtgactgtcgttca

SEQ ID NO: 106805 - DNA, 20 bp, Artificial Sequence
  Description of Artificial Sequence: Synthetic oligonucleotide
  Target: ATXN1; (+) strand; PAM type: NRG; PAM sequence: CAG
atgatctgatctgctcctcc

SEQ ID NO: 106806 - DNA, 20 bp, Artificial Sequence
  Description of Artificial Sequence: Synthetic oligonucleotide
  Target: ATXN1; (+) strand; PAM type: NRG; PAM sequence: AGG
tgatctgatctgctcctccc

SEQ ID NO: 106807 - DNA, 20 bp, Artificial Sequence
  Description of Artificial Sequence: Synthetic oligonucleotide
  Target: ATXN1; (+) strand; PAM type: NRG; PAM sequence: GAG
tcctcccaggaatcctgcat

SEQ ID NO: 106808 - DNA, 20 bp, Artificial Sequence
  Description of Artificial Sequence: Synthetic oligonucleotide
  Target: ATXN1; (+) strand; PAM type: NRG; PAM sequence: AGG
cctcccaggaatcctgcatg

SEQ ID NO: 106809 - DNA, 20 bp, Artificial Sequence
  Description of Artificial Sequence: Synthetic oligonucleotide
  Target: ATXN1; (+) strand; PAM type: NRG; PAM sequence: TGG
cccaggaatcctgcatgagg

SEQ ID NO: 106810 - DNA, 20 bp, Artificial Sequence
  Description of Artificial Sequence: Synthetic oligonucleotide
  Target: ATXN1; (+) strand; PAM type: NRG; PAM sequence: CAG
atcatgaatgttataatgtc

SEQ ID NO: 106811 - DNA, 20 bp, Artificial Sequence
  Description of Artificial Sequence: Synthetic oligonucleotide
  Target: ATXN1; (+) strand; PAM type: NRG; PAM sequence: AAG
atgaatgttataatgtccag

SEQ ID NO: 106812 - DNA, 20 bp, Artificial Sequence
  Description of Artificial Sequence: Synthetic oligonucleotide
  Target: ATXN1; (+) strand; PAM type: NRG; PAM sequence: CAG
aatgttataatgtccagaag

SEQ ID NO: 106813 - DNA, 20 bp, Artificial Sequence
  Description of Artificial Sequence: Synthetic oligonucleotide
  Target: ATXN1; (+) strand; PAM type: NRG; PAM sequence: AGG
atgttataatgtccagaagc

SEQ ID NO: 106814 - DNA, 20 bp, Artificial Sequence
  Description of Artificial Sequence: Synthetic oligonucleotide
  Target: ATXN1; (+) strand; PAM type: NRG; PAM sequence: TAG
tccagaagcaggaactgatg

SEQ ID NO: 106815 - DNA, 20 bp, Artificial Sequence
  Description of Artificial Sequence: Synthetic oligonucleotide
  Target: ATXN1; (+) strand; PAM type: NRG; PAM sequence: AAG
gaagcaggaactgatgtaga

SEQ ID NO: 106816 - DNA, 20 bp, Artificial Sequence
  Description of Artificial Sequence: Synthetic oligonucleotide
  Target: ATXN1; (+) strand; PAM type: NRG; PAM sequence: AAG
aggaactgatgtagaaagtt

SEQ ID NO: 106817 - DNA, 20 bp, Artificial Sequence
  Description of Artificial Sequence: Synthetic oligonucleotide
  Target: ATXN1; (+) strand; PAM type: NRG; PAM sequence: CAG
gaaagttaagtgatgttctc

SEQ ID NO: 106818 - DNA, 20 bp, Artificial Sequence
  Description of Artificial Sequence: Synthetic oligonucleotide
  Target: ATXN1; (+) strand; PAM type: NRG; PAM sequence: AGG
aaagttaagtgatgttctcc

SEQ ID NO: 106819 - DNA, 20 bp, Artificial Sequence
  Description of Artificial Sequence: Synthetic oligonucleotide
  Target: ATXN1; (+) strand; PAM type: NRG; PAM sequence: CAG
tgttctccaggcgaccccga

SEQ ID NO: 106820 - DNA, 20 bp, Artificial Sequence
  Description of Artificial Sequence: Synthetic oligonucleotide
  Target: ATXN1; (+) strand; PAM type: NRG; PAM sequence: GAG
ttctccaggcgaccccgaca

SEQ ID NO: 106821 - DNA, 20 bp, Artificial Sequence
  Description of Artificial Sequence: Synthetic oligonucleotide
  Target: ATXN1; (+) strand; PAM type: NRG; PAM sequence: TGG
caggcgaccccgacagagcc

SEQ ID NO: 106822 - DNA, 20 bp, Artificial Sequence
  Description of Artificial Sequence: Synthetic oligonucleotide
  Target: ATXN1; (+) strand; PAM type: NRG; PAM sequence: CAG
gcgaccccgacagagcctgg

SEQ ID NO: 106823 - DNA, 20 bp, Artificial Sequence
  Description of Artificial Sequence: Synthetic oligonucleotide
  Target: ATXN1; (+) strand; PAM type: NRG; PAM sequence: AGG
cgaccccgacagagcctggc

SEQ ID NO: 106824 - DNA, 20 bp, Artificial Sequence
  Description of Artificial Sequence: Synthetic oligonucleotide
  Target: ATXN1; (+) strand; PAM type: NRG; PAM sequence: GGG
gaccccgacagagcctggca

SEQ ID NO: 106825 - DNA, 20 bp, Artificial Sequence
  Description of Artificial Sequence: Synthetic oligonucleotide
  Target: ATXN1; (+) strand; PAM type: NRG; PAM sequence: TGG
cagggctgctgctttgaccc

SEQ ID NO: 106826 - DNA, 20 bp, Artificial Sequence
  Description of Artificial Sequence: Synthetic oligonucleotide
  Target: ATXN1; (+) strand; PAM type: NRG; PAM sequence: GAG
gggctgctgctttgaccctg

SEQ ID NO: 106827 - DNA, 20 bp, Artificial Sequence
  Description of Artificial Sequence: Synthetic oligonucleotide
  Target: ATXN1; (+) strand; PAM type: NRG; PAM sequence: GAG
gctgctttgaccctggagtt

SEQ ID NO: 106828 - DNA, 20 bp, Artificial Sequence
  Description of Artificial Sequence: Synthetic oligonucleotide
  Target: ATXN1; (+) strand; PAM type: NRG; PAM sequence: GAG
tgctttgaccctggagttga

SEQ ID NO: 106829 - DNA, 20 bp, Artificial Sequence
  Description of Artificial Sequence: Synthetic oligonucleotide
  Target: ATXN1; (+) strand; PAM type: NRG; PAM sequence: AGG
gctttgaccctggagttgag

SEQ ID NO: 106830 - DNA, 20 bp, Artificial Sequence
  Description of Artificial Sequence: Synthetic oligonucleotide
  Target: ATXN1; (+) strand; PAM type: NRG; PAM sequence: CGG
ctttccacatcaacccccgc

SEQ ID NO: 106831 - DNA, 20 bp, Artificial Sequence
  Description of Artificial Sequence: Synthetic oligonucleotide
  Target: ATXN1; (+) strand; PAM type: NRG; PAM sequence: TGG
aaatgcaactgtttttcatt

SEQ ID NO: 106832 - DNA, 20 bp, Artificial Sequence
  Description of Artificial Sequence: Synthetic oligonucleotide
  Target: ATXN1; (+) strand; PAM type: NRG; PAM sequence: GGG
aatgcaactgtttttcattt

SEQ ID NO: 106833 - DNA, 20 bp, Artificial Sequence
  Description of Artificial Sequence: Synthetic oligonucleotide
  Target: ATXN1; (+) strand; PAM type: NRG; PAM sequence: TAG
gtctatcttttctttgctaa

SEQ ID NO: 106834 - DNA, 20 bp, Artificial Sequence
  Description of Artificial Sequence: Synthetic oligonucleotide
  Target: ATXN1; (+) strand; PAM type: NRG; PAM sequence: AAG
ttctttgctaatagtaatca

SEQ ID NO: 106835 - DNA, 20 bp, Artificial Sequence
  Description of Artificial Sequence: Synthetic oligonucleotide
  Target: ATXN1; (+) strand; PAM type: NRG; PAM sequence: AAG
aatagtaatcaaagatctaa

SEQ ID NO: 106836 - DNA, 20 bp, Artificial Sequence
  Description of Artificial Sequence: Synthetic oligonucleotide
  Target: ATXN1; (+) strand; PAM type: NRG; PAM sequence: CAG
aatcaaagatctaaaagcta

SEQ ID NO: 106837 - DNA, 20 bp, Artificial Sequence
  Description of Artificial Sequence: Synthetic oligonucleotide
  Target: ATXN1; (+) strand; PAM type: NRG; PAM sequence: AAG
taaaagctacagatttatca

SEQ ID NO: 106838 - DNA, 20 bp, Artificial Sequence
  Description of Artificial Sequence: Synthetic oligonucleotide
  Target: ATXN1; (+) strand; PAM type: NRG; PAM sequence: AAG
acagatttatcaaagaactg

SEQ ID NO: 106839 - DNA, 20 bp, Artificial Sequence
  Description of Artificial Sequence: Synthetic oligonucleotide
  Target: ATXN1; (+) strand; PAM type: NRG; PAM sequence: CAG
gaagctactaaaattgtttg

SEQ ID NO: 106840 - DNA, 20 bp, Artificial Sequence
  Description of Artificial Sequence: Synthetic oligonucleotide
  Target: ATXN1; (+) strand; PAM type: NRG; PAM sequence: AAG
aattgtttgcagtgtcgtga

SEQ ID NO: 106841 - DNA, 20 bp, Artificial Sequence
  Description of Artificial Sequence: Synthetic oligonucleotide
  Target: ATXN1; (+) strand; PAM type: NRG; PAM sequence: TGG
tgcagtgtcgtgaaagaaac

SEQ ID NO: 106842 - DNA, 20 bp, Artificial Sequence
  Description of Artificial Sequence: Synthetic oligonucleotide
  Target: ATXN1; (+) strand; PAM type: NRG; PAM sequence: AAG
aaactggcaaacacgatttt

SEQ ID NO: 106843 - DNA, 20 bp, Artificial Sequence
  Description of Artificial Sequence: Synthetic oligonucleotide
  Target: ATXN1; (+) strand; PAM type: NRG; PAM sequence: AAG
ggcaaacacgattttaagaa

SEQ ID NO: 106844 - DNA, 20 bp, Artificial Sequence
  Description of Artificial Sequence: Synthetic oligonucleotide
  Target: ATXN1; (+) strand; PAM type: NRG; PAM sequence: GAG
caaacacgattttaagaaaa

SEQ ID NO: 106845 - DNA, 20 bp, Artificial Sequence
  Description of Artificial Sequence: Synthetic oligonucleotide
  Target: ATXN1; (+) strand; PAM type: NRG; PAM sequence: AGG
aaacacgattttaagaaaag

SEQ ID NO: 106846 - DNA, 20 bp, Artificial Sequence
  Description of Artificial Sequence: Synthetic oligonucleotide
  Target: ATXN1; (+) strand; PAM type: NRG; PAM sequence: CAG
aagaaaagaggcaactgtga

SEQ ID NO: 106847 - DNA, 20 bp, Artificial Sequence
  Description of Artificial Sequence: Synthetic oligonucleotide
  Target: ATXN1; (+) strand; PAM type: NRG; PAM sequence: AAG
aaaagaggcaactgtgacag

SEQ ID NO: 106848 - DNA, 20 bp, Artificial Sequence
  Description of Artificial Sequence: Synthetic oligonucleotide
  Target: ATXN1; (+) strand; PAM type: NRG; PAM sequence: TAG
aagaaataaaaacttgtgtt

SEQ ID NO: 106849 - DNA, 20 bp, Artificial Sequence
  Description of Artificial Sequence: Synthetic oligonucleotide
  Target: ATXN1; (+) strand; PAM type: NRG; PAM sequence: AGG
agaaataaaaacttgtgttt

SEQ ID NO: 106850 - DNA, 20 bp, Artificial Sequence
  Description of Artificial Sequence: Synthetic oligonucleotide
  Target: ATXN1; (+) strand; PAM type: NRG; PAM sequence: AAG
ctaatgtacaatgcacaact

SEQ ID NO: 106851 - DNA, 20 bp, Artificial Sequence
  Description of Artificial Sequence: Synthetic oligonucleotide
  Target: ATXN1; (+) strand; PAM type: NRG; PAM sequence: TAG
tgtacaatgcacaactaaga

SEQ ID NO: 106852 - DNA, 20 bp, Artificial Sequence
  Description of Artificial Sequence: Synthetic oligonucleotide
  Target: ATXN1; (+) strand; PAM type: NRG; PAM sequence: AAG
ttttttctgatataaaaata

SEQ ID NO: 106853 - DNA, 20 bp, Artificial Sequence
  Description of Artificial Sequence: Synthetic oligonucleotide
  Target: ATXN1; (+) strand; PAM type: NRG; PAM sequence: TGG
aaataaagtgtgatcatatg

SEQ ID NO: 106854 - DNA, 20 bp, Artificial Sequence
  Description of Artificial Sequence: Synthetic oligonucleotide
  Target: ATXN1; (+) strand; PAM type: NRG; PAM sequence: CAG
tgtgatcatatgtggaaaca

SEQ ID NO: 106855 - DNA, 20 bp, Artificial Sequence
  Description of Artificial Sequence: Synthetic oligonucleotide
  Target: ATXN1; (+) strand; PAM type: NRG; PAM sequence: TGG
tttacattttgattgtattt

SEQ ID NO: 106856 - DNA, 20 bp, Artificial Sequence
  Description of Artificial Sequence: Synthetic oligonucleotide
  Target: ATXN1; (+) strand; PAM type: NRG; PAM sequence: AAG
atatataattttctttttta

SEQ ID NO: 106857 - DNA, 20 bp, Artificial Sequence
  Description of Artificial Sequence: Synthetic oligonucleotide
  Target: ATXN1; (+) strand; PAM type: NRG; PAM sequence: AAG
tatatctatgcatgtttaca

SEQ ID NO: 106858 - DNA, 20 bp, Artificial Sequence
  Description of Artificial Sequence: Synthetic oligonucleotide
  Target: ATXN1; (+) strand; PAM type: NRG; PAM sequence: TAG
tctatgcatgtttacaaagt

SEQ ID NO: 106859 - DNA, 20 bp, Artificial Sequence
  Description of Artificial Sequence: Synthetic oligonucleotide
  Target: ATXN1; (+) strand; PAM type: NRG; PAM sequence: CAG
ctgaatatataattttgaat

SEQ ID NO: 106860 - DNA, 20 bp, Artificial Sequence
  Description of Artificial Sequence: Synthetic oligonucleotide
  Target: ATXN1; (+) strand; PAM type: NRG; PAM sequence: TAG
acttaacattgtattgtaac

SEQ ID NO: 106861 - DNA, 20 bp, Artificial Sequence
  Description of Artificial Sequence: Synthetic oligonucleotide
  Target: ATXN1; (+) strand; PAM type: NRG; PAM sequence: TAG
ttgtaactagaattataaac

SEQ ID NO: 106862 - DNA, 20 bp, Artificial Sequence
  Description of Artificial Sequence: Synthetic oligonucleotide
  Target: ATXN1; (+) strand; PAM type: NRG; PAM sequence: AAG
aattataaactagtttttta

SEQ ID NO: 106863 - DNA, 20 bp, Artificial Sequence
  Description of Artificial Sequence: Synthetic oligonucleotide
  Target: ATXN1; (+) strand; PAM type: NRG; PAM sequence: TAG
ataaactagttttttaaagc

SEQ ID NO: 106864 - DNA, 20 bp, Artificial Sequence
  Description of Artificial Sequence: Synthetic oligonucleotide
  Target: ATXN1; (+) strand; PAM type: NRG; PAM sequence: AAG
tagttttttaaagctagtta

SEQ ID NO: 106865 - DNA, 20 bp, Artificial Sequence
  Description of Artificial Sequence: Synthetic oligonucleotide
  Target: ATXN1; (+) strand; PAM type: NRG; PAM sequence: AGG
agttttttaaagctagttaa

SEQ ID NO: 106866 - DNA, 20 bp, Artificial Sequence
  Description of Artificial Sequence: Synthetic oligonucleotide
  Target: ATXN1; (+) strand; PAM type: NRG; PAM sequence: AAG
tttttaaagctagttaaagg

SEQ ID NO: 106867 - DNA, 20 bp, Artificial Sequence
  Description of Artificial Sequence: Synthetic oligonucleotide
  Target: ATXN1; (+) strand; PAM type: NRG; PAM sequence: AAG
agctagttaaaggaagaatg

SEQ ID NO: 106868 - DNA, 20 bp, Artificial Sequence
  Description of Artificial Sequence: Synthetic oligonucleotide
  Target: ATXN1; (+) strand; PAM type: NRG; PAM sequence: AAG
gttaaaggaagaatgaagta

SEQ ID NO: 106869 - DNA, 20 bp, Artificial Sequence
  Description of Artificial Sequence: Synthetic oligonucleotide
  Target: ATXN1; (+) strand; PAM type: NRG; PAM sequence: CAG
aaggaagaatgaagtaaagc

SEQ ID NO: 106870 - DNA, 20 bp, Artificial Sequence
  Description of Artificial Sequence: Synthetic oligonucleotide
  Target: ATXN1; (+) strand; PAM type: NRG; PAM sequence: CAG
gccagaaaaaccttaaacta

SEQ ID NO: 106871 - DNA, 20 bp, Artificial Sequence
  Description of Artificial Sequence: Synthetic oligonucleotide
  Target: ATXN1; (+) strand; PAM type: NRG; PAM sequence: AAG
taactaactgtaaaatccaa

SEQ ID NO: 106872 - DNA, 20 bp, Artificial Sequence
  Description of Artificial Sequence: Synthetic oligonucleotide
  Target: ATXN1; (+) strand; PAM type: NRG; PAM sequence: TGG
ctgtaaaatccaaaagcact

SEQ ID NO: 106873 - DNA, 20 bp, Artificial Sequence
  Description of Artificial Sequence: Synthetic oligonucleotide
  Target: ATXN1; (+) strand; PAM type: NRG; PAM sequence: TGG
atccaaaagcacttggcaaa

SEQ ID NO: 106874 - DNA, 20 bp, Artificial Sequence
  Description of Artificial Sequence: Synthetic oligonucleotide
  Target: ATXN1; (+) strand; PAM type: NRG; PAM sequence: AAG
aaaagcacttggcaaatggt

SEQ ID NO: 106875 - DNA, 20 bp, Artificial Sequence
  Description of Artificial Sequence: Synthetic oligonucleotide
  Target: ATXN1; (+) strand; PAM type: NRG; PAM sequence: AGG
aaagcacttggcaaatggta

SEQ ID NO: 106876 - DNA, 20 bp, Artificial Sequence
  Description of Artificial Sequence: Synthetic oligonucleotide
  Target: ATXN1; (+) strand; PAM type: NRG; PAM sequence: TGG
ttggcaaatggtaaggaatt

SEQ ID NO: 106877 - DNA, 20 bp, Artificial Sequence
  Description of Artificial Sequence: Synthetic oligonucleotide
  Target: ATXN1; (+) strand; PAM type: NRG; PAM sequence: TGG
aatttggacacataaattaa

SEQ ID NO: 106878 - DNA, 20 bp, Artificial Sequence
  Description of Artificial Sequence: Synthetic oligonucleotide
  Target: ATXN1; (+) strand; PAM type: NRG; PAM sequence: GAG
tttggacacataaattaatg

SEQ ID NO: 106879 - DNA, 20 bp, Artificial Sequence
  Description of Artificial Sequence: Synthetic oligonucleotide
  Target: ATXN1; (+) strand; PAM type: NRG; PAM sequence: CAG
taatggagctaaatattaat

SEQ ID NO: 106880 - DNA, 20 bp, Artificial Sequence
  Description of Artificial Sequence: Synthetic oligonucleotide
  Target: ATXN1; (+) strand; PAM type: NRG; PAM sequence: GAG
ggagctaaatattaatcagt

SEQ ID NO: 106881 - DNA, 20 bp, Artificial Sequence
  Description of Artificial Sequence: Synthetic oligonucleotide
  Target: ATXN1; (+) strand; PAM type: NRG; PAM sequence: GAG
tcagtgagcaaatattaatt

SEQ ID NO: 106882 - DNA, 20 bp, Artificial Sequence
  Description of Artificial Sequence: Synthetic oligonucleotide
  Target: ATXN1; (+) strand; PAM type: NRG; PAM sequence: AAG
caaatattaattgagtctta

SEQ ID NO: 106883 - DNA, 20 bp, Artificial Sequence
  Description of Artificial Sequence: Synthetic oligonucleotide
  Target: ATXN1; (+) strand; PAM type: NRG; PAM sequence: GAG
aatattaattgagtcttaaa

SEQ ID NO: 106884 - DNA, 20 bp, Artificial Sequence
  Description of Artificial Sequence: Synthetic oligonucleotide
  Target: ATXN1; (+) strand; PAM type: NRG; PAM sequence: TAG
ttaaagagctgaaattattc

SEQ ID NO: 106885 - DNA, 20 bp, Artificial Sequence
  Description of Artificial Sequence: Synthetic oligonucleotide
  Target: ATXN1; (+) strand; PAM type: NRG; PAM sequence: AGG
taaagagctgaaattattct

SEQ ID NO: 106886 - DNA, 20 bp, Artificial Sequence
  Description of Artificial Sequence: Synthetic oligonucleotide
  Target: ATXN1; (+) strand; PAM type: NRG; PAM sequence: GAG
aagagctgaaattattctag

SEQ ID NO: 106887 - DNA, 20 bp, Artificial Sequence
  Description of Artificial Sequence: Synthetic oligonucleotide
  Target: ATXN1; (+) strand; PAM type: NRG; PAM sequence: TGG
attattctaggagccatgcc

SEQ ID NO: 106888 - DNA, 20 bp, Artificial Sequence
  Description of Artificial Sequence: Synthetic oligonucleotide
  Target: ATXN1; (+) strand; PAM type: NRG; PAM sequence: GGG
ttattctaggagccatgcct

SEQ ID NO: 106889 - DNA, 20 bp, Artificial Sequence
  Description of Artificial Sequence: Synthetic oligonucleotide
  Target: ATXN1; (+) strand; PAM type: NRG; PAM sequence: TGG
gagccatgcctgggatgtcg

SEQ ID NO: 106890 - DNA, 20 bp, Artificial Sequence
  Description of Artificial Sequence: Synthetic oligonucleotide
  Target: ATXN1; (+) strand; PAM type: NRG; PAM sequence: TGG
ccatgcctgggatgtcgtgg

SEQ ID NO: 106891 - DNA, 20 bp, Artificial Sequence
  Description of Artificial Sequence: Synthetic oligonucleotide
  Target: ATXN1; (+) strand; PAM type: NRG; PAM sequence: AAG
cctgggatgtcgtggtggct

SEQ ID NO: 106892 - DNA, 20 bp, Artificial Sequence
  Description of Artificial Sequence: Synthetic oligonucleotide
  Target: ATXN1; (+) strand; PAM type: NRG; PAM sequence: TGG
ggatgtcgtggtggctaaga

SEQ ID NO: 106893 - DNA, 20 bp, Artificial Sequence
  Description of Artificial Sequence: Synthetic oligonucleotide
  Target: ATXN1; (+) strand; PAM type: NRG; PAM sequence: GAG
atgtcgtggtggctaagatg

SEQ ID NO: 106894 - DNA, 20 bp, Artificial Sequence
  Description of Artificial Sequence: Synthetic oligonucleotide
  Target: ATXN1; (+) strand; PAM type: NRG; PAM sequence: TGG
taagatggagtccctactat

SEQ ID NO: 106895 - DNA, 20 bp, Artificial Sequence
  Description of Artificial Sequence: Synthetic oligonucleotide
  Target: ATXN1; (+) strand; PAM type: NRG; PAM sequence: GGG
aagatggagtccctactatt

SEQ ID NO: 106896 - DNA, 20 bp, Artificial Sequence
  Description of Artificial Sequence: Synthetic oligonucleotide
  Target: ATXN1; (+) strand; PAM type: NRG; PAM sequence: GAG
gatggagtccctactattgg

SEQ ID NO: 106897 - DNA, 20 bp, Artificial Sequence
  Description of Artificial Sequence: Synthetic oligonucleotide
  Target: ATXN1; (+) strand; PAM type: NRG; PAM sequence: TAG
agtccctactattgggagca

SEQ ID NO: 106898 - DNA, 20 bp, Artificial Sequence
  Description of Artificial Sequence: Synthetic oligonucleotide
  Target: ATXN1; (+) strand; PAM type: NRG; PAM sequence: GAG
tccctactattgggagcata

SEQ ID NO: 106899 - DNA, 20 bp, Artificial Sequence
  Description of Artificial Sequence: Synthetic oligonucleotide
  Target: ATXN1; (+) strand; PAM type: NRG; PAM sequence: CAG
ctattgggagcatagagtgt

SEQ ID NO: 106900 - DNA, 20 bp, Artificial Sequence
  Description of Artificial Sequence: Synthetic oligonucleotide
  Target: ATXN1; (+) strand; PAM type: NRG; PAM sequence: AAG
agcatagagtgtcagaaatt

SEQ ID NO: 106901 - DNA, 20 bp, Artificial Sequence
  Description of Artificial Sequence: Synthetic oligonucleotide
  Target: ATXN1; (+) strand; PAM type: NRG; PAM sequence: GAG
catagagtgtcagaaattaa

SEQ ID NO: 106902 - DNA, 20 bp, Artificial Sequence
  Description of Artificial Sequence: Synthetic oligonucleotide
  Target: ATXN1; (+) strand; PAM type: NRG; PAM sequence: CAG
taagagaatgcaataaattc

SEQ ID NO: 106903 - DNA, 20 bp, Artificial Sequence
  Description of Artificial Sequence: Synthetic oligonucleotide
  Target: ATXN1; (+) strand; PAM type: NRG; PAM sequence: TAG
gagaatgcaataaattccag

SEQ ID NO: 106904 - DNA, 20 bp, Artificial Sequence
  Description of Artificial Sequence: Synthetic oligonucleotide
  Target: ATXN1; (+) strand; PAM type: NRG; PAM sequence: GAG
gaatgcaataaattccagta

SEQ ID NO: 106905 - DNA, 20 bp, Artificial Sequence
  Description of Artificial Sequence: Synthetic oligonucleotide
  Target: ATXN1; (+) strand; PAM type: NRG; PAM sequence: TGG
gcaataaattccagtagaga

SEQ ID NO: 106906 - DNA, 20 bp, Artificial Sequence
  Description of Artificial Sequence: Synthetic oligonucleotide
  Target: ATXN1; (+) strand; PAM type: NRG; PAM sequence: GGG
caataaattccagtagagat

SEQ ID NO: 106907 - DNA, 20 bp, Artificial Sequence
  Description of Artificial Sequence: Synthetic oligonucleotide
  Target: ATXN1; (+) strand; PAM type: NRG; PAM sequence: TAG
caatttgctttcacaccaac

SEQ ID NO: 106908 - DNA, 20 bp, Artificial Sequence
  Description of Artificial Sequence: Synthetic oligonucleotide
  Target: ATXN1; (+) strand; PAM type: NRG; PAM sequence: TGG
tgctttcacaccaactagaa

SEQ ID NO: 106909 - DNA, 20 bp, Artificial Sequence
  Description of Artificial Sequence: Synthetic oligonucleotide
  Target: ATXN1; (+) strand; PAM type: NRG; PAM sequence: AAG
caccaactagaatggtgtga

SEQ ID NO: 106910 - DNA, 20 bp, Artificial Sequence
  Description of Artificial Sequence: Synthetic oligonucleotide
  Target: ATXN1; (+) strand; PAM type: NRG; PAM sequence: TGG
actagaatggtgtgaaagaa

SEQ ID NO: 106911 - DNA, 20 bp, Artificial Sequence
  Description of Artificial Sequence: Synthetic oligonucleotide
  Target: ATXN1; (+) strand; PAM type: NRG; PAM sequence: AAG
gtgtgaaagaatggtttgca

SEQ ID NO: 106912 - DNA, 20 bp, Artificial Sequence
  Description of Artificial Sequence: Synthetic oligonucleotide
  Target: ATXN1; (+) strand; PAM type: NRG; PAM sequence: AAG
aatgatgcataccatcgtct

SEQ ID NO: 106913 - DNA, 20 bp, Artificial Sequence
  Description of Artificial Sequence: Synthetic oligonucleotide
  Target: ATXN1; (+) strand; PAM type: NRG; PAM sequence: TAG
tgcataccatcgtctaagaa

SEQ ID NO: 106914 - DNA, 20 bp, Artificial Sequence
  Description of Artificial Sequence: Synthetic oligonucleotide
  Target: ATXN1; (+) strand; PAM type: NRG; PAM sequence: AAG
atagcacttaatttacttac

SEQ ID NO: 106915 - DNA, 20 bp, Artificial Sequence
  Description of Artificial Sequence: Synthetic oligonucleotide
  Target: ATXN1; (+) strand; PAM type: NRG; PAM sequence: AAG
gcacttaatttacttacaag

SEQ ID NO: 106916 - DNA, 20 bp, Artificial Sequence
  Description of Artificial Sequence: Synthetic oligonucleotide
  Target: ATXN1; (+) strand; PAM type: NRG; PAM sequence: AGG
cacttaatttacttacaaga

SEQ ID NO: 106917 - DNA, 20 bp, Artificial Sequence
  Description of Artificial Sequence: Synthetic oligonucleotide
  Target: ATXN1; (+) strand; PAM type: NRG; PAM sequence: TGG
caagaaggaactgttttaat

SEQ ID NO: 106918 - DNA, 20 bp, Artificial Sequence
  Description of Artificial Sequence: Synthetic oligonucleotide
  Target: ATXN1; (+) strand; PAM type: NRG; PAM sequence: GAG
atattttgttaattaaaaat

SEQ ID NO: 106919 - DNA, 20 bp, Artificial Sequence
  Description of Artificial Sequence: Synthetic oligonucleotide
  Target: ATXN1; (+) strand; PAM type: NRG; PAM sequence: TAG
gaacacttatgtgaactaaa

SEQ ID NO: 106920 - DNA, 20 bp, Artificial Sequence
  Description of Artificial Sequence: Synthetic oligonucleotide
  Target: ATXN1; (+) strand; PAM type: NRG; PAM sequence: AGG
aacacttatgtgaactaaat

SEQ ID NO: 106921 - DNA, 20 bp, Artificial Sequence
  Description of Artificial Sequence: Synthetic oligonucleotide
  Target: ATXN1; (+) strand; PAM type: NRG; PAM sequence: GAG
cacttatgtgaactaaatag

SEQ ID NO: 106922 - DNA, 20 bp, Artificial Sequence
  Description of Artificial Sequence: Synthetic oligonucleotide
  Target: ATXN1; (+) strand; PAM type: NRG; PAM sequence: GAG
ctaaataggagctaatacat

SEQ ID NO: 106923 - DNA, 20 bp, Artificial Sequence
  Description of Artificial Sequence: Synthetic oligonucleotide
  Target: ATXN1; (+) strand; PAM type: NRG; PAM sequence: TAG
tacatgagataaaaattatg

SEQ ID NO: 106924 - DNA, 20 bp, Artificial Sequence
  Description of Artificial Sequence: Synthetic oligonucleotide
  Target: ATXN1; (+) strand; PAM type: NRG; PAM sequence: CAG
ttgcttttcattaattgaat

SEQ ID NO: 106925 - DNA, 20 bp, Artificial Sequence
  Description of Artificial Sequence: Synthetic oligonucleotide
  Target: ATXN1; (+) strand; PAM type: NRG; PAM sequence: TGG
tttcattaattgaatcagac

SEQ ID NO: 106926 - DNA, 20 bp, Artificial Sequence
  Description of Artificial Sequence: Synthetic oligonucleotide
  Target: ATXN1; (+) strand; PAM type: NRG; PAM sequence: AAG
aatcagactggactttctcc

SEQ ID NO: 106927 - DNA, 20 bp, Artificial Sequence
  Description of Artificial Sequence: Synthetic oligonucleotide
  Target: ATXN1; (+) strand; PAM type: NRG; PAM sequence: GAG
ctttctccaagcatgtgaat

SEQ ID NO: 106928 - DNA, 20 bp, Artificial Sequence
  Description of Artificial Sequence: Synthetic oligonucleotide
  Target: ATXN1; (+) strand; PAM type: NRG; PAM sequence: GAG
ctccaagcatgtgaatgagt

SEQ ID NO: 106929 - DNA, 20 bp, Artificial Sequence
  Description of Artificial Sequence: Synthetic oligonucleotide
  Target: ATXN1; (+) strand; PAM type: NRG; PAM sequence: AGG
tccaagcatgtgaatgagtg

SEQ ID NO: 106930 - DNA, 20 bp, Artificial Sequence
  Description of Artificial Sequence: Synthetic oligonucleotide
  Target: ATXN1; (+) strand; PAM type: NRG; PAM sequence: TAG
tattgtaccatgcaaaaact

SEQ ID NO: 106931 - DNA, 20 bp, Artificial Sequence
  Description of Artificial Sequence: Synthetic oligonucleotide
  Target: ATXN1; (+) strand; PAM type: NRG; PAM sequence: AGG
attgtaccatgcaaaaactt

SEQ ID NO: 106932 - DNA, 20 bp, Artificial Sequence
  Description of Artificial Sequence: Synthetic oligonucleotide
  Target: ATXN1; (+) strand; PAM type: NRG; PAM sequence: CAG
gcaaaaacttaggatcttta

SEQ ID NO: 106933 - DNA, 20 bp, Artificial Sequence
  Description of Artificial Sequence: Synthetic oligonucleotide
  Target: ATXN1; (+) strand; PAM type: NRG; PAM sequence: AGG
caaaaacttaggatctttac

SEQ ID NO: 106934 - DNA, 20 bp, Artificial Sequence
  Description of Artificial Sequence: Synthetic oligonucleotide
  Target: ATXN1; (+) strand; PAM type: NRG; PAM sequence: TAG
ttattatttgtatttaacac

SEQ ID NO: 106935 - DNA, 20 bp, Artificial Sequence
  Description of Artificial Sequence: Synthetic oligonucleotide
  Target: ATXN1; (+) strand; PAM type: NRG; PAM sequence: CAG
atttaacactagttccattt

SEQ ID NO: 106936 - DNA, 20 bp, Artificial Sequence
  Description of Artificial Sequence: Synthetic oligonucleotide
  Target: ATXN1; (+) strand; PAM type: NRG; PAM sequence: TGG
aacactagttccatttcagc

SEQ ID NO: 106937 - DNA, 20 bp, Artificial Sequence
  Description of Artificial Sequence: Synthetic oligonucleotide
  Target: ATXN1; (+) strand; PAM type: NRG; PAM sequence: CAG
ctagttccatttcagctggt

SEQ ID NO: 106938 - DNA, 20 bp, Artificial Sequence
  Description of Artificial Sequence: Synthetic oligonucleotide
  Target: ATXN1; (+) strand; PAM type: NRG; PAM sequence: AAG
tccatttcagctggtcagat

SEQ ID NO: 106939 - DNA, 20 bp, Artificial Sequence
  Description of Artificial Sequence: Synthetic oligonucleotide
  Target: ATXN1; (+) strand; PAM type: NRG; PAM sequence: AAG
atttcagctggtcagataag

SEQ ID NO: 106940 - DNA, 20 bp, Artificial Sequence
  Description of Artificial Sequence: Synthetic oligonucleotide
  Target: ATXN1; (+) strand; PAM type: NRG; PAM sequence: TAG
tcagataagaagaaatgtga

SEQ ID NO: 106941 - DNA, 20 bp, Artificial Sequence
  Description of Artificial Sequence: Synthetic oligonucleotide
  Target: ATXN1; (+) strand; PAM type: NRG; PAM sequence: AAG
aagaagaaatgtgatagcaa

SEQ ID NO: 106942 - DNA, 20 bp, Artificial Sequence
  Description of Artificial Sequence: Synthetic oligonucleotide
  Target: ATXN1; (+) strand; PAM type: NRG; PAM sequence: AAG
tgtgatagcaaaagatatgc

SEQ ID NO: 106943 - DNA, 20 bp, Artificial Sequence
  Description of Artificial Sequence: Synthetic oligonucleotide
  Target: ATXN1; (+) strand; PAM type: NRG; PAM sequence: AAG
gttaatctgctcttaaaaaa

SEQ ID NO: 106944 - DNA, 20 bp, Artificial Sequence
  Description of Artificial Sequence: Synthetic oligonucleotide
  Target: ATXN1; (+) strand; PAM type: NRG; PAM sequence: AAG
tatttgacctgaattgatac

SEQ ID NO: 106945 - DNA, 20 bp, Artificial Sequence
  Description of Artificial Sequence: Synthetic oligonucleotide
  Target: ATXN1; (+) strand; PAM type: NRG; PAM sequence: GAG
acaagtgttttctttttttt

SEQ ID NO: 106946 - DNA, 20 bp, Artificial Sequence
  Description of Artificial Sequence: Synthetic oligonucleotide
  Target: ATXN1; (+) strand; PAM type: NRG; PAM sequence: GAG
tgttttcttttttttgagcc

SEQ ID NO: 106947 - DNA, 20 bp, Artificial Sequence
  Description of Artificial Sequence: Synthetic oligonucleotide
  Target: ATXN1; (+) strand; PAM type: NRG; PAM sequence: CAG
ttcttttttttgagccgaga

SEQ ID NO: 106948 - DNA, 20 bp, Artificial Sequence
  Description of Artificial Sequence: Synthetic oligonucleotide
  Target: ATXN1; (+) strand; PAM type: NRG; PAM sequence: AGG
tcttttttttgagccgagac

SEQ ID NO: 106949 - DNA, 20 bp, Artificial Sequence
  Description of Artificial Sequence: Synthetic oligonucleotide
  Target: ATXN1; (+) strand; PAM type: NRG; PAM sequence: GGG
cttttttttgagccgagaca

SEQ ID NO: 106950 - DNA, 20 bp, Artificial Sequence
  Description of Artificial Sequence: Synthetic oligonucleotide
  Target: ATXN1; (+) strand; PAM type: NRG; PAM sequence: TAG
gggtcttgctctgttgcatc

SEQ ID NO: 106951 - DNA, 20 bp, Artificial Sequence
  Description of Artificial Sequence: Synthetic oligonucleotide
  Target: ATXN1; (+) strand; PAM type: NRG; PAM sequence: GAG
gtcttgctctgttgcatcta

SEQ ID NO: 106952 - DNA, 20 bp, Artificial Sequence
  Description of Artificial Sequence: Synthetic oligonucleotide
  Target: ATXN1; (+) strand; PAM type: NRG; PAM sequence: CAG
gctctgttgcatctagagtg

SEQ ID NO: 106953 - DNA, 20 bp, Artificial Sequence
  Description of Artificial Sequence: Synthetic oligonucleotide
  Target: ATXN1; (+) strand; PAM type: NRG; PAM sequence: TGG
ctgttgcatctagagtgcag

SEQ ID NO: 106954 - DNA, 20 bp, Artificial Sequence
  Description of Artificial Sequence: Synthetic oligonucleotide
  Target: ATXN1; (+) strand; PAM type: NRG; PAM sequence: TAG
agagtgcagtggtgcaatca

SEQ ID NO: 106955 - DNA, 20 bp, Artificial Sequence
  Description of Artificial Sequence: Synthetic oligonucleotide
  Target: ATXN1; (+) strand; PAM type: NRG; PAM sequence: CAG
ggtgcaatcatagctcactg

SEQ ID NO: 106956 - DNA, 20 bp, Artificial Sequence
  Description of Artificial Sequence: Synthetic oligonucleotide
  Target: ATXN1; (+) strand; PAM type: NRG; PAM sequence: TGG
tcactgcagtctcaaactgc

SEQ ID NO: 106957 - DNA, 20 bp, Artificial Sequence
  Description of Artificial Sequence: Synthetic oligonucleotide
  Target: ATXN1; (+) strand; PAM type: NRG; PAM sequence: AAG
cagtctcaaactgctggctc

SEQ ID NO: 106958 - DNA, 20 bp, Artificial Sequence
  Description of Artificial Sequence: Synthetic oligonucleotide
  Target: ATXN1; (+) strand; PAM type: NRG; PAM sequence: CAG
ctcaagtgatcctcccatct

SEQ ID NO: 106959 - DNA, 20 bp, Artificial Sequence
  Description of Artificial Sequence: Synthetic oligonucleotide
  Target: ATXN1; (+) strand; PAM type: NRG; PAM sequence: GAG
tcctcccatctcagcttcct

SEQ ID NO: 106960 - DNA, 20 bp, Artificial Sequence
  Description of Artificial Sequence: Synthetic oligonucleotide
  Target: ATXN1; (+) strand; PAM type: NRG; PAM sequence: TAG
tcccatctcagcttcctgag

SEQ ID NO: 106961 - DNA, 20 bp, Artificial Sequence
  Description of Artificial Sequence: Synthetic oligonucleotide
  Target: ATXN1; (+) strand; PAM type: NRG; PAM sequence: TGG
atctcagcttcctgagtagc

SEQ ID NO: 106962 - DNA, 20 bp, Artificial Sequence
  Description of Artificial Sequence: Synthetic oligonucleotide
  Target: ATXN1; (+) strand; PAM type: NRG; PAM sequence: GGG
tctcagcttcctgagtagct

SEQ ID NO: 106963 - DNA, 20 bp, Artificial Sequence
  Description of Artificial Sequence: Synthetic oligonucleotide
  Target: ATXN1; (+) strand; PAM type: NRG; PAM sequence: CAG
ttcctgagtagctgggacta

SEQ ID NO: 106964 - DNA, 20 bp, Artificial Sequence
  Description of Artificial Sequence: Synthetic oligonucleotide
  Target: ATXN1; (+) strand; PAM type: NRG; PAM sequence: AGG
tcctgagtagctgggactac

SEQ ID NO: 106965 - DNA, 20 bp, Artificial Sequence
  Description of Artificial Sequence: Synthetic oligonucleotide
  Target: ATXN1; (+) strand; PAM type: NRG; PAM sequence: TGG
tacaggcatgccactatgcc

SEQ ID NO: 106966 - DNA, 20 bp, Artificial Sequence
  Description of Artificial Sequence: Synthetic oligonucleotide
  Target: ATXN1; (+) strand; PAM type: NRG; PAM sequence: CAG
atttttatttttattttttt

SEQ ID NO: 106967 - DNA, 20 bp, Artificial Sequence
  Description of Artificial Sequence: Synthetic oligonucleotide
  Target: ATXN1; (+) strand; PAM type: NRG; PAM sequence: TAG
tttatttttatttttttcag

SEQ ID NO: 106968 - DNA, 20 bp, Artificial Sequence
  Description of Artificial Sequence: Synthetic oligonucleotide
  Target: ATXN1; (+) strand; PAM type: NRG; PAM sequence: GAG
tatttttatttttttcagta

SEQ ID NO: 106969 - DNA, 20 bp, Artificial Sequence
  Description of Artificial Sequence: Synthetic oligonucleotide
  Target: ATXN1; (+) strand; PAM type: NRG; PAM sequence: TGG
ttatttttttcagtagagat

SEQ ID NO: 106970 - DNA, 20 bp, Artificial Sequence
  Description of Artificial Sequence: Synthetic oligonucleotide
  Target: ATXN1; (+) strand; PAM type: NRG; PAM sequence: GGG
tatttttttcagtagagatt

SEQ ID NO: 106971 - DNA, 20 bp, Artificial Sequence
  Description of Artificial Sequence: Synthetic oligonucleotide
  Target: ATXN1; (+) strand; PAM type: NRG; PAM sequence: TGG
gtagagattgggtcttgcta

SEQ ID NO: 106972 - DNA, 20 bp, Artificial Sequence
  Description of Artificial Sequence: Synthetic oligonucleotide
  Target: ATXN1; (+) strand; PAM type: NRG; PAM sequence: TAG
ttgggtcttgctatggtacc

SEQ ID NO: 106973 - DNA, 20 bp, Artificial Sequence
  Description of Artificial Sequence: Synthetic oligonucleotide
  Target: ATXN1; (+) strand; PAM type: NRG; PAM sequence: AGG
tgggtcttgctatggtacct

SEQ ID NO: 106974 - DNA, 20 bp, Artificial Sequence
  Description of Artificial Sequence: Synthetic oligonucleotide
  Target: ATXN1; (+) strand; PAM type: NRG; PAM sequence: TGG
tcttgctatggtacctaggc

SEQ ID NO: 106975 - DNA, 20 bp, Artificial Sequence
  Description of Artificial Sequence: Synthetic oligonucleotide
  Target: ATXN1; (+) strand; PAM type: NRG; PAM sequence: TGG
ctaggctggtctcaaaatcc

SEQ ID NO: 106976 - DNA, 20 bp, Artificial Sequence
  Description of Artificial Sequence: Synthetic oligonucleotide
  Target: ATXN1; (+) strand; PAM type: NRG; PAM sequence: GGG
taggctggtctcaaaatcct

SEQ ID NO: 106977 - DNA, 20 bp, Artificial Sequence
  Description of Artificial Sequence: Synthetic oligonucleotide
  Target: ATXN1; (+) strand; PAM type: NRG; PAM sequence: AAG
ggtctcaaaatcctgggctc

SEQ ID NO: 106978 - DNA, 20 bp, Artificial Sequence
  Description of Artificial Sequence: Synthetic oligonucleotide
  Target: ATXN1; (+) strand; PAM type: NRG; PAM sequence: TAG
ctcaagtgatcctcctgcct

SEQ ID NO: 106979 - DNA, 20 bp, Artificial Sequence
  Description of Artificial Sequence: Synthetic oligonucleotide
  Target: ATXN1; (+) strand; PAM type: NRG; PAM sequence: AAG
cctcctgccttagcctccca

SEQ ID NO: 106980 - DNA, 20 bp, Artificial Sequence
  Description of Artificial Sequence: Synthetic oligonucleotide
  Target: ATXN1; (+) strand; PAM type: NRG; PAM sequence: TGG
gccttagcctcccaaagtgc

SEQ ID NO: 106981 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctggaatta

SEQ ID NO: 106982 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctggaattac

SEQ ID NO: 106983 - DNA, 20 bp, Artificial Sequence
  Description of Artificial Sequence: Synthetic oligonucleotide
  Target: ATXN1; (+) strand; PAM type: NRG; PAM sequence: GAG
agtgctggaattacaggcat

SEQ ID NO: 106984 - DNA, 20 bp, Artificial Sequence
  Description of Artificial Sequence: Synthetic oligonucleotide
  Target: ATXN1; (+) strand; PAM type: NRG; PAM sequence: CAG
caggcatgagccaccatgcc

SEQ ID NO: 106985 - DNA, 20 bp, Artificial Sequence
  Description of Artificial Sequence: Synthetic oligonucleotide
  Target: ATXN1; (+) strand; PAM type: NRG; PAM sequence: CAG
gccaccatgcccagcccata

SEQ ID NO: 106986 - DNA, 20 bp, Artificial Sequence
  Description of Artificial Sequence: Synthetic oligonucleotide
  Target: ATXN1; (+) strand; PAM type: NRG; PAM sequence: AGG
ccaccatgcccagcccatac

SEQ ID NO: 106987 - DNA, 20 bp, Artificial Sequence
  Description of Artificial Sequence: Synthetic oligonucleotide
  Target: ATXN1; (+) strand; PAM type: NRG; PAM sequence: TGG
cccatacaggtgttttaatt

SEQ ID NO: 106988 - DNA, 20 bp, Artificial Sequence
  Description of Artificial Sequence: Synthetic oligonucleotide
  Target: ATXN1; (+) strand; PAM type: NRG; PAM sequence: CAG
ggtttaatcccaaatgtcta

SEQ ID NO: 106989 - DNA, 20 bp, Artificial Sequence
  Description of Artificial Sequence: Synthetic oligonucleotide
  Target: ATXN1; (+) strand; PAM type: NRG; PAM sequence: GAG
tttaatcccaaatgtctaca

SEQ ID NO: 106990 - DNA, 20 bp, Artificial Sequence
  Description of Artificial Sequence: Synthetic oligonucleotide
  Target: ATXN1; (+) strand; PAM type: NRG; PAM sequence: AGG
ttaatcccaaatgtctacag

SEQ ID NO: 106991 - DNA, 20 bp, Artificial Sequence
  Description of Artificial Sequence: Synthetic oligonucleotide
  Target: ATXN1; (+) strand; PAM type: NRG; PAM sequence: CAG
ccaaatgtctacagaggtca

SEQ ID NO: 106992 - DNA, 20 bp, Artificial Sequence
  Description of Artificial Sequence: Synthetic oligonucleotide
  Target: ATXN1; (+) strand; PAM type: NRG; PAM sequence: AGG
caaatgtctacagaggtcac

SEQ ID NO: 106993 - DNA, 20 bp, Artificial Sequence
  Description of Artificial Sequence: Synthetic oligonucleotide
  Target: ATXN1; (+) strand; PAM type: NRG; PAM sequence: TGG
tctttgacttctttctctac

SEQ ID NO: 106994 - DNA, 20 bp, Artificial Sequence
  Description of Artificial Sequence: Synthetic oligonucleotide
  Target: ATXN1; (+) strand; PAM type: NRG; PAM sequence: CAG
tctttatgtgtgattaaacc

SEQ ID NO: 106995 - DNA, 20 bp, Artificial Sequence
  Description of Artificial Sequence: Synthetic oligonucleotide
  Target: ATXN1; (+) strand; PAM type: NRG; PAM sequence: AGG
ctttatgtgtgattaaaccc

SEQ ID NO: 106996 - DNA, 20 bp, Artificial Sequence
  Description of Artificial Sequence: Synthetic oligonucleotide
  Target: ATXN1; (+) strand; PAM type: NRG; PAM sequence: GGG
tttatgtgtgattaaaccca

SEQ ID NO: 106997 - DNA, 20 bp, Artificial Sequence
  Description of Artificial Sequence: Synthetic oligonucleotide
  Target: ATXN1; (+) strand; PAM type: NRG; PAM sequence: AAG
tgtgtgattaaacccagggc

SEQ ID NO: 106998 - DNA, 20 bp, Artificial Sequence
  Description of Artificial Sequence: Synthetic oligonucleotide
  Target: ATXN1; (+) strand; PAM type: NRG; PAM sequence: CAG
tgattaaacccagggcaagc

SEQ ID NO: 106999 - DNA, 20 bp, Artificial Sequence
  Description of Artificial Sequence: Synthetic oligonucleotide
  Target: ATXN1; (+) strand; PAM type: NRG; PAM sequence: GAG
attaaacccagggcaagcca

SEQ ID NO: 107000 - DNA, 20 bp, Artificial Sequence
  Description of Artificial Sequence: Synthetic oligonucleotide
  Target: ATXN1; (+) strand; PAM type: NRG; PAM sequence: CAG
gcaagccagagtcaataaat

SEQ ID NO: 107001 - DNA, 20 bp, Artificial Sequence
  Description of Artificial Sequence: Synthetic oligonucleotide
  Target: ATXN1; (+) strand; PAM type: NRG; PAM sequence: TAG
acatttttaaaattgctttt

SEQ ID NO: 107002 - DNA, 20 bp, Artificial Sequence
  Description of Artificial Sequence: Synthetic oligonucleotide
  Target: ATXN1; (+) strand; PAM type: NRG; PAM sequence: AAG
ttttagaaaatcaacaaatt

SEQ ID NO: 107003 - DNA, 20 bp, Artificial Sequence
  Description of Artificial Sequence: Synthetic oligonucleotide
  Target: ATXN1; (+) strand; PAM type: NRG; PAM sequence: AGG
tttagaaaatcaacaaatta

SEQ ID NO: 107004 - DNA, 20 bp, Artificial Sequence
  Description of Artificial Sequence: Synthetic oligonucleotide
  Target: ATXN1; (+) strand; PAM type: NRG; PAM sequence: CAG
tctatttttcttttataaaa

SEQ ID NO: 107005 - DNA, 20 bp, Artificial Sequence
  Description of Artificial Sequence: Synthetic oligonucleotide
  Target: ATXN1; (+) strand; PAM type: NRG; PAM sequence: AGG
ctatttttcttttataaaac

SEQ ID NO: 107006 - DNA, 20 bp, Artificial Sequence
  Description of Artificial Sequence: Synthetic oligonucleotide
  Target: ATXN1; (+) strand; PAM type: NRG; PAM sequence: AAG
tttttcttttataaaacagg

SEQ ID NO: 107007 - DNA, 20 bp, Artificial Sequence
  Description of Artificial Sequence: Synthetic oligonucleotide
  Target: ATXN1; (+) strand; PAM type: NRG; PAM sequence: AGG
ttttcttttataaaacagga

SEQ ID NO: 107008 - DNA, 20 bp, Artificial Sequence
  Description of Artificial Sequence: Synthetic oligonucleotide
  Target: ATXN1; (+) strand; PAM type: NRG; PAM sequence: TAG
tataaaacaggaaggaatat

SEQ ID NO: 107009 - DNA, 20 bp, Artificial Sequence
  Description of Artificial Sequence: Synthetic oligonucleotide
  Target: ATXN1; (+) strand; PAM type: NRG; PAM sequence: CAG
aggaaggaatattagaaaca

SEQ ID NO: 107010 - DNA, 20 bp, Artificial Sequence
  Description of Artificial Sequence: Synthetic oligonucleotide
  Target: ATXN1; (+) strand; PAM type: NRG; PAM sequence: AGG
ggaaggaatattagaaacac

SEQ ID NO: 107011 - DNA, 20 bp, Artificial Sequence
  Description of Artificial Sequence: Synthetic oligonucleotide
  Target: ATXN1; (+) strand; PAM type: NRG; PAM sequence: AAG
aggaatattagaaacacagg

SEQ ID NO: 107012 - DNA, 20 bp, Artificial Sequence
  Description of Artificial Sequence: Synthetic oligonucleotide
  Target: ATXN1; (+) strand; PAM type: NRG; PAM sequence: CAG
acacaggaagttgaacatct

SEQ ID NO: 107013 - DNA, 20 bp, Artificial Sequence
  Description of Artificial Sequence: Synthetic oligonucleotide
  Target: ATXN1; (+) strand; PAM type: NRG; PAM sequence: AAG
tgaacatctcagtaaatgcc

SEQ ID NO: 107014 - DNA, 20 bp, Artificial Sequence
  Description of Artificial Sequence: Synthetic oligonucleotide
  Target: ATXN1; (+) strand; PAM type: NRG; PAM sequence: AAG
acatctcagtaaatgccaag

SEQ ID NO: 107015 - DNA, 20 bp, Artificial Sequence
  Description of Artificial Sequence: Synthetic oligonucleotide
  Target: ATXN1; (+) strand; PAM type: NRG; PAM sequence: AGG
catctcagtaaatgccaaga

SEQ ID NO: 107016 - DNA, 20 bp, Artificial Sequence
  Description of Artificial Sequence: Synthetic oligonucleotide
  Target: ATXN1; (+) strand; PAM type: NRG; PAM sequence: GAG
tctcagtaaatgccaagaag

SEQ ID NO: 107017 - DNA, 20 bp, Artificial Sequence
  Description of Artificial Sequence: Synthetic oligonucleotide
  Target: ATXN1; (+) strand; PAM type: NRG; PAM sequence: TGG
ccaagaaggagattgtgcct

SEQ ID NO: 107018 - DNA, 20 bp, Artificial Sequence
  Description of Artificial Sequence: Synthetic oligonucleotide
  Target: ATXN1; (+) strand; PAM type: NRG; PAM sequence: GAG
aagaaggagattgtgccttg

SEQ ID NO: 107019 - DNA, 20 bp, Artificial Sequence
  Description of Artificial Sequence: Synthetic oligonucleotide
  Target: ATXN1; (+) strand; PAM type: NRG; PAM sequence: AGG
agaaggagattgtgccttgg

SEQ ID NO: 107020 - DNA, 20 bp, Artificial Sequence
  Description of Artificial Sequence: Synthetic oligonucleotide
  Target: ATXN1; (+) strand; PAM type: NRG; PAM sequence: AAG
ggagattgtgccttggagga

SEQ ID NO: 107021 - DNA, 20 bp, Artificial Sequence
  Description of Artificial Sequence: Synthetic oligonucleotide
  Target: ATXN1; (+) strand; PAM type: NRG; PAM sequence: AGG
gagattgtgccttggaggaa

SEQ ID NO: 107022 - DNA, 20 bp, Artificial Sequence
  Description of Artificial Sequence: Synthetic oligonucleotide
  Target: ATXN1; (+) strand; PAM type: NRG; PAM sequence: TGG
ttgtgccttggaggaaaggt

SEQ ID NO: 107023 - DNA, 20 bp, Artificial Sequence
  Description of Artificial Sequence: Synthetic oligonucleotide
  Target: ATXN1; (+) strand; PAM type: NRG; PAM sequence: TGG
ccttggaggaaaggttggca

SEQ ID NO: 107024 - DNA, 20 bp, Artificial Sequence
  Description of Artificial Sequence: Synthetic oligonucleotide
  Target: ATXN1; (+) strand; PAM type: NRG; PAM sequence: GAG
ttggaggaaaggttggcatg

SEQ ID NO: 107025 - DNA, 20 bp, Artificial Sequence
  Description of Artificial Sequence: Synthetic oligonucleotide
  Target: ATXN1; (+) strand; PAM type: NRG; PAM sequence: CAG
aggaaaggttggcatggagc

SEQ ID NO: 107026 - DNA, 20 bp, Artificial Sequence
  Description of Artificial Sequence: Synthetic oligonucleotide
  Target: ATXN1; (+) strand; PAM type: NRG; PAM sequence: TGG
ccagtatccttctgtgccct

SEQ ID NO: 107027 - DNA, 20 bp, Artificial Sequence
  Description of Artificial Sequence: Synthetic oligonucleotide
  Target: ATXN1; (+) strand; PAM type: NRG; PAM sequence: CAG
ttctgtgcccttggtctcac

SEQ ID NO: 107028 - DNA, 20 bp, Artificial Sequence
  Description of Artificial Sequence: Synthetic oligonucleotide
  Target: ATXN1; (+) strand; PAM type: NRG; PAM sequence: CAG
gcccttggtctcaccagacc

SEQ ID NO: 107029 - DNA, 20 bp, Artificial Sequence
  Description of Artificial Sequence: Synthetic oligonucleotide
  Target: ATXN1; (+) strand; PAM type: NRG; PAM sequence: AGG
cccttggtctcaccagaccc

SEQ ID NO: 107030 - DNA, 20 bp, Artificial Sequence
  Description of Artificial Sequence: Synthetic oligonucleotide
  Target: ATXN1; (+) strand; PAM type: NRG; PAM sequence: GGG
ccttggtctcaccagaccca

SEQ ID NO: 107031 - DNA, 20 bp, Artificial Sequence
  Description of Artificial Sequence: Synthetic oligonucleotide
  Target: ATXN1; (+) strand; PAM type: NRG; PAM sequence: CAG
ggtctcaccagacccagggc

SEQ ID NO: 107032 - DNA, 20 bp, Artificial Sequence
  Description of Artificial Sequence: Synthetic oligonucleotide
  Target: ATXN1; (+) strand; PAM type: NRG; PAM sequence: AAG
agacccagggccagaccaat

SEQ ID NO: 107033 - DNA, 20 bp, Artificial Sequence
  Description of Artificial Sequence: Synthetic oligonucleotide
  Target: ATXN1; (+) strand; PAM type: NRG; PAM sequence: AAG
ccagggccagaccaataaga

SEQ ID NO: 107034 - DNA, 20 bp, Artificial Sequence
  Description of Artificial Sequence: Synthetic oligonucleotide
  Target: ATXN1; (+) strand; PAM type: NRG; PAM sequence: AAG
gggccagaccaataagaaag

SEQ ID NO: 107035 - DNA, 20 bp, Artificial Sequence
  Description of Artificial Sequence: Synthetic oligonucleotide
  Target: ATXN1; (+) strand; PAM type: NRG; PAM sequence: AGG
ggccagaccaataagaaaga

SEQ ID NO: 107036 - DNA, 20 bp, Artificial Sequence
  Description of Artificial Sequence: Synthetic oligonucleotide
  Target: ATXN1; (+) strand; PAM type: NRG; PAM sequence: GGG
gccagaccaataagaaagaa

SEQ ID NO: 107037 - DNA, 20 bp, Artificial Sequence
  Description of Artificial Sequence: Synthetic oligonucleotide
  Target: ATXN1; (+) strand; PAM type: NRG; PAM sequence: AAG
accaataagaaagaagggaa

SEQ ID NO: 107038 - DNA, 20 bp, Artificial Sequence
  Description of Artificial Sequence: Synthetic oligonucleotide
  Target: ATXN1; (+) strand; PAM type: NRG; PAM sequence: AGG
ccaataagaaagaagggaaa

SEQ ID NO: 107039 - DNA, 20 bp, Artificial Sequence
  Description of Artificial Sequence: Synthetic oligonucleotide
  Target: ATXN1; (+) strand; PAM type: NRG; PAM sequence: GGG
caataagaaagaagggaaaa

SEQ ID NO: 107040 - DNA, 20 bp, Artificial Sequence
  Description of Artificial Sequence: Synthetic oligonucleotide
  Target: ATXN1; (+) strand; PAM type: NRG; PAM sequence: AAG
gaagggaaaagggaaattaa

SEQ ID NO: 107041 - DNA, 20 bp, Artificial Sequence
  Description of Artificial Sequence: Synthetic oligonucleotide
  Target: ATXN1; (+) strand; PAM type: NRG; PAM sequence: AAG
gggaaaagggaaattaaaag

SEQ ID NO: 107042 - DNA, 20 bp, Artificial Sequence
  Description of Artificial Sequence: Synthetic oligonucleotide
  Target: ATXN1; (+) strand; PAM type: NRG; PAM sequence: CAG
aaagggaaattaaaagaagc

SEQ ID NO: 107043 - DNA, 20 bp, Artificial Sequence
  Description of Artificial Sequence: Synthetic oligonucleotide
  Target: ATXN1; (+) strand; PAM type: NRG; PAM sequence: GAG
agggaaattaaaagaagcca

SEQ ID NO: 107044 - DNA, 20 bp, Artificial Sequence
  Description of Artificial Sequence: Synthetic oligonucleotide
  Target: ATXN1; (+) strand; PAM type: NRG; PAM sequence: TGG
attaaaagaagccagagata

SEQ ID NO: 107045 - DNA, 20 bp, Artificial Sequence
  Description of Artificial Sequence: Synthetic oligonucleotide
  Target: ATXN1; (+) strand; PAM type: NRG; PAM sequence: CAG
aaagaagccagagatatgga

SEQ ID NO: 107046 - DNA, 20 bp, Artificial Sequence
  Description of Artificial Sequence: Synthetic oligonucleotide
  Target: ATXN1; (+) strand; PAM type: NRG; PAM sequence: AAG
ccagagatatggacagaaac

SEQ ID NO: 107047 - DNA, 20 bp, Artificial Sequence
  Description of Artificial Sequence: Synthetic oligonucleotide
  Target: ATXN1; (+) strand; PAM type: NRG; PAM sequence: GAG
agagatatggacagaaacaa

SEQ ID NO: 107048 - DNA, 20 bp, Artificial Sequence
  Description of Artificial Sequence: Synthetic oligonucleotide
  Target: ATXN1; (+) strand; PAM type: NRG; PAM sequence: AGG
gagatatggacagaaacaag

SEQ ID NO: 107049 - DNA, 20 bp, Artificial Sequence
  Description of Artificial Sequence: Synthetic oligonucleotide
  Target: ATXN1; (+) strand; PAM type: NRG; PAM sequence: AAG
atatggacagaaacaagagg

SEQ ID NO: 107050 - DNA, 20 bp, Artificial Sequence
  Description of Artificial Sequence: Synthetic oligonucleotide
  Target: ATXN1; (+) strand; PAM type: NRG; PAM sequence: AGG
tatggacagaaacaagagga

SEQ ID NO: 107051 - DNA, 20 bp, Artificial Sequence
  Description of Artificial Sequence: Synthetic oligonucleotide
  Target: ATXN1; (+) strand; PAM type: NRG; PAM sequence: GAG
tggacagaaacaagaggaag

SEQ ID NO: 107052 - DNA, 20 bp, Artificial Sequence
  Description of Artificial Sequence: Synthetic oligonucleotide
  Target: ATXN1; (+) strand; PAM type: NRG; PAM sequence: GAG
gacagaaacaagaggaagga

SEQ ID NO: 107053 - DNA, 20 bp, Artificial Sequence
  Description of Artificial Sequence: Synthetic oligonucleotide
  Target: ATXN1; (+) strand; PAM type: NRG; PAM sequence: TGG
aaacaagaggaaggagagaa

SEQ ID NO: 107054 - DNA, 20 bp, Artificial Sequence
  Description of Artificial Sequence: Synthetic oligonucleotide
  Target: ATXN1; (+) strand; PAM type: NRG; PAM sequence: AAG
agaggaaggagagaatggaa

SEQ ID NO: 107055 - DNA, 20 bp, Artificial Sequence
  Description of Artificial Sequence: Synthetic oligonucleotide
  Target: ATXN1; (+) strand; PAM type: NRG; PAM sequence: AAG
ggaaggagagaatggaaaag

SEQ ID NO: 107056 - DNA, 20 bp, Artificial Sequence
  Description of Artificial Sequence: Synthetic oligonucleotide
  Target: ATXN1; (+) strand; PAM type: NRG; PAM sequence: GAG
gagagaatggaaaagaagtt

SEQ ID NO: 107057 - DNA, 20 bp, Artificial Sequence
  Description of Artificial Sequence: Synthetic oligonucleotide
  Target: ATXN1; (+) strand; PAM type: NRG; PAM sequence: GAG
gagaatggaaaagaagttga

SEQ ID NO: 107058 - DNA, 20 bp, Artificial Sequence
  Description of Artificial Sequence: Synthetic oligonucleotide
  Target: ATXN1; (+) strand; PAM type: NRG; PAM sequence: AGG
agaatggaaaagaagttgag

SEQ ID NO: 107059 - DNA, 20 bp, Artificial Sequence
  Description of Artificial Sequence: Synthetic oligonucleotide
  Target: ATXN1; (+) strand; PAM type: NRG; PAM sequence: GGG
gaatggaaaagaagttgaga

SEQ ID NO: 107060 - DNA, 20 bp, Artificial Sequence
  Description of Artificial Sequence: Synthetic oligonucleotide
  Target: ATXN1; (+) strand; PAM type: NRG; PAM sequence: CAG
gaaaagaagttgagagggaa

SEQ ID NO: 107061 - DNA, 20 bp, Artificial Sequence
  Description of Artificial Sequence: Synthetic oligonucleotide
  Target: ATXN1; (+) strand; PAM type: NRG; PAM sequence: AAG
gaagttgagagggaacagaa

SEQ ID NO: 107062 - DNA, 20 bp, Artificial Sequence
  Description of Artificial Sequence: Synthetic oligonucleotide
  Target: ATXN1; (+) strand; PAM type: NRG; PAM sequence: AAG
gttgagagggaacagaaaag

SEQ ID NO: 107063 - DNA, 20 bp, Artificial Sequence
  Description of Artificial Sequence: Synthetic oligonucleotide
  Target: ATXN1; (+) strand; PAM type: NRG; PAM sequence: CAG
gggaacagaaaagaagtaca

SEQ ID NO: 107064 - DNA, 20 bp, Artificial Sequence
  Description of Artificial Sequence: Synthetic oligonucleotide
  Target: ATXN1; (+) strand; PAM type: NRG; PAM sequence: AGG
ggaacagaaaagaagtacac

SEQ ID NO: 107065 - DNA, 20 bp, Artificial Sequence
  Description of Artificial Sequence: Synthetic oligonucleotide
  Target: ATXN1; (+) strand; PAM type: NRG; PAM sequence: TAG
acagaaaagaagtacacagg

SEQ ID NO: 107066 - DNA, 20 bp, Artificial Sequence
  Description of Artificial Sequence: Synthetic oligonucleotide
  Target: ATXN1; (+) strand; PAM type: NRG; PAM sequence: TGG
aagaagtacacaggtagaat

SEQ ID NO: 107067 - DNA, 20 bp, Artificial Sequence
  Description of Artificial Sequence: Synthetic oligonucleotide
  Target: ATXN1; (+) strand; PAM type: NRG; PAM sequence: TGG
aagtacacaggtagaattgg

SEQ ID NO: 107068 - DNA, 20 bp, Artificial Sequence
  Description of Artificial Sequence: Synthetic oligonucleotide
  Target: ATXN1; (+) strand; PAM type: NRG; PAM sequence: GGG
agtacacaggtagaattggt

SEQ ID NO: 107069 - DNA, 20 bp, Artificial Sequence
  Description of Artificial Sequence: Synthetic oligonucleotide
  Target: ATXN1; (+) strand; PAM type: NRG; PAM sequence: GAG
cacaggtagaattggtgggt

SEQ ID NO: 107070 - DNA, 20 bp, Artificial Sequence
  Description of Artificial Sequence: Synthetic oligonucleotide
  Target: ATXN1; (+) strand; PAM type: NRG; PAM sequence: TGG
tagaattggtgggtgagctg

SEQ ID NO: 107071 - DNA, 20 bp, Artificial Sequence
  Description of Artificial Sequence: Synthetic oligonucleotide
  Target: ATXN1; (+) strand; PAM type: NRG; PAM sequence: GAG
gaattggtgggtgagctgtg

SEQ ID NO: 107072 - DNA, 20 bp, Artificial Sequence
  Description of Artificial Sequence: Synthetic oligonucleotide
  Target: ATXN1; (+) strand; PAM type: NRG; PAM sequence: GAG
ctgtggagaaactgcaaacc

SEQ ID NO: 107073 - DNA, 20 bp, Artificial Sequence
  Description of Artificial Sequence: Synthetic oligonucleotide
  Target: ATXN1; (+) strand; PAM type: NRG; PAM sequence: AAG
agaaactgcaaaccgagtga

SEQ ID NO: 107074 - DNA, 20 bp, Artificial Sequence
  Description of Artificial Sequence: Synthetic oligonucleotide
  Target: ATXN1; (+) strand; PAM type: NRG; PAM sequence: AAG
ctctaacactgaaatgcaat

SEQ ID NO: 107075 - DNA, 20 bp, Artificial Sequence
  Description of Artificial Sequence: Synthetic oligonucleotide
  Target: ATXN1; (+) strand; PAM type: NRG; PAM sequence: CAG
gcattactccatcccatgct

SEQ ID NO: 107076 - DNA, 20 bp, Artificial Sequence
  Description of Artificial Sequence: Synthetic oligonucleotide
  Target: ATXN1; (+) strand; PAM type: NRG; PAM sequence: TGG
cagccccaaccatgcccatt

SEQ ID NO: 107077 - DNA, 20 bp, Artificial Sequence
  Description of Artificial Sequence: Synthetic oligonucleotide
  Target: ATXN1; (+) strand; PAM type: NRG; PAM sequence: TGG
ccatgcccatttggataaaa

SEQ ID NO: 107078 - DNA, 20 bp, Artificial Sequence
  Description of Artificial Sequence: Synthetic oligonucleotide
  Target: ATXN1; (+) strand; PAM type: NRG; PAM sequence: TGG
tggataaaatggattccatt

SEQ ID NO: 107079 - DNA, 20 bp, Artificial Sequence
  Description of Artificial Sequence: Synthetic oligonucleotide
  Target: ATXN1; (+) strand; PAM type: NRG; PAM sequence: TGG
aaatggattccatttggtaa

SEQ ID NO: 107080 - DNA, 20 bp, Artificial Sequence
  Description of Artificial Sequence: Synthetic oligonucleotide
  Target: ATXN1; (+) strand; PAM type: NRG; PAM sequence: TGG
ggattccatttggtaatggt

SEQ ID NO: 107081 - DNA, 20 bp, Artificial Sequence
  Description of Artificial Sequence: Synthetic oligonucleotide
  Target: ATXN1; (+) strand; PAM type: NRG; PAM sequence: AAG
actgtcatttctgaaatgcc

SEQ ID NO: 107082 - DNA, 20 bp, Artificial Sequence
  Description of Artificial Sequence: Synthetic oligonucleotide
  Target: ATXN1; (+) strand; PAM type: NRG; PAM sequence: AGG
ctgtcatttctgaaatgcca

SEQ ID NO: 107083 - DNA, 20 bp, Artificial Sequence
  Description of Artificial Sequence: Synthetic oligonucleotide
  Target: ATXN1; (+) strand; PAM type: NRG; PAM sequence: GGG
tgtcatttctgaaatgccaa

SEQ ID NO: 107084 - DNA, 20 bp, Artificial Sequence
  Description of Artificial Sequence: Synthetic oligonucleotide
  Target: ATXN1; (+) strand; PAM type: NRG; PAM sequence: CAG
caagggcccacatatacaac

SEQ ID NO: 107085 - DNA, 20 bp, Artificial Sequence
  Description of Artificial Sequence: Synthetic oligonucleotide
  Target: ATXN1; (+) strand; PAM type: NRG; PAM sequence: TAG
acaaccagttgacaccttta

SEQ ID NO: 107086 - DNA, 20 bp, Artificial Sequence
  Description of Artificial Sequence: Synthetic oligonucleotide
  Target: ATXN1; (+) strand; PAM type: NRG; PAM sequence: TAG
accagttgacacctttatag

SEQ ID NO: 107087 - DNA, 20 bp, Artificial Sequence
  Description of Artificial Sequence: Synthetic oligonucleotide
  Target: ATXN1; (+) strand; PAM type: NRG; PAM sequence: TAG
cacctttatagtagtattta

SEQ ID NO: 107088 - DNA, 20 bp, Artificial Sequence
  Description of Artificial Sequence: Synthetic oligonucleotide
  Target: ATXN1; (+) strand; PAM type: NRG; PAM sequence: CAG
ttatagtagtatttatagct

SEQ ID NO: 107089 - DNA, 20 bp, Artificial Sequence
  Description of Artificial Sequence: Synthetic oligonucleotide
  Target: ATXN1; (+) strand; PAM type: NRG; PAM sequence: TGG
gacactttaaaacatgactg

SEQ ID NO: 107090 - DNA, 20 bp, Artificial Sequence
  Description of Artificial Sequence: Synthetic oligonucleotide
  Target: ATXN1; (+) strand; PAM type: NRG; PAM sequence: GGG
acactttaaaacatgactgt

SEQ ID NO: 107091 - DNA, 20 bp, Artificial Sequence
  Description of Artificial Sequence: Synthetic oligonucleotide
  Target: ATXN1; (+) strand; PAM type: NRG; PAM sequence: TGG
tttaaaacatgactgtgggc

SEQ ID NO: 107092 - DNA, 20 bp, Artificial Sequence
  Description of Artificial Sequence: Synthetic oligonucleotide
  Target: ATXN1; (+) strand; PAM type: NRG; PAM sequence: GGG
ttaaaacatgactgtgggct

SEQ ID NO: 107093 - DNA, 20 bp, Artificial Sequence
  Description of Artificial Sequence: Synthetic oligonucleotide
  Target: ATXN1; (+) strand; PAM type: NRG; PAM sequence: CAG
acatgactgtgggctgggca

SEQ ID NO: 107094 - DNA, 20 bp, Artificial Sequence
  Description of Artificial Sequence: Synthetic oligonucleotide
  Target: ATXN1; (+) strand; PAM type: NRG; PAM sequence: TGG
tgactgtgggctgggcacag

SEQ ID NO: 107095 - DNA, 20 bp, Artificial Sequence
  Description of Artificial Sequence: Synthetic oligonucleotide
  Target: ATXN1; (+) strand; PAM type: NRG; PAM sequence: AAG
gtggctcatgtctgtaatcc

SEQ ID NO: 107096 - DNA, 20 bp, Artificial Sequence
  Description of Artificial Sequence: Synthetic oligonucleotide
  Target: ATXN1; (+) strand; PAM type: NRG; PAM sequence: TGG
tgtctgtaatccaagctctt

SEQ ID NO: 107097 - DNA, 20 bp, Artificial Sequence
  Description of Artificial Sequence: Synthetic oligonucleotide
  Target: ATXN1; (+) strand; PAM type: NRG; PAM sequence: GGG
gtctgtaatccaagctcttt

SEQ ID NO: 107098 - DNA, 20 bp, Artificial Sequence
  Description of Artificial Sequence: Synthetic oligonucleotide
  Target: ATXN1; (+) strand; PAM type: NRG; PAM sequence: GAG
ctgtaatccaagctctttgg

SEQ ID NO: 107099 - DNA, 20 bp, Artificial Sequence
  Description of Artificial Sequence: Synthetic oligonucleotide
  Target: ATXN1; (+) strand; PAM type: NRG; PAM sequence: GAG
tccaagctctttgggagtct

SEQ ID NO: 107100 - DNA, 20 bp, Artificial Sequence
  Description of Artificial Sequence: Synthetic oligonucleotide
  Target: ATXN1; (+) strand; PAM type: NRG; PAM sequence: AGG
ccaagctctttgggagtctg

SEQ ID NO: 107101 - DNA, 20 bp, Artificial Sequence
  Description of Artificial Sequence: Synthetic oligonucleotide
  Target: ATXN1; (+) strand; PAM type: NRG; PAM sequence: CAG
agctctttgggagtctgagg

SEQ ID NO: 107102 - DNA, 20 bp, Artificial Sequence
  Description of Artificial Sequence: Synthetic oligonucleotide
  Target: ATXN1; (+) strand; PAM type: NRG; PAM sequence: AAG
tctttgggagtctgaggcag

SEQ ID NO: 107103 - DNA, 20 bp, Artificial Sequence
  Description of Artificial Sequence: Synthetic oligonucleotide
  Target: ATXN1; (+) strand; PAM type: NRG; PAM sequence: AGG
ctttgggagtctgaggcaga

SEQ ID NO: 107104 - DNA, 20 bp, Artificial Sequence
  Description of Artificial Sequence: Synthetic oligonucleotide
  Target: ATXN1; (+) strand; PAM type: NRG; PAM sequence: GAG
ctgaggcagaaggatcactt

SEQ ID NO: 107105 - DNA, 20 bp, Artificial Sequence
  Description of Artificial Sequence: Synthetic oligonucleotide
  Target: ATXN1; (+) strand; PAM type: NRG; PAM sequence: CAG
gcagaaggatcacttgagcc

SEQ ID NO: 107106 - DNA, 20 bp, Artificial Sequence
  Description of Artificial Sequence: Synthetic oligonucleotide
  Target: ATXN1; (+) strand; PAM type: NRG; PAM sequence: AGG
cagaaggatcacttgagccc

SEQ ID NO: 107107 - DNA, 20 bp, Artificial Sequence
  Description of Artificial Sequence: Synthetic oligonucleotide
  Target: ATXN1; (+) strand; PAM type: NRG; PAM sequence: GAG
gaaggatcacttgagcccag

SEQ ID NO: 107108 - DNA, 20 bp, Artificial Sequence
  Description of Artificial Sequence: Synthetic oligonucleotide
  Target: ATXN1; (+) strand; PAM type: NRG; PAM sequence: GAG
tcacttgagcccaggagttt

SEQ ID NO: 107109 - DNA, 20 bp, Artificial Sequence
  Description of Artificial Sequence: Synthetic oligonucleotide
  Target: ATXN1; (+) strand; PAM type: NRG; PAM sequence: CAG
tgagcccaggagtttgagac

SEQ ID NO: 107110 - DNA, 20 bp, Artificial Sequence
  Description of Artificial Sequence: Synthetic oligonucleotide
  Target: ATXN1; (+) strand; PAM type: NRG; PAM sequence: TGG
ccaggagtttgagaccagcc

SEQ ID NO: 107111 - DNA, 20 bp, Artificial Sequence
  Description of Artificial Sequence: Synthetic oligonucleotide
  Target: ATXN1; (+) strand; PAM type: NRG; PAM sequence: GGG
caggagtttgagaccagcct

SEQ ID NO: 107112 - DNA, 20 bp, Artificial Sequence
  Description of Artificial Sequence: Synthetic oligonucleotide
  Target: ATXN1; (+) strand; PAM type: NRG; PAM sequence: CAG
tgagaccagcctgggcaacc

SEQ ID NO: 107113 - DNA, 20 bp, Artificial Sequence
  Description of Artificial Sequence: Synthetic oligonucleotide
  Target: ATXN1; (+) strand; PAM type: NRG; PAM sequence: GAG
accagcctgggcaacccagt

SEQ ID NO: 107114 - DNA, 20 bp, Artificial Sequence
  Description of Artificial Sequence: Synthetic oligonucleotide
  Target: ATXN1; (+) strand; PAM type: NRG; PAM sequence: AAG
gaactcatctctacaaaaaa

SEQ ID NO: 107115 - DNA, 20 bp, Artificial Sequence
  Description of Artificial Sequence: Synthetic oligonucleotide
  Target: ATXN1; (+) strand; PAM type: NRG; PAM sequence: AGG
aactcatctctacaaaaaaa

SEQ ID NO: 107116 - DNA, 20 bp, Artificial Sequence
  Description of Artificial Sequence: Synthetic oligonucleotide
  Target: ATXN1; (+) strand; PAM type: NRG; PAM sequence: TAG
tacaaaaaaaaggtaaaaat

SEQ ID NO: 107117 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaggtaaaaattagc

SEQ ID NO: 107118 - DNA, 20 bp, Artificial Sequence
  Description of Artificial Sequence: Synthetic oligonucleotide
  Target: ATXN1; (+) strand; PAM type: NRG; PAM sequence: GGG
aaaaaaggtaaaaattagct

SEQ ID NO: 107119 - DNA, 20 bp, Artificial Sequence
  Description of Artificial Sequence: Synthetic oligonucleotide
  Target: ATXN1; (+) strand; PAM type: NRG; PAM sequence: TGG
aggtaaaaattagctgggcg

SEQ ID NO: 107120 - DNA, 20 bp, Artificial Sequence
  Description of Artificial Sequence: Synthetic oligonucleotide
  Target: ATXN1; (+) strand; PAM type: NRG; PAM sequence: TGG
taaaaattagctgggcgtgg

SEQ ID NO: 107121 - DNA, 20 bp, Artificial Sequence
  Description of Artificial Sequence: Synthetic oligonucleotide
  Target: ATXN1; (+) strand; PAM type: NRG; PAM sequence: TAG
ggcgtggtggcacatgtcta

SEQ ID NO: 107122 - DNA, 20 bp, Artificial Sequence
  Description of Artificial Sequence: Synthetic oligonucleotide
  Target: ATXN1; (+) strand; PAM type: NRG; PAM sequence: TAG
atgtctatagtccttgctac

SEQ ID NO: 107123 - DNA, 20 bp, Artificial Sequence
  Description of Artificial Sequence: Synthetic oligonucleotide
  Target: ATXN1; (+) strand; PAM type: NRG; PAM sequence: AGG
tgtctatagtccttgctact

SEQ ID NO: 107124 - DNA, 20 bp, Artificial Sequence
  Description of Artificial Sequence: Synthetic oligonucleotide
  Target: ATXN1; (+) strand; PAM type: NRG; PAM sequence: GGG
gtctatagtccttgctacta

SEQ ID NO: 107125 - DNA, 20 bp, Artificial Sequence
  Description of Artificial Sequence: Synthetic oligonucleotide
  Target: ATXN1; (+) strand; PAM type: NRG; PAM sequence: GAG
ctatagtccttgctactagg

SEQ ID NO: 107126 - DNA, 20 bp, Artificial Sequence
  Description of Artificial Sequence: Synthetic oligonucleotide
  Target: ATXN1; (+) strand; PAM type: NRG; PAM sequence: AGG
tatagtccttgctactaggg

SEQ ID NO: 107127 - DNA, 20 bp, Artificial Sequence
  Description of Artificial Sequence: Synthetic oligonucleotide
  Target: ATXN1; (+) strand; PAM type: NRG; PAM sequence: GAG
tccttgctactagggaggct

SEQ ID NO: 107128 - DNA, 20 bp, Artificial Sequence
  Description of Artificial Sequence: Synthetic oligonucleotide
  Target: ATXN1; (+) strand; PAM type: NRG; PAM sequence: AGG
ccttgctactagggaggctg

SEQ ID NO: 107129 - DNA, 20 bp, Artificial Sequence
  Description of Artificial Sequence: Synthetic oligonucleotide
  Target: ATXN1; (+) strand; PAM type: NRG; PAM sequence: CAG
tgctactagggaggctgagg

SEQ ID NO: 107130 - DNA, 20 bp, Artificial Sequence
  Description of Artificial Sequence: Synthetic oligonucleotide
  Target: ATXN1; (+) strand; PAM type: NRG; PAM sequence: AGG
gctactagggaggctgaggc

SEQ ID NO: 107131 - DNA, 20 bp, Artificial Sequence
  Description of Artificial Sequence: Synthetic oligonucleotide
  Target: ATXN1; (+) strand; PAM type: NRG; PAM sequence: GAG
tactagggaggctgaggcag

SEQ ID NO: 107132 - DNA, 20 bp, Artificial Sequence
  Description of Artificial Sequence: Synthetic oligonucleotide
  Target: ATXN1; (+) strand; PAM type: NRG; PAM sequence: AGG
actagggaggctgaggcagg

SEQ ID NO: 107133 - DNA, 20 bp, Artificial Sequence
  Description of Artificial Sequence: Synthetic oligonucleotide
  Target: ATXN1; (+) strand; PAM type: NRG; PAM sequence: GAG
ctgaggcaggaggatcactt

SEQ ID NO: 107134 - DNA, 20 bp, Artificial Sequence
  Description of Artificial Sequence: Synthetic oligonucleotide
  Target: ATXN1; (+) strand; PAM type: NRG; PAM sequence: TGG
gcaggaggatcacttgagcc

SEQ ID NO: 107135 - DNA, 20 bp, Artificial Sequence
  Description of Artificial Sequence: Synthetic oligonucleotide
  Target: ATXN1; (+) strand; PAM type: NRG; PAM sequence: GGG
caggaggatcacttgagcct

SEQ ID NO: 107136 - DNA, 20 bp, Artificial Sequence
  Description of Artificial Sequence: Synthetic oligonucleotide
  Target: ATXN1; (+) strand; PAM type: NRG; PAM sequence: GAG
ggaggatcacttgagcctgg

SEQ ID NO: 107137 - DNA, 20 bp, Artificial Sequence
  Description of Artificial Sequence: Synthetic oligonucleotide
  Target: ATXN1; (+) strand; PAM type: NRG; PAM sequence: CAG
gatcacttgagcctgggaga

SEQ ID NO: 107138 - DNA, 20 bp, Artificial Sequence
  Description of Artificial Sequence: Synthetic oligonucleotide
  Target: ATXN1; (+) strand; PAM type: NRG; PAM sequence: GAG
tcacttgagcctgggagaca

SEQ ID NO: 107139 - DNA, 20 bp, Artificial Sequence
  Description of Artificial Sequence: Synthetic oligonucleotide
  Target: ATXN1; (+) strand; PAM type: NRG; PAM sequence: AGG
cacttgagcctgggagacag

SEQ ID NO: 107140 - DNA, 20 bp, Artificial Sequence
  Description of Artificial Sequence: Synthetic oligonucleotide
  Target: ATXN1; (+) strand; PAM type: NRG; PAM sequence: TAG
agcctgggagacagaggcta

SEQ ID NO: 107141 - DNA, 20 bp, Artificial Sequence
  Description of Artificial Sequence: Synthetic oligonucleotide
  Target: ATXN1; (+) strand; PAM type: NRG; PAM sequence: AGG
gcctgggagacagaggctat

SEQ ID NO: 107142 - DNA, 20 bp, Artificial Sequence
  Description of Artificial Sequence: Synthetic oligonucleotide
  Target: ATXN1; (+) strand; PAM type: NRG; PAM sequence: GGG
cctgggagacagaggctata

SEQ ID NO: 107143 - DNA, 20 bp, Artificial Sequence
  Description of Artificial Sequence: Synthetic oligonucleotide
  Target: ATXN1; (+) strand; PAM type: NRG; PAM sequence: GAG
tgggagacagaggctatagg

SEQ ID NO: 107144 - DNA, 20 bp, Artificial Sequence
  Description of Artificial Sequence: Synthetic oligonucleotide
  Target: ATXN1; (+) strand; PAM type: NRG; PAM sequence: CAG
tgtgattgcacactgcactc

SEQ ID NO: 107145 - DNA, 20 bp, Artificial Sequence
  Description of Artificial Sequence: Synthetic oligonucleotide
  Target: ATXN1; (+) strand; PAM type: NRG; PAM sequence: TGG
attgcacactgcactccagc

SEQ ID NO: 107146 - DNA, 20 bp, Artificial Sequence
  Description of Artificial Sequence: Synthetic oligonucleotide
  Target: ATXN1; (+) strand; PAM type: NRG; PAM sequence: CAG
cacactgcactccagctgga

SEQ ID NO: 107147 - DNA, 20 bp, Artificial Sequence
  Description of Artificial Sequence: Synthetic oligonucleotide
  Target: ATXN1; (+) strand; PAM type: NRG; PAM sequence: AAG
tgcactccagctggacagca

SEQ ID NO: 107148 - DNA, 20 bp, Artificial Sequence
  Description of Artificial Sequence: Synthetic oligonucleotide
  Target: ATXN1; (+) strand; PAM type: NRG; PAM sequence: GAG
ctccagctggacagcaaagt

SEQ ID NO: 107149 - DNA, 20 bp, Artificial Sequence
  Description of Artificial Sequence: Synthetic oligonucleotide
  Target: ATXN1; (+) strand; PAM type: NRG; PAM sequence: TGG
caaacaaataaatgaacctg

SEQ ID NO: 107150 - DNA, 20 bp, Artificial Sequence
  Description of Artificial Sequence: Synthetic oligonucleotide
  Target: ATXN1; (+) strand; PAM type: NRG; PAM sequence: TAG
acaaataaatgaacctgtgg

SEQ ID NO: 107151 - DNA, 20 bp, Artificial Sequence
  Description of Artificial Sequence: Synthetic oligonucleotide
  Target: ATXN1; (+) strand; PAM type: NRG; PAM sequence: GAG
aaataaatgaacctgtggta

SEQ ID NO: 107152 - DNA, 20 bp, Artificial Sequence
  Description of Artificial Sequence: Synthetic oligonucleotide
  Target: ATXN1; (+) strand; PAM type: NRG; PAM sequence: TAG
taaatgaacctgtggtagag

SEQ ID NO: 107153 - DNA, 20 bp, Artificial Sequence
  Description of Artificial Sequence: Synthetic oligonucleotide
  Target: ATXN1; (+) strand; PAM type: NRG; PAM sequence: GAG
aatgaacctgtggtagagta

SEQ ID NO: 107154 - DNA, 20 bp, Artificial Sequence
  Description of Artificial Sequence: Synthetic oligonucleotide
  Target: ATXN1; (+) strand; PAM type: NRG; PAM sequence: TAG
ctgtggtagagtagagaatg

SEQ ID NO: 107155 - DNA, 20 bp, Artificial Sequence
  Description of Artificial Sequence: Synthetic oligonucleotide
  Target: ATXN1; (+) strand; PAM type: NRG; PAM sequence: GAG
gtggtagagtagagaatgta

SEQ ID NO: 107156 - DNA, 20 bp, Artificial Sequence
  Description of Artificial Sequence: Synthetic oligonucleotide
  Target: ATXN1; (+) strand; PAM type: NRG; PAM sequence: CAG
tagagtagagaatgtagaga

SEQ ID NO: 107157 - DNA, 20 bp, Artificial Sequence
  Description of Artificial Sequence: Synthetic oligonucleotide
  Target: ATXN1; (+) strand; PAM type: NRG; PAM sequence: AAG
agtagagaatgtagagacag

SEQ ID NO: 107158 - DNA, 20 bp, Artificial Sequence
  Description of Artificial Sequence: Synthetic oligonucleotide
  Target: ATXN1; (+) strand; PAM type: NRG; PAM sequence: TGG
tgtagagacagaagtttatg

SEQ ID NO: 107159 - DNA, 20 bp, Artificial Sequence
  Description of Artificial Sequence: Synthetic oligonucleotide
  Target: ATXN1; (+) strand; PAM type: NRG; PAM sequence: TAG
agagacagaagtttatgtgg

SEQ ID NO: 107160 - DNA, 20 bp, Artificial Sequence
  Description of Artificial Sequence: Synthetic oligonucleotide
  Target: ATXN1; (+) strand; PAM type: NRG; PAM sequence: AGG
gagacagaagtttatgtggt

SEQ ID NO: 107161 - DNA, 20 bp, Artificial Sequence
  Description of Artificial Sequence: Synthetic oligonucleotide
  Target: ATXN1; (+) strand; PAM type: NRG; PAM sequence: AAG
acagaagtttatgtggtagg

SEQ ID NO: 107162 - DNA, 20 bp, Artificial Sequence
  Description of Artificial Sequence: Synthetic oligonucleotide
  Target: ATXN1; (+) strand; PAM type: NRG; PAM sequence: AGG
cagaagtttatgtggtagga

SEQ ID NO: 107163 - DNA, 20 bp, Artificial Sequence
  Description of Artificial Sequence: Synthetic oligonucleotide
  Target: ATXN1; (+) strand; PAM type: NRG; PAM sequence: GGG
agaagtttatgtggtaggaa

SEQ ID NO: 107164 - DNA, 20 bp, Artificial Sequence
  Description of Artificial Sequence: Synthetic oligonucleotide
  Target: ATXN1; (+) strand; PAM type: NRG; PAM sequence: GGG
gaagtttatgtggtaggaag

SEQ ID NO: 107165 - DNA, 20 bp, Artificial Sequence
  Description of Artificial Sequence: Synthetic oligonucleotide
  Target: ATXN1; (+) strand; PAM type: NRG; PAM sequence: GAG
aggaaggggacatgtgatac

SEQ ID NO: 107166 - DNA, 20 bp, Artificial Sequence
  Description of Artificial Sequence: Synthetic oligonucleotide
  Target: ATXN1; (+) strand; PAM type: NRG; PAM sequence: AGG
ggaaggggacatgtgatacg

SEQ ID NO: 107167 - DNA, 20 bp, Artificial Sequence
  Description of Artificial Sequence: Synthetic oligonucleotide
  Target: ATXN1; (+) strand; PAM type: NRG; PAM sequence: AAG
catgtgatacgaggttgaac

SEQ ID NO: 107168 - DNA, 20 bp, Artificial Sequence
  Description of Artificial Sequence: Synthetic oligonucleotide
  Target: ATXN1; (+) strand; PAM type: NRG; PAM sequence: GAG
tgtgatacgaggttgaacaa

SEQ ID NO: 107169 - DNA, 20 bp, Artificial Sequence
  Description of Artificial Sequence: Synthetic oligonucleotide
  Target: ATXN1; (+) strand; PAM type: NRG; PAM sequence: AGG
gtgatacgaggttgaacaag

SEQ ID NO: 107170 - DNA, 20 bp, Artificial Sequence
  Description of Artificial Sequence: Synthetic oligonucleotide
  Target: ATXN1; (+) strand; PAM type: NRG; PAM sequence: AAG
cgaggttgaacaagaggccc

SEQ ID NO: 107171 - DNA, 20 bp, Artificial Sequence
  Description of Artificial Sequence: Synthetic oligonucleotide
  Target: ATXN1; (+) strand; PAM type: NRG; PAM sequence: TGG
ggttgaacaagaggcccaag

SEQ ID NO: 107172 - DNA, 20 bp, Artificial Sequence
  Description of Artificial Sequence: Synthetic oligonucleotide
  Target: ATXN1; (+) strand; PAM type: NRG; PAM sequence: GAG
ttgaacaagaggcccaagtg

SEQ ID NO: 107173 - DNA, 20 bp, Artificial Sequence
  Description of Artificial Sequence: Synthetic oligonucleotide
  Target: ATXN1; (+) strand; PAM type: NRG; PAM sequence: AGG
tgaacaagaggcccaagtgg

SEQ ID NO: 107174 - DNA, 20 bp, Artificial Sequence
  Description of Artificial Sequence: Synthetic oligonucleotide
  Target: ATXN1; (+) strand; PAM type: NRG; PAM sequence: GGG
gaacaagaggcccaagtgga

SEQ ID NO: 107175 - DNA, 20 bp, Artificial Sequence
  Description of Artificial Sequence: Synthetic oligonucleotide
  Target: ATXN1; (+) strand; PAM type: NRG; PAM sequence: TAG
ggcccaagtggagggacaca

SEQ ID NO: 107176 - DNA, 20 bp, Artificial Sequence
  Description of Artificial Sequence: Synthetic oligonucleotide
  Target: ATXN1; (+) strand; PAM type: NRG; PAM sequence: AGG
gcccaagtggagggacacat

SEQ ID NO: 107177 - DNA, 20 bp, Artificial Sequence
  Description of Artificial Sequence: Synthetic oligonucleotide
  Target: ATXN1; (+) strand; PAM type: NRG; PAM sequence: GGG
cccaagtggagggacacata

SEQ ID NO: 107178 - DNA, 20 bp, Artificial Sequence
  Description of Artificial Sequence: Synthetic oligonucleotide
  Target: ATXN1; (+) strand; PAM type: NRG; PAM sequence: TAG
gagggacacatagggccatg

SEQ ID NO: 107179 - DNA, 20 bp, Artificial Sequence
  Description of Artificial Sequence: Synthetic oligonucleotide
  Target: ATXN1; (+) strand; PAM type: NRG; PAM sequence: AGG
agggacacatagggccatgt

SEQ ID NO: 107180 - DNA, 20 bp, Artificial Sequence
  Description of Artificial Sequence: Synthetic oligonucleotide
  Target: ATXN1; (+) strand; PAM type: NRG; PAM sequence: TGG
taggtgtcctgttaactcca

SEQ ID NO: 107181 - DNA, 20 bp, Artificial Sequence
  Description of Artificial Sequence: Synthetic oligonucleotide
  Target: ATXN1; (+) strand; PAM type: NRG; PAM sequence: GAG
ggtgtcctgttaactccatg

SEQ ID NO: 107182 - DNA, 20 bp, Artificial Sequence
  Description of Artificial Sequence: Synthetic oligonucleotide
  Target: ATXN1; (+) strand; PAM type: NRG; PAM sequence: AGG
gtgtcctgttaactccatgg

SEQ ID NO: 107183 - DNA, 20 bp, Artificial Sequence
  Description of Artificial Sequence: Synthetic oligonucleotide
  Target: ATXN1; (+) strand; PAM type: NRG; PAM sequence: GAG
gtcctgttaactccatggag

SEQ ID NO: 107184 - DNA, 20 bp, Artificial Sequence
  Description of Artificial Sequence: Synthetic oligonucleotide
  Target: ATXN1; (+) strand; PAM type: NRG; PAM sequence: AGG
tcctgttaactccatggagg

SEQ ID NO: 107185 - DNA, 20 bp, Artificial Sequence
  Description of Artificial Sequence: Synthetic oligonucleotide
  Target: ATXN1; (+) strand; PAM type: NRG; PAM sequence: TGG
aactccatggaggaggtttc

SEQ ID NO: 107186 - DNA, 20 bp, Artificial Sequence
  Description of Artificial Sequence: Synthetic oligonucleotide
  Target: ATXN1; (+) strand; PAM type: NRG; PAM sequence: GGG
actccatggaggaggtttct

SEQ ID NO: 107187 - DNA, 20 bp, Artificial Sequence
  Description of Artificial Sequence: Synthetic oligonucleotide
  Target: ATXN1; (+) strand; PAM type: NRG; PAM sequence: GGG
ctccatggaggaggtttctg

SEQ ID NO: 107188 - DNA, 20 bp, Artificial Sequence
  Description of Artificial Sequence: Synthetic oligonucleotide
  Target: ATXN1; (+) strand; PAM type: NRG; PAM sequence: CAG
ggaggtttctggggatgtcc

SEQ ID NO: 107189 - DNA, 20 bp, Artificial Sequence
  Description of Artificial Sequence: Synthetic oligonucleotide
  Target: ATXN1; (+) strand; PAM type: NRG; PAM sequence: AGG
gaggtttctggggatgtccc

SEQ ID NO: 107190 - DNA, 20 bp, Artificial Sequence
  Description of Artificial Sequence: Synthetic oligonucleotide
  Target: ATXN1; (+) strand; PAM type: NRG; PAM sequence: GAG
tgtcccaggccatgttgcct

SEQ ID NO: 107191 - DNA, 20 bp, Artificial Sequence
  Description of Artificial Sequence: Synthetic oligonucleotide
  Target: ATXN1; (+) strand; PAM type: NRG; PAM sequence: GAG
gcctgagaacatgtctgcct

SEQ ID NO: 107192 - DNA, 20 bp, Artificial Sequence
  Description of Artificial Sequence: Synthetic oligonucleotide
  Target: ATXN1; (+) strand; PAM type: NRG; PAM sequence: AAG
gagactcattctattcctga

SEQ ID NO: 107193 - DNA, 20 bp, Artificial Sequence
  Description of Artificial Sequence: Synthetic oligonucleotide
  Target: ATXN1; (+) strand; PAM type: NRG; PAM sequence: CAG
tcctgaaagtctgaaaccat

SEQ ID NO: 107194 - DNA, 20 bp, Artificial Sequence
  Description of Artificial Sequence: Synthetic oligonucleotide
  Target: ATXN1; (+) strand; PAM type: NRG; PAM sequence: TGG
ttgtattcttacattgatta

SEQ ID NO: 107195 - DNA, 20 bp, Artificial Sequence
  Description of Artificial Sequence: Synthetic oligonucleotide
  Target: ATXN1; (+) strand; PAM type: NRG; PAM sequence: TGG
ttacattgattatggttcaa

SEQ ID NO: 107196 - DNA, 20 bp, Artificial Sequence
  Description of Artificial Sequence: Synthetic oligonucleotide
  Target: ATXN1; (+) strand; PAM type: NRG; PAM sequence: TGG
ttgattatggttcaatggta

SEQ ID NO: 107197 - DNA, 20 bp, Artificial Sequence
  Description of Artificial Sequence: Synthetic oligonucleotide
  Target: ATXN1; (+) strand; PAM type: NRG; PAM sequence: TGG
gtttctccgtataaacgtcc

SEQ ID NO: 107198 - DNA, 20 bp, Artificial Sequence
  Description of Artificial Sequence: Synthetic oligonucleotide
  Target: ATXN1; (+) strand; PAM type: NRG; PAM sequence: TAG
taaacgtcctggccaccatt

SEQ ID NO: 107199 - DNA, 20 bp, Artificial Sequence
  Description of Artificial Sequence: Synthetic oligonucleotide
  Target: ATXN1; (+) strand; PAM type: NRG; PAM sequence: TGG
atgatccataatttcttgtt

SEQ ID NO: 107200 - DNA, 20 bp, Artificial Sequence
  Description of Artificial Sequence: Synthetic oligonucleotide
  Target: ATXN1; (+) strand; PAM type: NRG; PAM sequence: GGG
tgatccataatttcttgttt

SEQ ID NO: 107201 - DNA, 20 bp, Artificial Sequence
  Description of Artificial Sequence: Synthetic oligonucleotide
  Target: ATXN1; (+) strand; PAM type: NRG; PAM sequence: TAG
ataatttcttgtttgggtct

SEQ ID NO: 107202 - DNA, 20 bp, Artificial Sequence
  Description of Artificial Sequence: Synthetic oligonucleotide
  Target: ATXN1; (+) strand; PAM type: NRG; PAM sequence: CGG
tttattttctatctgcttca

SEQ ID NO: 107203 - DNA, 20 bp, Artificial Sequence
  Description of Artificial Sequence: Synthetic oligonucleotide
  Target: ATXN1; (+) strand; PAM type: NRG; PAM sequence: GGG
ttattttctatctgcttcac

SEQ ID NO: 107204 - DNA, 20 bp, Artificial Sequence
  Description of Artificial Sequence: Synthetic oligonucleotide
  Target: ATXN1; (+) strand; PAM type: NRG; PAM sequence: TGG
cacgggcatattaatgtgta

SEQ ID NO: 107205 - DNA, 20 bp, Artificial Sequence
  Description of Artificial Sequence: Synthetic oligonucleotide
  Target: ATXN1; (+) strand; PAM type: NRG; PAM sequence: AAG
tattaatgtgtatggttaac

SEQ ID NO: 107206 - DNA, 20 bp, Artificial Sequence
  Description of Artificial Sequence: Synthetic oligonucleotide
  Target: ATXN1; (+) strand; PAM type: NRG; PAM sequence: TAG
tatggttaacaagcaatcat

SEQ ID NO: 107207 - DNA, 20 bp, Artificial Sequence
  Description of Artificial Sequence: Synthetic oligonucleotide
  Target: ATXN1; (+) strand; PAM type: NRG; PAM sequence: CAG
ggttaacaagcaatcattag

SEQ ID NO: 107208 - DNA, 20 bp, Artificial Sequence
  Description of Artificial Sequence: Synthetic oligonucleotide
  Target: ATXN1; (+) strand; PAM type: NRG; PAM sequence: AAG
agcaatcattagcagttacc

SEQ ID NO: 107209 - DNA, 20 bp, Artificial Sequence
  Description of Artificial Sequence: Synthetic oligonucleotide
  Target: ATXN1; (+) strand; PAM type: NRG; PAM sequence: AAG
cattagcagttaccaagtga

SEQ ID NO: 107210 - DNA, 20 bp, Artificial Sequence
  Description of Artificial Sequence: Synthetic oligonucleotide
  Target: ATXN1; (+) strand; PAM type: NRG; PAM sequence: TGG
gttaccaagtgaaagacaaa

SEQ ID NO: 107211 - DNA, 20 bp, Artificial Sequence
  Description of Artificial Sequence: Synthetic oligonucleotide
  Target: ATXN1; (+) strand; PAM type: NRG; PAM sequence: CAG
accaagtgaaagacaaatgg

SEQ ID NO: 107212 - DNA, 20 bp, Artificial Sequence
  Description of Artificial Sequence: Synthetic oligonucleotide
  Target: ATXN1; (+) strand; PAM type: NRG; PAM sequence: TGG
agtgaaagacaaatggcaga

SEQ ID NO: 107213 - DNA, 20 bp, Artificial Sequence
  Description of Artificial Sequence: Synthetic oligonucleotide
  Target: ATXN1; (+) strand; PAM type: NRG; PAM sequence: TGG
tctgtcccacacacgtgtct

SEQ ID NO: 107214 - DNA, 20 bp, Artificial Sequence
  Description of Artificial Sequence: Synthetic oligonucleotide
  Target: ATXN1; (+) strand; PAM type: NRG; PAM sequence: AAG
cccacacacgtgtcttggtg

SEQ ID NO: 107215 - DNA, 20 bp, Artificial Sequence
  Description of Artificial Sequence: Synthetic oligonucleotide
  Target: ATXN1; (+) strand; PAM type: NRG; PAM sequence: AGG
ccacacacgtgtcttggtga

SEQ ID NO: 107216 - DNA, 20 bp, Artificial Sequence
  Description of Artificial Sequence: Synthetic oligonucleotide
  Target: ATXN1; (+) strand; PAM type: NRG; PAM sequence: CAG
cgtgtcttggtgaaggtatt

SEQ ID NO: 107217 - DNA, 20 bp, Artificial Sequence
  Description of Artificial Sequence: Synthetic oligonucleotide
  Target: ATXN1; (+) strand; PAM type: NRG; PAM sequence: AGG
gtgtcttggtgaaggtattc

SEQ ID NO: 107218 - DNA, 20 bp, Artificial Sequence
  Description of Artificial Sequence: Synthetic oligonucleotide
  Target: ATXN1; (+) strand; PAM type: NRG; PAM sequence: CAG
tgaaggtattcaggccactc

SEQ ID NO: 107219 - DNA, 20 bp, Artificial Sequence
  Description of Artificial Sequence: Synthetic oligonucleotide
  Target: ATXN1; (+) strand; PAM type: NRG; PAM sequence: AGG
gaaggtattcaggccactcc

SEQ ID NO: 107220 - DNA, 20 bp, Artificial Sequence
  Description of Artificial Sequence: Synthetic oligonucleotide
  Target: ATXN1; (+) strand; PAM type: NRG; PAM sequence: GGG
aaggtattcaggccactcca

SEQ ID NO: 107221 - DNA, 20 bp, Artificial Sequence
  Description of Artificial Sequence: Synthetic oligonucleotide
  Target: ATXN1; (+) strand; PAM type: NRG; PAM sequence: GGG
aggtattcaggccactccag

SEQ ID NO: 107222 - DNA, 20 bp, Artificial Sequence
  Description of Artificial Sequence: Synthetic oligonucleotide
  Target: ATXN1; (+) strand; PAM type: NRG; PAM sequence: CAG
attcaggccactccaggggc

SEQ ID NO: 107223 - DNA, 20 bp, Artificial Sequence
  Description of Artificial Sequence: Synthetic oligonucleotide
  Target: ATXN1; (+) strand; PAM type: NRG; PAM sequence: TGG
ggccactccaggggccagtc

SEQ ID NO: 107224 - DNA, 20 bp, Artificial Sequence
  Description of Artificial Sequence: Synthetic oligonucleotide
  Target: ATXN1; (+) strand; PAM type: NRG; PAM sequence: AAG
cactccaggggccagtctgg

SEQ ID NO: 107225 - DNA, 20 bp, Artificial Sequence
  Description of Artificial Sequence: Synthetic oligonucleotide
  Target: ATXN1; (+) strand; PAM type: NRG; PAM sequence: CAG
gtctggaagccatatctgat

SEQ ID NO: 107226 - DNA, 20 bp, Artificial Sequence
  Description of Artificial Sequence: Synthetic oligonucleotide
  Target: ATXN1; (+) strand; PAM type: NRG; PAM sequence: AGG
tctggaagccatatctgatc

SEQ ID NO: 107227 - DNA, 20 bp, Artificial Sequence
  Description of Artificial Sequence: Synthetic oligonucleotide
  Target: ATXN1; (+) strand; PAM type: NRG; PAM sequence: TAG
gaagccatatctgatcaggt

SEQ ID NO: 107228 - DNA, 20 bp, Artificial Sequence
  Description of Artificial Sequence: Synthetic oligonucleotide
  Target: ATXN1; (+) strand; PAM type: NRG; PAM sequence: AGG
aagccatatctgatcaggtt

SEQ ID NO: 107229 - DNA, 20 bp, Artificial Sequence
  Description of Artificial Sequence: Synthetic oligonucleotide
  Target: ATXN1; (+) strand; PAM type: NRG; PAM sequence: GGG
agccatatctgatcaggtta

SEQ ID NO: 107230 - DNA, 20 bp, Artificial Sequence
  Description of Artificial Sequence: Synthetic oligonucleotide
  Target: ATXN1; (+) strand; PAM type: NRG; PAM sequence: TAG
gatcaggttagggcatgata

SEQ ID NO: 107231 - DNA, 20 bp, Artificial Sequence
  Description of Artificial Sequence: Synthetic oligonucleotide
  Target: ATXN1; (+) strand; PAM type: NRG; PAM sequence: TGG
ggttagggcatgatatagtt

SEQ ID NO: 107232 - DNA, 20 bp, Artificial Sequence
  Description of Artificial Sequence: Synthetic oligonucleotide
  Target: ATXN1; (+) strand; PAM type: NRG; PAM sequence: AAG
gtttggctgtgtccccaccc

SEQ ID NO: 107233 - DNA, 20 bp, Artificial Sequence
  Description of Artificial Sequence: Synthetic oligonucleotide
  Target: ATXN1; (+) strand; PAM type: NRG; PAM sequence: TAG
ccaagtgtcatcctgaatcg

SEQ ID NO: 107234 - DNA, 20 bp, Artificial Sequence
  Description of Artificial Sequence: Synthetic oligonucleotide
  Target: ATXN1; (+) strand; PAM type: NRG; PAM sequence: TAG
cccacaattcccacatattg

SEQ ID NO: 107235 - DNA, 20 bp, Artificial Sequence
  Description of Artificial Sequence: Synthetic oligonucleotide
  Target: ATXN1; (+) strand; PAM type: NRG; PAM sequence: AGG
ccacaattcccacatattgt

SEQ ID NO: 107236 - DNA, 20 bp, Artificial Sequence
  Description of Artificial Sequence: Synthetic oligonucleotide
  Target: ATXN1; (+) strand; PAM type: NRG; PAM sequence: GAG
acaattcccacatattgtag

SEQ ID NO: 107237 - DNA, 20 bp, Artificial Sequence
  Description of Artificial Sequence: Synthetic oligonucleotide
  Target: ATXN1; (+) strand; PAM type: NRG; PAM sequence: AGG
caattcccacatattgtagg

SEQ ID NO: 107238 - DNA, 20 bp, Artificial Sequence
  Description of Artificial Sequence: Synthetic oligonucleotide
  Target: ATXN1; (+) strand; PAM type: NRG; PAM sequence: GGG
aattcccacatattgtagga

SEQ ID NO: 107239 - DNA, 20 bp, Artificial Sequence
  Description of Artificial Sequence: Synthetic oligonucleotide
  Target: ATXN1; (+) strand; PAM type: NRG; PAM sequence: TGG
atattgtaggagggacctgc

SEQ ID NO: 107240 - DNA, 20 bp, Artificial Sequence
  Description of Artificial Sequence: Synthetic oligonucleotide
  Target: ATXN1; (+) strand; PAM type: NRG; PAM sequence: GGG
tattgtaggagggacctgct

SEQ ID NO: 107241 - DNA, 20 bp, Artificial Sequence
  Description of Artificial Sequence: Synthetic oligonucleotide
  Target: ATXN1; (+) strand; PAM type: NRG; PAM sequence: GAG
ttgtaggagggacctgctgg

SEQ ID NO: 107242 - DNA, 20 bp, Artificial Sequence
  Description of Artificial Sequence: Synthetic oligonucleotide
  Target: ATXN1; (+) strand; PAM type: NRG; PAM sequence: TGG
gctgggagacaactgaataa

SEQ ID NO: 107243 - DNA, 20 bp, Artificial Sequence
  Description of Artificial Sequence: Synthetic oligonucleotide
  Target: ATXN1; (+) strand; PAM type: NRG; PAM sequence: GGG
ctgggagacaactgaataat

SEQ ID NO: 107244 - DNA, 20 bp, Artificial Sequence
  Description of Artificial Sequence: Synthetic oligonucleotide
  Target: ATXN1; (+) strand; PAM type: NRG; PAM sequence: GGG
tgggagacaactgaataatg

SEQ ID NO: 107245 - DNA, 20 bp, Artificial Sequence
  Description of Artificial Sequence: Synthetic oligonucleotide
  Target: ATXN1; (+) strand; PAM type: NRG; PAM sequence: GGG
gggagacaactgaataatgg

SEQ ID NO: 107246 - DNA, 20 bp, Artificial Sequence
  Description of Artificial Sequence: Synthetic oligonucleotide
  Target: ATXN1; (+) strand; PAM type: NRG; PAM sequence: CAG
agacaactgaataatggggg

SEQ ID NO: 107247 - DNA, 20 bp, Artificial Sequence
  Description of Artificial Sequence: Synthetic oligonucleotide
  Target: ATXN1; (+) strand; PAM type: NRG; PAM sequence: TGG
tttcccccatactgttctcg

SEQ ID NO: 107248 - DNA, 20 bp, Artificial Sequence
  Description of Artificial Sequence: Synthetic oligonucleotide
  Target: ATXN1; (+) strand; PAM type: NRG; PAM sequence: TAG
cccccatactgttctcgtgg

SEQ ID NO: 107249 - DNA, 20 bp, Artificial Sequence
  Description of Artificial Sequence: Synthetic oligonucleotide
  Target: ATXN1; (+) strand; PAM type: NRG; PAM sequence: AAG
ctgttctcgtggtagtgaat

SEQ ID NO: 107250 - DNA, 20 bp, Artificial Sequence
  Description of Artificial Sequence: Synthetic oligonucleotide
  Target: ATXN1; (+) strand; PAM type: NRG; PAM sequence: GAG
tggtagtgaataagtctcac

SEQ ID NO: 107251 - DNA, 20 bp, Artificial Sequence
  Description of Artificial Sequence: Synthetic oligonucleotide
  Target: ATXN1; (+) strand; PAM type: NRG; PAM sequence: AAG
acgagatctgattgttttat

SEQ ID NO: 107252 - DNA, 20 bp, Artificial Sequence
  Description of Artificial Sequence: Synthetic oligonucleotide
  Target: ATXN1; (+) strand; PAM type: NRG; PAM sequence: GAG
gagatctgattgttttataa

SEQ ID NO: 107253 - DNA, 20 bp, Artificial Sequence
  Description of Artificial Sequence: Synthetic oligonucleotide
  Target: ATXN1; (+) strand; PAM type: NRG; PAM sequence: AGG
agatctgattgttttataag

SEQ ID NO: 107254 - DNA, 20 bp, Artificial Sequence
  Description of Artificial Sequence: Synthetic oligonucleotide
  Target: ATXN1; (+) strand; PAM type: NRG; PAM sequence: AAG
tctcttgcctgctgccatgt

SEQ ID NO: 107255 - DNA, 20 bp, Artificial Sequence
  Description of Artificial Sequence: Synthetic oligonucleotide
  Target: ATXN1; (+) strand; PAM type: NRG; PAM sequence: AAG
tgccttccaccatgattgtg

SEQ ID NO: 107256 - DNA, 20 bp, Artificial Sequence
  Description of Artificial Sequence: Synthetic oligonucleotide
  Target: ATXN1; (+) strand; PAM type: NRG; PAM sequence: CAG
ccatgattgtgaagcctccc

SEQ ID NO: 107257 - DNA, 20 bp, Artificial Sequence
  Description of Artificial Sequence: Synthetic oligonucleotide
  Target: ATXN1; (+) strand; PAM type: NRG; PAM sequence: TGG
gtgaagcctccccagccacg

SEQ ID NO: 107258 - DNA, 20 bp, Artificial Sequence
  Description of Artificial Sequence: Synthetic oligonucleotide
  Target: ATXN1; (+) strand; PAM type: NRG; PAM sequence: GAG
ccccagccacgtggaactgt

SEQ ID NO: 107259 - DNA, 20 bp, Artificial Sequence
  Description of Artificial Sequence: Synthetic oligonucleotide
  Target: ATXN1; (+) strand; PAM type: NRG; PAM sequence: TAG
ctttttctttataaattacc

SEQ ID NO: 107260 - DNA, 20 bp, Artificial Sequence
  Description of Artificial Sequence: Synthetic oligonucleotide
  Target: ATXN1; (+) strand; PAM type: NRG; PAM sequence: AGG
tttttctttataaattacct

SEQ ID NO: 107261 - DNA, 20 bp, Artificial Sequence
  Description of Artificial Sequence: Synthetic oligonucleotide
  Target: ATXN1; (+) strand; PAM type: NRG; PAM sequence: TGG
ctttataaattacctaggct

SEQ ID NO: 107262 - DNA, 20 bp, Artificial Sequence
  Description of Artificial Sequence: Synthetic oligonucleotide
  Target: ATXN1; (+) strand; PAM type: NRG; PAM sequence: GGG
tttataaattacctaggctt

SEQ ID NO: 107263 - DNA, 20 bp, Artificial Sequence
  Description of Artificial Sequence: Synthetic oligonucleotide
  Target: ATXN1; (+) strand; PAM type: NRG; PAM sequence: TAG
aggcttgggtatgtctttat

SEQ ID NO: 107264 - DNA, 20 bp, Artificial Sequence
  Description of Artificial Sequence: Synthetic oligonucleotide
  Target: ATXN1; (+) strand; PAM type: NRG; PAM sequence: CAG
cttgggtatgtctttattag

SEQ ID NO: 107265 - DNA, 20 bp, Artificial Sequence
  Description of Artificial Sequence: Synthetic oligonucleotide
  Target: ATXN1; (+) strand; PAM type: NRG; PAM sequence: CAG
ctttattagcagcatgaaaa

SEQ ID NO: 107266 - DNA, 20 bp, Artificial Sequence
  Description of Artificial Sequence: Synthetic oligonucleotide
  Target: ATXN1; (+) strand; PAM type: NRG; PAM sequence: CAG
agcatgaaaacagactaata

SEQ ID NO: 107267 - DNA, 20 bp, Artificial Sequence
  Description of Artificial Sequence: Synthetic oligonucleotide
  Target: ATXN1; (+) strand; PAM type: NRG; PAM sequence: AGG
gcatgaaaacagactaatac

SEQ ID NO: 107268 - DNA, 20 bp, Artificial Sequence
  Description of Artificial Sequence: Synthetic oligonucleotide
  Target: ATXN1; (+) strand; PAM type: NRG; PAM sequence: GGG
catgaaaacagactaataca

SEQ ID NO: 107269 - DNA, 20 bp, Artificial Sequence
  Description of Artificial Sequence: Synthetic oligonucleotide
  Target: ATXN1; (+) strand; PAM type: NRG; PAM sequence: TAG
acagggcatcacacccaaat

SEQ ID NO: 107270 - DNA, 20 bp, Artificial Sequence
  Description of Artificial Sequence: Synthetic oligonucleotide
  Target: ATXN1; (+) strand; PAM type: NRG; PAM sequence: TGG
tcctattgctgataacaacc

SEQ ID NO: 107271 - DNA, 20 bp, Artificial Sequence
  Description of Artificial Sequence: Synthetic oligonucleotide
  Target: ATXN1; (+) strand; PAM type: NRG; PAM sequence: CAG
tgctgataacaacctggttg

SEQ ID NO: 107272 - DNA, 20 bp, Artificial Sequence
  Description of Artificial Sequence: Synthetic oligonucleotide
  Target: ATXN1; (+) strand; PAM type: NRG; PAM sequence: TAG
ttatatcaatgttctgtaaa

SEQ ID NO: 107273 - DNA, 20 bp, Artificial Sequence
  Description of Artificial Sequence: Synthetic oligonucleotide
  Target: ATXN1; (+) strand; PAM type: NRG; PAM sequence: AGG
tatatcaatgttctgtaaat

SEQ ID NO: 107274 - DNA, 20 bp, Artificial Sequence
  Description of Artificial Sequence: Synthetic oligonucleotide
  Target: ATXN1; (+) strand; PAM type: NRG; PAM sequence: AAG
aaataggcacatgttacata

SEQ ID NO: 107275 - DNA, 20 bp, Artificial Sequence
  Description of Artificial Sequence: Synthetic oligonucleotide
  Target: ATXN1; (+) strand; PAM type: NRG; PAM sequence: CGG
acatgttacataaagcacca

SEQ ID NO: 107276 - DNA, 20 bp, Artificial Sequence
  Description of Artificial Sequence: Synthetic oligonucleotide
  Target: ATXN1; (+) strand; PAM type: NRG; PAM sequence: CAG
taaagcaccacggcataaac

SEQ ID NO: 107277 - DNA, 20 bp, Artificial Sequence
  Description of Artificial Sequence: Synthetic oligonucleotide
  Target: ATXN1; (+) strand; PAM type: NRG; PAM sequence: AGG
aaagcaccacggcataaacc

SEQ ID NO: 107278 - DNA, 20 bp, Artificial Sequence
  Description of Artificial Sequence: Synthetic oligonucleotide
  Target: ATXN1; (+) strand; PAM type: NRG; PAM sequence: TAG
gtaatgacactctaaaaatg

SEQ ID NO: 107279 - DNA, 20 bp, Artificial Sequence
  Description of Artificial Sequence: Synthetic oligonucleotide
  Target: ATXN1; (+) strand; PAM type: NRG; PAM sequence: TAG
taatcactcaataaaatcct

SEQ ID NO: 107280 - DNA, 20 bp, Artificial Sequence
  Description of Artificial Sequence: Synthetic oligonucleotide
  Target: ATXN1; (+) strand; PAM type: NRG; PAM sequence: CAG
ctatatacctcgaattatac

SEQ ID NO: 107281 - DNA, 20 bp, Artificial Sequence
  Description of Artificial Sequence: Synthetic oligonucleotide
  Target: ATXN1; (+) strand; PAM type: NRG; PAM sequence: AAG
tatacctcgaattataccag

SEQ ID NO: 107282 - DNA, 20 bp, Artificial Sequence
  Description of Artificial Sequence: Synthetic oligonucleotide
  Target: ATXN1; (+) strand; PAM type: NRG; PAM sequence: TAG
cgaattataccagaagcttt

SEQ ID NO: 107283 - DNA, 20 bp, Artificial Sequence
  Description of Artificial Sequence: Synthetic oligonucleotide
  Target: ATXN1; (+) strand; PAM type: NRG; PAM sequence: AGG
gaattataccagaagctttt

SEQ ID NO: 107284 - DNA, 20 bp, Artificial Sequence
  Description of Artificial Sequence: Synthetic oligonucleotide
  Target: ATXN1; (+) strand; PAM type: NRG; PAM sequence: GAG
accagaagcttttaggatat

SEQ ID NO: 107285 - DNA, 20 bp, Artificial Sequence
  Description of Artificial Sequence: Synthetic oligonucleotide
  Target: ATXN1; (+) strand; PAM type: NRG; PAM sequence: AAG
gagcaaaaaaaaaaaaaaaa

SEQ ID NO: 107286 - DNA, 20 bp, Artificial Sequence
  Description of Artificial Sequence: Synthetic oligonucleotide
  Target: ATXN1; (+) strand; PAM type: NRG; PAM sequence: TAG
aaaaaaaaaaaaaaaagaca

SEQ ID NO: 107287 - DNA, 20 bp, Artificial Sequence
  Description of Artificial Sequence: Synthetic oligonucleotide
  Target: ATXN1; (+) strand; PAM type: NRG; PAM sequence: AAG
aagacatagaccctgctaaa

SEQ ID NO: 107288 - DNA, 20 bp, Artificial Sequence
  Description of Artificial Sequence: Synthetic oligonucleotide
  Target: ATXN1; (+) strand; PAM type: NRG; PAM sequence: AGG
agacatagaccctgctaaaa

SEQ ID NO: 107289 - DNA, 20 bp, Artificial Sequence
  Description of Artificial Sequence: Synthetic oligonucleotide
  Target: ATXN1; (+) strand; PAM type: NRG; PAM sequence: CAG
ctaaaaaggaacttacaatc

SEQ ID NO: 107290 - DNA, 20 bp, Artificial Sequence
  Description of Artificial Sequence: Synthetic oligonucleotide
  Target: ATXN1; (+) strand; PAM type: NRG; PAM sequence: AAG
ggaacttacaatccagcttg

SEQ ID NO: 107291 - DNA, 20 bp, Artificial Sequence
  Description of Artificial Sequence: Synthetic oligonucleotide
  Target: ATXN1; (+) strand; PAM type: NRG; PAM sequence: AAG
caatccagcttgaagaaata

SEQ ID NO: 107292 - DNA, 20 bp, Artificial Sequence
  Description of Artificial Sequence: Synthetic oligonucleotide
  Target: ATXN1; (+) strand; PAM type: NRG; PAM sequence: TAG
aagcccacacataaaaaaat

SEQ ID NO: 107293 - DNA, 20 bp, Artificial Sequence
  Description of Artificial Sequence: Synthetic oligonucleotide
  Target: ATXN1; (+) strand; PAM type: NRG; PAM sequence: AGG
agcccacacataaaaaaatt

SEQ ID NO: 107294 - DNA, 20 bp, Artificial Sequence
  Description of Artificial Sequence: Synthetic oligonucleotide
  Target: ATXN1; (+) strand; PAM type: NRG; PAM sequence: GGG
gcccacacataaaaaaatta

SEQ ID NO: 107295 - DNA, 20 bp, Artificial Sequence
  Description of Artificial Sequence: Synthetic oligonucleotide
  Target: ATXN1; (+) strand; PAM type: NRG; PAM sequence: AAG
acataaaaaaattagggaac

SEQ ID NO: 107296 - DNA, 20 bp, Artificial Sequence
  Description of Artificial Sequence: Synthetic oligonucleotide
  Target: ATXN1; (+) strand; PAM type: NRG; PAM sequence: CAG
ttagggaacaagaccatatt

SEQ ID NO: 107297 - DNA, 20 bp, Artificial Sequence
  Description of Artificial Sequence: Synthetic oligonucleotide
  Target: ATXN1; (+) strand; PAM type: NRG; PAM sequence: AAG
gaacaagaccatattcagtt

SEQ ID NO: 107298 - DNA, 20 bp, Artificial Sequence
  Description of Artificial Sequence: Synthetic oligonucleotide
  Target: ATXN1; (+) strand; PAM type: NRG; PAM sequence: AAG
agttaagtgcaaaaattgaa

SEQ ID NO: 107299 - DNA, 20 bp, Artificial Sequence
  Description of Artificial Sequence: Synthetic oligonucleotide
  Target: ATXN1; (+) strand; PAM type: NRG; PAM sequence: TAG
aattgaaaagtatgctcgat

SEQ ID NO: 107300 - DNA, 20 bp, Artificial Sequence
  Description of Artificial Sequence: Synthetic oligonucleotide
  Target: ATXN1; (+) strand; PAM type: NRG; PAM sequence: AAG
gaaaagtatgctcgattagc

SEQ ID NO: 107301 - DNA, 20 bp, Artificial Sequence
  Description of Artificial Sequence: Synthetic oligonucleotide
  Target: ATXN1; (+) strand; PAM type: NRG; PAM sequence: TAG
agtatgctcgattagcaagc

SEQ ID NO: 107302 - DNA, 20 bp, Artificial Sequence
  Description of Artificial Sequence: Synthetic oligonucleotide
  Target: ATXN1; (+) strand; PAM type: NRG; PAM sequence: GAG
tatgctcgattagcaagcta

SEQ ID NO: 107303 - DNA, 20 bp, Artificial Sequence
  Description of Artificial Sequence: Synthetic oligonucleotide
  Target: ATXN1; (+) strand; PAM type: NRG; PAM sequence: AGG
atgctcgattagcaagctag

SEQ ID NO: 107304 - DNA, 20 bp, Artificial Sequence
  Description of Artificial Sequence: Synthetic oligonucleotide
  Target: ATXN1; (+) strand; PAM type: NRG; PAM sequence: GGG
tgctcgattagcaagctaga

SEQ ID NO: 107305 - DNA, 20 bp, Artificial Sequence
  Description of Artificial Sequence: Synthetic oligonucleotide
  Target: ATXN1; (+) strand; PAM type: NRG; PAM sequence: TAG
tagcaagctagagggtttat

SEQ ID NO: 107306 - DNA, 20 bp, Artificial Sequence
  Description of Artificial Sequence: Synthetic oligonucleotide
  Target: ATXN1; (+) strand; PAM type: NRG; PAM sequence: CAG
agagggtttattagaaataa

SEQ ID NO: 107307 - DNA, 20 bp, Artificial Sequence
  Description of Artificial Sequence: Synthetic oligonucleotide
  Target: ATXN1; (+) strand; PAM type: NRG; PAM sequence: TAG
gggtttattagaaataacag

SEQ ID NO: 107308 - DNA, 20 bp, Artificial Sequence
  Description of Artificial Sequence: Synthetic oligonucleotide
  Target: ATXN1; (+) strand; PAM type: NRG; PAM sequence: TAG
cttccctactataaaaacca

SEQ ID NO: 107309 - DNA, 20 bp, Artificial Sequence
  Description of Artificial Sequence: Synthetic oligonucleotide
  Target: ATXN1; (+) strand; PAM type: NRG; PAM sequence: AAG
tactataaaaaccatagttt

SEQ ID NO: 107310 - DNA, 20 bp, Artificial Sequence
  Description of Artificial Sequence: Synthetic oligonucleotide
  Target: ATXN1; (+) strand; PAM type: NRG; PAM sequence: TAG
gtttaagcctgctttaacat

SEQ ID NO: 107311 - DNA, 20 bp, Artificial Sequence
  Description of Artificial Sequence: Synthetic oligonucleotide
  Target: ATXN1; (+) strand; PAM type: NRG; PAM sequence: TGG
gcctgctttaacattagatc

SEQ ID NO: 107312 - DNA, 20 bp, Artificial Sequence
  Description of Artificial Sequence: Synthetic oligonucleotide
  Target: ATXN1; (+) strand; PAM type: NRG; PAM sequence: TGG
acaactgattaacctgaaaa

SEQ ID NO: 107313 - DNA, 20 bp, Artificial Sequence
  Description of Artificial Sequence: Synthetic oligonucleotide
  Target: ATXN1; (+) strand; PAM type: NRG; PAM sequence: TAG
tgattaacctgaaaatggtt

SEQ ID NO: 107314 - DNA, 20 bp, Artificial Sequence
  Description of Artificial Sequence: Synthetic oligonucleotide
  Target: ATXN1; (+) strand; PAM type: NRG; PAM sequence: AAG
ctataaatgccgtatataac

SEQ ID NO: 107315 - DNA, 20 bp, Artificial Sequence
  Description of Artificial Sequence: Synthetic oligonucleotide
  Target: ATXN1; (+) strand; PAM type: NRG; PAM sequence: CAG
gccgtatataacaagttcca

SEQ ID NO: 107316 - DNA, 20 bp, Artificial Sequence
  Description of Artificial Sequence: Synthetic oligonucleotide
  Target: ATXN1; (+) strand; PAM type: NRG; PAM sequence: GAG
cgtatataacaagttccaca

SEQ ID NO: 107317 - DNA, 20 bp, Artificial Sequence
  Description of Artificial Sequence: Synthetic oligonucleotide
  Target: ATXN1; (+) strand; PAM type: NRG; PAM sequence: TGG
agttccacagagccctttct

SEQ ID NO: 107318 - DNA, 20 bp, Artificial Sequence
  Description of Artificial Sequence: Synthetic oligonucleotide
  Target: ATXN1; (+) strand; PAM type: NRG; PAM sequence: GAG
tatccaatgttcattttaat

SEQ ID NO: 107319 - DNA, 20 bp, Artificial Sequence
  Description of Artificial Sequence: Synthetic oligonucleotide
  Target: ATXN1; (+) strand; PAM type: NRG; PAM sequence: TGG
ttcattttaatgagcacctc

SEQ ID NO: 107320 - DNA, 20 bp, Artificial Sequence
  Description of Artificial Sequence: Synthetic oligonucleotide
  Target: ATXN1; (+) strand; PAM type: NRG; PAM sequence: TAG
tggactttaatgaacaatct

SEQ ID NO: 107321 - DNA, 20 bp, Artificial Sequence
  Description of Artificial Sequence: Synthetic oligonucleotide
  Target: ATXN1; (+) strand; PAM type: NRG; PAM sequence: AGG
ggactttaatgaacaatctt

SEQ ID NO: 107322 - DNA, 20 bp, Artificial Sequence
  Description of Artificial Sequence: Synthetic oligonucleotide
  Target: ATXN1; (+) strand; PAM type: NRG; PAM sequence: AAG
taatgaacaatcttaggtct

SEQ ID NO: 107323 - DNA, 20 bp, Artificial Sequence
  Description of Artificial Sequence: Synthetic oligonucleotide
  Target: ATXN1; (+) strand; PAM type: NRG; PAM sequence: GAG
gaacaatcttaggtctaagt

SEQ ID NO: 107324 - DNA, 20 bp, Artificial Sequence
  Description of Artificial Sequence: Synthetic oligonucleotide
  Target: ATXN1; (+) strand; PAM type: NRG; PAM sequence: AAG
gtctaagtgagcatcaatta

SEQ ID NO: 107325 - DNA, 20 bp, Artificial Sequence
  Description of Artificial Sequence: Synthetic oligonucleotide
  Target: ATXN1; (+) strand; PAM type: NRG; PAM sequence: GAG
ctaagtgagcatcaattaaa

SEQ ID NO: 107326 - DNA, 20 bp, Artificial Sequence
  Description of Artificial Sequence: Synthetic oligonucleotide
  Target: ATXN1; (+) strand; PAM type: NRG; PAM sequence: AAG
ttaaagagaaaatgcctcca

SEQ ID NO: 107327 - DNA, 20 bp, Artificial Sequence
  Description of Artificial Sequence: Synthetic oligonucleotide
  Target: ATXN1; (+) strand; PAM type: NRG; PAM sequence: AGG
taaagagaaaatgcctccaa

SEQ ID NO: 107328 - DNA, 20 bp, Artificial Sequence
  Description of Artificial Sequence: Synthetic oligonucleotide
  Target: ATXN1; (+) strand; PAM type: NRG; PAM sequence: TGG
aatgcctccaaaggtataaa

SEQ ID NO: 107329 - DNA, 20 bp, Artificial Sequence
  Description of Artificial Sequence: Synthetic oligonucleotide
  Target: ATXN1; (+) strand; PAM type: NRG; PAM sequence: TGG
ataaatggtgatgtatcatc

SEQ ID NO: 107330 - DNA, 20 bp, Artificial Sequence
  Description of Artificial Sequence: Synthetic oligonucleotide
  Target: ATXN1; (+) strand; PAM type: NRG; PAM sequence: GGG
taaatggtgatgtatcatct

SEQ ID NO: 107331 - DNA, 20 bp, Artificial Sequence
  Description of Artificial Sequence: Synthetic oligonucleotide
  Target: ATXN1; (+) strand; PAM type: NRG; PAM sequence: TAG
tggtgatgtatcatctgggt

SEQ ID NO: 107332 - DNA, 20 bp, Artificial Sequence
  Description of Artificial Sequence: Synthetic oligonucleotide
  Target: ATXN1; (+) strand; PAM type: NRG; PAM sequence: CAG
tgatgtatcatctgggttag

SEQ ID NO: 107333 - DNA, 20 bp, Artificial Sequence
  Description of Artificial Sequence: Synthetic oligonucleotide
  Target: ATXN1; (+) strand; PAM type: NRG; PAM sequence: AGG
gatgtatcatctgggttagc

SEQ ID NO: 107334 - DNA, 20 bp, Artificial Sequence
  Description of Artificial Sequence: Synthetic oligonucleotide
  Target: ATXN1; (+) strand; PAM type: NRG; PAM sequence: GGG
atgtatcatctgggttagca

SEQ ID NO: 107335 - DNA, 20 bp, Artificial Sequence
  Description of Artificial Sequence: Synthetic oligonucleotide
  Target: ATXN1; (+) strand; PAM type: NRG; PAM sequence: AAG
atctgggttagcagggttga

SEQ ID NO: 107336 - DNA, 20 bp, Artificial Sequence
  Description of Artificial Sequence: Synthetic oligonucleotide
  Target: ATXN1; (+) strand; PAM type: NRG; PAM sequence: AGG
tctgggttagcagggttgaa

SEQ ID NO: 107337 - DNA, 20 bp, Artificial Sequence
  Description of Artificial Sequence: Synthetic oligonucleotide
  Target: ATXN1; (+) strand; PAM type: NRG; PAM sequence: GAG
agggttgaaaggacacctgt

SEQ ID NO: 107338 - DNA, 20 bp, Artificial Sequence
  Description of Artificial Sequence: Synthetic oligonucleotide
  Target: ATXN1; (+) strand; PAM type: NRG; PAM sequence: GAG
aggacacctgtgagcatcgt

SEQ ID NO: 107339 - DNA, 20 bp, Artificial Sequence
  Description of Artificial Sequence: Synthetic oligonucleotide
  Target: ATXN1; (+) strand; PAM type: NRG; PAM sequence: AGG
ggacacctgtgagcatcgtg

SEQ ID NO: 107340 - DNA, 20 bp, Artificial Sequence
  Description of Artificial Sequence: Synthetic oligonucleotide
  Target: ATXN1; (+) strand; PAM type: NRG; PAM sequence: TGG
cctgtgagcatcgtgaggtt

SEQ ID NO: 107341 - DNA, 20 bp, Artificial Sequence
  Description of Artificial Sequence: Synthetic oligonucleotide
  Target: ATXN1; (+) strand; PAM type: NRG; PAM sequence: TGG
tgagcatcgtgaggtttgga

SEQ ID NO: 107342 - DNA, 20 bp, Artificial Sequence
  Description of Artificial Sequence: Synthetic oligonucleotide
  Target: ATXN1; (+) strand; PAM type: NRG; PAM sequence: AAG
catcgtgaggtttggatggc

SEQ ID NO: 107343 - DNA, 20 bp, Artificial Sequence
  Description of Artificial Sequence: Synthetic oligonucleotide
  Target: ATXN1; (+) strand; PAM type: NRG; PAM sequence: CAG
ggcaagtgtgcccccttgat

SEQ ID NO: 107344 - DNA, 20 bp, Artificial Sequence
  Description of Artificial Sequence: Synthetic oligonucleotide
  Target: ATXN1; (+) strand; PAM type: NRG; PAM sequence: CAG
aagtgtgcccccttgatcag

SEQ ID NO: 107345 - DNA, 20 bp, Artificial Sequence
  Description of Artificial Sequence: Synthetic oligonucleotide
  Target: ATXN1; (+) strand; PAM type: NRG; PAM sequence: TAG
gctcccacctctgtctgata

SEQ ID NO: 107346 - DNA, 20 bp, Artificial Sequence
  Description of Artificial Sequence: Synthetic oligonucleotide
  Target: ATXN1; (+) strand; PAM type: NRG; PAM sequence: GAG
tcccacctctgtctgatata

SEQ ID NO: 107347 - DNA, 20 bp, Artificial Sequence
  Description of Artificial Sequence: Synthetic oligonucleotide
  Target: ATXN1; (+) strand; PAM type: NRG; PAM sequence: AAG
cctctgtctgatatagagcg

SEQ ID NO: 107348 - DNA, 20 bp, Artificial Sequence
  Description of Artificial Sequence: Synthetic oligonucleotide
  Target: ATXN1; (+) strand; PAM type: NRG; PAM sequence: TGG
tgtctgatatagagcgaagc

SEQ ID NO: 107349 - DNA, 20 bp, Artificial Sequence
  Description of Artificial Sequence: Synthetic oligonucleotide
  Target: ATXN1; (+) strand; PAM type: NRG; PAM sequence: GGG
gtctgatatagagcgaagct

SEQ ID NO: 107350 - DNA, 20 bp, Artificial Sequence
  Description of Artificial Sequence: Synthetic oligonucleotide
  Target: ATXN1; (+) strand; PAM type: NRG; PAM sequence: GGG
tctgatatagagcgaagctg

SEQ ID NO: 107351 - DNA, 20 bp, Artificial Sequence
  Description of Artificial Sequence: Synthetic oligonucleotide
  Target: ATXN1; (+) strand; PAM type: NRG; PAM sequence: TGG
tatagagcgaagctggggcc

SEQ ID NO: 107352 - DNA, 20 bp, Artificial Sequence
  Description of Artificial Sequence: Synthetic oligonucleotide
  Target: ATXN1; (+) strand; PAM type: NRG; PAM sequence: GGG
atagagcgaagctggggcct

SEQ ID NO: 107353 - DNA, 20 bp, Artificial Sequence
  Description of Artificial Sequence: Synthetic oligonucleotide
  Target: ATXN1; (+) strand; PAM type: NRG; PAM sequence: AAG
gaagctggggcctgggatga

SEQ ID NO: 107354 - DNA, 20 bp, Artificial Sequence
  Description of Artificial Sequence: Synthetic oligonucleotide
  Target: ATXN1; (+) strand; PAM type: NRG; PAM sequence: AAG
gctggggcctgggatgaaag

SEQ ID NO: 107355 - DNA, 20 bp, Artificial Sequence
  Description of Artificial Sequence: Synthetic oligonucleotide
  Target: ATXN1; (+) strand; PAM type: NRG; PAM sequence: AAG
gggcctgggatgaaagaaga

SEQ ID NO: 107356 - DNA, 20 bp, Artificial Sequence
  Description of Artificial Sequence: Synthetic oligonucleotide
  Target: ATXN1; (+) strand; PAM type: NRG; PAM sequence: CAG
gggatgaaagaagaaagccc

SEQ ID NO: 107357 - DNA, 20 bp, Artificial Sequence
  Description of Artificial Sequence: Synthetic oligonucleotide
  Target: ATXN1; (+) strand; PAM type: NRG; PAM sequence: TAG
aagccccagcacataaatat

SEQ ID NO: 107358 - DNA, 20 bp, Artificial Sequence
  Description of Artificial Sequence: Synthetic oligonucleotide
  Target: ATXN1; (+) strand; PAM type: NRG; PAM sequence: AGG
agccccagcacataaatatt

SEQ ID NO: 107359 - DNA, 20 bp, Artificial Sequence
  Description of Artificial Sequence: Synthetic oligonucleotide
  Target: ATXN1; (+) strand; PAM type: NRG; PAM sequence: GGG
gccccagcacataaatatta

SEQ ID NO: 107360 - DNA, 20 bp, Artificial Sequence
  Description of Artificial Sequence: Synthetic oligonucleotide
  Target: ATXN1; (+) strand; PAM type: NRG; PAM sequence: GGG
ccccagcacataaatattag

SEQ ID NO: 107361 - DNA, 20 bp, Artificial Sequence
  Description of Artificial Sequence: Synthetic oligonucleotide
  Target: ATXN1; (+) strand; PAM type: NRG; PAM sequence: TAG
taaatattaggggaatgcta

SEQ ID NO: 107362 - DNA, 20 bp, Artificial Sequence
  Description of Artificial Sequence: Synthetic oligonucleotide
  Target: ATXN1; (+) strand; PAM type: NRG; PAM sequence: AAG
atattaggggaatgctatag

SEQ ID NO: 107363 - DNA, 20 bp, Artificial Sequence
  Description of Artificial Sequence: Synthetic oligonucleotide
  Target: ATXN1; (+) strand; PAM type: NRG; PAM sequence: AGG
tattaggggaatgctataga

SEQ ID NO: 107364 - DNA, 20 bp, Artificial Sequence
  Description of Artificial Sequence: Synthetic oligonucleotide
  Target: ATXN1; (+) strand; PAM type: NRG; PAM sequence: GAG
ttaggggaatgctatagaag

SEQ ID NO: 107365 - DNA, 20 bp, Artificial Sequence
  Description of Artificial Sequence: Synthetic oligonucleotide
  Target: ATXN1; (+) strand; PAM type: NRG; PAM sequence: AGG
taggggaatgctatagaagg

SEQ ID NO: 107366 - DNA, 20 bp, Artificial Sequence
  Description of Artificial Sequence: Synthetic oligonucleotide
  Target: ATXN1; (+) strand; PAM type: NRG; PAM sequence: AAG
tatagaaggaggaattctga

SEQ ID NO: 107367 - DNA, 20 bp, Artificial Sequence
  Description of Artificial Sequence: Synthetic oligonucleotide
  Target: ATXN1; (+) strand; PAM type: NRG; PAM sequence: AAG
agaaggaggaattctgaaag

SEQ ID NO: 107368 - DNA, 20 bp, Artificial Sequence
  Description of Artificial Sequence: Synthetic oligonucleotide
  Target: ATXN1; (+) strand; PAM type: NRG; PAM sequence: GAG
aaggaggaattctgaaagaa

SEQ ID NO: 107369 - DNA, 20 bp, Artificial Sequence
  Description of Artificial Sequence: Synthetic oligonucleotide
  Target: ATXN1; (+) strand; PAM type: NRG; PAM sequence: GAG
gaaagaagagaaatacatct

SEQ ID NO: 107370 - DNA, 20 bp, Artificial Sequence
  Description of Artificial Sequence: Synthetic oligonucleotide
  Target: ATXN1; (+) strand; PAM type: NRG; PAM sequence: CAG
agaaatacatctgagcaaca

SEQ ID NO: 107371 - DNA, 20 bp, Artificial Sequence
  Description of Artificial Sequence: Synthetic oligonucleotide
  Target: ATXN1; (+) strand; PAM type: NRG; PAM sequence: CAG
tgagcaacacagaattgctg

SEQ ID NO: 107372 - DNA, 20 bp, Artificial Sequence
  Description of Artificial Sequence: Synthetic oligonucleotide
  Target: ATXN1; (+) strand; PAM type: NRG; PAM sequence: GAG
agcaacacagaattgctgca

SEQ ID NO: 107373 - DNA, 20 bp, Artificial Sequence
  Description of Artificial Sequence: Synthetic oligonucleotide
  Target: ATXN1; (+) strand; PAM type: NRG; PAM sequence: CAG
gttacctgcacgcattctta

SEQ ID NO: 107374 - DNA, 20 bp, Artificial Sequence
  Description of Artificial Sequence: Synthetic oligonucleotide
  Target: ATXN1; (+) strand; PAM type: NRG; PAM sequence: AAG
acgcattcttacagttttcc

SEQ ID NO: 107375 - DNA, 20 bp, Artificial Sequence
  Description of Artificial Sequence: Synthetic oligonucleotide
  Target: ATXN1; (+) strand; PAM type: NRG; PAM sequence: AGG
cgcattcttacagttttcca

SEQ ID NO: 107376 - DNA, 20 bp, Artificial Sequence
  Description of Artificial Sequence: Synthetic oligonucleotide
  Target: ATXN1; (+) strand; PAM type: NRG; PAM sequence: AAG
tcttacagttttccaaggac

SEQ ID NO: 107377 - DNA, 20 bp, Artificial Sequence
  Description of Artificial Sequence: Synthetic oligonucleotide
  Target: ATXN1; (+) strand; PAM type: NRG; PAM sequence: GAG
ttacagttttccaaggacaa

SEQ ID NO: 107378 - DNA, 20 bp, Artificial Sequence
  Description of Artificial Sequence: Synthetic oligonucleotide
  Target: ATXN1; (+) strand; PAM type: NRG; PAM sequence: AGG
tacagttttccaaggacaag

SEQ ID NO: 107379 - DNA, 20 bp, Artificial Sequence
  Description of Artificial Sequence: Synthetic oligonucleotide
  Target: ATXN1; (+) strand; PAM type: NRG; PAM sequence: GAG
cagttttccaaggacaagag

SEQ ID NO: 107380 - DNA, 20 bp, Artificial Sequence
  Description of Artificial Sequence: Synthetic oligonucleotide
  Target: ATXN1; (+) strand; PAM type: NRG; PAM sequence: AGG
agttttccaaggacaagagg

SEQ ID NO: 107381 - DNA, 20 bp, Artificial Sequence
  Description of Artificial Sequence: Synthetic oligonucleotide
  Target: ATXN1; (+) strand; PAM type: NRG; PAM sequence: GGG
gttttccaaggacaagagga

SEQ ID NO: 107382 - DNA, 20 bp, Artificial Sequence
  Description of Artificial Sequence: Synthetic oligonucleotide
  Target: ATXN1; (+) strand; PAM type: NRG; PAM sequence: TGG
ccaaggacaagaggagggta

SEQ ID NO: 107383 - DNA, 20 bp, Artificial Sequence
  Description of Artificial Sequence: Synthetic oligonucleotide
  Target: ATXN1; (+) strand; PAM type: NRG; PAM sequence: GAG
ggagggtatggcattaaccc

SEQ ID NO: 107384 - DNA, 20 bp, Artificial Sequence
  Description of Artificial Sequence: Synthetic oligonucleotide
  Target: ATXN1; (+) strand; PAM type: NRG; PAM sequence: TAG
cctgaatatgtctaattctg

SEQ ID NO: 107385 - DNA, 20 bp, Artificial Sequence
  Description of Artificial Sequence: Synthetic oligonucleotide
  Target: ATXN1; (+) strand; PAM type: NRG; PAM sequence: AGG
ctgaatatgtctaattctgt

SEQ ID NO: 107386 - DNA, 20 bp, Artificial Sequence
  Description of Artificial Sequence: Synthetic oligonucleotide
  Target: ATXN1; (+) strand; PAM type: NRG; PAM sequence: GAG
aattctgtaggcatgcaaat

SEQ ID NO: 107387 - DNA, 20 bp, Artificial Sequence
  Description of Artificial Sequence: Synthetic oligonucleotide
  Target: ATXN1; (+) strand; PAM type: NRG; PAM sequence: TGG
gtaggcatgcaaatgagaat

SEQ ID NO: 107388 - DNA, 20 bp, Artificial Sequence
  Description of Artificial Sequence: Synthetic oligonucleotide
  Target: ATXN1; (+) strand; PAM type: NRG; PAM sequence: CGG
aattggtctgactgactttg

SEQ ID NO: 107389 - DNA, 20 bp, Artificial Sequence
  Description of Artificial Sequence: Synthetic oligonucleotide
  Target: ATXN1; (+) strand; PAM type: NRG; PAM sequence: CAG
tggtctgactgactttgcgg

SEQ ID NO: 107390 - DNA, 20 bp, Artificial Sequence
  Description of Artificial Sequence: Synthetic oligonucleotide
  Target: ATXN1; (+) strand; PAM type: NRG; PAM sequence: CAG
tctgactgactttgcggcag

SEQ ID NO: 107391 - DNA, 20 bp, Artificial Sequence
  Description of Artificial Sequence: Synthetic oligonucleotide
  Target: ATXN1; (+) strand; PAM type: NRG; PAM sequence: GAG
ctgactttgcggcagcagct

SEQ ID NO: 107392 - DNA, 20 bp, Artificial Sequence
  Description of Artificial Sequence: Synthetic oligonucleotide
  Target: ATXN1; (+) strand; PAM type: NRG; PAM sequence: CAG
gagccctgctaacttccctt

SEQ ID NO: 107393 - DNA, 20 bp, Artificial Sequence
  Description of Artificial Sequence: Synthetic oligonucleotide
  Target: ATXN1; (+) strand; PAM type: NRG; PAM sequence: CAG
gctaacttcccttcagaact

SEQ ID NO: 107394 - DNA, 20 bp, Artificial Sequence
  Description of Artificial Sequence: Synthetic oligonucleotide
  Target: ATXN1; (+) strand; PAM type: NRG; PAM sequence: TGG
cttcccttcagaactcagct

SEQ ID NO: 107395 - DNA, 20 bp, Artificial Sequence
  Description of Artificial Sequence: Synthetic oligonucleotide
  Target: ATXN1; (+) strand; PAM type: NRG; PAM sequence: GGG
ttcccttcagaactcagctt

SEQ ID NO: 107396 - DNA, 20 bp, Artificial Sequence
  Description of Artificial Sequence: Synthetic oligonucleotide
  Target: ATXN1; (+) strand; PAM type: NRG; PAM sequence: TAG
cttcagaactcagcttgggc

SEQ ID NO: 107397 - DNA, 20 bp, Artificial Sequence
  Description of Artificial Sequence: Synthetic oligonucleotide
  Target: ATXN1; (+) strand; PAM type: NRG; PAM sequence: AAG
gaactcagcttgggctagca

SEQ ID NO: 107398 - DNA, 20 bp, Artificial Sequence
  Description of Artificial Sequence: Synthetic oligonucleotide
  Target: ATXN1; (+) strand; PAM type: NRG; PAM sequence: AAG
cagcttgggctagcaaagaa

SEQ ID NO: 107399 - DNA, 20 bp, Artificial Sequence
  Description of Artificial Sequence: Synthetic oligonucleotide
  Target: ATXN1; (+) strand; PAM type: NRG; PAM sequence: CAG
gcccactcacccacctaccc

SEQ ID NO: 107400 - DNA, 20 bp, Artificial Sequence
  Description of Artificial Sequence: Synthetic oligonucleotide
  Target: ATXN1; (+) strand; PAM type: NRG; PAM sequence: CAG
cactcacccacctaccccag

SEQ ID NO: 107401 - DNA, 20 bp, Artificial Sequence
  Description of Artificial Sequence: Synthetic oligonucleotide
  Target: ATXN1; (+) strand; PAM type: NRG; PAM sequence: CAG
cacctaccccagcagctttg

SEQ ID NO: 107402 - DNA, 20 bp, Artificial Sequence
  Description of Artificial Sequence: Synthetic oligonucleotide
  Target: ATXN1; (+) strand; PAM type: NRG; PAM sequence: AAG
ctaccccagcagctttgcag

SEQ ID NO: 107403 - DNA, 20 bp, Artificial Sequence
  Description of Artificial Sequence: Synthetic oligonucleotide
  Target: ATXN1; (+) strand; PAM type: NRG; PAM sequence: CAG
gcagctttgcagaagtgctg

SEQ ID NO: 107404 - DNA, 20 bp, Artificial Sequence
  Description of Artificial Sequence: Synthetic oligonucleotide
  Target: ATXN1; (+) strand; PAM type: NRG; PAM sequence: AGG
cagctttgcagaagtgctgc

SEQ ID NO: 107405 - DNA, 20 bp, Artificial Sequence
  Description of Artificial Sequence: Synthetic oligonucleotide
  Target: ATXN1; (+) strand; PAM type: NRG; PAM sequence: GGG
agctttgcagaagtgctgca

SEQ ID NO: 107406 - DNA, 20 bp, Artificial Sequence
  Description of Artificial Sequence: Synthetic oligonucleotide
  Target: ATXN1; (+) strand; PAM type: NRG; PAM sequence: AAG
tgcagaagtgctgcagggtg

SEQ ID NO: 107407 - DNA, 20 bp, Artificial Sequence
  Description of Artificial Sequence: Synthetic oligonucleotide
  Target: ATXN1; (+) strand; PAM type: NRG; PAM sequence: AAG
gctgcagggtgaagacaatg

SEQ ID NO: 107408 - DNA, 20 bp, Artificial Sequence
  Description of Artificial Sequence: Synthetic oligonucleotide
  Target: ATXN1; (+) strand; PAM type: NRG; PAM sequence: AAG
cagggtgaagacaatgaaga

SEQ ID NO: 107409 - DNA, 20 bp, Artificial Sequence
  Description of Artificial Sequence: Synthetic oligonucleotide
  Target: ATXN1; (+) strand; PAM type: NRG; PAM sequence: AGG
agggtgaagacaatgaagaa

SEQ ID NO: 107410 - DNA, 20 bp, Artificial Sequence
  Description of Artificial Sequence: Synthetic oligonucleotide
  Target: ATXN1; (+) strand; PAM type: NRG; PAM sequence: AAG
tgaagacaatgaagaaaggc

SEQ ID NO: 107411 - DNA, 20 bp, Artificial Sequence
  Description of Artificial Sequence: Synthetic oligonucleotide
  Target: ATXN1; (+) strand; PAM type: NRG; PAM sequence: AGG
gaagacaatgaagaaaggca

SEQ ID NO: 107412 - DNA, 20 bp, Artificial Sequence
  Description of Artificial Sequence: Synthetic oligonucleotide
  Target: ATXN1; (+) strand; PAM type: NRG; PAM sequence: AAG
aatgaagaaaggcaaggctg

SEQ ID NO: 107413 - DNA, 20 bp, Artificial Sequence
  Description of Artificial Sequence: Synthetic oligonucleotide
  Target: ATXN1; (+) strand; PAM type: NRG; PAM sequence: AAG
aagaaaggcaaggctgaaga

SEQ ID NO: 107414 - DNA, 20 bp, Artificial Sequence
  Description of Artificial Sequence: Synthetic oligonucleotide
  Target: ATXN1; (+) strand; PAM type: NRG; PAM sequence: GAG
aggcaaggctgaagaaagcc

SEQ ID NO: 107415 - DNA, 20 bp, Artificial Sequence
  Description of Artificial Sequence: Synthetic oligonucleotide
  Target: ATXN1; (+) strand; PAM type: NRG; PAM sequence: AGG
ggcaaggctgaagaaagccg

SEQ ID NO: 107416 - DNA, 20 bp, Artificial Sequence
  Description of Artificial Sequence: Synthetic oligonucleotide
  Target: ATXN1; (+) strand; PAM type: NRG; PAM sequence: CAG
cgaggcattctgccctctcc

SEQ ID NO: 107417 - DNA, 20 bp, Artificial Sequence
  Description of Artificial Sequence: Synthetic oligonucleotide
  Target: ATXN1; (+) strand; PAM type: NRG; PAM sequence: AAG
cattctgccctctcccagca

SEQ ID NO: 107418 - DNA, 20 bp, Artificial Sequence
  Description of Artificial Sequence: Synthetic oligonucleotide
  Target: ATXN1; (+) strand; PAM type: NRG; PAM sequence: CAG
ctgccctctcccagcaaaga

SEQ ID NO: 107419 - DNA, 20 bp, Artificial Sequence
  Description of Artificial Sequence: Synthetic oligonucleotide
  Target: ATXN1; (+) strand; PAM type: NRG; PAM sequence: TGG
ctctcccagcaaagacagcc

SEQ ID NO: 107420 - DNA, 20 bp, Artificial Sequence
  Description of Artificial Sequence: Synthetic oligonucleotide
  Target: ATXN1; (+) strand; PAM type: NRG; PAM sequence: CAG
aaagacagcctggacgtgtt

SEQ ID NO: 107421 - DNA, 20 bp, Artificial Sequence
  Description of Artificial Sequence: Synthetic oligonucleotide
  Target: ATXN1; (+) strand; PAM type: NRG; PAM sequence: AAG
agaccctatcgccgcatcaa

SEQ ID NO: 107422 - DNA, 20 bp, Artificial Sequence
  Description of Artificial Sequence: Synthetic oligonucleotide
  Target: ATXN1; (+) strand; PAM type: NRG; PAM sequence: AAG
ccctatcgccgcatcaaaag

SEQ ID NO: 107423 - DNA, 20 bp, Artificial Sequence
  Description of Artificial Sequence: Synthetic oligonucleotide
  Target: ATXN1; (+) strand; PAM type: NRG; PAM sequence: AAG
cgcatcaaaagaagaacacc

SEQ ID NO: 107424 - DNA, 20 bp, Artificial Sequence
  Description of Artificial Sequence: Synthetic oligonucleotide
  Target: ATXN1; (+) strand; PAM type: NRG; PAM sequence: AGG
gcatcaaaagaagaacacca

SEQ ID NO: 107425 - DNA, 20 bp, Artificial Sequence
  Description of Artificial Sequence: Synthetic oligonucleotide
  Target: ATXN1; (+) strand; PAM type: NRG; PAM sequence: GAG
atcaaaagaagaacaccaag

SEQ ID NO: 107426 - DNA, 20 bp, Artificial Sequence
  Description of Artificial Sequence: Synthetic oligonucleotide
  Target: ATXN1; (+) strand; PAM type: NRG; PAM sequence: AAG
aaagaagaacaccaaggaga

SEQ ID NO: 107427 - DNA, 20 bp, Artificial Sequence
  Description of Artificial Sequence: Synthetic oligonucleotide
  Target: ATXN1; (+) strand; PAM type: NRG; PAM sequence: AGG
aagaagaacaccaaggagaa

SEQ ID NO: 107428 - DNA, 20 bp, Artificial Sequence
  Description of Artificial Sequence: Synthetic oligonucleotide
  Target: ATXN1; (+) strand; PAM type: NRG; PAM sequence: GAG
gaagaacaccaaggagaaag

SEQ ID NO: 107429 - DNA, 20 bp, Artificial Sequence
  Description of Artificial Sequence: Synthetic oligonucleotide
  Target: ATXN1; (+) strand; PAM type: NRG; PAM sequence: AAG
caaggagaaaggagtcacaa

SEQ ID NO: 107430 - DNA, 20 bp, Artificial Sequence
  Description of Artificial Sequence: Synthetic oligonucleotide
  Target: ATXN1; (+) strand; PAM type: NRG; PAM sequence: TGG
gaaaggagtcacaaaagctc

SEQ ID NO: 107431 - DNA, 20 bp, Artificial Sequence
  Description of Artificial Sequence: Synthetic oligonucleotide
  Target: ATXN1; (+) strand; PAM type: NRG; PAM sequence: CAG
cacaaaagctctggcatgat

SEQ ID NO: 107432 - DNA, 20 bp, Artificial Sequence
  Description of Artificial Sequence: Synthetic oligonucleotide
  Target: ATXN1; (+) strand; PAM type: NRG; PAM sequence: AGG
acaaaagctctggcatgatc

SEQ ID NO: 107433 - DNA, 20 bp, Artificial Sequence
  Description of Artificial Sequence: Synthetic oligonucleotide
  Target: ATXN1; (+) strand; PAM type: NRG; PAM sequence: AAG
aaagctctggcatgatcagg

SEQ ID NO: 107434 - DNA, 20 bp, Artificial Sequence
  Description of Artificial Sequence: Synthetic oligonucleotide
  Target: ATXN1; (+) strand; PAM type: NRG; PAM sequence: AGG
aagctctggcatgatcagga

SEQ ID NO: 107435 - DNA, 20 bp, Artificial Sequence
  Description of Artificial Sequence: Synthetic oligonucleotide
  Target: ATXN1; (+) strand; PAM type: NRG; PAM sequence: TGG
ggcatgatcaggaaggcacc

SEQ ID NO: 107436 - DNA, 20 bp, Artificial Sequence
  Description of Artificial Sequence: Synthetic oligonucleotide
  Target: ATXN1; (+) strand; PAM type: NRG; PAM sequence: AAG
ggaaggcacctggatttgaa

SEQ ID NO: 107437 - DNA, 20 bp, Artificial Sequence
  Description of Artificial Sequence: Synthetic oligonucleotide
  Target: ATXN1; (+) strand; PAM type: NRG; PAM sequence: AGG
gaaggcacctggatttgaaa

SEQ ID NO: 107438 - DNA, 20 bp, Artificial Sequence
  Description of Artificial Sequence: Synthetic oligonucleotide
  Target: ATXN1; (+) strand; PAM type: NRG; PAM sequence: AAG
aaaaggatatattattgccc

SEQ ID NO: 107439 - DNA, 20 bp, Artificial Sequence
  Description of Artificial Sequence: Synthetic oligonucleotide
  Target: ATXN1; (+) strand; PAM type: NRG; PAM sequence: AAG
cttcactgatttccatgact

SEQ ID NO: 107440 - DNA, 20 bp, Artificial Sequence
  Description of Artificial Sequence: Synthetic oligonucleotide
  Target: ATXN1; (+) strand; PAM type: NRG; PAM sequence: CAG
tccatgactaagccacttga

SEQ ID NO: 107441 - DNA, 20 bp, Artificial Sequence
  Description of Artificial Sequence: Synthetic oligonucleotide
  Target: ATXN1; (+) strand; PAM type: NRG; PAM sequence: AAG
tttttttcaatttaaacttt

SEQ ID NO: 107442 - DNA, 20 bp, Artificial Sequence
  Description of Artificial Sequence: Synthetic oligonucleotide
  Target: ATXN1; (+) strand; PAM type: NRG; PAM sequence: CAG
aatttaaactttaagaacta

SEQ ID NO: 107443 - DNA, 20 bp, Artificial Sequence
  Description of Artificial Sequence: Synthetic oligonucleotide
  Target: ATXN1; (+) strand; PAM type: NRG; PAM sequence: TAG
agaactacagctctgttact

SEQ ID NO: 107444 - DNA, 20 bp, Artificial Sequence
  Description of Artificial Sequence: Synthetic oligonucleotide
  Target: ATXN1; (+) strand; PAM type: NRG; PAM sequence: AAG
gctctgttacttagaatcca

SEQ ID NO: 107445 - DNA, 20 bp, Artificial Sequence
  Description of Artificial Sequence: Synthetic oligonucleotide
  Target: ATXN1; (+) strand; PAM type: NRG; PAM sequence: CAG
gaatccaaagcaaatatcat

SEQ ID NO: 107446 - DNA, 20 bp, Artificial Sequence
  Description of Artificial Sequence: Synthetic oligonucleotide
  Target: ATXN1; (+) strand; PAM type: NRG; PAM sequence: AGG
aatccaaagcaaatatcatc

SEQ ID NO: 107447 - DNA, 20 bp, Artificial Sequence
  Description of Artificial Sequence: Synthetic oligonucleotide
  Target: ATXN1; (+) strand; PAM type: NRG; PAM sequence: AAG
aaagcaaatatcatcaggac

SEQ ID NO: 107448 - DNA, 20 bp, Artificial Sequence
  Description of Artificial Sequence: Synthetic oligonucleotide
  Target: ATXN1; (+) strand; PAM type: NRG; PAM sequence: GAG
tcatcaggacaagtgtctct

SEQ ID NO: 107449 - DNA, 20 bp, Artificial Sequence
  Description of Artificial Sequence: Synthetic oligonucleotide
  Target: ATXN1; (+) strand; PAM type: NRG; PAM sequence: AGG
catcaggacaagtgtctctg

SEQ ID NO: 107450 - DNA, 20 bp, Artificial Sequence
  Description of Artificial Sequence: Synthetic oligonucleotide
  Target: ATXN1; (+) strand; PAM type: NRG; PAM sequence: CAG
gacaagtgtctctgaggaaa

SEQ ID NO: 107451 - DNA, 20 bp, Artificial Sequence
  Description of Artificial Sequence: Synthetic oligonucleotide
  Target: ATXN1; (+) strand; PAM type: NRG; PAM sequence: GAG
tacatgctaacacccatcct

SEQ ID NO: 107452 - DNA, 20 bp, Artificial Sequence
  Description of Artificial Sequence: Synthetic oligonucleotide
  Target: ATXN1; (+) strand; PAM type: NRG; PAM sequence: CAG
gctaacacccatcctgagcc

SEQ ID NO: 107453 - DNA, 20 bp, Artificial Sequence
  Description of Artificial Sequence: Synthetic oligonucleotide
  Target: ATXN1; (+) strand; PAM type: NRG; PAM sequence: TGG
agcgaatgtccttctatgcc

SEQ ID NO: 107454 - DNA, 20 bp, Artificial Sequence
  Description of Artificial Sequence: Synthetic oligonucleotide
  Target: ATXN1; (+) strand; PAM type: NRG; PAM sequence: AAG
tccttctatgcctggttaca

SEQ ID NO: 107455 - DNA, 20 bp, Artificial Sequence
  Description of Artificial Sequence: Synthetic oligonucleotide
  Target: ATXN1; (+) strand; PAM type: NRG; PAM sequence: TGG
ctatgcctggttacaaagat

SEQ ID NO: 107456 - DNA, 20 bp, Artificial Sequence
  Description of Artificial Sequence: Synthetic oligonucleotide
  Target: ATXN1; (+) strand; PAM type: NRG; PAM sequence: GGG
tatgcctggttacaaagatt

SEQ ID NO: 107457 - DNA, 20 bp, Artificial Sequence
  Description of Artificial Sequence: Synthetic oligonucleotide
  Target: ATXN1; (+) strand; PAM type: NRG; PAM sequence: GGG
atgcctggttacaaagattg

SEQ ID NO: 107458 - DNA, 20 bp, Artificial Sequence
  Description of Artificial Sequence: Synthetic oligonucleotide
  Target: ATXN1; (+) strand; PAM type: NRG; PAM sequence: CAG
ttctctcaccctgataatca

SEQ ID NO: 107459 - DNA, 20 bp, Artificial Sequence
  Description of Artificial Sequence: Synthetic oligonucleotide
  Target: ATXN1; (+) strand; PAM type: NRG; PAM sequence: TAG
tctcaccctgataatcacag

SEQ ID NO: 107460 - DNA, 20 bp, Artificial Sequence
  Description of Artificial Sequence: Synthetic oligonucleotide
  Target: ATXN1; (+) strand; PAM type: NRG; PAM sequence: TGG
ctgataatcacagtagtttc

SEQ ID NO: 107461 - DNA, 20 bp, Artificial Sequence
  Description of Artificial Sequence: Synthetic oligonucleotide
  Target: ATXN1; (+) strand; PAM type: NRG; PAM sequence: GGG
tgataatcacagtagtttct

SEQ ID NO: 107462 - DNA, 20 bp, Artificial Sequence
  Description of Artificial Sequence: Synthetic oligonucleotide
  Target: ATXN1; (+) strand; PAM type: NRG; PAM sequence: GGG
gataatcacagtagtttctg

SEQ ID NO: 107463 - DNA, 20 bp, Artificial Sequence
  Description of Artificial Sequence: Synthetic oligonucleotide
  Target: ATXN1; (+) strand; PAM type: NRG; PAM sequence: GGG
ataatcacagtagtttctgg

SEQ ID NO: 107464 - DNA, 20 bp, Artificial Sequence
  Description of Artificial Sequence: Synthetic oligonucleotide
  Target: ATXN1; (+) strand; PAM type: NRG; PAM sequence: TAG
acagtagtttctgggggacc

SEQ ID NO: 107465 - DNA, 20 bp, Artificial Sequence
  Description of Artificial Sequence: Synthetic oligonucleotide
  Target: ATXN1; (+) strand; PAM type: NRG; PAM sequence: TGG
tagtttctgggggacctaga

SEQ ID NO: 107466 - DNA, 20 bp, Artificial Sequence
  Description of Artificial Sequence: Synthetic oligonucleotide
  Target: ATXN1; (+) strand; PAM type: NRG; PAM sequence: TGG
tggaaccctttattaaattt

SEQ ID NO: 107467 - DNA, 20 bp, Artificial Sequence
  Description of Artificial Sequence: Synthetic oligonucleotide
  Target: ATXN1; (+) strand; PAM type: NRG; PAM sequence: GAG
tttattaaattttggaacat

SEQ ID NO: 107468 - DNA, 20 bp, Artificial Sequence
  Description of Artificial Sequence: Synthetic oligonucleotide
  Target: ATXN1; (+) strand; PAM type: NRG; PAM sequence: AAG
ttaaattttggaacatgaga

SEQ ID NO: 107469 - DNA, 20 bp, Artificial Sequence
  Description of Artificial Sequence: Synthetic oligonucleotide
  Target: ATXN1; (+) strand; PAM type: NRG; PAM sequence: AGG
taaattttggaacatgagaa

SEQ ID NO: 107470 - DNA, 20 bp, Artificial Sequence
  Description of Artificial Sequence: Synthetic oligonucleotide
  Target: ATXN1; (+) strand; PAM type: NRG; PAM sequence: TGG
ttttggaacatgagaaaggc

SEQ ID NO: 107471 - DNA, 20 bp, Artificial Sequence
  Description of Artificial Sequence: Synthetic oligonucleotide
  Target: ATXN1; (+) strand; PAM type: NRG; PAM sequence: GGG
tttggaacatgagaaaggct

SEQ ID NO: 107472 - DNA, 20 bp, Artificial Sequence
  Description of Artificial Sequence: Synthetic oligonucleotide
  Target: ATXN1; (+) strand; PAM type: NRG; PAM sequence: TGG
ggaacatgagaaaggctggg

SEQ ID NO: 107473 - DNA, 20 bp, Artificial Sequence
  Description of Artificial Sequence: Synthetic oligonucleotide
  Target: ATXN1; (+) strand; PAM type: NRG; PAM sequence: AAG
ggtacccacttgtcatttgt

SEQ ID NO: 107474 - DNA, 20 bp, Artificial Sequence
  Description of Artificial Sequence: Synthetic oligonucleotide
  Target: ATXN1; (+) strand; PAM type: NRG; PAM sequence: GAG
cccacttgtcatttgtaagt

SEQ ID NO: 107475 - DNA, 20 bp, Artificial Sequence
  Description of Artificial Sequence: Synthetic oligonucleotide
  Target: ATXN1; (+) strand; PAM type: NRG; PAM sequence: TGG
tgtcatttgtaagtgagtgc

SEQ ID NO: 107476 - DNA, 20 bp, Artificial Sequence
  Description of Artificial Sequence: Synthetic oligonucleotide
  Target: ATXN1; (+) strand; PAM type: NRG; PAM sequence: CAG
gagtgctggataatttccat

SEQ ID NO: 107477 - DNA, 20 bp, Artificial Sequence
  Description of Artificial Sequence: Synthetic oligonucleotide
  Target: ATXN1; (+) strand; PAM type: NRG; PAM sequence: AAG
ccttcctatgatactaattt

SEQ ID NO: 107478 - DNA, 20 bp, Artificial Sequence
  Description of Artificial Sequence: Synthetic oligonucleotide
  Target: ATXN1; (+) strand; PAM type: NRG; PAM sequence: GAG
ttcctatgatactaatttaa

SEQ ID NO: 107479 - DNA, 20 bp, Artificial Sequence
  Description of Artificial Sequence: Synthetic oligonucleotide
  Target: ATXN1; (+) strand; PAM type: NRG; PAM sequence: TAG
agttctttcaaacccaaatt

SEQ ID NO: 107480 - DNA, 20 bp, Artificial Sequence
  Description of Artificial Sequence: Synthetic oligonucleotide
  Target: ATXN1; (+) strand; PAM type: NRG; PAM sequence: TAG
tttagctctgtgtgcccacc

SEQ ID NO: 107481 - DNA, 20 bp, Artificial Sequence
  Description of Artificial Sequence: Synthetic oligonucleotide
  Target: ATXN1; (+) strand; PAM type: NRG; PAM sequence: TGG
tgtgcccacctagattgctc

SEQ ID NO: 107482 - DNA, 20 bp, Artificial Sequence
  Description of Artificial Sequence: Synthetic oligonucleotide
  Target: ATXN1; (+) strand; PAM type: NRG; PAM sequence: GGG
gtgcccacctagattgctct

SEQ ID NO: 107483 - DNA, 20 bp, Artificial Sequence
  Description of Artificial Sequence: Synthetic oligonucleotide
  Target: ATXN1; (+) strand; PAM type: NRG; PAM sequence: TAG
gattgctctgggaattgaaa

SEQ ID NO: 107484 - DNA, 20 bp, Artificial Sequence
  Description of Artificial Sequence: Synthetic oligonucleotide
  Target: ATXN1; (+) strand; PAM type: NRG; PAM sequence: AAG
tctgggaattgaaatagtcc

SEQ ID NO: 107485 - DNA, 20 bp, Artificial Sequence
  Description of Artificial Sequence: Synthetic oligonucleotide
  Target: ATXN1; (+) strand; PAM type: NRG; PAM sequence: TGG
atagtccaagctatttgctt

SEQ ID NO: 107486 - DNA, 20 bp, Artificial Sequence
  Description of Artificial Sequence: Synthetic oligonucleotide
  Target: ATXN1; (+) strand; PAM type: NRG; PAM sequence: AAG
atatactccattgtgaatga

SEQ ID NO: 107487 - DNA, 20 bp, Artificial Sequence
  Description of Artificial Sequence: Synthetic oligonucleotide
  Target: ATXN1; (+) strand; PAM type: NRG; PAM sequence: AGG
tatactccattgtgaatgaa

SEQ ID NO: 107488 - DNA, 20 bp, Artificial Sequence
  Description of Artificial Sequence: Synthetic oligonucleotide
  Target: ATXN1; (+) strand; PAM type: NRG; PAM sequence: TGG
cattgtgaatgaaaggccta

SEQ ID NO: 107489 - DNA, 20 bp, Artificial Sequence
  Description of Artificial Sequence: Synthetic oligonucleotide
  Target: ATXN1; (+) strand; PAM type: NRG; PAM sequence: AAG
tgaatgaaaggcctatggcc

SEQ ID NO: 107490 - DNA, 20 bp, Artificial Sequence
  Description of Artificial Sequence: Synthetic oligonucleotide
  Target: ATXN1; (+) strand; PAM type: NRG; PAM sequence: AGG
gaatgaaaggcctatggcca

SEQ ID NO: 107491 - DNA, 20 bp, Artificial Sequence
  Description of Artificial Sequence: Synthetic oligonucleotide
  Target: ATXN1; (+) strand; PAM type: NRG; PAM sequence: TGG
atggccaaggtgtttccttc

SEQ ID NO: 107492 - DNA, 20 bp, Artificial Sequence
  Description of Artificial Sequence: Synthetic oligonucleotide
  Target: ATXN1; (+) strand; PAM type: NRG; PAM sequence: AAG
aaggtgtttccttctggcac

SEQ ID NO: 107493 - DNA, 20 bp, Artificial Sequence
  Description of Artificial Sequence: Synthetic oligonucleotide
  Target: ATXN1; (+) strand; PAM type: NRG; PAM sequence: AAG
gtttccttctggcacaagaa

SEQ ID NO: 107494 - DNA, 20 bp, Artificial Sequence
  Description of Artificial Sequence: Synthetic oligonucleotide
  Target: ATXN1; (+) strand; PAM type: NRG; PAM sequence: GAG
ttccttctggcacaagaaaa

SEQ ID NO: 107495 - DNA, 20 bp, Artificial Sequence
  Description of Artificial Sequence: Synthetic oligonucleotide
  Target: ATXN1; (+) strand; PAM type: NRG; PAM sequence: AAG
tctggcacaagaaaagagaa

SEQ ID NO: 107496 - DNA, 20 bp, Artificial Sequence
  Description of Artificial Sequence: Synthetic oligonucleotide
  Target: ATXN1; (+) strand; PAM type: NRG; PAM sequence: CAG
gcacaagaaaagagaaaaga

SEQ ID NO: 107497 - DNA, 20 bp, Artificial Sequence
  Description of Artificial Sequence: Synthetic oligonucleotide
  Target: ATXN1; (+) strand; PAM type: NRG; PAM sequence: CAG
agaaaagagaaaagacagaa

SEQ ID NO: 107498 - DNA, 20 bp, Artificial Sequence
  Description of Artificial Sequence: Synthetic oligonucleotide
  Target: ATXN1; (+) strand; PAM type: NRG; PAM sequence: AGG
gaaaagagaaaagacagaac

SEQ ID NO: 107499 - DNA, 20 bp, Artificial Sequence
  Description of Artificial Sequence: Synthetic oligonucleotide
  Target: ATXN1; (+) strand; PAM type: NRG; PAM sequence: GGG
aaaagagaaaagacagaaca

SEQ ID NO: 107500 - DNA, 20 bp, Artificial Sequence
  Description of Artificial Sequence: Synthetic oligonucleotide
  Target: ATXN1; (+) strand; PAM type: NRG; PAM sequence: AAG
agagaaaagacagaacaggg

SEQ ID NO: 107501 - DNA, 20 bp, Artificial Sequence
  Description of Artificial Sequence: Synthetic oligonucleotide
  Target: ATXN1; (+) strand; PAM type: NRG; PAM sequence: AGG
gagaaaagacagaacaggga

SEQ ID NO: 107502 - DNA, 20 bp, Artificial Sequence
  Description of Artificial Sequence: Synthetic oligonucleotide
  Target: ATXN1; (+) strand; PAM type: NRG; PAM sequence: GGG
agaaaagacagaacagggaa

SEQ ID NO: 107503 - DNA, 20 bp, Artificial Sequence
  Description of Artificial Sequence: Synthetic oligonucleotide
  Target: ATXN1; (+) strand; PAM type: NRG; PAM sequence: GGG
gaaaagacagaacagggaag

SEQ ID NO: 107504 - DNA, 20 bp, Artificial Sequence
  Description of Artificial Sequence: Synthetic oligonucleotide
  Target: ATXN1; (+) strand; PAM type: NRG; PAM sequence: CAG
aagacagaacagggaagggg

SEQ ID NO: 107505 - DNA, 20 bp, Artificial Sequence
  Description of Artificial Sequence: Synthetic oligonucleotide
  Target: ATXN1; (+) strand; PAM type: NRG; PAM sequence: AGG
agacagaacagggaaggggc

SEQ ID NO: 107506 - DNA, 20 bp, Artificial Sequence
  Description of Artificial Sequence: Synthetic oligonucleotide
  Target: ATXN1; (+) strand; PAM type: NRG; PAM sequence: GGG
gacagaacagggaaggggca

SEQ ID NO: 107507 - DNA, 20 bp, Artificial Sequence
  Description of Artificial Sequence: Synthetic oligonucleotide
  Target: ATXN1; (+) strand; PAM type: NRG; PAM sequence: GGG
acagaacagggaaggggcag

SEQ ID NO: 107508 - DNA, 20 bp, Artificial Sequence
  Description of Artificial Sequence: Synthetic oligonucleotide
  Target: ATXN1; (+) strand; PAM type: NRG; PAM sequence: GGG
cagaacagggaaggggcagg

SEQ ID NO: 107509 - DNA, 20 bp, Artificial Sequence
  Description of Artificial Sequence: Synthetic oligonucleotide
  Target: ATXN1; (+) strand; PAM type: NRG; PAM sequence: AAG
aacagggaaggggcaggggg

SEQ ID NO: 107510 - DNA, 20 bp, Artificial Sequence
  Description of Artificial Sequence: Synthetic oligonucleotide
  Target: ATXN1; (+) strand; PAM type: NRG; PAM sequence: TGG
agggggaagtctgataaaaa

SEQ ID NO: 107511 - DNA, 20 bp, Artificial Sequence
  Description of Artificial Sequence: Synthetic oligonucleotide
  Target: ATXN1; (+) strand; PAM type: NRG; PAM sequence: CAG
actatctgttcaattaccta

SEQ ID NO: 107512 - DNA, 20 bp, Artificial Sequence
  Description of Artificial Sequence: Synthetic oligonucleotide
  Target: ATXN1; (+) strand; PAM type: NRG; PAM sequence: TGG
attacctacagatttcccac

SEQ ID NO: 107513 - DNA, 20 bp, Artificial Sequence
  Description of Artificial Sequence: Synthetic oligonucleotide
  Target: ATXN1; (+) strand; PAM type: NRG; PAM sequence: GGG
ttacctacagatttcccact

SEQ ID NO: 107514 - DNA, 20 bp, Artificial Sequence
  Description of Artificial Sequence: Synthetic oligonucleotide
  Target: ATXN1; (+) strand; PAM type: NRG; PAM sequence: TAG
tttcccactgggctttactt

SEQ ID NO: 107515 - DNA, 20 bp, Artificial Sequence
  Description of Artificial Sequence: Synthetic oligonucleotide
  Target: ATXN1; (+) strand; PAM type: NRG; PAM sequence: AAG
ccactgggctttactttaga

SEQ ID NO: 107516 - DNA, 20 bp, Artificial Sequence
  Description of Artificial Sequence: Synthetic oligonucleotide
  Target: ATXN1; (+) strand; PAM type: NRG; PAM sequence: CAG
ctttactttagaaagttgta

SEQ ID NO: 107517 - DNA, 20 bp, Artificial Sequence
  Description of Artificial Sequence: Synthetic oligonucleotide
  Target: ATXN1; (+) strand; PAM type: NRG; PAM sequence: AGG
tttactttagaaagttgtac

SEQ ID NO: 107518 - DNA, 20 bp, Artificial Sequence
  Description of Artificial Sequence: Synthetic oligonucleotide
  Target: ATXN1; (+) strand; PAM type: NRG; PAM sequence: AAG
tacaggttaatgctatccac

SEQ ID NO: 107519 - DNA, 20 bp, Artificial Sequence
  Description of Artificial Sequence: Synthetic oligonucleotide
  Target: ATXN1; (+) strand; PAM type: NRG; PAM sequence: TGG
ttaatgctatccacaagccc

SEQ ID NO: 107520 - DNA, 20 bp, Artificial Sequence
  Description of Artificial Sequence: Synthetic oligonucleotide
  Target: ATXN1; (+) strand; PAM type: NRG; PAM sequence: GGG
taatgctatccacaagccct

SEQ ID NO: 107521 - DNA, 20 bp, Artificial Sequence
  Description of Artificial Sequence: Synthetic oligonucleotide
  Target: ATXN1; (+) strand; PAM type: NRG; PAM sequence: TGG
tatccacaagccctgggcac

SEQ ID NO: 107522 - DNA, 20 bp, Artificial Sequence
  Description of Artificial Sequence: Synthetic oligonucleotide
  Target: ATXN1; (+) strand; PAM type: NRG; PAM sequence: TGG
ccctgggcactggtgcccca

SEQ ID NO: 107523 - DNA, 20 bp, Artificial Sequence
  Description of Artificial Sequence: Synthetic oligonucleotide
  Target: ATXN1; (+) strand; PAM type: NRG; PAM sequence: CAG
ggcactggtgccccatggca

SEQ ID NO: 107524 - DNA, 20 bp, Artificial Sequence
  Description of Artificial Sequence: Synthetic oligonucleotide
  Target: ATXN1; (+) strand; PAM type: NRG; PAM sequence: CGG
ccccatggcacagctgcctg

SEQ ID NO: 107525 - DNA, 20 bp, Artificial Sequence
  Description of Artificial Sequence: Synthetic oligonucleotide
  Target: ATXN1; (+) strand; PAM type: NRG; PAM sequence: GGG
cccatggcacagctgcctgc

SEQ ID NO: 107526 - DNA, 20 bp, Artificial Sequence
  Description of Artificial Sequence: Synthetic oligonucleotide
  Target: ATXN1; (+) strand; PAM type: NRG; PAM sequence: TGG
tggcacagctgcctgcggga

SEQ ID NO: 107527 - DNA, 20 bp, Artificial Sequence
  Description of Artificial Sequence: Synthetic oligonucleotide
  Target: ATXN1; (+) strand; PAM type: NRG; PAM sequence: TGG
gctgcctgcgggatggcaca

SEQ ID NO: 107528 - DNA, 20 bp, Artificial Sequence
  Description of Artificial Sequence: Synthetic oligonucleotide
  Target: ATXN1; (+) strand; PAM type: NRG; PAM sequence: TAG
gatggcacatggtacactaa

SEQ ID NO: 107529 - DNA, 20 bp, Artificial Sequence
  Description of Artificial Sequence: Synthetic oligonucleotide
  Target: ATXN1; (+) strand; PAM type: NRG; PAM sequence: TAG
actaatagcacacttattat

SEQ ID NO: 107530 - DNA, 20 bp, Artificial Sequence
  Description of Artificial Sequence: Synthetic oligonucleotide
  Target: ATXN1; (+) strand; PAM type: NRG; PAM sequence: TGG
ttattattagattttctgca

SEQ ID NO: 107531 - DNA, 20 bp, Artificial Sequence
  Description of Artificial Sequence: Synthetic oligonucleotide
  Target: ATXN1; (+) strand; PAM type: NRG; PAM sequence: AAG
gattttctgcatggttacat

SEQ ID NO: 107532 - DNA, 20 bp, Artificial Sequence
  Description of Artificial Sequence: Synthetic oligonucleotide
  Target: ATXN1; (+) strand; PAM type: NRG; PAM sequence: AAG
atggttacataagcctacaa

SEQ ID NO: 107533 - DNA, 20 bp, Artificial Sequence
  Description of Artificial Sequence: Synthetic oligonucleotide
  Target: ATXN1; (+) strand; PAM type: NRG; PAM sequence: AGG
tggttacataagcctacaaa

SEQ ID NO: 107534 - DNA, 20 bp, Artificial Sequence
  Description of Artificial Sequence: Synthetic oligonucleotide
  Target: ATXN1; (+) strand; PAM type: NRG; PAM sequence: GGG
ggttacataagcctacaaaa

SEQ ID NO: 107535 - DNA, 20 bp, Artificial Sequence
  Description of Artificial Sequence: Synthetic oligonucleotide
  Target: ATXN1; (+) strand; PAM type: NRG; PAM sequence: AAG
gggaaaaatgtaaatgattc

SEQ ID NO: 107536 - DNA, 20 bp, Artificial Sequence
  Description of Artificial Sequence: Synthetic oligonucleotide
  Target: ATXN1; (+) strand; PAM type: NRG; PAM sequence: AAG
aaaaatgtaaatgattcaag

SEQ ID NO: 107537 - DNA, 20 bp, Artificial Sequence
  Description of Artificial Sequence: Synthetic oligonucleotide
  Target: ATXN1; (+) strand; PAM type: NRG; PAM sequence: CGG
tcaagaagatattcttcatg

SEQ ID NO: 107538 - DNA, 20 bp, Artificial Sequence
  Description of Artificial Sequence: Synthetic oligonucleotide
  Target: ATXN1; (+) strand; PAM type: NRG; PAM sequence: AAG
catgaaatctttaatatctt

SEQ ID NO: 107539 - DNA, 20 bp, Artificial Sequence
  Description of Artificial Sequence: Synthetic oligonucleotide
  Target: ATXN1; (+) strand; PAM type: NRG; PAM sequence: TAG
atctttaatatcttaagact

SEQ ID NO: 107540 - DNA, 20 bp, Artificial Sequence
  Description of Artificial Sequence: Synthetic oligonucleotide
  Target: ATXN1; (+) strand; PAM type: NRG; PAM sequence: AGG
tctttaatatcttaagactt

SEQ ID NO: 107541 - DNA, 20 bp, Artificial Sequence
  Description of Artificial Sequence: Synthetic oligonucleotide
  Target: ATXN1; (+) strand; PAM type: NRG; PAM sequence: AAG
ttaatatcttaagacttagg

SEQ ID NO: 107542 - DNA, 20 bp, Artificial Sequence
  Description of Artificial Sequence: Synthetic oligonucleotide
  Target: ATXN1; (+) strand; PAM type: NRG; PAM sequence: TGG
agacttaggaagaactctcc

SEQ ID NO: 107543 - DNA, 20 bp, Artificial Sequence
  Description of Artificial Sequence: Synthetic oligonucleotide
  Target: ATXN1; (+) strand; PAM type: NRG; PAM sequence: AAG
ttaggaagaactctcctggc

SEQ ID NO: 107544 - DNA, 20 bp, Artificial Sequence
  Description of Artificial Sequence: Synthetic oligonucleotide
  Target: ATXN1; (+) strand; PAM type: NRG; PAM sequence: TAG
gatcaattttcatgcttcat

SEQ ID NO: 107545 - DNA, 20 bp, Artificial Sequence
  Description of Artificial Sequence: Synthetic oligonucleotide
  Target: ATXN1; (+) strand; PAM type: NRG; PAM sequence: AGG
atcaattttcatgcttcatt

SEQ ID NO: 107546 - DNA, 20 bp, Artificial Sequence
  Description of Artificial Sequence: Synthetic oligonucleotide
  Target: ATXN1; (+) strand; PAM type: NRG; PAM sequence: AAG
ttcatgcttcattaggaaaa

SEQ ID NO: 107547 - DNA, 20 bp, Artificial Sequence
  Description of Artificial Sequence: Synthetic oligonucleotide
  Target: ATXN1; (+) strand; PAM type: NRG; PAM sequence: CAG
cattaggaaaaaagcccttt

SEQ ID NO: 107548 - DNA, 20 bp, Artificial Sequence
  Description of Artificial Sequence: Synthetic oligonucleotide
  Target: ATXN1; (+) strand; PAM type: NRG; PAM sequence: CAG
aagccctttcagtaatgtta

SEQ ID NO: 107549 - DNA, 20 bp, Artificial Sequence
  Description of Artificial Sequence: Synthetic oligonucleotide
  Target: ATXN1; (+) strand; PAM type: NRG; PAM sequence: TGG
tttcagtaatgttacagaaa

SEQ ID NO: 107550 - DNA, 20 bp, Artificial Sequence
  Description of Artificial Sequence: Synthetic oligonucleotide
  Target: ATXN1; (+) strand; PAM type: NRG; PAM sequence: TAG
taatgttacagaaatggcta

SEQ ID NO: 107551 - DNA, 20 bp, Artificial Sequence
  Description of Artificial Sequence: Synthetic oligonucleotide
  Target: ATXN1; (+) strand; PAM type: NRG; PAM sequence: AGG
aatgttacagaaatggctat

SEQ ID NO: 107552 - DNA, 20 bp, Artificial Sequence
  Description of Artificial Sequence: Synthetic oligonucleotide
  Target: ATXN1; (+) strand; PAM type: NRG; PAM sequence: AAG
acagaaatggctataggcaa

SEQ ID NO: 107553 - DNA, 20 bp, Artificial Sequence
  Description of Artificial Sequence: Synthetic oligonucleotide
  Target: ATXN1; (+) strand; PAM type: NRG; PAM sequence: GAG
agaaatggctataggcaaaa

SEQ ID NO: 107554 - DNA, 20 bp, Artificial Sequence
  Description of Artificial Sequence: Synthetic oligonucleotide
  Target: ATXN1; (+) strand; PAM type: NRG; PAM sequence: GAG
aaatggctataggcaaaaga

SEQ ID NO: 107555 - DNA, 20 bp, Artificial Sequence
  Description of Artificial Sequence: Synthetic oligonucleotide
  Target: ATXN1; (+) strand; PAM type: NRG; PAM sequence: TGG
gagagaaaaaaattacactc

SEQ ID NO: 107556 - DNA, 20 bp, Artificial Sequence
  Description of Artificial Sequence: Synthetic oligonucleotide
  Target: ATXN1; (+) strand; PAM type: NRG; PAM sequence: AAG
tctggactgaacaaaacccc

SEQ ID NO: 107557 - DNA, 20 bp, Artificial Sequence
  Description of Artificial Sequence: Synthetic oligonucleotide
  Target: ATXN1; (+) strand; PAM type: NRG; PAM sequence: AGG
ctggactgaacaaaacccca

SEQ ID NO: 107558 - DNA, 20 bp, Artificial Sequence
  Description of Artificial Sequence: Synthetic oligonucleotide
  Target: ATXN1; (+) strand; PAM type: NRG; PAM sequence: TGG
aacaaaaccccaaggcactt

SEQ ID NO: 107559 - DNA, 20 bp, Artificial Sequence
  Description of Artificial Sequence: Synthetic oligonucleotide
  Target: ATXN1; (+) strand; PAM type: NRG; PAM sequence: CAG
aaatcctttctttgtaccca

SEQ ID NO: 107560 - DNA, 20 bp, Artificial Sequence
  Description of Artificial Sequence: Synthetic oligonucleotide
  Target: ATXN1; (+) strand; PAM type: NRG; PAM sequence: AAG
tgtacccacagcatatctga

SEQ ID NO: 107561 - DNA, 20 bp, Artificial Sequence
  Description of Artificial Sequence: Synthetic oligonucleotide
  Target: ATXN1; (+) strand; PAM type: NRG; PAM sequence: AGG
gtacccacagcatatctgaa

SEQ ID NO: 107562 - DNA, 20 bp, Artificial Sequence
  Description of Artificial Sequence: Synthetic oligonucleotide
  Target: ATXN1; (+) strand; PAM type: NRG; PAM sequence: GAG
acccacagcatatctgaaag

SEQ ID NO: 107563 - DNA, 20 bp, Artificial Sequence
  Description of Artificial Sequence: Synthetic oligonucleotide
  Target: ATXN1; (+) strand; PAM type: NRG; PAM sequence: AAG
cacagcatatctgaaaggag

SEQ ID NO: 107564 - DNA, 20 bp, Artificial Sequence
  Description of Artificial Sequence: Synthetic oligonucleotide
  Target: ATXN1; (+) strand; PAM type: NRG; PAM sequence: TGG
aaggagaagcaatgctcact

SEQ ID NO: 107565 - DNA, 20 bp, Artificial Sequence
  Description of Artificial Sequence: Synthetic oligonucleotide
  Target: ATXN1; (+) strand; PAM type: NRG; PAM sequence: GGG
aggagaagcaatgctcactt

SEQ ID NO: 107566 - DNA, 20 bp, Artificial Sequence
  Description of Artificial Sequence: Synthetic oligonucleotide
  Target: ATXN1; (+) strand; PAM type: NRG; PAM sequence: GGG
ggagaagcaatgctcacttg

SEQ ID NO: 107567 - DNA, 20 bp, Artificial Sequence
  Description of Artificial Sequence: Synthetic oligonucleotide
  Target: ATXN1; (+) strand; PAM type: NRG; PAM sequence: TGG
caatgctcacttggggtgtg

SEQ ID NO: 107568 - DNA, 20 bp, Artificial Sequence
  Description of Artificial Sequence: Synthetic oligonucleotide
  Target: ATXN1; (+) strand; PAM type: NRG; PAM sequence: GGG
aatgctcacttggggtgtgt

SEQ ID NO: 107569 - DNA, 20 bp, Artificial Sequence
  Description of Artificial Sequence: Synthetic oligonucleotide
  Target: ATXN1; (+) strand; PAM type: NRG; PAM sequence: GGG
atgctcacttggggtgtgtg

SEQ ID NO: 107570 - DNA, 20 bp, Artificial Sequence
  Description of Artificial Sequence: Synthetic oligonucleotide
  Target: ATXN1; (+) strand; PAM type: NRG; PAM sequence: TAG
tgtggggattgtattttgac

SEQ ID NO: 107571 - DNA, 20 bp, Artificial Sequence
  Description of Artificial Sequence: Synthetic oligonucleotide
  Target: ATXN1; (+) strand; PAM type: NRG; PAM sequence: CAG
ttgactagcctgtctaccca

SEQ ID NO: 107572 - DNA, 20 bp, Artificial Sequence
  Description of Artificial Sequence: Synthetic oligonucleotide
  Target: ATXN1; (+) strand; PAM type: NRG; PAM sequence: TAG
ccacagaatttcatttaatc

SEQ ID NO: 107573 - DNA, 20 bp, Artificial Sequence
  Description of Artificial Sequence: Synthetic oligonucleotide
  Target: ATXN1; (+) strand; PAM type: NRG; PAM sequence: AGG
cacagaatttcatttaatct

SEQ ID NO: 107574 - DNA, 20 bp, Artificial Sequence
  Description of Artificial Sequence: Synthetic oligonucleotide
  Target: ATXN1; (+) strand; PAM type: NRG; PAM sequence: TGG
agaatttcatttaatctagg

SEQ ID NO: 107575 - DNA, 20 bp, Artificial Sequence
  Description of Artificial Sequence: Synthetic oligonucleotide
  Target: ATXN1; (+) strand; PAM type: NRG; PAM sequence: GAG
aatttcatttaatctaggtg

SEQ ID NO: 107576 - DNA, 20 bp, Artificial Sequence
  Description of Artificial Sequence: Synthetic oligonucleotide
  Target: ATXN1; (+) strand; PAM type: NRG; PAM sequence: TAG
ggagttgttatcaatctgtt

SEQ ID NO: 107577 - DNA, 20 bp, Artificial Sequence
  Description of Artificial Sequence: Synthetic oligonucleotide
  Target: ATXN1; (+) strand; PAM type: NRG; PAM sequence: AAG
tttagtctttcacaaatttg

SEQ ID NO: 107578 - DNA, 20 bp, Artificial Sequence
  Description of Artificial Sequence: Synthetic oligonucleotide
  Target: ATXN1; (+) strand; PAM type: NRG; PAM sequence: AGG
ttagtctttcacaaatttga

SEQ ID NO: 107579 - DNA, 20 bp, Artificial Sequence
  Description of Artificial Sequence: Synthetic oligonucleotide
  Target: ATXN1; (+) strand; PAM type: NRG; PAM sequence: GGG
tagtctttcacaaatttgaa

SEQ ID NO: 107580 - DNA, 20 bp, Artificial Sequence
  Description of Artificial Sequence: Synthetic oligonucleotide
  Target: ATXN1; (+) strand; PAM type: NRG; PAM sequence: TAG
tcacaaatttgaagggactg

SEQ ID NO: 107581 - DNA, 20 bp, Artificial Sequence
  Description of Artificial Sequence: Synthetic oligonucleotide
  Target: ATXN1; (+) strand; PAM type: NRG; PAM sequence: AAG
taaaccaacaatcaccctca

SEQ ID NO: 107582 - DNA, 20 bp, Artificial Sequence
  Description of Artificial Sequence: Synthetic oligonucleotide
  Target: ATXN1; (+) strand; PAM type: NRG; PAM sequence: AAG
caaagcattgcaatgatatg

SEQ ID NO: 107583 - DNA, 20 bp, Artificial Sequence
  Description of Artificial Sequence: Synthetic oligonucleotide
  Target: ATXN1; (+) strand; PAM type: NRG; PAM sequence: AGG
aaagcattgcaatgatatga

SEQ ID NO: 107584 - DNA, 20 bp, Artificial Sequence
  Description of Artificial Sequence: Synthetic oligonucleotide
  Target: ATXN1; (+) strand; PAM type: NRG; PAM sequence: CAG
ttgcaatgatatgaaggaaa

SEQ ID NO: 107585 - DNA, 20 bp, Artificial Sequence
  Description of Artificial Sequence: Synthetic oligonucleotide
  Target: ATXN1; (+) strand; PAM type: NRG; PAM sequence: TGG
tatgaaggaaacagctgaca

SEQ ID NO: 107586 - DNA, 20 bp, Artificial Sequence
  Description of Artificial Sequence: Synthetic oligonucleotide
  Target: ATXN1; (+) strand; PAM type: NRG; PAM sequence: GGG
atgaaggaaacagctgacat

SEQ ID NO: 107587 - DNA, 20 bp, Artificial Sequence
  Description of Artificial Sequence: Synthetic oligonucleotide
  Target: ATXN1; (+) strand; PAM type: NRG; PAM sequence: GGG
tgaaggaaacagctgacatg

SEQ ID NO: 107588 - DNA, 20 bp, Artificial Sequence
  Description of Artificial Sequence: Synthetic oligonucleotide
  Target: ATXN1; (+) strand; PAM type: NRG; PAM sequence: TGG
aacagctgacatggggcctg

SEQ ID NO: 107589 - DNA, 20 bp, Artificial Sequence
  Description of Artificial Sequence: Synthetic oligonucleotide
  Target: ATXN1; (+) strand; PAM type: NRG; PAM sequence: GAG
cagctgacatggggcctgtg

SEQ ID NO: 107590 - DNA, 20 bp, Artificial Sequence
  Description of Artificial Sequence: Synthetic oligonucleotide
  Target: ATXN1; (+) strand; PAM type: NRG; PAM sequence: AGG
agctgacatggggcctgtgg

SEQ ID NO: 107591 - DNA, 20 bp, Artificial Sequence
  Description of Artificial Sequence: Synthetic oligonucleotide
  Target: ATXN1; (+) strand; PAM type: NRG; PAM sequence: TGG
tgacatggggcctgtggagg

SEQ ID NO: 107592 - DNA, 20 bp, Artificial Sequence
  Description of Artificial Sequence: Synthetic oligonucleotide
  Target: ATXN1; (+) strand; PAM type: NRG; PAM sequence: GGG
gacatggggcctgtggaggt

SEQ ID NO: 107593 - DNA, 20 bp, Artificial Sequence
  Description of Artificial Sequence: Synthetic oligonucleotide
  Target: ATXN1; (+) strand; PAM type: NRG; PAM sequence: TGG
ggcctgtggaggtgggaaaa

SEQ ID NO: 107594 - DNA, 20 bp, Artificial Sequence
  Description of Artificial Sequence: Synthetic oligonucleotide
  Target: ATXN1; (+) strand; PAM type: NRG; PAM sequence: TGG
ctgtggaggtgggaaaatgg

SEQ ID NO: 107595 - DNA, 20 bp, Artificial Sequence
  Description of Artificial Sequence: Synthetic oligonucleotide
  Target: ATXN1; (+) strand; PAM type: NRG; PAM sequence: TGG
gaggtgggaaaatggtggat

SEQ ID NO: 107596 - DNA, 20 bp, Artificial Sequence
  Description of Artificial Sequence: Synthetic oligonucleotide
  Target: ATXN1; (+) strand; PAM type: NRG; PAM sequence: GAG
ggtgggaaaatggtggattg

SEQ ID NO: 107597 - DNA, 20 bp, Artificial Sequence
  Description of Artificial Sequence: Synthetic oligonucleotide
  Target: ATXN1; (+) strand; PAM type: NRG; PAM sequence: GAG
tgggaaaatggtggattgga

SEQ ID NO: 107598 - DNA, 20 bp, Artificial Sequence
  Description of Artificial Sequence: Synthetic oligonucleotide
  Target: ATXN1; (+) strand; PAM type: NRG; PAM sequence: GAG
ggaaaatggtggattggaga

SEQ ID NO: 107599 - DNA, 20 bp, Artificial Sequence
  Description of Artificial Sequence: Synthetic oligonucleotide
  Target: ATXN1; (+) strand; PAM type: NRG; PAM sequence: AGG
gaaaatggtggattggagag

SEQ ID NO: 107600 - DNA, 20 bp, Artificial Sequence
  Description of Artificial Sequence: Synthetic oligonucleotide
  Target: ATXN1; (+) strand; PAM type: NRG; PAM sequence: AAG
tatacacttgaatttctgca

SEQ ID NO: 107601 - DNA, 20 bp, Artificial Sequence
  Description of Artificial Sequence: Synthetic oligonucleotide
  Target: ATXN1; (+) strand; PAM type: NRG; PAM sequence: AGG
atacacttgaatttctgcaa

SEQ ID NO: 107602 - DNA, 20 bp, Artificial Sequence
  Description of Artificial Sequence: Synthetic oligonucleotide
  Target: ATXN1; (+) strand; PAM type: NRG; PAM sequence: CAG
cacttgaatttctgcaaagg

SEQ ID NO: 107603 - DNA, 20 bp, Artificial Sequence
  Description of Artificial Sequence: Synthetic oligonucleotide
  Target: ATXN1; (+) strand; PAM type: NRG; PAM sequence: GAG
cttgaatttctgcaaaggca

SEQ ID NO: 107604 - DNA, 20 bp, Artificial Sequence
  Description of Artificial Sequence: Synthetic oligonucleotide
  Target: ATXN1; (+) strand; PAM type: NRG; PAM sequence: AGG
ttgaatttctgcaaaggcag

SEQ ID NO: 107605 - DNA, 20 bp, Artificial Sequence
  Description of Artificial Sequence: Synthetic oligonucleotide
  Target: ATXN1; (+) strand; PAM type: NRG; PAM sequence: CAG
tccttttcatttaaaatcta

SEQ ID NO: 107606 - DNA, 20 bp, Artificial Sequence
  Description of Artificial Sequence: Synthetic oligonucleotide
  Target: ATXN1; (+) strand; PAM type: NRG; PAM sequence: AAG
tttaaaatctacagcttttc

SEQ ID NO: 107607 - DNA, 20 bp, Artificial Sequence
  Description of Artificial Sequence: Synthetic oligonucleotide
  Target: ATXN1; (+) strand; PAM type: NRG; PAM sequence: CAG
aagacaatttccctttattt

SEQ ID NO: 107608 - DNA, 20 bp, Artificial Sequence
  Description of Artificial Sequence: Synthetic oligonucleotide
  Target: ATXN1; (+) strand; PAM type: NRG; PAM sequence: AGG
agacaatttccctttatttc

SEQ ID NO: 107609 - DNA, 20 bp, Artificial Sequence
  Description of Artificial Sequence: Synthetic oligonucleotide
  Target: ATXN1; (+) strand; PAM type: NRG; PAM sequence: GAG
acaatttccctttatttcag

SEQ ID NO: 107610 - DNA, 20 bp, Artificial Sequence
  Description of Artificial Sequence: Synthetic oligonucleotide
  Target: ATXN1; (+) strand; PAM type: NRG; PAM sequence: GAG
ccctttatttcaggagaatc

SEQ ID NO: 107611 - DNA, 20 bp, Artificial Sequence
  Description of Artificial Sequence: Synthetic oligonucleotide
  Target: ATXN1; (+) strand; PAM type: NRG; PAM sequence: AAG
aatacaaaaataaatgtctt

SEQ ID NO: 107612 - DNA, 20 bp, Artificial Sequence
  Description of Artificial Sequence: Synthetic oligonucleotide
  Target: ATXN1; (+) strand; PAM type: NRG; PAM sequence: TAG
atttttttctgacacttgaa

SEQ ID NO: 107613 - DNA, 20 bp, Artificial Sequence
  Description of Artificial Sequence: Synthetic oligonucleotide
  Target: ATXN1; (+) strand; PAM type: NRG; PAM sequence: TGG
tgataccaaattctactttt

SEQ ID NO: 107614 - DNA, 20 bp, Artificial Sequence
  Description of Artificial Sequence: Synthetic oligonucleotide
  Target: ATXN1; (+) strand; PAM type: NRG; PAM sequence: CAG
actttttggactcaaaaaaa

SEQ ID NO: 107615 - DNA, 20 bp, Artificial Sequence
  Description of Artificial Sequence: Synthetic oligonucleotide
  Target: ATXN1; (+) strand; PAM type: NRG; PAM sequence: TAG
ggactcaaaaaaacagtctt

SEQ ID NO: 107616 - DNA, 20 bp, Artificial Sequence
  Description of Artificial Sequence: Synthetic oligonucleotide
  Target: ATXN1; (+) strand; PAM type: NRG; PAM sequence: AAG
tttagaattgttcaatttaa

SEQ ID NO: 107617 - DNA, 20 bp, Artificial Sequence
  Description of Artificial Sequence: Synthetic oligonucleotide
  Target: ATXN1; (+) strand; PAM type: NRG; PAM sequence: TAG
ttaaaagccttgtcatactg

SEQ ID NO: 107618 - DNA, 20 bp, Artificial Sequence
  Description of Artificial Sequence: Synthetic oligonucleotide
  Target: ATXN1; (+) strand; PAM type: NRG; PAM sequence: AAG
tactgtagttatatatactc

SEQ ID NO: 107619 - DNA, 20 bp, Artificial Sequence
  Description of Artificial Sequence: Synthetic oligonucleotide
  Target: ATXN1; (+) strand; PAM type: NRG; PAM sequence: AGG
actgtagttatatatactca

SEQ ID NO: 107620 - DNA, 20 bp, Artificial Sequence
  Description of Artificial Sequence: Synthetic oligonucleotide
  Target: ATXN1; (+) strand; PAM type: NRG; PAM sequence: AAG
gtagttatatatactcaagg

SEQ ID NO: 107621 - DNA, 20 bp, Artificial Sequence
  Description of Artificial Sequence: Synthetic oligonucleotide
  Target: ATXN1; (+) strand; PAM type: NRG; PAM sequence: CAG
ctcaaggaagttattgtatg

SEQ ID NO: 107622 - DNA, 20 bp, Artificial Sequence
  Description of Artificial Sequence: Synthetic oligonucleotide
  Target: ATXN1; (+) strand; PAM type: NRG; PAM sequence: GAG
caaggaagttattgtatgca

SEQ ID NO: 107623 - DNA, 20 bp, Artificial Sequence
  Description of Artificial Sequence: Synthetic oligonucleotide
  Target: ATXN1; (+) strand; PAM type: NRG; PAM sequence: GAG
aggaagttattgtatgcaga

SEQ ID NO: 107624 - DNA, 20 bp, Artificial Sequence
  Description of Artificial Sequence: Synthetic oligonucleotide
  Target: ATXN1; (+) strand; PAM type: NRG; PAM sequence: CAG
ttattgtatgcagagagctg

SEQ ID NO: 107625 - DNA, 20 bp, Artificial Sequence
  Description of Artificial Sequence: Synthetic oligonucleotide
  Target: ATXN1; (+) strand; PAM type: NRG; PAM sequence: AAG
agagctgcagacattcttga

SEQ ID NO: 107626 - DNA, 20 bp, Artificial Sequence
  Description of Artificial Sequence: Synthetic oligonucleotide
  Target: ATXN1; (+) strand; PAM type: NRG; PAM sequence: AGG
gagctgcagacattcttgaa

SEQ ID NO: 107627 - DNA, 20 bp, Artificial Sequence
  Description of Artificial Sequence: Synthetic oligonucleotide
  Target: ATXN1; (+) strand; PAM type: NRG; PAM sequence: AAG
tgcagacattcttgaaaggt

SEQ ID NO: 107628 - DNA, 20 bp, Artificial Sequence
  Description of Artificial Sequence: Synthetic oligonucleotide
  Target: ATXN1; (+) strand; PAM type: NRG; PAM sequence: AGG
gcagacattcttgaaaggta

SEQ ID NO: 107629 - DNA, 20 bp, Artificial Sequence
  Description of Artificial Sequence: Synthetic oligonucleotide
  Target: ATXN1; (+) strand; PAM type: NRG; PAM sequence: GAG
agacattcttgaaaggtaag

SEQ ID NO: 107630 - DNA, 20 bp, Artificial Sequence
  Description of Artificial Sequence: Synthetic oligonucleotide
  Target: ATXN1; (+) strand; PAM type: NRG; PAM sequence: AAG
tgaaaggtaaggagtataca

SEQ ID NO: 107631 - DNA, 20 bp, Artificial Sequence
  Description of Artificial Sequence: Synthetic oligonucleotide
  Target: ATXN1; (+) strand; PAM type: NRG; PAM sequence: CAG
gtatacaaagatataacctg

SEQ ID NO: 107632 - DNA, 20 bp, Artificial Sequence
  Description of Artificial Sequence: Synthetic oligonucleotide
  Target: ATXN1; (+) strand; PAM type: NRG; PAM sequence: AGG
tatacaaagatataacctgc

SEQ ID NO: 107633 - DNA, 20 bp, Artificial Sequence
  Description of Artificial Sequence: Synthetic oligonucleotide
  Target: ATXN1; (+) strand; PAM type: NRG; PAM sequence: TAG
agatataacctgcaggaacc

SEQ ID NO: 107634 - DNA, 20 bp, Artificial Sequence
  Description of Artificial Sequence: Synthetic oligonucleotide
  Target: ATXN1; (+) strand; PAM type: NRG; PAM sequence: TAG
cctgcaggaacctagcaatc

SEQ ID NO: 107635 - DNA, 20 bp, Artificial Sequence
  Description of Artificial Sequence: Synthetic oligonucleotide
  Target: ATXN1; (+) strand; PAM type: NRG; PAM sequence: TGG
ctagcaatctagcttcaaaa

SEQ ID NO: 107636 - DNA, 20 bp, Artificial Sequence
  Description of Artificial Sequence: Synthetic oligonucleotide
  Target: ATXN1; (+) strand; PAM type: NRG; PAM sequence: GAG
attcattcattcattcacac

SEQ ID NO: 107637 - DNA, 20 bp, Artificial Sequence
  Description of Artificial Sequence: Synthetic oligonucleotide
  Target: ATXN1; (+) strand; PAM type: NRG; PAM sequence: CAG
cacttccatcaatttacttt

SEQ ID NO: 107638 - DNA, 20 bp, Artificial Sequence
  Description of Artificial Sequence: Synthetic oligonucleotide
  Target: ATXN1; (+) strand; PAM type: NRG; PAM sequence: TGG
ctttcagtatccctcatata

SEQ ID NO: 107639 - DNA, 20 bp, Artificial Sequence
  Description of Artificial Sequence: Synthetic oligonucleotide
  Target: ATXN1; (+) strand; PAM type: NRG; PAM sequence: GGG
tttcagtatccctcatatat

SEQ ID NO: 107640 - DNA, 20 bp, Artificial Sequence
  Description of Artificial Sequence: Synthetic oligonucleotide
  Target: ATXN1; (+) strand; PAM type: NRG; PAM sequence: TAG
gtatccctcatatatgggat

SEQ ID NO: 107641 - DNA, 20 bp, Artificial Sequence
  Description of Artificial Sequence: Synthetic oligonucleotide
  Target: ATXN1; (+) strand; PAM type: NRG; PAM sequence: AAG
tgggattagtgcccatctat

SEQ ID NO: 107642 - DNA, 20 bp, Artificial Sequence
  Description of Artificial Sequence: Synthetic oligonucleotide
  Target: ATXN1; (+) strand; PAM type: NRG; PAM sequence: AGG
gggattagtgcccatctata

SEQ ID NO: 107643 - DNA, 20 bp, Artificial Sequence
  Description of Artificial Sequence: Synthetic oligonucleotide
  Target: ATXN1; (+) strand; PAM type: NRG; PAM sequence: GGG
ggattagtgcccatctataa

SEQ ID NO: 107644 - DNA, 20 bp, Artificial Sequence
  Description of Artificial Sequence: Synthetic oligonucleotide
  Target: ATXN1; (+) strand; PAM type: NRG; PAM sequence: CAG
tgcccatctataagggaccc

SEQ ID NO: 107645 - DNA, 20 bp, Artificial Sequence
  Description of Artificial Sequence: Synthetic oligonucleotide
  Target: ATXN1; (+) strand; PAM type: NRG; PAM sequence: GAG
cccatctataagggacccca

SEQ ID NO: 107646 - DNA, 20 bp, Artificial Sequence
  Description of Artificial Sequence: Synthetic oligonucleotide
  Target: ATXN1; (+) strand; PAM type: NRG; PAM sequence: GAG
catctataagggaccccaga

SEQ ID NO: 107647 - DNA, 20 bp, Artificial Sequence
  Description of Artificial Sequence: Synthetic oligonucleotide
  Target: ATXN1; (+) strand; PAM type: NRG; PAM sequence: GAG
ccttgctccttccaccatgt

SEQ ID NO: 107648 - DNA, 20 bp, Artificial Sequence
  Description of Artificial Sequence: Synthetic oligonucleotide
  Target: ATXN1; (+) strand; PAM type: NRG; PAM sequence: AGG
cttgctccttccaccatgtg

SEQ ID NO: 107649 - DNA, 20 bp, Artificial Sequence
  Description of Artificial Sequence: Synthetic oligonucleotide
  Target: ATXN1; (+) strand; PAM type: NRG; PAM sequence: AAG
ccaccatgtgaggacacacc

SEQ ID NO: 107650 - DNA, 20 bp, Artificial Sequence
  Description of Artificial Sequence: Synthetic oligonucleotide
  Target: ATXN1; (+) strand; PAM type: NRG; PAM sequence: AAG
ccatgtgaggacacaccaag

SEQ ID NO: 107651 - DNA, 20 bp, Artificial Sequence
  Description of Artificial Sequence: Synthetic oligonucleotide
  Target: ATXN1; (+) strand; PAM type: NRG; PAM sequence: AGG
catgtgaggacacaccaaga

SEQ ID NO: 107652 - DNA, 20 bp, Artificial Sequence
  Description of Artificial Sequence: Synthetic oligonucleotide
  Target: ATXN1; (+) strand; PAM type: NRG; PAM sequence: AAG
tcaaacctcaccaaatcctg

SEQ ID NO: 107653 - DNA, 20 bp, Artificial Sequence
  Description of Artificial Sequence: Synthetic oligonucleotide
  Target: ATXN1; (+) strand; PAM type: NRG; PAM sequence: TGG
tcaccaaatcctgaagctgc

SEQ ID NO: 107654 - DNA, 20 bp, Artificial Sequence
  Description of Artificial Sequence: Synthetic oligonucleotide
  Target: ATXN1; (+) strand; PAM type: NRG; PAM sequence: TGG
agctgctggcaccttgatct

SEQ ID NO: 107655 - DNA, 20 bp, Artificial Sequence
  Description of Artificial Sequence: Synthetic oligonucleotide
  Target: ATXN1; (+) strand; PAM type: NRG; PAM sequence: CAG
caccttgatcttggacttcc

SEQ ID NO: 107656 - DNA, 20 bp, Artificial Sequence
  Description of Artificial Sequence: Synthetic oligonucleotide
  Target: ATXN1; (+) strand; PAM type: NRG; PAM sequence: CAG
atcttggacttcccagccac

SEQ ID NO: 107657 - DNA, 20 bp, Artificial Sequence
  Description of Artificial Sequence: Synthetic oligonucleotide
  Target: ATXN1; (+) strand; PAM type: NRG; PAM sequence: GAG
ttcccagccaccagcactgt

SEQ ID NO: 107658 - DNA, 20 bp, Artificial Sequence
  Description of Artificial Sequence: Synthetic oligonucleotide
  Target: ATXN1; (+) strand; PAM type: NRG; PAM sequence: AAG
aatgtatttctgttgtttat

SEQ ID NO: 107659 - DNA, 20 bp, Artificial Sequence
  Description of Artificial Sequence: Synthetic oligonucleotide
  Target: ATXN1; (+) strand; PAM type: NRG; PAM sequence: CGG
ttctgttgtttataagttta

SEQ ID NO: 107660 - DNA, 20 bp, Artificial Sequence
  Description of Artificial Sequence: Synthetic oligonucleotide
  Target: ATXN1; (+) strand; PAM type: NRG; PAM sequence: TAG
taagtttacggtattttgct

SEQ ID NO: 107661 - DNA, 20 bp, Artificial Sequence
  Description of Artificial Sequence: Synthetic oligonucleotide
  Target: ATXN1; (+) strand; PAM type: NRG; PAM sequence: CAG
gtttacggtattttgcttag

SEQ ID NO: 107662 - DNA, 20 bp, Artificial Sequence
  Description of Artificial Sequence: Synthetic oligonucleotide
  Target: ATXN1; (+) strand; PAM type: NRG; PAM sequence: TGG
attttgcttagcagtccaaa

SEQ ID NO: 107663 - DNA, 20 bp, Artificial Sequence
  Description of Artificial Sequence: Synthetic oligonucleotide
  Target: ATXN1; (+) strand; PAM type: NRG; PAM sequence: AAG
cttagcagtccaaatggact

SEQ ID NO: 107664 - DNA, 20 bp, Artificial Sequence
  Description of Artificial Sequence: Synthetic oligonucleotide
  Target: ATXN1; (+) strand; PAM type: NRG; PAM sequence: AAG
atggactaagacactgccaa

SEQ ID NO: 107665 - DNA, 20 bp, Artificial Sequence
  Description of Artificial Sequence: Synthetic oligonucleotide
  Target: ATXN1; (+) strand; PAM type: NRG; PAM sequence: AAG
ccaaaaatacatccacctca

SEQ ID NO: 107666 - DNA, 20 bp, Artificial Sequence
  Description of Artificial Sequence: Synthetic oligonucleotide
  Target: ATXN1; (+) strand; PAM type: NRG; PAM sequence: AGG
caaaaatacatccacctcaa

SEQ ID NO: 107667 - DNA, 20 bp, Artificial Sequence
  Description of Artificial Sequence: Synthetic oligonucleotide
  Target: ATXN1; (+) strand; PAM type: NRG; PAM sequence: AAG
aaatacatccacctcaaagg

SEQ ID NO: 107668 - DNA, 20 bp, Artificial Sequence
  Description of Artificial Sequence: Synthetic oligonucleotide
  Target: ATXN1; (+) strand; PAM type: NRG; PAM sequence: AAG
catccacctcaaaggaagaa

SEQ ID NO: 107669 - DNA, 20 bp, Artificial Sequence
  Description of Artificial Sequence: Synthetic oligonucleotide
  Target: ATXN1; (+) strand; PAM type: NRG; PAM sequence: TGG
aaagtttgaaaccattcaac

SEQ ID NO: 107670 - DNA, 20 bp, Artificial Sequence
  Description of Artificial Sequence: Synthetic oligonucleotide
  Target: ATXN1; (+) strand; PAM type: NRG; PAM sequence: GAG
agtttgaaaccattcaactg

SEQ ID NO: 107671 - DNA, 20 bp, Artificial Sequence
  Description of Artificial Sequence: Synthetic oligonucleotide
  Target: ATXN1; (+) strand; PAM type: NRG; PAM sequence: TGG
ccattcaactggagtgaatg

SEQ ID NO: 107672 - DNA, 20 bp, Artificial Sequence
  Description of Artificial Sequence: Synthetic oligonucleotide
  Target: ATXN1; (+) strand; PAM type: NRG; PAM sequence: TGG
gcacactcttgttctctgcc

SEQ ID NO: 107673 - DNA, 20 bp, Artificial Sequence
  Description of Artificial Sequence: Synthetic oligonucleotide
  Target: ATXN1; (+) strand; PAM type: NRG; PAM sequence: GGG
cacactcttgttctctgcct

SEQ ID NO: 107674 - DNA, 20 bp, Artificial Sequence
  Description of Artificial Sequence: Synthetic oligonucleotide
  Target: ATXN1; (+) strand; PAM type: NRG; PAM sequence: GAG
cactcttgttctctgcctgg

SEQ ID NO: 107675 - DNA, 20 bp, Artificial Sequence
  Description of Artificial Sequence: Synthetic oligonucleotide
  Target: ATXN1; (+) strand; PAM type: NRG; PAM sequence: AAG
tgttctctgcctgggagaac

SEQ ID NO: 107676 - DNA, 20 bp, Artificial Sequence
  Description of Artificial Sequence: Synthetic oligonucleotide
  Target: ATXN1; (+) strand; PAM type: NRG; PAM sequence: CAG
ctctgcctgggagaacaagt

SEQ ID NO: 107677 - DNA, 20 bp, Artificial Sequence
  Description of Artificial Sequence: Synthetic oligonucleotide
  Target: ATXN1; (+) strand; PAM type: NRG; PAM sequence: GAG
gagaacaagtcagctgatat

SEQ ID NO: 107678 - DNA, 20 bp, Artificial Sequence
  Description of Artificial Sequence: Synthetic oligonucleotide
  Target: ATXN1; (+) strand; PAM type: NRG; PAM sequence: AAG
tgagcctgcttttctgtgtg

SEQ ID NO: 107679 - DNA, 20 bp, Artificial Sequence
  Description of Artificial Sequence: Synthetic oligonucleotide
  Target: ATXN1; (+) strand; PAM type: NRG; PAM sequence: CAG
ttttctgtgtgaagaatgta

SEQ ID NO: 107680 - DNA, 20 bp, Artificial Sequence
  Description of Artificial Sequence: Synthetic oligonucleotide
  Target: ATXN1; (+) strand; PAM type: NRG; PAM sequence: GAG
ttctgtgtgaagaatgtaca

SEQ ID NO: 107681 - DNA, 20 bp, Artificial Sequence
  Description of Artificial Sequence: Synthetic oligonucleotide
  Target: ATXN1; (+) strand; PAM type: NRG; PAM sequence: AAG
aagaatgtacagagtttgaa

SEQ ID NO: 107682 - DNA, 20 bp, Artificial Sequence
  Description of Artificial Sequence: Synthetic oligonucleotide
  Target: ATXN1; (+) strand; PAM type: NRG; PAM sequence: TGG
cccattgctgtgcaccttca

SEQ ID NO: 107683 - DNA, 20 bp, Artificial Sequence
  Description of Artificial Sequence: Synthetic oligonucleotide
  Target: ATXN1; (+) strand; PAM type: NRG; PAM sequence: GGG
ccattgctgtgcaccttcat

SEQ ID NO: 107684 - DNA, 20 bp, Artificial Sequence
  Description of Artificial Sequence: Synthetic oligonucleotide
  Target: ATXN1; (+) strand; PAM type: NRG; PAM sequence: CAG
gtgcaccttcatgggtcata

SEQ ID NO: 107685 - DNA, 20 bp, Artificial Sequence
  Description of Artificial Sequence: Synthetic oligonucleotide
  Target: ATXN1; (+) strand; PAM type: NRG; PAM sequence: AGG
tgcaccttcatgggtcatac

SEQ ID NO: 107686 - DNA, 20 bp, Artificial Sequence
  Description of Artificial Sequence: Synthetic oligonucleotide
  Target: ATXN1; (+) strand; PAM type: NRG; PAM sequence: GAG
atgggtcatacaggttatat

SEQ ID NO: 107687 - DNA, 20 bp, Artificial Sequence
  Description of Artificial Sequence: Synthetic oligonucleotide
  Target: ATXN1; (+) strand; PAM type: NRG; PAM sequence: AGG
tgggtcatacaggttatatg

SEQ ID NO: 107688 - DNA, 20 bp, Artificial Sequence
  Description of Artificial Sequence: Synthetic oligonucleotide
  Target: ATXN1; (+) strand; PAM type: NRG; PAM sequence: GGG
gggtcatacaggttatatga

SEQ ID NO: 107689 - DNA, 20 bp, Artificial Sequence
  Description of Artificial Sequence: Synthetic oligonucleotide
  Target: ATXN1; (+) strand; PAM type: NRG; PAM sequence: CGG
atacaggttatatgagggtc

SEQ ID NO: 107690 - DNA, 20 bp, Artificial Sequence
  Description of Artificial Sequence: Synthetic oligonucleotide
  Target: ATXN1; (+) strand; PAM type: NRG; PAM sequence: GAG
acaggttatatgagggtccg

SEQ ID NO: 107691 - DNA, 20 bp, Artificial Sequence
  Description of Artificial Sequence: Synthetic oligonucleotide
  Target: ATXN1; (+) strand; PAM type: NRG; PAM sequence: AGG
caggttatatgagggtccgg

SEQ ID NO: 107692 - DNA, 20 bp, Artificial Sequence
  Description of Artificial Sequence: Synthetic oligonucleotide
  Target: ATXN1; (+) strand; PAM type: NRG; PAM sequence: GGG
aggttatatgagggtccgga

SEQ ID NO: 107693 - DNA, 20 bp, Artificial Sequence
  Description of Artificial Sequence: Synthetic oligonucleotide
  Target: ATXN1; (+) strand; PAM type: NRG; PAM sequence: CAG
tatatgagggtccggagggt

SEQ ID NO: 107694 - DNA, 20 bp, Artificial Sequence
  Description of Artificial Sequence: Synthetic oligonucleotide
  Target: ATXN1; (+) strand; PAM type: NRG; PAM sequence: GAG
tatgagggtccggagggtca

SEQ ID NO: 107695 - DNA, 20 bp, Artificial Sequence
  Description of Artificial Sequence: Synthetic oligonucleotide
  Target: ATXN1; (+) strand; PAM type: NRG; PAM sequence: CAG
tccggagggtcagagctgaa

SEQ ID NO: 107696 - DNA, 20 bp, Artificial Sequence
  Description of Artificial Sequence: Synthetic oligonucleotide
  Target: ATXN1; (+) strand; PAM type: NRG; PAM sequence: AGG
ccggagggtcagagctgaac

SEQ ID NO: 107697 - DNA, 20 bp, Artificial Sequence
  Description of Artificial Sequence: Synthetic oligonucleotide
  Target: ATXN1; (+) strand; PAM type: NRG; PAM sequence: CAG
ggtcagagctgaacaggcta

SEQ ID NO: 107698 - DNA, 20 bp, Artificial Sequence
  Description of Artificial Sequence: Synthetic oligonucleotide
  Target: ATXN1; (+) strand; PAM type: NRG; PAM sequence: AAG
ggctacagccgctgttcacc

SEQ ID NO: 107699 - DNA, 20 bp, Artificial Sequence
  Description of Artificial Sequence: Synthetic oligonucleotide
  Target: ATXN1; (+) strand; PAM type: NRG; PAM sequence: GAG
ctacagccgctgttcaccaa

SEQ ID NO: 107700 - DNA, 20 bp, Artificial Sequence
  Description of Artificial Sequence: Synthetic oligonucleotide
  Target: ATXN1; (+) strand; PAM type: NRG; PAM sequence: TGG
cgctgttcaccaagagccca

SEQ ID NO: 107701 - DNA, 20 bp, Artificial Sequence
  Description of Artificial Sequence: Synthetic oligonucleotide
  Target: ATXN1; (+) strand; PAM type: NRG; PAM sequence: CGG
accaagagcccatggtctcg

SEQ ID NO: 107702 - DNA, 20 bp, Artificial Sequence
  Description of Artificial Sequence: Synthetic oligonucleotide
  Target: ATXN1; (+) strand; PAM type: NRG; PAM sequence: GGG
ccaagagcccatggtctcgc

SEQ ID NO: 107703 - DNA, 20 bp, Artificial Sequence
  Description of Artificial Sequence: Synthetic oligonucleotide
  Target: ATXN1; (+) strand; PAM type: NRG; PAM sequence: GGG
caagagcccatggtctcgcg

SEQ ID NO: 107704 - DNA, 20 bp, Artificial Sequence
  Description of Artificial Sequence: Synthetic oligonucleotide
  Target: ATXN1; (+) strand; PAM type: NRG; PAM sequence: GAG
agagcccatggtctcgcggg

SEQ ID NO: 107705 - DNA, 20 bp, Artificial Sequence
  Description of Artificial Sequence: Synthetic oligonucleotide
  Target: ATXN1; (+) strand; PAM type: NRG; PAM sequence: CAG
cccatggtctcgcggggaga

SEQ ID NO: 107706 - DNA, 20 bp, Artificial Sequence
  Description of Artificial Sequence: Synthetic oligonucleotide
  Target: ATXN1; (+) strand; PAM type: NRG; PAM sequence: AAG
ctcgcggggagacagacacc

SEQ ID NO: 107707 - DNA, 20 bp, Artificial Sequence
  Description of Artificial Sequence: Synthetic oligonucleotide
  Target: ATXN1; (+) strand; PAM type: NRG; PAM sequence: CAG
cagacaccaagaaaccatca

SEQ ID NO: 107708 - DNA, 20 bp, Artificial Sequence
  Description of Artificial Sequence: Synthetic oligonucleotide
  Target: ATXN1; (+) strand; PAM type: NRG; PAM sequence: TGG
aagaaaccatcacagctcac

SEQ ID NO: 107709 - DNA, 20 bp, Artificial Sequence
  Description of Artificial Sequence: Synthetic oligonucleotide
  Target: ATXN1; (+) strand; PAM type: NRG; PAM sequence: GGG
agaaaccatcacagctcact

SEQ ID NO: 107710 - DNA, 20 bp, Artificial Sequence
  Description of Artificial Sequence: Synthetic oligonucleotide
  Target: ATXN1; (+) strand; PAM type: NRG; PAM sequence: TAG
ccatcacagctcactgggat

SEQ ID NO: 107711 - DNA, 20 bp, Artificial Sequence
  Description of Artificial Sequence: Synthetic oligonucleotide
  Target: ATXN1; (+) strand; PAM type: NRG; PAM sequence: TGG
cactgggattagtgctccac

SEQ ID NO: 107712 - DNA, 20 bp, Artificial Sequence
  Description of Artificial Sequence: Synthetic oligonucleotide
  Target: ATXN1; (+) strand; PAM type: NRG; PAM sequence: GGG
actgggattagtgctccact

SEQ ID NO: 107713 - DNA, 20 bp, Artificial Sequence
  Description of Artificial Sequence: Synthetic oligonucleotide
  Target: ATXN1; (+) strand; PAM type: NRG; PAM sequence: GGG
ctgggattagtgctccactg

SEQ ID NO: 107714 - DNA, 20 bp, Artificial Sequence
  Description of Artificial Sequence: Synthetic oligonucleotide
  Target: ATXN1; (+) strand; PAM type: NRG; PAM sequence: GGG
tgggattagtgctccactgg

SEQ ID NO: 107715 - DNA, 20 bp, Artificial Sequence
  Description of Artificial Sequence: Synthetic oligonucleotide
  Target: ATXN1; (+) strand; PAM type: NRG; PAM sequence: TAG
gattagtgctccactggggg

SEQ ID NO: 107716 - DNA, 20 bp, Artificial Sequence
  Description of Artificial Sequence: Synthetic oligonucleotide
  Target: ATXN1; (+) strand; PAM type: NRG; PAM sequence: TGG
ctccactgggggtagctgaa

SEQ ID NO: 107717 - DNA, 20 bp, Artificial Sequence
  Description of Artificial Sequence: Synthetic oligonucleotide
  Target: ATXN1; (+) strand; PAM type: NRG; PAM sequence: AAG
gggtagctgaatggtgctct

SEQ ID NO: 107718 - DNA, 20 bp, Artificial Sequence
  Description of Artificial Sequence: Synthetic oligonucleotide
  Target: ATXN1; (+) strand; PAM type: NRG; PAM sequence: GAG
gtagctgaatggtgctctaa

SEQ ID NO: 107719 - DNA, 20 bp, Artificial Sequence
  Description of Artificial Sequence: Synthetic oligonucleotide
  Target: ATXN1; (+) strand; PAM type: NRG; PAM sequence: CAG
gctgaatggtgctctaagag

SEQ ID NO: 107720 - DNA, 20 bp, Artificial Sequence
  Description of Artificial Sequence: Synthetic oligonucleotide
  Target: ATXN1; (+) strand; PAM type: NRG; PAM sequence: GAG
tgaatggtgctctaagagca

SEQ ID NO: 107721 - DNA, 20 bp, Artificial Sequence
  Description of Artificial Sequence: Synthetic oligonucleotide
  Target: ATXN1; (+) strand; PAM type: NRG; PAM sequence: GAG
aatggtgctctaagagcaga

SEQ ID NO: 107722 - DNA, 20 bp, Artificial Sequence
  Description of Artificial Sequence: Synthetic oligonucleotide
  Target: ATXN1; (+) strand; PAM type: NRG; PAM sequence: AGG
atggtgctctaagagcagag

SEQ ID NO: 107723 - DNA, 20 bp, Artificial Sequence
  Description of Artificial Sequence: Synthetic oligonucleotide
  Target: ATXN1; (+) strand; PAM type: NRG; PAM sequence: AAG
ctctaagagcagagaggaac

SEQ ID NO: 107724 - DNA, 20 bp, Artificial Sequence
  Description of Artificial Sequence: Synthetic oligonucleotide
  Target: ATXN1; (+) strand; PAM type: NRG; PAM sequence: CAG
tctctgtacgcctgtgtgca

SEQ ID NO: 107725 - DNA, 20 bp, Artificial Sequence
  Description of Artificial Sequence: Synthetic oligonucleotide
  Target: ATXN1; (+) strand; PAM type: NRG; PAM sequence: AGG
ctctgtacgcctgtgtgcac

SEQ ID NO: 107726 - DNA, 20 bp, Artificial Sequence
  Description of Artificial Sequence: Synthetic oligonucleotide
  Target: ATXN1; (+) strand; PAM type: NRG; PAM sequence: GAG
ctgtacgcctgtgtgcacag

SEQ ID NO: 107727 - DNA, 20 bp, Artificial Sequence
  Description of Artificial Sequence: Synthetic oligonucleotide
  Target: ATXN1; (+) strand; PAM type: NRG; PAM sequence: CGG
tacgcctgtgtgcacaggag

SEQ ID NO: 107728 - DNA, 20 bp, Artificial Sequence
  Description of Artificial Sequence: Synthetic oligonucleotide
  Target: ATXN1; (+) strand; PAM type: NRG; PAM sequence: GGG
acgcctgtgtgcacaggagc

SEQ ID NO: 107729 - DNA, 20 bp, Artificial Sequence
  Description of Artificial Sequence: Synthetic oligonucleotide
  Target: ATXN1; (+) strand; PAM type: NRG; PAM sequence: TGG
cctgtgtgcacaggagcggg

SEQ ID NO: 107730 - DNA, 20 bp, Artificial Sequence
  Description of Artificial Sequence: Synthetic oligonucleotide
  Target: ATXN1; (+) strand; PAM type: NRG; PAM sequence: GAG
tgcacaggagcgggtggtgt

SEQ ID NO: 107731 - DNA, 20 bp, Artificial Sequence
  Description of Artificial Sequence: Synthetic oligonucleotide
  Target: ATXN1; (+) strand; PAM type: NRG; PAM sequence: AGG
gcacaggagcgggtggtgtg

SEQ ID NO: 107732 - DNA, 20 bp, Artificial Sequence
  Description of Artificial Sequence: Synthetic oligonucleotide
  Target: ATXN1; (+) strand; PAM type: NRG; PAM sequence: TGG
caggagcgggtggtgtgagg

SEQ ID NO: 107733 - DNA, 20 bp, Artificial Sequence
  Description of Artificial Sequence: Synthetic oligonucleotide
  Target: ATXN1; (+) strand; PAM type: NRG; PAM sequence: CAG
tggtgtgaggtggctgctga

SEQ ID NO: 107734 - DNA, 20 bp, Artificial Sequence
  Description of Artificial Sequence: Synthetic oligonucleotide
  Target: ATXN1; (+) strand; PAM type: NRG; PAM sequence: AGG
ggtgtgaggtggctgctgac

SEQ ID NO: 107735 - DNA, 20 bp, Artificial Sequence
  Description of Artificial Sequence: Synthetic oligonucleotide
  Target: ATXN1; (+) strand; PAM type: NRG; PAM sequence: TGG
ggtggctgctgacaggaatg

SEQ ID NO: 107736 - DNA, 20 bp, Artificial Sequence
  Description of Artificial Sequence: Synthetic oligonucleotide
  Target: ATXN1; (+) strand; PAM type: NRG; PAM sequence: CAG
ctgctgacaggaatgtggca

SEQ ID NO: 107737 - DNA, 20 bp, Artificial Sequence
  Description of Artificial Sequence: Synthetic oligonucleotide
  Target: ATXN1; (+) strand; PAM type: NRG; PAM sequence: GAG
gctgacaggaatgtggcaca

SEQ ID NO: 107738 - DNA, 20 bp, Artificial Sequence
  Description of Artificial Sequence: Synthetic oligonucleotide
  Target: ATXN1; (+) strand; PAM type: NRG; PAM sequence: AAG
gacaggaatgtggcacagag

SEQ ID NO: 107739 - DNA, 20 bp, Artificial Sequence
  Description of Artificial Sequence: Synthetic oligonucleotide
  Target: ATXN1; (+) strand; PAM type: NRG; PAM sequence: AAG
gaatgtggcacagagaagac

SEQ ID NO: 107740 - DNA, 20 bp, Artificial Sequence
  Description of Artificial Sequence: Synthetic oligonucleotide
  Target: ATXN1; (+) strand; PAM type: NRG; PAM sequence: AAG
gcacagagaagacaagatgt

SEQ ID NO: 107741 - DNA, 20 bp, Artificial Sequence
  Description of Artificial Sequence: Synthetic oligonucleotide
  Target: ATXN1; (+) strand; PAM type: NRG; PAM sequence: AAG
agatgtaagctgaatcctga

SEQ ID NO: 107742 - DNA, 20 bp, Artificial Sequence
  Description of Artificial Sequence: Synthetic oligonucleotide
  Target: ATXN1; (+) strand; PAM type: NRG; PAM sequence: GAG
taagctgaatcctgaaagat

SEQ ID NO: 107743 - DNA, 20 bp, Artificial Sequence
  Description of Artificial Sequence: Synthetic oligonucleotide
  Target: ATXN1; (+) strand; PAM type: NRG; PAM sequence: AAG
tgaatcctgaaagatgagca

SEQ ID NO: 107744 - DNA, 20 bp, Artificial Sequence
  Description of Artificial Sequence: Synthetic oligonucleotide
  Target: ATXN1; (+) strand; PAM type: NRG; PAM sequence: CAG
atcctgaaagatgagcaaag

SEQ ID NO: 107745 - DNA, 20 bp, Artificial Sequence
  Description of Artificial Sequence: Synthetic oligonucleotide
  Target: ATXN1; (+) strand; PAM type: NRG; PAM sequence: AAG
gatgagcaaagcagttacca

SEQ ID NO: 107746 - DNA, 20 bp, Artificial Sequence
  Description of Artificial Sequence: Synthetic oligonucleotide
  Target: ATXN1; (+) strand; PAM type: NRG; PAM sequence: CAG
agcaaagcagttaccaaaga

SEQ ID NO: 107747 - DNA, 20 bp, Artificial Sequence
  Description of Artificial Sequence: Synthetic oligonucleotide
  Target: ATXN1; (+) strand; PAM type: NRG; PAM sequence: AAG
aaagcagttaccaaagacag

SEQ ID NO: 107748 - DNA, 20 bp, Artificial Sequence
  Description of Artificial Sequence: Synthetic oligonucleotide
  Target: ATXN1; (+) strand; PAM type: NRG; PAM sequence: AGG
aagcagttaccaaagacaga

SEQ ID NO: 107749 - DNA, 20 bp, Artificial Sequence
  Description of Artificial Sequence: Synthetic oligonucleotide
  Target: ATXN1; (+) strand; PAM type: NRG; PAM sequence: GGG
agcagttaccaaagacagaa

SEQ ID NO: 107750 - DNA, 20 bp, Artificial Sequence
  Description of Artificial Sequence: Synthetic oligonucleotide
  Target: ATXN1; (+) strand; PAM type: NRG; PAM sequence: CAG
agttaccaaagacagaaggg

SEQ ID NO: 107751 - DNA, 20 bp, Artificial Sequence
  Description of Artificial Sequence: Synthetic oligonucleotide
  Target: ATXN1; (+) strand; PAM type: NRG; PAM sequence: TGG
gaaaaatgcttgtaaaacta

SEQ ID NO: 107752 - DNA, 20 bp, Artificial Sequence
  Description of Artificial Sequence: Synthetic oligonucleotide
  Target: ATXN1; (+) strand; PAM type: NRG; PAM sequence: CGG
aaatgcttgtaaaactatgg

SEQ ID NO: 107753 - DNA, 20 bp, Artificial Sequence
  Description of Artificial Sequence: Synthetic oligonucleotide
  Target: ATXN1; (+) strand; PAM type: NRG; PAM sequence: TAG
cttgtaaaactatggcggca

SEQ ID NO: 107754 - DNA, 20 bp, Artificial Sequence
  Description of Artificial Sequence: Synthetic oligonucleotide
  Target: ATXN1; (+) strand; PAM type: NRG; PAM sequence: AAG
aaactatggcggcatagcat

SEQ ID NO: 107755 - DNA, 20 bp, Artificial Sequence
  Description of Artificial Sequence: Synthetic oligonucleotide
  Target: ATXN1; (+) strand; PAM type: NRG; PAM sequence: CAG
cggcatagcataagcacacg

SEQ ID NO: 107756 - DNA, 20 bp, Artificial Sequence
  Description of Artificial Sequence: Synthetic oligonucleotide
  Target: ATXN1; (+) strand; PAM type: NRG; PAM sequence: TGG
gcataagcacacgcagtgtt

SEQ ID NO: 107757 - DNA, 20 bp, Artificial Sequence
  Description of Artificial Sequence: Synthetic oligonucleotide
  Target: ATXN1; (+) strand; PAM type: NRG; PAM sequence: GGG
cataagcacacgcagtgttt

SEQ ID NO: 107758 - DNA, 20 bp, Artificial Sequence
  Description of Artificial Sequence: Synthetic oligonucleotide
  Target: ATXN1; (+) strand; PAM type: NRG; PAM sequence: GAG
taagcacacgcagtgtttgg

SEQ ID NO: 107759 - DNA, 20 bp, Artificial Sequence
  Description of Artificial Sequence: Synthetic oligonucleotide
  Target: ATXN1; (+) strand; PAM type: NRG; PAM sequence: TGG
acacgcagtgtttgggagaa

SEQ ID NO: 107760 - DNA, 20 bp, Artificial Sequence
  Description of Artificial Sequence: Synthetic oligonucleotide
  Target: ATXN1; (+) strand; PAM type: NRG; PAM sequence: CAG
gcagtgtttgggagaatggc

SEQ ID NO: 107761 - DNA, 20 bp, Artificial Sequence
  Description of Artificial Sequence: Synthetic oligonucleotide
  Target: ATXN1; (+) strand; PAM type: NRG; PAM sequence: AAG
agaatggccagtgatttgct

SEQ ID NO: 107762 - DNA, 20 bp, Artificial Sequence
  Description of Artificial Sequence: Synthetic oligonucleotide
  Target: ATXN1; (+) strand; PAM type: NRG; PAM sequence: AGG
gaatggccagtgatttgcta

SEQ ID NO: 107763 - DNA, 20 bp, Artificial Sequence
  Description of Artificial Sequence: Synthetic oligonucleotide
  Target: ATXN1; (+) strand; PAM type: NRG; PAM sequence: CAG
gtgatttgctaaggctccac

SEQ ID NO: 107764 - DNA, 20 bp, Artificial Sequence
  Description of Artificial Sequence: Synthetic oligonucleotide
  Target: ATXN1; (+) strand; PAM type: NRG; PAM sequence: AGG
tgatttgctaaggctccacc

SEQ ID NO: 107765 - DNA, 20 bp, Artificial Sequence
  Description of Artificial Sequence: Synthetic oligonucleotide
  Target: ATXN1; (+) strand; PAM type: NRG; PAM sequence: CAG
taaggctccaccaggtcttt

SEQ ID NO: 107766 - DNA, 20 bp, Artificial Sequence
  Description of Artificial Sequence: Synthetic oligonucleotide
  Target: ATXN1; (+) strand; PAM type: NRG; PAM sequence: AGG
aaggctccaccaggtctttc

SEQ ID NO: 107767 - DNA, 20 bp, Artificial Sequence
  Description of Artificial Sequence: Synthetic oligonucleotide
  Target: ATXN1; (+) strand; PAM type: NRG; PAM sequence: GGG
aggctccaccaggtctttca

SEQ ID NO: 107768 - DNA, 20 bp, Artificial Sequence
  Description of Artificial Sequence: Synthetic oligonucleotide
  Target: ATXN1; (+) strand; PAM type: NRG; PAM sequence: TAG
tccaccaggtctttcagggt

SEQ ID NO: 107769 - DNA, 20 bp, Artificial Sequence
  Description of Artificial Sequence: Synthetic oligonucleotide
  Target: ATXN1; (+) strand; PAM type: NRG; PAM sequence: CAG
caggtctttcagggttagaa

SEQ ID NO: 107770 - DNA, 20 bp, Artificial Sequence
  Description of Artificial Sequence: Synthetic oligonucleotide
  Target: ATXN1; (+) strand; PAM type: NRG; PAM sequence: GAG
ggtctttcagggttagaaca

SEQ ID NO: 107771 - DNA, 20 bp, Artificial Sequence
  Description of Artificial Sequence: Synthetic oligonucleotide
  Target: ATXN1; (+) strand; PAM type: NRG; PAM sequence: CAG
cagagcatcatcacacataa

SEQ ID NO: 107772 - DNA, 20 bp, Artificial Sequence
  Description of Artificial Sequence: Synthetic oligonucleotide
  Target: ATXN1; (+) strand; PAM type: NRG; PAM sequence: AAG
gcacgtgtatgtaatatgac

SEQ ID NO: 107773 - DNA, 20 bp, Artificial Sequence
  Description of Artificial Sequence: Synthetic oligonucleotide
  Target: ATXN1; (+) strand; PAM type: NRG; PAM sequence: GAG
atgtaatatgacaagcaatt

SEQ ID NO: 107774 - DNA, 20 bp, Artificial Sequence
  Description of Artificial Sequence: Synthetic oligonucleotide
  Target: ATXN1; (+) strand; PAM type: NRG; PAM sequence: TGG
acaagcaattgagctccatt

SEQ ID NO: 107775 - DNA, 20 bp, Artificial Sequence
  Description of Artificial Sequence: Synthetic oligonucleotide
  Target: ATXN1; (+) strand; PAM type: NRG; PAM sequence: GGG
caagcaattgagctccattt

SEQ ID NO: 107776 - DNA, 20 bp, Artificial Sequence
  Description of Artificial Sequence: Synthetic oligonucleotide
  Target: ATXN1; (+) strand; PAM type: NRG; PAM sequence: TAG
ttgagctccatttgggaaac

SEQ ID NO: 107777 - DNA, 20 bp, Artificial Sequence
  Description of Artificial Sequence: Synthetic oligonucleotide
  Target: ATXN1; (+) strand; PAM type: NRG; PAM sequence: GAG
gagctccatttgggaaacta

SEQ ID NO: 107778 - DNA, 20 bp, Artificial Sequence
  Description of Artificial Sequence: Synthetic oligonucleotide
  Target: ATXN1; (+) strand; PAM type: NRG; PAM sequence: AAG
atttgggaaactagagctct

SEQ ID NO: 107779 - DNA, 20 bp, Artificial Sequence
  Description of Artificial Sequence: Synthetic oligonucleotide
  Target: ATXN1; (+) strand; PAM type: NRG; PAM sequence: TGG
agcgccttctgcctacttca

SEQ ID NO: 107780 - DNA, 20 bp, Artificial Sequence
  Description of Artificial Sequence: Synthetic oligonucleotide
  Target: ATXN1; (+) strand; PAM type: NRG; PAM sequence: AAG
ccttctgcctacttcatggc

SEQ ID NO: 107781 - DNA, 20 bp, Artificial Sequence
  Description of Artificial Sequence: Synthetic oligonucleotide
  Target: ATXN1; (+) strand; PAM type: NRG; PAM sequence: AGG
cttctgcctacttcatggca

SEQ ID NO: 107782 - DNA, 20 bp, Artificial Sequence
  Description of Artificial Sequence: Synthetic oligonucleotide
  Target: ATXN1; (+) strand; PAM type: NRG; PAM sequence: GAG
tctgcctacttcatggcaag

SEQ ID NO: 107783 - DNA, 20 bp, Artificial Sequence
  Description of Artificial Sequence: Synthetic oligonucleotide
  Target: ATXN1; (+) strand; PAM type: NRG; PAM sequence: AGG
ctgcctacttcatggcaagg

SEQ ID NO: 107784 - DNA, 20 bp, Artificial Sequence
  Description of Artificial Sequence: Synthetic oligonucleotide
  Target: ATXN1; (+) strand; PAM type: NRG; PAM sequence: GGG
tgcctacttcatggcaagga

SEQ ID NO: 107785 - DNA, 20 bp, Artificial Sequence
  Description of Artificial Sequence: Synthetic oligonucleotide
  Target: ATXN1; (+) strand; PAM type: NRG; PAM sequence: CGG
catggcaaggagggccatct

SEQ ID NO: 107786 - DNA, 20 bp, Artificial Sequence
  Description of Artificial Sequence: Synthetic oligonucleotide
  Target: ATXN1; (+) strand; PAM type: NRG; PAM sequence: GGG
atggcaaggagggccatctc

SEQ ID NO: 107787 - DNA, 20 bp, Artificial Sequence
  Description of Artificial Sequence: Synthetic oligonucleotide
  Target: ATXN1; (+) strand; PAM type: NRG; PAM sequence: CAG
agggccatctcgggcaccac

SEQ ID NO: 107788 - DNA, 20 bp, Artificial Sequence
  Description of Artificial Sequence: Synthetic oligonucleotide
  Target: ATXN1; (+) strand; PAM type: NRG; PAM sequence: TGG
cgggcaccaccagccctcta

SEQ ID NO: 107789 - DNA, 20 bp, Artificial Sequence
  Description of Artificial Sequence: Synthetic oligonucleotide
  Target: ATXN1; (+) strand; PAM type: NRG; PAM sequence: CAG
gcaccaccagccctctatgg

SEQ ID NO: 107790 - DNA, 20 bp, Artificial Sequence
  Description of Artificial Sequence: Synthetic oligonucleotide
  Target: ATXN1; (+) strand; PAM type: NRG; PAM sequence: TGG
ccagccctctatggcagcca

SEQ ID NO: 107791 - DNA, 20 bp, Artificial Sequence
  Description of Artificial Sequence: Synthetic oligonucleotide
  Target: ATXN1; (+) strand; PAM type: NRG; PAM sequence: GGG
cagccctctatggcagccat

SEQ ID NO: 107792 - DNA, 20 bp, Artificial Sequence
  Description of Artificial Sequence: Synthetic oligonucleotide
  Target: ATXN1; (+) strand; PAM type: NRG; PAM sequence: GGG
agccctctatggcagccatg

SEQ ID NO: 107793 - DNA, 20 bp, Artificial Sequence
  Description of Artificial Sequence: Synthetic oligonucleotide
  Target: ATXN1; (+) strand; PAM type: NRG; PAM sequence: TGG
ggggctcgttcatatcctcc

SEQ ID NO: 107794 - DNA, 20 bp, Artificial Sequence
  Description of Artificial Sequence: Synthetic oligonucleotide
  Target: ATXN1; (+) strand; PAM type: NRG; PAM sequence: CAG
ggcccaccacaacctgtgtg

SEQ ID NO: 107795 - DNA, 20 bp, Artificial Sequence
  Description of Artificial Sequence: Synthetic oligonucleotide
  Target: ATXN1; (+) strand; PAM type: NRG; PAM sequence: AGG
gcccaccacaacctgtgtgc

SEQ ID NO: 107796 - DNA, 20 bp, Artificial Sequence
  Description of Artificial Sequence: Synthetic oligonucleotide
  Target: ATXN1; (+) strand; PAM type: NRG; PAM sequence: CAG
acaacctgtgtgcaggtact

SEQ ID NO: 107797 - DNA, 20 bp, Artificial Sequence
  Description of Artificial Sequence: Synthetic oligonucleotide
  Target: ATXN1; (+) strand; PAM type: NRG; PAM sequence: AGG
caacctgtgtgcaggtactc

SEQ ID NO: 107798 - DNA, 20 bp, Artificial Sequence
  Description of Artificial Sequence: Synthetic oligonucleotide
  Target: ATXN1; (+) strand; PAM type: NRG; PAM sequence: CAG
ctgcttccctttgtctatgc

SEQ ID NO: 107799 - DNA, 20 bp, Artificial Sequence
  Description of Artificial Sequence: Synthetic oligonucleotide
  Target: ATXN1; (+) strand; PAM type: NRG; PAM sequence: AGG
tgcttccctttgtctatgcc

SEQ ID NO: 107800 - DNA, 20 bp, Artificial Sequence
  Description of Artificial Sequence: Synthetic oligonucleotide
  Target: ATXN1; (+) strand; PAM type: NRG; PAM sequence: TGG
ttccctttgtctatgccagg

SEQ ID NO: 107801 - DNA, 20 bp, Artificial Sequence
  Description of Artificial Sequence: Synthetic oligonucleotide
  Target: ATXN1; (+) strand; PAM type: NRG; PAM sequence: AAG
ccaggtggccttattcttca

SEQ ID NO: 107802 - DNA, 20 bp, Artificial Sequence
  Description of Artificial Sequence: Synthetic oligonucleotide
  Target: ATXN1; (+) strand; PAM type: NRG; PAM sequence: TGG
ggccttattcttcaaagctc

SEQ ID NO: 107803 - DNA, 20 bp, Artificial Sequence
  Description of Artificial Sequence: Synthetic oligonucleotide
  Target: ATXN1; (+) strand; PAM type: NRG; PAM sequence: AAG
tattcttcaaagctctggcc

SEQ ID NO: 107804 - DNA, 20 bp, Artificial Sequence
  Description of Artificial Sequence: Synthetic oligonucleotide
  Target: ATXN1; (+) strand; PAM type: NRG; PAM sequence: CAG
cttacttgctaactcctacc

SEQ ID NO: 107805 - DNA, 20 bp, Artificial Sequence
  Description of Artificial Sequence: Synthetic oligonucleotide
  Target: ATXN1; (+) strand; PAM type: NRG; PAM sequence: CAG
ctaactcctacccagcaact

SEQ ID NO: 107806 - DNA, 20 bp, Artificial Sequence
  Description of Artificial Sequence: Synthetic oligonucleotide
  Target: ATXN1; (+) strand; PAM type: NRG; PAM sequence: TGG
aactgattgtaccactcccc

SEQ ID NO: 107807 - DNA, 20 bp, Artificial Sequence
  Description of Artificial Sequence: Synthetic oligonucleotide
  Target: ATXN1; (+) strand; PAM type: NRG; PAM sequence: CAG
tcccctggtctgtcctaact

SEQ ID NO: 107808 - DNA, 20 bp, Artificial Sequence
  Description of Artificial Sequence: Synthetic oligonucleotide
  Target: ATXN1; (+) strand; PAM type: NRG; PAM sequence: AAG
gatactgccttgtgtcataa

SEQ ID NO: 107809 - DNA, 20 bp, Artificial Sequence
  Description of Artificial Sequence: Synthetic oligonucleotide
  Target: ATXN1; (+) strand; PAM type: NRG; PAM sequence: TAG
gtcataaaagcaacatacct

SEQ ID NO: 107810 - DNA, 20 bp, Artificial Sequence
  Description of Artificial Sequence: Synthetic oligonucleotide
  Target: ATXN1; (+) strand; PAM type: NRG; PAM sequence: TAG
aaagcaacataccttagatt

SEQ ID NO: 107811 - DNA, 20 bp, Artificial Sequence
  Description of Artificial Sequence: Synthetic oligonucleotide
  Target: ATXN1; (+) strand; PAM type: NRG; PAM sequence: AAG
ataccatgctatgacttacc

SEQ ID NO: 107812 - DNA, 20 bp, Artificial Sequence
  Description of Artificial Sequence: Synthetic oligonucleotide
  Target: ATXN1; (+) strand; PAM type: NRG; PAM sequence: CAG
cattatacccttaatatccc

SEQ ID NO: 107813 - DNA, 20 bp, Artificial Sequence
  Description of Artificial Sequence: Synthetic oligonucleotide
  Target: ATXN1; (+) strand; PAM type: NRG; PAM sequence: CAG
aatatccccagtaattcttt

SEQ ID NO: 107814 - DNA, 20 bp, Artificial Sequence
  Description of Artificial Sequence: Synthetic oligonucleotide
  Target: ATXN1; (+) strand; PAM type: NRG; PAM sequence: TAG
tccccagtaattctttcaga

SEQ ID NO: 107815 - DNA, 20 bp, Artificial Sequence
  Description of Artificial Sequence: Synthetic oligonucleotide
  Target: ATXN1; (+) strand; PAM type: NRG; PAM sequence: AGG
ccccagtaattctttcagat

SEQ ID NO: 107816 - DNA, 20 bp, Artificial Sequence
  Description of Artificial Sequence: Synthetic oligonucleotide
  Target: ATXN1; (+) strand; PAM type: NRG; PAM sequence: TAG
taattctttcagataggcgt

SEQ ID NO: 107817 - DNA, 20 bp, Artificial Sequence
  Description of Artificial Sequence: Synthetic oligonucleotide
  Target: ATXN1; (+) strand; PAM type: NRG; PAM sequence: AGG
aattctttcagataggcgtt

SEQ ID NO: 107818 - DNA, 20 bp, Artificial Sequence
  Description of Artificial Sequence: Synthetic oligonucleotide
  Target: ATXN1; (+) strand; PAM type: NRG; PAM sequence: TAG
taggcgttaggcccactttt

SEQ ID NO: 107819 - DNA, 20 bp, Artificial Sequence
  Description of Artificial Sequence: Synthetic oligonucleotide
  Target: ATXN1; (+) strand; PAM type: NRG; PAM sequence: CAG
gttaggcccactttttagat

SEQ ID NO: 107820 - DNA, 20 bp, Artificial Sequence
  Description of Artificial Sequence: Synthetic oligonucleotide
  Target: ATXN1; (+) strand; PAM type: NRG; PAM sequence: CAG
actttttagatcagtaaact

SEQ ID NO: 107821 - DNA, 20 bp, Artificial Sequence
  Description of Artificial Sequence: Synthetic oligonucleotide
  Target: ATXN1; (+) strand; PAM type: NRG; PAM sequence: AGG
ctttttagatcagtaaactc

SEQ ID NO: 107822 - DNA, 20 bp, Artificial Sequence
  Description of Artificial Sequence: Synthetic oligonucleotide
  Target: ATXN1; (+) strand; PAM type: NRG; PAM sequence: TAG
tcagtaaactcaggctcatg

SEQ ID NO: 107823 - DNA, 20 bp, Artificial Sequence
  Description of Artificial Sequence: Synthetic oligonucleotide
  Target: ATXN1; (+) strand; PAM type: NRG; PAM sequence: AGG
cagtaaactcaggctcatgt

SEQ ID NO: 107824 - DNA, 20 bp, Artificial Sequence
  Description of Artificial Sequence: Synthetic oligonucleotide
  Target: ATXN1; (+) strand; PAM type: NRG; PAM sequence: AAG
aactcaggctcatgtaggtt

SEQ ID NO: 107825 - DNA, 20 bp, Artificial Sequence
  Description of Artificial Sequence: Synthetic oligonucleotide
  Target: ATXN1; (+) strand; PAM type: NRG; PAM sequence: AGG
actcaggctcatgtaggtta

SEQ ID NO: 107826 - DNA, 20 bp, Artificial Sequence
  Description of Artificial Sequence: Synthetic oligonucleotide
  Target: ATXN1; (+) strand; PAM type: NRG; PAM sequence: GGG
ctcaggctcatgtaggttaa

SEQ ID NO: 107827 - DNA, 20 bp, Artificial Sequence
  Description of Artificial Sequence: Synthetic oligonucleotide
  Target: ATXN1; (+) strand; PAM type: NRG; PAM sequence: AAG
aggctcatgtaggttaaggg

SEQ ID NO: 107828 - DNA, 20 bp, Artificial Sequence
  Description of Artificial Sequence: Synthetic oligonucleotide
  Target: ATXN1; (+) strand; PAM type: NRG; PAM sequence: CAG
tgtaggttaagggaagttcc

SEQ ID NO: 107829 - DNA, 20 bp, Artificial Sequence
  Description of Artificial Sequence: Synthetic oligonucleotide
  Target: ATXN1; (+) strand; PAM type: NRG; PAM sequence: AGG
gtaggttaagggaagttccc

SEQ ID NO: 107830 - DNA, 20 bp, Artificial Sequence
  Description of Artificial Sequence: Synthetic oligonucleotide
  Target: ATXN1; (+) strand; PAM type: NRG; PAM sequence: GAG
aggttaagggaagttcccag

SEQ ID NO: 107831 - DNA, 20 bp, Artificial Sequence
  Description of Artificial Sequence: Synthetic oligonucleotide
  Target: ATXN1; (+) strand; PAM type: NRG; PAM sequence: CAG
aagggaagttcccaggagca

SEQ ID NO: 107832 - DNA, 20 bp, Artificial Sequence
  Description of Artificial Sequence: Synthetic oligonucleotide
  Target: ATXN1; (+) strand; PAM type: NRG; PAM sequence: TGG
agcacagaatatgtaacttg

SEQ ID NO: 107833 - DNA, 20 bp, Artificial Sequence
  Description of Artificial Sequence: Synthetic oligonucleotide
  Target: ATXN1; (+) strand; PAM type: NRG; PAM sequence: GAG
cacagaatatgtaacttgtg

SEQ ID NO: 107834 - DNA, 20 bp, Artificial Sequence
  Description of Artificial Sequence: Synthetic oligonucleotide
  Target: ATXN1; (+) strand; PAM type: NRG; PAM sequence: CAG
gaatatgtaacttgtggagc

SEQ ID NO: 107835 - DNA, 20 bp, Artificial Sequence
  Description of Artificial Sequence: Synthetic oligonucleotide
  Target: ATXN1; (+) strand; PAM type: NRG; PAM sequence: AGG
aatatgtaacttgtggagcc

SEQ ID NO: 107836 - DNA, 20 bp, Artificial Sequence
  Description of Artificial Sequence: Synthetic oligonucleotide
  Target: ATXN1; (+) strand; PAM type: NRG; PAM sequence: TAG
gtaacttgtggagccaggac

SEQ ID NO: 107837 - DNA, 20 bp, Artificial Sequence
  Description of Artificial Sequence: Synthetic oligonucleotide
  Target: ATXN1; (+) strand; PAM type: NRG; PAM sequence: CAG
aggactagaaaacaaatcta

SEQ ID NO: 107838 - DNA, 20 bp, Artificial Sequence
  Description of Artificial Sequence: Synthetic oligonucleotide
  Target: ATXN1; (+) strand; PAM type: NRG; PAM sequence: CAG
aaatctacagattctatgaa

SEQ ID NO: 107839 - DNA, 20 bp, Artificial Sequence
  Description of Artificial Sequence: Synthetic oligonucleotide
  Target: ATXN1; (+) strand; PAM type: NRG; PAM sequence: TGG
gtgctcttccattacaccac

SEQ ID NO: 107840 - DNA, 20 bp, Artificial Sequence
  Description of Artificial Sequence: Synthetic oligonucleotide
  Target: ATXN1; (+) strand; PAM type: NRG; PAM sequence: GGG
tgctcttccattacaccact

SEQ ID NO: 107841 - DNA, 20 bp, Artificial Sequence
  Description of Artificial Sequence: Synthetic oligonucleotide
  Target: ATXN1; (+) strand; PAM type: NRG; PAM sequence: TAG
tatttatttatttatttatt

SEQ ID NO: 107842 - DNA, 20 bp, Artificial Sequence
  Description of Artificial Sequence: Synthetic oligonucleotide
  Target: ATXN1; (+) strand; PAM type: NRG; PAM sequence: GAG
tttatttatttatttattta

SEQ ID NO: 107843 - DNA, 20 bp, Artificial Sequence
  Description of Artificial Sequence: Synthetic oligonucleotide
  Target: ATXN1; (+) strand; PAM type: NRG; PAM sequence: CAG
tttatttatttatttagaga

SEQ ID NO: 107844 - DNA, 20 bp, Artificial Sequence
  Description of Artificial Sequence: Synthetic oligonucleotide
  Target: ATXN1; (+) strand; PAM type: NRG; PAM sequence: AGG
ttatttatttatttagagac

SEQ ID NO: 107845 - DNA, 20 bp, Artificial Sequence
  Description of Artificial Sequence: Synthetic oligonucleotide
  Target: ATXN1; (+) strand; PAM type: NRG; PAM sequence: GGG
tatttatttatttagagaca

SEQ ID NO: 107846 - DNA, 20 bp, Artificial Sequence
  Description of Artificial Sequence: Synthetic oligonucleotide
  Target: ATXN1; (+) strand; PAM type: NRG; PAM sequence: GAG
cagggtctcactctgtcacc

SEQ ID NO: 107847 - DNA, 20 bp, Artificial Sequence
  Description of Artificial Sequence: Synthetic oligonucleotide
  Target: ATXN1; (+) strand; PAM type: NRG; PAM sequence: AGG
agggtctcactctgtcaccg

SEQ ID NO: 107848 - DNA, 20 bp, Artificial Sequence
  Description of Artificial Sequence: Synthetic oligonucleotide
  Target: ATXN1; (+) strand; PAM type: NRG; PAM sequence: TGG
tctcactctgtcaccgaggc

SEQ ID NO: 107849 - DNA, 20 bp, Artificial Sequence
  Description of Artificial Sequence: Synthetic oligonucleotide
  Target: ATXN1; (+) strand; PAM type: NRG; PAM sequence: GAG
tcactctgtcaccgaggctg

SEQ ID NO: 107850 - DNA, 20 bp, Artificial Sequence
  Description of Artificial Sequence: Synthetic oligonucleotide
  Target: ATXN1; (+) strand; PAM type: NRG; PAM sequence: CAG
ctgtcaccgaggctggagtg

SEQ ID NO: 107851 - DNA, 20 bp, Artificial Sequence
  Description of Artificial Sequence: Synthetic oligonucleotide
  Target: ATXN1; (+) strand; PAM type: NRG; PAM sequence: TGG
tcaccgaggctggagtgcag

SEQ ID NO: 107852 - DNA, 20 bp, Artificial Sequence
  Description of Artificial Sequence: Synthetic oligonucleotide
  Target: ATXN1; (+) strand; PAM type: NRG; PAM sequence: CGG
ggagtgcagtggtgcaatca

SEQ ID NO: 107853 - DNA, 20 bp, Artificial Sequence
  Description of Artificial Sequence: Synthetic oligonucleotide
  Target: ATXN1; (+) strand; PAM type: NRG; PAM sequence: CAG
ggtgcaatcacggctcaccg

SEQ ID NO: 107854 - DNA, 20 bp, Artificial Sequence
  Description of Artificial Sequence: Synthetic oligonucleotide
  Target: ATXN1; (+) strand; PAM type: NRG; PAM sequence: TGG
caccgcagccttgactgccc

SEQ ID NO: 107855 - DNA, 20 bp, Artificial Sequence
  Description of Artificial Sequence: Synthetic oligonucleotide
  Target: ATXN1; (+) strand; PAM type: NRG; PAM sequence: CAG
gctgaaatatcctcccacct

SEQ ID NO: 107856 - DNA, 20 bp, Artificial Sequence
  Description of Artificial Sequence: Synthetic oligonucleotide
  Target: ATXN1; (+) strand; PAM type: NRG; PAM sequence: GAG
tcctcccacctcagcctcct

SEQ ID NO: 107857 - DNA, 20 bp, Artificial Sequence
  Description of Artificial Sequence: Synthetic oligonucleotide
  Target: ATXN1; (+) strand; PAM type: NRG; PAM sequence: TAG
tcccacctcagcctcctgag

SEQ ID NO: 107858 - DNA, 20 bp, Artificial Sequence
  Description of Artificial Sequence: Synthetic oligonucleotide
  Target: ATXN1; (+) strand; PAM type: NRG; PAM sequence: TGG
acctcagcctcctgagtagc

SEQ ID NO: 107859 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcctgagtagct

SEQ ID NO: 107860 - DNA, 20 bp, Artificial Sequence
  Description of Artificial Sequence: Synthetic oligonucleotide
  Target: ATXN1; (+) strand; PAM type: NRG; PAM sequence: CAG
ctcctgagtagctgggacta

SEQ ID NO: 107861 - DNA, 20 bp, Artificial Sequence
  Description of Artificial Sequence: Synthetic oligonucleotide
  Target: ATXN1; (+) strand; PAM type: NRG; PAM sequence: AGG
tcctgagtagctgggactac

SEQ ID NO: 107862 - DNA, 20 bp, Artificial Sequence
  Description of Artificial Sequence: Synthetic oligonucleotide
  Target: ATXN1; (+) strand; PAM type: NRG; PAM sequence: TGG
caggtgcacaccaccacccc

SEQ ID NO: 107863 - DNA, 20 bp, Artificial Sequence
  Description of Artificial Sequence: Synthetic oligonucleotide
  Target: ATXN1; (+) strand; PAM type: NRG; PAM sequence: AAG
aattttttaacttttttgta

SEQ ID NO: 107864 - DNA, 20 bp, Artificial Sequence
  Description of Artificial Sequence: Synthetic oligonucleotide
  Target: ATXN1; (+) strand; PAM type: NRG; PAM sequence: AAG
ttaacttttttgtaaagaca

SEQ ID NO: 107865 - DNA, 20 bp, Artificial Sequence
  Description of Artificial Sequence: Synthetic oligonucleotide
  Target: ATXN1; (+) strand; PAM type: NRG; PAM sequence: CAG
caaagtctcactatatttcc

SEQ ID NO: 107866 - DNA, 20 bp, Artificial Sequence
  Description of Artificial Sequence: Synthetic oligonucleotide
  Target: ATXN1; (+) strand; PAM type: NRG; PAM sequence: AGG
aaagtctcactatatttccc

SEQ ID NO: 107867 - DNA, 20 bp, Artificial Sequence
  Description of Artificial Sequence: Synthetic oligonucleotide
  Target: ATXN1; (+) strand; PAM type: NRG; PAM sequence: TGG
tctcactatatttcccaggc

SEQ ID NO: 107868 - DNA, 20 bp, Artificial Sequence
  Description of Artificial Sequence: Synthetic oligonucleotide
  Target: ATXN1; (+) strand; PAM type: NRG; PAM sequence: TGG
ccaggctggtctcaaactcc

SEQ ID NO: 107869 - DNA, 20 bp, Artificial Sequence
  Description of Artificial Sequence: Synthetic oligonucleotide
  Target: ATXN1; (+) strand; PAM type: NRG; PAM sequence: GGG
caggctggtctcaaactcct

SEQ ID NO: 107870 - DNA, 20 bp, Artificial Sequence
  Description of Artificial Sequence: Synthetic oligonucleotide
  Target: ATXN1; (+) strand; PAM type: NRG; PAM sequence: AAG
ggtctcaaactcctgggttc

SEQ ID NO: 107871 - DNA, 20 bp, Artificial Sequence
  Description of Artificial Sequence: Synthetic oligonucleotide
  Target: ATXN1; (+) strand; PAM type: NRG; PAM sequence: CAG
ctcaaactcctgggttcaag

SEQ ID NO: 107872 - DNA, 20 bp, Artificial Sequence
  Description of Artificial Sequence: Synthetic oligonucleotide
  Target: ATXN1; (+) strand; PAM type: NRG; PAM sequence: CAG
ttcaagcagtcctcccacct

SEQ ID NO: 107873 - DNA, 20 bp, Artificial Sequence
  Description of Artificial Sequence: Synthetic oligonucleotide
  Target: ATXN1; (+) strand; PAM type: NRG; PAM sequence: TGG
acctcagcttcccaaaatgc

SEQ ID NO: 107874 - DNA, 20 bp, Artificial Sequence
  Description of Artificial Sequence: Synthetic oligonucleotide
  Target: ATXN1; (+) strand; PAM type: NRG; PAM sequence: GGG
cctcagcttcccaaaatgct

SEQ ID NO: 107875 - DNA, 20 bp, Artificial Sequence
  Description of Artificial Sequence: Synthetic oligonucleotide
  Target: ATXN1; (+) strand; PAM type: NRG; PAM sequence: GAG
tcagcttcccaaaatgctgg

SEQ ID NO: 107876 - DNA, 20 bp, Artificial Sequence
  Description of Artificial Sequence: Synthetic oligonucleotide
  Target: ATXN1; (+) strand; PAM type: NRG; PAM sequence: TAG
ttcccaaaatgctgggagta

SEQ ID NO: 107877 - DNA, 20 bp, Artificial Sequence
  Description of Artificial Sequence: Synthetic oligonucleotide
  Target: ATXN1; (+) strand; PAM type: NRG; PAM sequence: AGG
tcccaaaatgctgggagtat

SEQ ID NO: 107878 - DNA, 20 bp, Artificial Sequence
  Description of Artificial Sequence: Synthetic oligonucleotide
  Target: ATXN1; (+) strand; PAM type: NRG; PAM sequence: GAG
aatgctgggagtataggcat

SEQ ID NO: 107879 - DNA, 20 bp, Artificial Sequence
  Description of Artificial Sequence: Synthetic oligonucleotide
  Target: ATXN1; (+) strand; PAM type: NRG; PAM sequence: CAG
tgggagtataggcatgagca

SEQ ID NO: 107880 - DNA, 20 bp, Artificial Sequence
  Description of Artificial Sequence: Synthetic oligonucleotide
  Target: ATXN1; (+) strand; PAM type: NRG; PAM sequence: CAG
ataggcatgagcacagtgcc

SEQ ID NO: 107881 - DNA, 20 bp, Artificial Sequence
  Description of Artificial Sequence: Synthetic oligonucleotide
  Target: ATXN1; (+) strand; PAM type: NRG; PAM sequence: AAG
agacctcctcttgacttatt

SEQ ID NO: 107882 - DNA, 20 bp, Artificial Sequence
  Description of Artificial Sequence: Synthetic oligonucleotide
  Target: ATXN1; (+) strand; PAM type: NRG; PAM sequence: CAG
aagttattatgatgccgatt

SEQ ID NO: 107883 - DNA, 20 bp, Artificial Sequence
  Description of Artificial Sequence: Synthetic oligonucleotide
  Target: ATXN1; (+) strand; PAM type: NRG; PAM sequence: AAG
tattatgatgccgattcagc

SEQ ID NO: 107884 - DNA, 20 bp, Artificial Sequence
  Description of Artificial Sequence: Synthetic oligonucleotide
  Target: ATXN1; (+) strand; PAM type: NRG; PAM sequence: TGG
cgattcagcaagcccactac

SEQ ID NO: 107885 - DNA, 20 bp, Artificial Sequence
  Description of Artificial Sequence: Synthetic oligonucleotide
  Target: ATXN1; (+) strand; PAM type: NRG; PAM sequence: GGG
gattcagcaagcccactact

SEQ ID NO: 107886 - DNA, 20 bp, Artificial Sequence
  Description of Artificial Sequence: Synthetic oligonucleotide
  Target: ATXN1; (+) strand; PAM type: NRG; PAM sequence: CAG
cccactactgggtatctacc

SEQ ID NO: 107887 - DNA, 20 bp, Artificial Sequence
  Description of Artificial Sequence: Synthetic oligonucleotide
  Target: ATXN1; (+) strand; PAM type: NRG; PAM sequence: GAG
cactactgggtatctaccca

SEQ ID NO: 107888 - DNA, 20 bp, Artificial Sequence
  Description of Artificial Sequence: Synthetic oligonucleotide
  Target: ATXN1; (+) strand; PAM type: NRG; PAM sequence: AGG
actactgggtatctacccag

SEQ ID NO: 107889 - DNA, 20 bp, Artificial Sequence
  Description of Artificial Sequence: Synthetic oligonucleotide
  Target: ATXN1; (+) strand; PAM type: NRG; PAM sequence: AAG
gtatctacccagaggaaaat

SEQ ID NO: 107890 - DNA, 20 bp, Artificial Sequence
  Description of Artificial Sequence: Synthetic oligonucleotide
  Target: ATXN1; (+) strand; PAM type: NRG; PAM sequence: AAG
aaataagtcattattcgaaa

SEQ ID NO: 107891 - DNA, 20 bp, Artificial Sequence
  Description of Artificial Sequence: Synthetic oligonucleotide
  Target: ATXN1; (+) strand; PAM type: NRG; PAM sequence: TAG
tacttgcacacgcatgttta

SEQ ID NO: 107892 - DNA, 20 bp, Artificial Sequence
  Description of Artificial Sequence: Synthetic oligonucleotide
  Target: ATXN1; (+) strand; PAM type: NRG; PAM sequence: CAG
ttgcacacgcatgtttatag

SEQ ID NO: 107893 - DNA, 20 bp, Artificial Sequence
  Description of Artificial Sequence: Synthetic oligonucleotide
  Target: ATXN1; (+) strand; PAM type: NRG; PAM sequence: TGG
aattcacaattgcaaaatca

SEQ ID NO: 107894 - DNA, 20 bp, Artificial Sequence
  Description of Artificial Sequence: Synthetic oligonucleotide
  Target: ATXN1; (+) strand; PAM type: NRG; PAM sequence: GAG
aacccaaatgcccatcaatt

SEQ ID NO: 107895 - DNA, 20 bp, Artificial Sequence
  Description of Artificial Sequence: Synthetic oligonucleotide
  Target: ATXN1; (+) strand; PAM type: NRG; PAM sequence: TGG
ccaaatgcccatcaattgag

SEQ ID NO: 107896 - DNA, 20 bp, Artificial Sequence
  Description of Artificial Sequence: Synthetic oligonucleotide
  Target: ATXN1; (+) strand; PAM type: NRG; PAM sequence: AAG
gcccatcaattgagtggata

SEQ ID NO: 107897 - DNA, 20 bp, Artificial Sequence
  Description of Artificial Sequence: Synthetic oligonucleotide
  Target: ATXN1; (+) strand; PAM type: NRG; PAM sequence: AGG
cccatcaattgagtggataa

SEQ ID NO: 107898 - DNA, 20 bp, Artificial Sequence
  Description of Artificial Sequence: Synthetic oligonucleotide
  Target: ATXN1; (+) strand; PAM type: NRG; PAM sequence: TGG
ttgagtggataaaggaactg

SEQ ID NO: 107899 - DNA, 20 bp, Artificial Sequence
  Description of Artificial Sequence: Synthetic oligonucleotide
  Target: ATXN1; (+) strand; PAM type: NRG; PAM sequence: TGG
actgtggtacatatatatga

SEQ ID NO: 107900 - DNA, 20 bp, Artificial Sequence
  Description of Artificial Sequence: Synthetic oligonucleotide
  Target: ATXN1; (+) strand; PAM type: NRG; PAM sequence: CAG
atatatgatggaatactact

SEQ ID NO: 107901 - DNA, 20 bp, Artificial Sequence
  Description of Artificial Sequence: Synthetic oligonucleotide
  Target: ATXN1; (+) strand; PAM type: NRG; PAM sequence: AAG
gaatactactcagccataaa

SEQ ID NO: 107902 - DNA, 20 bp, Artificial Sequence
  Description of Artificial Sequence: Synthetic oligonucleotide
  Target: ATXN1; (+) strand; PAM type: NRG; PAM sequence: AGG
aatactactcagccataaaa

SEQ ID NO: 107903 - DNA, 20 bp, Artificial Sequence
  Description of Artificial Sequence: Synthetic oligonucleotide
  Target: ATXN1; (+) strand; PAM type: NRG; PAM sequence: CAG
cataaaaaggaatgaattaa

SEQ ID NO: 107904 - DNA, 20 bp, Artificial Sequence
  Description of Artificial Sequence: Synthetic oligonucleotide
  Target: ATXN1; (+) strand; PAM type: NRG; PAM sequence: CAG
gaatgaattaacagcatttg

SEQ ID NO: 107905 - DNA, 20 bp, Artificial Sequence
  Description of Artificial Sequence: Synthetic oligonucleotide
  Target: ATXN1; (+) strand; PAM type: NRG; PAM sequence: TGG
taacagcatttgcagtgacc

SEQ ID NO: 107906 - DNA, 20 bp, Artificial Sequence
  Description of Artificial Sequence: Synthetic oligonucleotide
  Target: ATXN1; (+) strand; PAM type: NRG; PAM sequence: GAG
gcatttgcagtgacctggat

SEQ ID NO: 107907 - DNA, 20 bp, Artificial Sequence
  Description of Artificial Sequence: Synthetic oligonucleotide
  Target: ATXN1; (+) strand; PAM type: NRG; PAM sequence: TGG
tgcagtgacctggatgagat

SEQ ID NO: 107908 - DNA, 20 bp, Artificial Sequence
  Description of Artificial Sequence: Synthetic oligonucleotide
  Target: ATXN1; (+) strand; PAM type: NRG; PAM sequence: GAG
cagtgacctggatgagattg

SEQ ID NO: 107909 - DNA, 20 bp, Artificial Sequence
  Description of Artificial Sequence: Synthetic oligonucleotide
  Target: ATXN1; (+) strand; PAM type: NRG; PAM sequence: AAG
agattggagactattattct

SEQ ID NO: 107910 - DNA, 20 bp, Artificial Sequence
  Description of Artificial Sequence: Synthetic oligonucleotide
  Target: ATXN1; (+) strand; PAM type: NRG; PAM sequence: AAG
ggagactattattctaagtg

SEQ ID NO: 107911 - DNA, 20 bp, Artificial Sequence
  Description of Artificial Sequence: Synthetic oligonucleotide
  Target: ATXN1; (+) strand; PAM type: NRG; PAM sequence: AAG
tattctaagtgaagtaactc

SEQ ID NO: 107912 - DNA, 20 bp, Artificial Sequence
  Description of Artificial Sequence: Synthetic oligonucleotide
  Target: ATXN1; (+) strand; PAM type: NRG; PAM sequence: TGG
taagtgaagtaactcaagaa

SEQ ID NO: 107913 - DNA, 20 bp, Artificial Sequence
  Description of Artificial Sequence: Synthetic oligonucleotide
  Target: ATXN1; (+) strand; PAM type: NRG; PAM sequence: GAG
atatgttctcactgatatgt

SEQ ID NO: 107914 - DNA, 20 bp, Artificial Sequence
  Description of Artificial Sequence: Synthetic oligonucleotide
  Target: ATXN1; (+) strand; PAM type: NRG; PAM sequence: GAG
atgttctcactgatatgtga

SEQ ID NO: 107915 - DNA, 20 bp, Artificial Sequence
  Description of Artificial Sequence: Synthetic oligonucleotide
  Target: ATXN1; (+) strand; PAM type: NRG; PAM sequence: AAG
ctcactgatatgtgagagct

SEQ ID NO: 107916 - DNA, 20 bp, Artificial Sequence
  Description of Artificial Sequence: Synthetic oligonucleotide
  Target: ATXN1; (+) strand; PAM type: NRG; PAM sequence: GAG
atatgtgagagctaagctat

SEQ ID NO: 107917 - DNA, 20 bp, Artificial Sequence
  Description of Artificial Sequence: Synthetic oligonucleotide
  Target: ATXN1; (+) strand; PAM type: NRG; PAM sequence: AGG
tatgtgagagctaagctatg

SEQ ID NO: 107918 - DNA, 20 bp, Artificial Sequence
  Description of Artificial Sequence: Synthetic oligonucleotide
  Target: ATXN1; (+) strand; PAM type: NRG; PAM sequence: AAG
agctaagctatgaggatgca

SEQ ID NO: 107919 - DNA, 20 bp, Artificial Sequence
  Description of Artificial Sequence: Synthetic oligonucleotide
  Target: ATXN1; (+) strand; PAM type: NRG; PAM sequence: AGG
gctaagctatgaggatgcaa

SEQ ID NO: 107920 - DNA, 20 bp, Artificial Sequence
  Description of Artificial Sequence: Synthetic oligonucleotide
  Target: ATXN1; (+) strand; PAM type: NRG; PAM sequence: AAG
ctatgaggatgcaaaggcat

SEQ ID NO: 107921 - DNA, 20 bp, Artificial Sequence
  Description of Artificial Sequence: Synthetic oligonucleotide
  Target: ATXN1; (+) strand; PAM type: NRG; PAM sequence: CAG
gcaaaggcataagaatgata

SEQ ID NO: 107922 - DNA, 20 bp, Artificial Sequence
  Description of Artificial Sequence: Synthetic oligonucleotide
  Target: ATXN1; (+) strand; PAM type: NRG; PAM sequence: CGG
aaggcataagaatgatacag

SEQ ID NO: 107923 - DNA, 20 bp, Artificial Sequence
  Description of Artificial Sequence: Synthetic oligonucleotide
  Target: ATXN1; (+) strand; PAM type: NRG; PAM sequence: TGG
aagaatgatacagcggactt

SEQ ID NO: 107924 - DNA, 20 bp, Artificial Sequence
  Description of Artificial Sequence: Synthetic oligonucleotide
  Target: ATXN1; (+) strand; PAM type: NRG; PAM sequence: GGG
agaatgatacagcggacttt

SEQ ID NO: 107925 - DNA, 20 bp, Artificial Sequence
  Description of Artificial Sequence: Synthetic oligonucleotide
  Target: ATXN1; (+) strand; PAM type: NRG; PAM sequence: TAG
tacagcggactttgggcact

SEQ ID NO: 107926 - DNA, 20 bp, Artificial Sequence
  Description of Artificial Sequence: Synthetic oligonucleotide
  Target: ATXN1; (+) strand; PAM type: NRG; PAM sequence: AGG
acagcggactttgggcactt

SEQ ID NO: 107927 - DNA, 20 bp, Artificial Sequence
  Description of Artificial Sequence: Synthetic oligonucleotide
  Target: ATXN1; (+) strand; PAM type: NRG; PAM sequence: GGG
cagcggactttgggcactta

SEQ ID NO: 107928 - DNA, 20 bp, Artificial Sequence
  Description of Artificial Sequence: Synthetic oligonucleotide
  Target: ATXN1; (+) strand; PAM type: NRG; PAM sequence: GGG
agcggactttgggcacttag

SEQ ID NO: 107929 - DNA, 20 bp, Artificial Sequence
  Description of Artificial Sequence: Synthetic oligonucleotide
  Target: ATXN1; (+) strand; PAM type: NRG; PAM sequence: GGG
gcggactttgggcacttagg

SEQ ID NO: 107930 - DNA, 20 bp, Artificial Sequence
  Description of Artificial Sequence: Synthetic oligonucleotide
  Target: ATXN1; (+) strand; PAM type: NRG; PAM sequence: AAG
gactttgggcacttaggggg

SEQ ID NO: 107931 - DNA, 20 bp, Artificial Sequence
  Description of Artificial Sequence: Synthetic oligonucleotide
  Target: ATXN1; (+) strand; PAM type: NRG; PAM sequence: GAG
ctttgggcacttagggggaa

SEQ ID NO: 107932 - DNA, 20 bp, Artificial Sequence
  Description of Artificial Sequence: Synthetic oligonucleotide
  Target: ATXN1; (+) strand; PAM type: NRG; PAM sequence: TGG
tgggcacttagggggaagag

SEQ ID NO: 107933 - DNA, 20 bp, Artificial Sequence
  Description of Artificial Sequence: Synthetic oligonucleotide
  Target: ATXN1; (+) strand; PAM type: NRG; PAM sequence: GGG
gggcacttagggggaagagt

SEQ ID NO: 107934 - DNA, 20 bp, Artificial Sequence
  Description of Artificial Sequence: Synthetic oligonucleotide
  Target: ATXN1; (+) strand; PAM type: NRG; PAM sequence: GAG
gcacttagggggaagagtgg

SEQ ID NO: 107935 - DNA, 20 bp, Artificial Sequence
  Description of Artificial Sequence: Synthetic oligonucleotide
  Target: ATXN1; (+) strand; PAM type: NRG; PAM sequence: TGG
cttagggggaagagtgggag

SEQ ID NO: 107936 - DNA, 20 bp, Artificial Sequence
  Description of Artificial Sequence: Synthetic oligonucleotide
  Target: ATXN1; (+) strand; PAM type: NRG; PAM sequence: GGG
ttagggggaagagtgggagt

SEQ ID NO: 107937 - DNA, 20 bp, Artificial Sequence
  Description of Artificial Sequence: Synthetic oligonucleotide
  Target: ATXN1; (+) strand; PAM type: NRG; PAM sequence: GGG
tagggggaagagtgggagtg

SEQ ID NO: 107938 - DNA, 20 bp, Artificial Sequence
  Description of Artificial Sequence: Synthetic oligonucleotide
  Target: ATXN1; (+) strand; PAM type: NRG; PAM sequence: GAG
gggggaagagtgggagtggg

SEQ ID NO: 107939 - DNA, 20 bp, Artificial Sequence
  Description of Artificial Sequence: Synthetic oligonucleotide
  Target: ATXN1; (+) strand; PAM type: NRG; PAM sequence: GAG
gggaagagtgggagtgggga

SEQ ID NO: 107940 - DNA, 20 bp, Artificial Sequence
  Description of Artificial Sequence: Synthetic oligonucleotide
  Target: ATXN1; (+) strand; PAM type: NRG; PAM sequence: AGG
ggaagagtgggagtggggag

SEQ ID NO: 107941 - DNA, 20 bp, Artificial Sequence
  Description of Artificial Sequence: Synthetic oligonucleotide
  Target: ATXN1; (+) strand; PAM type: NRG; PAM sequence: GGG
gaagagtgggagtggggaga

SEQ ID NO: 107942 - DNA, 20 bp, Artificial Sequence
  Description of Artificial Sequence: Synthetic oligonucleotide
  Target: ATXN1; (+) strand; PAM type: NRG; PAM sequence: AAG
gggagtggggagagggataa

SEQ ID NO: 107943 - DNA, 20 bp, Artificial Sequence
  Description of Artificial Sequence: Synthetic oligonucleotide
  Target: ATXN1; (+) strand; PAM type: NRG; PAM sequence: TGG
gggataaaagactgcaaata

SEQ ID NO: 107944 - DNA, 20 bp, Artificial Sequence
  Description of Artificial Sequence: Synthetic oligonucleotide
  Target: ATXN1; (+) strand; PAM type: NRG; PAM sequence: CAG
aaaagactgcaaatatggtg

SEQ ID NO: 107945 - DNA, 20 bp, Artificial Sequence
  Description of Artificial Sequence: Synthetic oligonucleotide
  Target: ATXN1; (+) strand; PAM type: NRG; PAM sequence: CAG
atggtgcagtgtatactgct

SEQ ID NO: 107946 - DNA, 20 bp, Artificial Sequence
  Description of Artificial Sequence: Synthetic oligonucleotide
  Target: ATXN1; (+) strand; PAM type: NRG; PAM sequence: AGG
tggtgcagtgtatactgctc

SEQ ID NO: 107947 - DNA, 20 bp, Artificial Sequence
  Description of Artificial Sequence: Synthetic oligonucleotide
  Target: ATXN1; (+) strand; PAM type: NRG; PAM sequence: TGG
agtgtatactgctcaggtga

SEQ ID NO: 107948 - DNA, 20 bp, Artificial Sequence
  Description of Artificial Sequence: Synthetic oligonucleotide
  Target: ATXN1; (+) strand; PAM type: NRG; PAM sequence: GGG
gtgtatactgctcaggtgat

SEQ ID NO: 107949 - DNA, 20 bp, Artificial Sequence
  Description of Artificial Sequence: Synthetic oligonucleotide
  Target: ATXN1; (+) strand; PAM type: NRG; PAM sequence: AAG
aatctcacaaatcgccacta

SEQ ID NO: 107950 - DNA, 20 bp, Artificial Sequence
  Description of Artificial Sequence: Synthetic oligonucleotide
  Target: ATXN1; (+) strand; PAM type: NRG; PAM sequence: CGG
acctgtatcccaataactta

SEQ ID NO: 107951 - DNA, 20 bp, Artificial Sequence
  Description of Artificial Sequence: Synthetic oligonucleotide
  Target: ATXN1; (+) strand; PAM type: NRG; PAM sequence: AAG
aaaaataaaataaaaatttt

SEQ ID NO: 107952 - DNA, 20 bp, Artificial Sequence
  Description of Artificial Sequence: Synthetic oligonucleotide
  Target: ATXN1; (+) strand; PAM type: NRG; PAM sequence: AAG
aataaaataaaaattttaag

SEQ ID NO: 107953 - DNA, 20 bp, Artificial Sequence
  Description of Artificial Sequence: Synthetic oligonucleotide
  Target: ATXN1; (+) strand; PAM type: NRG; PAM sequence: AAG
ttatgccacttattttgaat

SEQ ID NO: 107954 - DNA, 20 bp, Artificial Sequence
  Description of Artificial Sequence: Synthetic oligonucleotide
  Target: ATXN1; (+) strand; PAM type: NRG; PAM sequence: AAG
cttgtgatgcaacgcaactg

SEQ ID NO: 107955 - DNA, 20 bp, Artificial Sequence
  Description of Artificial Sequence: Synthetic oligonucleotide
  Target: ATXN1; (+) strand; PAM type: NRG; PAM sequence: TAG
ttgtgtcctccatgacactc

SEQ ID NO: 107956 - DNA, 20 bp, Artificial Sequence
  Description of Artificial Sequence: Synthetic oligonucleotide
  Target: ATXN1; (+) strand; PAM type: NRG; PAM sequence: CAG
tcctccatgacactctagaa

SEQ ID NO: 107957 - DNA, 20 bp, Artificial Sequence
  Description of Artificial Sequence: Synthetic oligonucleotide
  Target: ATXN1; (+) strand; PAM type: NRG; PAM sequence: AAG
actctagaacagtgctatgc

SEQ ID NO: 107958 - DNA, 20 bp, Artificial Sequence
  Description of Artificial Sequence: Synthetic oligonucleotide
  Target: ATXN1; (+) strand; PAM type: NRG; PAM sequence: CAG
ctagaacagtgctatgcaag

SEQ ID NO: 107959 - DNA, 20 bp, Artificial Sequence
  Description of Artificial Sequence: Synthetic oligonucleotide
  Target: ATXN1; (+) strand; PAM type: NRG; PAM sequence: AAG
aacagtgctatgcaagcaga

SEQ ID NO: 107960 - DNA, 20 bp, Artificial Sequence
  Description of Artificial Sequence: Synthetic oligonucleotide
  Target: ATXN1; (+) strand; PAM type: NRG; PAM sequence: CAG
gctatgcaagcagaaagtaa

SEQ ID NO: 107961 - DNA, 20 bp, Artificial Sequence
  Description of Artificial Sequence: Synthetic oligonucleotide
  Target: ATXN1; (+) strand; PAM type: NRG; PAM sequence: CAG
ataaccatacactgaacatc

SEQ ID NO: 107962 - DNA, 20 bp, Artificial Sequence
  Description of Artificial Sequence: Synthetic oligonucleotide
  Target: ATXN1; (+) strand; PAM type: NRG; PAM sequence: AGG
taaccatacactgaacatcc

SEQ ID NO: 107963 - DNA, 20 bp, Artificial Sequence
  Description of Artificial Sequence: Synthetic oligonucleotide
  Target: ATXN1; (+) strand; PAM type: NRG; PAM sequence: AAG
ccatacactgaacatccagg

SEQ ID NO: 107964 - DNA, 20 bp, Artificial Sequence
  Description of Artificial Sequence: Synthetic oligonucleotide
  Target: ATXN1; (+) strand; PAM type: NRG; PAM sequence: CAG
aacatccaggaagtgctaac

SEQ ID NO: 107965 - DNA, 20 bp, Artificial Sequence
  Description of Artificial Sequence: Synthetic oligonucleotide
  Target: ATXN1; (+) strand; PAM type: NRG; PAM sequence: AGG
acatccaggaagtgctaacc

SEQ ID NO: 107966 - DNA, 20 bp, Artificial Sequence
  Description of Artificial Sequence: Synthetic oligonucleotide
  Target: ATXN1; (+) strand; PAM type: NRG; PAM sequence: TAG
gtgctaaccaggtactgcac

SEQ ID NO: 107967 - DNA, 20 bp, Artificial Sequence
  Description of Artificial Sequence: Synthetic oligonucleotide
  Target: ATXN1; (+) strand; PAM type: NRG; PAM sequence: AGG
tgctaaccaggtactgcact

SEQ ID NO: 107968 - DNA, 20 bp, Artificial Sequence
  Description of Artificial Sequence: Synthetic oligonucleotide
  Target: ATXN1; (+) strand; PAM type: NRG; PAM sequence: TAG
ccaggtactgcactaggtat

SEQ ID NO: 107969 - DNA, 20 bp, Artificial Sequence
  Description of Artificial Sequence: Synthetic oligonucleotide
  Target: ATXN1; (+) strand; PAM type: NRG; PAM sequence: AGG
caggtactgcactaggtatt

SEQ ID NO: 107970 - DNA, 20 bp, Artificial Sequence
  Description of Artificial Sequence: Synthetic oligonucleotide
  Target: ATXN1; (+) strand; PAM type: NRG; PAM sequence: GGG
aggtactgcactaggtatta

SEQ ID NO: 107971 - DNA, 20 bp, Artificial Sequence
  Description of Artificial Sequence: Synthetic oligonucleotide
  Target: ATXN1; (+) strand; PAM type: NRG; PAM sequence: CAG
tgcactaggtattagggaaa

SEQ ID NO: 107972 - DNA, 20 bp, Artificial Sequence
  Description of Artificial Sequence: Synthetic oligonucleotide
  Target: ATXN1; (+) strand; PAM type: NRG; PAM sequence: GAG
cactaggtattagggaaaca

SEQ ID NO: 107973 - DNA, 20 bp, Artificial Sequence
  Description of Artificial Sequence: Synthetic oligonucleotide
  Target: ATXN1; (+) strand; PAM type: NRG; PAM sequence: GAG
ggtattagggaaacagagat

SEQ ID NO: 107974 - DNA, 20 bp, Artificial Sequence
  Description of Artificial Sequence: Synthetic oligonucleotide
  Target: ATXN1; (+) strand; PAM type: NRG; PAM sequence: CAG
aaacagagatgagtaaaatt

SEQ ID NO: 107975 - DNA, 20 bp, Artificial Sequence
  Description of Artificial Sequence: Synthetic oligonucleotide
  Target: ATXN1; (+) strand; PAM type: NRG; PAM sequence: GAG
gagatgagtaaaattcagtt

SEQ ID NO: 107976 - DNA, 20 bp, Artificial Sequence
  Description of Artificial Sequence: Synthetic oligonucleotide
  Target: ATXN1; (+) strand; PAM type: NRG; PAM sequence: TGG
gttgagactccatgtcttgt

SEQ ID NO: 107977 - DNA, 20 bp, Artificial Sequence
  Description of Artificial Sequence: Synthetic oligonucleotide
  Target: ATXN1; (+) strand; PAM type: NRG; PAM sequence: GGG
ttgagactccatgtcttgtt

SEQ ID NO: 107978 - DNA, 20 bp, Artificial Sequence
  Description of Artificial Sequence: Synthetic oligonucleotide
  Target: ATXN1; (+) strand; PAM type: NRG; PAM sequence: CAG
ctccatgtcttgttgggaac

SEQ ID NO: 107979 - DNA, 20 bp, Artificial Sequence
  Description of Artificial Sequence: Synthetic oligonucleotide
  Target: ATXN1; (+) strand; PAM type: NRG; PAM sequence: AGG
tccatgtcttgttgggaacc

SEQ ID NO: 107980 - DNA, 20 bp, Artificial Sequence
  Description of Artificial Sequence: Synthetic oligonucleotide
  Target: ATXN1; (+) strand; PAM type: NRG; PAM sequence: TAG
tgttgggaaccaggcacgtg

SEQ ID NO: 107981 - DNA, 20 bp, Artificial Sequence
  Description of Artificial Sequence: Synthetic oligonucleotide
  Target: ATXN1; (+) strand; PAM type: NRG; PAM sequence: GAG
ttgggaaccaggcacgtgta

SEQ ID NO: 107982 - DNA, 20 bp, Artificial Sequence
  Description of Artificial Sequence: Synthetic oligonucleotide
  Target: ATXN1; (+) strand; PAM type: NRG; PAM sequence: AGG
tgggaaccaggcacgtgtag

SEQ ID NO: 107983 - DNA, 20 bp, Artificial Sequence
  Description of Artificial Sequence: Synthetic oligonucleotide
  Target: ATXN1; (+) strand; PAM type: NRG; PAM sequence: CAG
gtgtagaggtcactcttacg

SEQ ID NO: 107984 - DNA, 20 bp, Artificial Sequence
  Description of Artificial Sequence: Synthetic oligonucleotide
  Target: ATXN1; (+) strand; PAM type: NRG; PAM sequence: AGG
tgtagaggtcactcttacgc

SEQ ID NO: 107985 - DNA, 20 bp, Artificial Sequence
  Description of Artificial Sequence: Synthetic oligonucleotide
  Target: ATXN1; (+) strand; PAM type: NRG; PAM sequence: CAG
gcaggtaataaatgactcta

SEQ ID NO: 107986 - DNA, 20 bp, Artificial Sequence
  Description of Artificial Sequence: Synthetic oligonucleotide
  Target: ATXN1; (+) strand; PAM type: NRG; PAM sequence: GAG
aggtaataaatgactctaca

SEQ ID NO: 107987 - DNA, 20 bp, Artificial Sequence
  Description of Artificial Sequence: Synthetic oligonucleotide
  Target: ATXN1; (+) strand; PAM type: NRG; PAM sequence: AGG
ggtaataaatgactctacag

SEQ ID NO: 107988 - DNA, 20 bp, Artificial Sequence
  Description of Artificial Sequence: Synthetic oligonucleotide
  Target: ATXN1; (+) strand; PAM type: NRG; PAM sequence: CAG
aaatgactctacagaggcat

SEQ ID NO: 107989 - DNA, 20 bp, Artificial Sequence
  Description of Artificial Sequence: Synthetic oligonucleotide
  Target: ATXN1; (+) strand; PAM type: NRG; PAM sequence: AAG
gactctacagaggcatcagc

SEQ ID NO: 107990 - DNA, 20 bp, Artificial Sequence
  Description of Artificial Sequence: Synthetic oligonucleotide
  Target: ATXN1; (+) strand; PAM type: NRG; PAM sequence: TGG
cagaggcatcagcaagacgc

SEQ ID NO: 107991 - DNA, 20 bp, Artificial Sequence
  Description of Artificial Sequence: Synthetic oligonucleotide
  Target: ATXN1; (+) strand; PAM type: NRG; PAM sequence: AAG
aggcatcagcaagacgctgg

SEQ ID NO: 107992 - DNA, 20 bp, Artificial Sequence
  Description of Artificial Sequence: Synthetic oligonucleotide
  Target: ATXN1; (+) strand; PAM type: NRG; PAM sequence: AGG
ggcatcagcaagacgctgga

SEQ ID NO: 107993 - DNA, 20 bp, Artificial Sequence
  Description of Artificial Sequence: Synthetic oligonucleotide
  Target: ATXN1; (+) strand; PAM type: NRG; PAM sequence: GAG
catcagcaagacgctggaag

SEQ ID NO: 107994 - DNA, 20 bp, Artificial Sequence
  Description of Artificial Sequence: Synthetic oligonucleotide
  Target: ATXN1; (+) strand; PAM type: NRG; PAM sequence: AAG
aagacgctggaaggagaaat

SEQ ID NO: 107995 - DNA, 20 bp, Artificial Sequence
  Description of Artificial Sequence: Synthetic oligonucleotide
  Target: ATXN1; (+) strand; PAM type: NRG; PAM sequence: CAG
cgctggaaggagaaataagt

SEQ ID NO: 107996 - DNA, 20 bp, Artificial Sequence
  Description of Artificial Sequence: Synthetic oligonucleotide
  Target: ATXN1; (+) strand; PAM type: NRG; PAM sequence: CAG
tggaaggagaaataagtcag

SEQ ID NO: 107997 - DNA, 20 bp, Artificial Sequence
  Description of Artificial Sequence: Synthetic oligonucleotide
  Target: ATXN1; (+) strand; PAM type: NRG; PAM sequence: AAG
cagcagcaactcactctgca

SEQ ID NO: 107998 - DNA, 20 bp, Artificial Sequence
  Description of Artificial Sequence: Synthetic oligonucleotide
  Target: ATXN1; (+) strand; PAM type: NRG; PAM sequence: AAG
cagcaactcactctgcaaag

SEQ ID NO: 107999 - DNA, 20 bp, Artificial Sequence
  Description of Artificial Sequence: Synthetic oligonucleotide
  Target: ATXN1; (+) strand; PAM type: NRG; PAM sequence: CAG
tcactctgcaaagaagtgta

SEQ ID NO: 108000 - DNA, 20 bp, Artificial Sequence
  Description of Artificial Sequence: Synthetic oligonucleotide
  Target: ATXN1; (+) strand; PAM type: NRG; PAM sequence: AGG
cactctgcaaagaagtgtac

SEQ ID NO: 108001 - DNA, 20 bp, Artificial Sequence
  Description of Artificial Sequence: Synthetic oligonucleotide
  Target: ATXN1; (+) strand; PAM type: NRG; PAM sequence: AAG
tctgcaaagaagtgtacagg

SEQ ID NO: 108002 - DNA, 20 bp, Artificial Sequence
  Description of Artificial Sequence: Synthetic oligonucleotide
  Target: ATXN1; (+) strand; PAM type: NRG; PAM sequence: TAG
aagaagtgtacaggaagctc

SEQ ID NO: 108003 - DNA, 20 bp, Artificial Sequence
  Description of Artificial Sequence: Synthetic oligonucleotide
  Target: ATXN1; (+) strand; PAM type: NRG; PAM sequence: TGG
agtgtacaggaagctctaga

SEQ ID NO: 108004 - DNA, 20 bp, Artificial Sequence
  Description of Artificial Sequence: Synthetic oligonucleotide
  Target: ATXN1; (+) strand; PAM type: NRG; PAM sequence: GGG
gtgtacaggaagctctagat

SEQ ID NO: 108005 - DNA, 20 bp, Artificial Sequence
  Description of Artificial Sequence: Synthetic oligonucleotide
  Target: ATXN1; (+) strand; PAM type: NRG; PAM sequence: AAG
tcatttttgaacatatcctc

SEQ ID NO: 108006 - DNA, 20 bp, Artificial Sequence
  Description of Artificial Sequence: Synthetic oligonucleotide
  Target: ATXN1; (+) strand; PAM type: NRG; PAM sequence: GAG
tttgaacatatcctcaagat

SEQ ID NO: 108007 - DNA, 20 bp, Artificial Sequence
  Description of Artificial Sequence: Synthetic oligonucleotide
  Target: ATXN1; (+) strand; PAM type: NRG; PAM sequence: AAG
atcctcaagatgagttttga

SEQ ID NO: 108008 - DNA, 20 bp, Artificial Sequence
  Description of Artificial Sequence: Synthetic oligonucleotide
  Target: ATXN1; (+) strand; PAM type: NRG; PAM sequence: AGG
tcctcaagatgagttttgaa

SEQ ID NO: 108009 - DNA, 20 bp, Artificial Sequence
  Description of Artificial Sequence: Synthetic oligonucleotide
  Target: ATXN1; (+) strand; PAM type: NRG; PAM sequence: AAG
tttgaaaggataaactcaat

SEQ ID NO: 108010 - DNA, 20 bp, Artificial Sequence
  Description of Artificial Sequence: Synthetic oligonucleotide
  Target: ATXN1; (+) strand; PAM type: NRG; PAM sequence: TGG
gaaaggataaactcaataag

SEQ ID NO: 108011 - DNA, 20 bp, Artificial Sequence
  Description of Artificial Sequence: Synthetic oligonucleotide
  Target: ATXN1; (+) strand; PAM type: NRG; PAM sequence: AAG
aactcaataagtggcttaaa

SEQ ID NO: 108012 - DNA, 20 bp, Artificial Sequence
  Description of Artificial Sequence: Synthetic oligonucleotide
  Target: ATXN1; (+) strand; PAM type: NRG; PAM sequence: AAG
caataagtggcttaaaaagt

SEQ ID NO: 108013 - DNA, 20 bp, Artificial Sequence
  Description of Artificial Sequence: Synthetic oligonucleotide
  Target: ATXN1; (+) strand; PAM type: NRG; PAM sequence: AAG
agtggcttaaaaagtaagaa

SEQ ID NO: 108014 - DNA, 20 bp, Artificial Sequence
  Description of Artificial Sequence: Synthetic oligonucleotide
  Target: ATXN1; (+) strand; PAM type: NRG; PAM sequence: GAG
tggcttaaaaagtaagaaaa

SEQ ID NO: 108015 - DNA, 20 bp, Artificial Sequence
  Description of Artificial Sequence: Synthetic oligonucleotide
  Target: ATXN1; (+) strand; PAM type: NRG; PAM sequence: AGG
ggcttaaaaagtaagaaaag

SEQ ID NO: 108016 - DNA, 20 bp, Artificial Sequence
  Description of Artificial Sequence: Synthetic oligonucleotide
  Target: ATXN1; (+) strand; PAM type: NRG; PAM sequence: AAG
ttaaaaagtaagaaaagagg

SEQ ID NO: 108017 - DNA, 20 bp, Artificial Sequence
  Description of Artificial Sequence: Synthetic oligonucleotide
  Target: ATXN1; (+) strand; PAM type: NRG; PAM sequence: AGG
taaaaagtaagaaaagagga

SEQ ID NO: 108018 - DNA, 20 bp, Artificial Sequence
  Description of Artificial Sequence: Synthetic oligonucleotide
  Target: ATXN1; (+) strand; PAM type: NRG; PAM sequence: AAG
aagtaagaaaagaggaagga

SEQ ID NO: 108019 - DNA, 20 bp, Artificial Sequence
  Description of Artificial Sequence: Synthetic oligonucleotide
  Target: ATXN1; (+) strand; PAM type: NRG; PAM sequence: AGG
agtaagaaaagaggaaggaa

SEQ ID NO: 108020 - DNA, 20 bp, Artificial Sequence
  Description of Artificial Sequence: Synthetic oligonucleotide
  Target: ATXN1; (+) strand; PAM type: NRG; PAM sequence: AAG
aagaggaaggaaaggaaaac

SEQ ID NO: 108021 - DNA, 20 bp, Artificial Sequence
  Description of Artificial Sequence: Synthetic oligonucleotide
  Target: ATXN1; (+) strand; PAM type: NRG; PAM sequence: AAG
ggaaggaaaggaaaacaaga

SEQ ID NO: 108022 - DNA, 20 bp, Artificial Sequence
  Description of Artificial Sequence: Synthetic oligonucleotide
  Target: ATXN1; (+) strand; PAM type: NRG; PAM sequence: AAG
aggaaaggaaaacaagaaag

SEQ ID NO: 108023 - DNA, 20 bp, Artificial Sequence
  Description of Artificial Sequence: Synthetic oligonucleotide
  Target: ATXN1; (+) strand; PAM type: NRG; PAM sequence: AGG
ggaaaggaaaacaagaaaga

SEQ ID NO: 108024 - DNA, 20 bp, Artificial Sequence
  Description of Artificial Sequence: Synthetic oligonucleotide
  Target: ATXN1; (+) strand; PAM type: NRG; PAM sequence: TAG
acaagaaagaaggaacaaaa

SEQ ID NO: 108025 - DNA, 20 bp, Artificial Sequence
  Description of Artificial Sequence: Synthetic oligonucleotide
  Target: ATXN1; (+) strand; PAM type: NRG; PAM sequence: AGG
caagaaagaaggaacaaaat

SEQ ID NO: 108026 - DNA, 20 bp, Artificial Sequence
  Description of Artificial Sequence: Synthetic oligonucleotide
  Target: ATXN1; (+) strand; PAM type: NRG; PAM sequence: TAG
aaggaacaaaataggaaact

SEQ ID NO: 108027 - DNA, 20 bp, Artificial Sequence
  Description of Artificial Sequence: Synthetic oligonucleotide
  Target: ATXN1; (+) strand; PAM type: NRG; PAM sequence: AGG
aggaacaaaataggaaactt

SEQ ID NO: 108028 - DNA, 20 bp, Artificial Sequence
  Description of Artificial Sequence: Synthetic oligonucleotide
  Target: ATXN1; (+) strand; PAM type: NRG; PAM sequence: TGG
aacaaaataggaaacttagg

SEQ ID NO: 108029 - DNA, 20 bp, Artificial Sequence
  Description of Artificial Sequence: Synthetic oligonucleotide
  Target: ATXN1; (+) strand; PAM type: NRG; PAM sequence: GGG
acaaaataggaaacttaggt

SEQ ID NO: 108030 - DNA, 20 bp, Artificial Sequence
  Description of Artificial Sequence: Synthetic oligonucleotide
  Target: ATXN1; (+) strand; PAM type: NRG; PAM sequence: TGG
gaaacttaggtgggtccaca

SEQ ID NO: 108031 - DNA, 20 bp, Artificial Sequence
  Description of Artificial Sequence: Synthetic oligonucleotide
  Target: ATXN1; (+) strand; PAM type: NRG; PAM sequence: CAG
atggactgtacacatccacc

SEQ ID NO: 108032 - DNA, 20 bp, Artificial Sequence
  Description of Artificial Sequence: Synthetic oligonucleotide
  Target: ATXN1; (+) strand; PAM type: NRG; PAM sequence: CAG
gactgtacacatccacccag

SEQ ID NO: 108033 - DNA, 20 bp, Artificial Sequence
  Description of Artificial Sequence: Synthetic oligonucleotide
  Target: ATXN1; (+) strand; PAM type: NRG; PAM sequence: AGG
actgtacacatccacccagc

SEQ ID NO: 108034 - DNA, 20 bp, Artificial Sequence
  Description of Artificial Sequence: Synthetic oligonucleotide
  Target: ATXN1; (+) strand; PAM type: NRG; PAM sequence: TAG
cacatccacccagcaggcta

SEQ ID NO: 108035 - DNA, 20 bp, Artificial Sequence
  Description of Artificial Sequence: Synthetic oligonucleotide
  Target: ATXN1; (+) strand; PAM type: NRG; PAM sequence: AAG
ctatagaatgtttctctccc

SEQ ID NO: 108036 - DNA, 20 bp, Artificial Sequence
  Description of Artificial Sequence: Synthetic oligonucleotide
  Target: ATXN1; (+) strand; PAM type: NRG; PAM sequence: AGG
tatagaatgtttctctccca

SEQ ID NO: 108037 - DNA, 20 bp, Artificial Sequence
  Description of Artificial Sequence: Synthetic oligonucleotide
  Target: ATXN1; (+) strand; PAM type: NRG; PAM sequence: GGG
atagaatgtttctctcccaa

SEQ ID NO: 108038 - DNA, 20 bp, Artificial Sequence
  Description of Artificial Sequence: Synthetic oligonucleotide
  Target: ATXN1; (+) strand; PAM type: NRG; PAM sequence: TGG
ctctcccaagggcaatgaat

SEQ ID NO: 108039 - DNA, 20 bp, Artificial Sequence
  Description of Artificial Sequence: Synthetic oligonucleotide
  Target: ATXN1; (+) strand; PAM type: NRG; PAM sequence: TAG
ccaagggcaatgaattggtt

SEQ ID NO: 108040 - DNA, 20 bp, Artificial Sequence
  Description of Artificial Sequence: Synthetic oligonucleotide
  Target: ATXN1; (+) strand; PAM type: NRG; PAM sequence: CAG
gcaatgaattggtttagcca

SEQ ID NO: 108041 - DNA, 20 bp, Artificial Sequence
  Description of Artificial Sequence: Synthetic oligonucleotide
  Target: ATXN1; (+) strand; PAM type: NRG; PAM sequence: AGG
caatgaattggtttagccac

SEQ ID NO: 108042 - DNA, 20 bp, Artificial Sequence
  Description of Artificial Sequence: Synthetic oligonucleotide
  Target: ATXN1; (+) strand; PAM type: NRG; PAM sequence: AAG
tagccacaggattttcttca

SEQ ID NO: 108043 - DNA, 20 bp, Artificial Sequence
  Description of Artificial Sequence: Synthetic oligonucleotide
  Target: ATXN1; (+) strand; PAM type: NRG; PAM sequence: AGG
agccacaggattttcttcaa

SEQ ID NO: 108044 - DNA, 20 bp, Artificial Sequence
  Description of Artificial Sequence: Synthetic oligonucleotide
  Target: ATXN1; (+) strand; PAM type: NRG; PAM sequence: GAG
ccacaggattttcttcaaag

SEQ ID NO: 108045 - DNA, 20 bp, Artificial Sequence
  Description of Artificial Sequence: Synthetic oligonucleotide
  Target: ATXN1; (+) strand; PAM type: NRG; PAM sequence: AGG
cacaggattttcttcaaagg

SEQ ID NO: 108046 - DNA, 20 bp, Artificial Sequence
  Description of Artificial Sequence: Synthetic oligonucleotide
  Target: ATXN1; (+) strand; PAM type: NRG; PAM sequence: CAG
aaaggaggtcctcaacatgc

SEQ ID NO: 108047 - DNA, 20 bp, Artificial Sequence
  Description of Artificial Sequence: Synthetic oligonucleotide
  Target: ATXN1; (+) strand; PAM type: NRG; PAM sequence: CGG
ggaggtcctcaacatgccag

SEQ ID NO: 108048 - DNA, 20 bp, Artificial Sequence
  Description of Artificial Sequence: Synthetic oligonucleotide
  Target: ATXN1; (+) strand; PAM type: NRG; PAM sequence: GGG
gaggtcctcaacatgccagc

SEQ ID NO: 108049 - DNA, 20 bp, Artificial Sequence
  Description of Artificial Sequence: Synthetic oligonucleotide
  Target: ATXN1; (+) strand; PAM type: NRG; PAM sequence: TGG
agcgggtacttccctgattt

SEQ ID NO: 108050 - DNA, 20 bp, Artificial Sequence
  Description of Artificial Sequence: Synthetic oligonucleotide
  Target: ATXN1; (+) strand; PAM type: NRG; PAM sequence: CAG
ggtacttccctgattttggt

SEQ ID NO: 108051 - DNA, 20 bp, Artificial Sequence
  Description of Artificial Sequence: Synthetic oligonucleotide
  Target: ATXN1; (+) strand; PAM type: NRG; PAM sequence: AGG
gtacttccctgattttggtc

SEQ ID NO: 108052 - DNA, 20 bp, Artificial Sequence
  Description of Artificial Sequence: Synthetic oligonucleotide
  Target: ATXN1; (+) strand; PAM type: NRG; PAM sequence: CAG
attttggtcaggatgcaatc

SEQ ID NO: 108053 - DNA, 20 bp, Artificial Sequence
  Description of Artificial Sequence: Synthetic oligonucleotide
  Target: ATXN1; (+) strand; PAM type: NRG; PAM sequence: AGG
ttttggtcaggatgcaatcc

SEQ ID NO: 108054 - DNA, 20 bp, Artificial Sequence
  Description of Artificial Sequence: Synthetic oligonucleotide
  Target: ATXN1; (+) strand; PAM type: NRG; PAM sequence: TGG
gcaatccaggtgtacatcac

SEQ ID NO: 108055 - DNA, 20 bp, Artificial Sequence
  Description of Artificial Sequence: Synthetic oligonucleotide
  Target: ATXN1; (+) strand; PAM type: NRG; PAM sequence: CAG
tgtgacatctgtaatctgcc

SEQ ID NO: 108056 - DNA, 20 bp, Artificial Sequence
  Description of Artificial Sequence: Synthetic oligonucleotide
  Target: ATXN1; (+) strand; PAM type: NRG; PAM sequence: CAG
tctgtaatctgcccagatca

SEQ ID NO: 108057 - DNA, 20 bp, Artificial Sequence
  Description of Artificial Sequence: Synthetic oligonucleotide
  Target: ATXN1; (+) strand; PAM type: NRG; PAM sequence: CAG
ctgcccagatcacagatgcg

SEQ ID NO: 108058 - DNA, 20 bp, Artificial Sequence
  Description of Artificial Sequence: Synthetic oligonucleotide
  Target: ATXN1; (+) strand; PAM type: NRG; PAM sequence: AAG
gatcacagatgcgcagaaac

SEQ ID NO: 108059 - DNA, 20 bp, Artificial Sequence
  Description of Artificial Sequence: Synthetic oligonucleotide
  Target: ATXN1; (+) strand; PAM type: NRG; PAM sequence: AGG
atcacagatgcgcagaaaca

SEQ ID NO: 108060 - DNA, 20 bp, Artificial Sequence
  Description of Artificial Sequence: Synthetic oligonucleotide
  Target: ATXN1; (+) strand; PAM type: NRG; PAM sequence: CAG
gatgcgcagaaacaaggcat

SEQ ID NO: 108061 - DNA, 20 bp, Artificial Sequence
  Description of Artificial Sequence: Synthetic oligonucleotide
  Target: ATXN1; (+) strand; PAM type: NRG; PAM sequence: TAG
ggcatcagattccctctgct

SEQ ID NO: 108062 - DNA, 20 bp, Artificial Sequence
  Description of Artificial Sequence: Synthetic oligonucleotide
  Target: ATXN1; (+) strand; PAM type: NRG; PAM sequence: CAG
cagattccctctgcttagaa

SEQ ID NO: 108063 - DNA, 20 bp, Artificial Sequence
  Description of Artificial Sequence: Synthetic oligonucleotide
  Target: ATXN1; (+) strand; PAM type: NRG; PAM sequence: AAG
attccctctgcttagaacag

SEQ ID NO: 108064 - DNA, 20 bp, Artificial Sequence
  Description of Artificial Sequence: Synthetic oligonucleotide
  Target: ATXN1; (+) strand; PAM type: NRG; PAM sequence: CAG
cctctgcttagaacagaagc

SEQ ID NO: 108065 - DNA, 20 bp, Artificial Sequence
  Description of Artificial Sequence: Synthetic oligonucleotide
  Target: ATXN1; (+) strand; PAM type: NRG; PAM sequence: AGG
ctctgcttagaacagaagcc

SEQ ID NO: 108066 - DNA, 20 bp, Artificial Sequence
  Description of Artificial Sequence: Synthetic oligonucleotide
  Target: ATXN1; (+) strand; PAM type: NRG; PAM sequence: GAG
ctgcttagaacagaagccag

SEQ ID NO: 108067 - DNA, 20 bp, Artificial Sequence
  Description of Artificial Sequence: Synthetic oligonucleotide
  Target: ATXN1; (+) strand; PAM type: NRG; PAM sequence: AAG
cttagaacagaagccaggag

SEQ ID NO: 108068 - DNA, 20 bp, Artificial Sequence
  Description of Artificial Sequence: Synthetic oligonucleotide
  Target: ATXN1; (+) strand; PAM type: NRG; PAM sequence: AGG
ttagaacagaagccaggaga

SEQ ID NO: 108069 - DNA, 20 bp, Artificial Sequence
  Description of Artificial Sequence: Synthetic oligonucleotide
  Target: ATXN1; (+) strand; PAM type: NRG; PAM sequence: GGG
tagaacagaagccaggagaa

SEQ ID NO: 108070 - DNA, 20 bp, Artificial Sequence
  Description of Artificial Sequence: Synthetic oligonucleotide
  Target: ATXN1; (+) strand; PAM type: NRG; PAM sequence: GGG
agaacagaagccaggagaag

SEQ ID NO: 108071 - DNA, 20 bp, Artificial Sequence
  Description of Artificial Sequence: Synthetic oligonucleotide
  Target: ATXN1; (+) strand; PAM type: NRG; PAM sequence: AAG
ggctgaatacatgcatcttt

SEQ ID NO: 108072 - DNA, 20 bp, Artificial Sequence
  Description of Artificial Sequence: Synthetic oligonucleotide
  Target: ATXN1; (+) strand; PAM type: NRG; PAM sequence: CGG
atctttaagattcataccca

SEQ ID NO: 108073 - DNA, 20 bp, Artificial Sequence
  Description of Artificial Sequence: Synthetic oligonucleotide
  Target: ATXN1; (+) strand; PAM type: NRG; PAM sequence: CAG
taagattcatacccacggaa

SEQ ID NO: 108074 - DNA, 20 bp, Artificial Sequence
  Description of Artificial Sequence: Synthetic oligonucleotide
  Target: ATXN1; (+) strand; PAM type: NRG; PAM sequence: GAG
agattcatacccacggaaca

SEQ ID NO: 108075 - DNA, 20 bp, Artificial Sequence
  Description of Artificial Sequence: Synthetic oligonucleotide
  Target: ATXN1; (+) strand; PAM type: NRG; PAM sequence: TAG
ccacggaacagagactctcc

SEQ ID NO: 108076 - DNA, 20 bp, Artificial Sequence
  Description of Artificial Sequence: Synthetic oligonucleotide
  Target: ATXN1; (+) strand; PAM type: NRG; PAM sequence: CAG
gtcatctgttcacaaacttt

SEQ ID NO: 108077 - DNA, 20 bp, Artificial Sequence
  Description of Artificial Sequence: Synthetic oligonucleotide
  Target: ATXN1; (+) strand; PAM type: NRG; PAM sequence: GAG
tctgttcacaaactttcagt

SEQ ID NO: 108078 - DNA, 20 bp, Artificial Sequence
  Description of Artificial Sequence: Synthetic oligonucleotide
  Target: ATXN1; (+) strand; PAM type: NRG; PAM sequence: CAG
agtgagtgtctactatatgc

SEQ ID NO: 108079 - DNA, 20 bp, Artificial Sequence
  Description of Artificial Sequence: Synthetic oligonucleotide
  Target: ATXN1; (+) strand; PAM type: NRG; PAM sequence: AGG
gtgagtgtctactatatgcc

SEQ ID NO: 108080 - DNA, 20 bp, Artificial Sequence
  Description of Artificial Sequence: Synthetic oligonucleotide
  Target: ATXN1; (+) strand; PAM type: NRG; PAM sequence: CAG
agtgtctactatatgccagg

SEQ ID NO: 108081 - DNA, 20 bp, Artificial Sequence
  Description of Artificial Sequence: Synthetic oligonucleotide
  Target: ATXN1; (+) strand; PAM type: NRG; PAM sequence: CAG
actatatgccaggcagacca

SEQ ID NO: 108082 - DNA, 20 bp, Artificial Sequence
  Description of Artificial Sequence: Synthetic oligonucleotide
  Target: ATXN1; (+) strand; PAM type: NRG; PAM sequence: AAG
agaccacagtgcaaaaaatt

SEQ ID NO: 108083 - DNA, 20 bp, Artificial Sequence
  Description of Artificial Sequence: Synthetic oligonucleotide
  Target: ATXN1; (+) strand; PAM type: NRG; PAM sequence: TGG
aacccttaaatatcattctc

SEQ ID NO: 108084 - DNA, 20 bp, Artificial Sequence
  Description of Artificial Sequence: Synthetic oligonucleotide
  Target: ATXN1; (+) strand; PAM type: NRG; PAM sequence: CAG
taaatatcattctctggttc

SEQ ID NO: 108085 - DNA, 20 bp, Artificial Sequence
  Description of Artificial Sequence: Synthetic oligonucleotide
  Target: ATXN1; (+) strand; PAM type: NRG; PAM sequence: AGG
aaatatcattctctggttcc

SEQ ID NO: 108086 - DNA, 20 bp, Artificial Sequence
  Description of Artificial Sequence: Synthetic oligonucleotide
  Target: ATXN1; (+) strand; PAM type: NRG; PAM sequence: CAG
tctctggttccaggcctctt

SEQ ID NO: 108087 - DNA, 20 bp, Artificial Sequence
  Description of Artificial Sequence: Synthetic oligonucleotide
  Target: ATXN1; (+) strand; PAM type: NRG; PAM sequence: AAG
ctggttccaggcctcttcag

SEQ ID NO: 108088 - DNA, 20 bp, Artificial Sequence
  Description of Artificial Sequence: Synthetic oligonucleotide
  Target: ATXN1; (+) strand; PAM type: NRG; PAM sequence: TGG
tccaggcctcttcagaagct

SEQ ID NO: 108089 - DNA, 20 bp, Artificial Sequence
  Description of Artificial Sequence: Synthetic oligonucleotide
  Target: ATXN1; (+) strand; PAM type: NRG; PAM sequence: GAG
ttattatctaatattcttgt

SEQ ID NO: 108090 - DNA, 20 bp, Artificial Sequence
  Description of Artificial Sequence: Synthetic oligonucleotide
  Target: ATXN1; (+) strand; PAM type: NRG; PAM sequence: TGG
ttcttgtgagttcctgtgtc

SEQ ID NO: 108091 - DNA, 20 bp, Artificial Sequence
  Description of Artificial Sequence: Synthetic oligonucleotide
  Target: ATXN1; (+) strand; PAM type: NRG; PAM sequence: TAG
tgtgtctggatttctgtgtt

SEQ ID NO: 108092 - DNA, 20 bp, Artificial Sequence
  Description of Artificial Sequence: Synthetic oligonucleotide
  Target: ATXN1; (+) strand; PAM type: NRG; PAM sequence: AGG
gtgtctggatttctgtgttt

SEQ ID NO: 108093 - DNA, 20 bp, Artificial Sequence
  Description of Artificial Sequence: Synthetic oligonucleotide
  Target: ATXN1; (+) strand; PAM type: NRG; PAM sequence: TAG
tttctgtgtttaggctcttt

SEQ ID NO: 108094 - DNA, 20 bp, Artificial Sequence
  Description of Artificial Sequence: Synthetic oligonucleotide
  Target: ATXN1; (+) strand; PAM type: NRG; PAM sequence: AGG
ttctgtgtttaggctctttt

SEQ ID NO: 108095 - DNA, 20 bp, Artificial Sequence
  Description of Artificial Sequence: Synthetic oligonucleotide
  Target: ATXN1; (+) strand; PAM type: NRG; PAM sequence: GGG
tctgtgtttaggctctttta

SEQ ID NO: 108096 - DNA, 20 bp, Artificial Sequence
  Description of Artificial Sequence: Synthetic oligonucleotide
  Target: ATXN1; (+) strand; PAM type: NRG; PAM sequence: GAG
tgtgtttaggctcttttagg

SEQ ID NO: 108097 - DNA, 20 bp, Artificial Sequence
  Description of Artificial Sequence: Synthetic oligonucleotide
  Target: ATXN1; (+) strand; PAM type: NRG; PAM sequence: TAG
tttaggctcttttagggaga

SEQ ID NO: 108098 - DNA, 20 bp, Artificial Sequence
  Description of Artificial Sequence: Synthetic oligonucleotide
  Target: ATXN1; (+) strand; PAM type: NRG; PAM sequence: AAG
ggctcttttagggagatagt

SEQ ID NO: 108099 - DNA, 20 bp, Artificial Sequence
  Description of Artificial Sequence: Synthetic oligonucleotide
  Target: ATXN1; (+) strand; PAM type: NRG; PAM sequence: AGG
gctcttttagggagatagta

SEQ ID NO: 108100 - DNA, 20 bp, Artificial Sequence
  Description of Artificial Sequence: Synthetic oligonucleotide
  Target: ATXN1; (+) strand; PAM type: NRG; PAM sequence: TGG
ttagggagatagtaaggaac

SEQ ID NO: 108101 - DNA, 20 bp, Artificial Sequence
  Description of Artificial Sequence: Synthetic oligonucleotide
  Target: ATXN1; (+) strand; PAM type: NRG; PAM sequence: AAG
tgacttttttttttttttaa

SEQ ID NO: 108102 - DNA, 20 bp, Artificial Sequence
  Description of Artificial Sequence: Synthetic oligonucleotide
  Target: ATXN1; (+) strand; PAM type: NRG; PAM sequence: CAG
ccttctctgcctgaaaatgc

SEQ ID NO: 108103 - DNA, 20 bp, Artificial Sequence
  Description of Artificial Sequence: Synthetic oligonucleotide
  Target: ATXN1; (+) strand; PAM type: NRG; PAM sequence: CAG
tgaaaatgccagacacattt

SEQ ID NO: 108104 - DNA, 20 bp, Artificial Sequence
  Description of Artificial Sequence: Synthetic oligonucleotide
  Target: ATXN1; (+) strand; PAM type: NRG; PAM sequence: TGG
ttcagatgtcaaaactaacg

SEQ ID NO: 108105 - DNA, 20 bp, Artificial Sequence
  Description of Artificial Sequence: Synthetic oligonucleotide
  Target: ATXN1; (+) strand; PAM type: NRG; PAM sequence: CAG
gtcaaaactaacgtggcatt

SEQ ID NO: 108106 - DNA, 20 bp, Artificial Sequence
  Description of Artificial Sequence: Synthetic oligonucleotide
  Target: ATXN1; (+) strand; PAM type: NRG; PAM sequence: AGG
tcaaaactaacgtggcattc

SEQ ID NO: 108107 - DNA, 20 bp, Artificial Sequence
  Description of Artificial Sequence: Synthetic oligonucleotide
  Target: ATXN1; (+) strand; PAM type: NRG; PAM sequence: GGG
caaaactaacgtggcattca

SEQ ID NO: 108108 - DNA, 20 bp, Artificial Sequence
  Description of Artificial Sequence: Synthetic oligonucleotide
  Target: ATXN1; (+) strand; PAM type: NRG; PAM sequence: TGG
aactaacgtggcattcaggg

SEQ ID NO: 108109 - DNA, 20 bp, Artificial Sequence
  Description of Artificial Sequence: Synthetic oligonucleotide
  Target: ATXN1; (+) strand; PAM type: NRG; PAM sequence: GGG
actaacgtggcattcagggt

SEQ ID NO: 108110 - DNA, 20 bp, Artificial Sequence
  Description of Artificial Sequence: Synthetic oligonucleotide
  Target: ATXN1; (+) strand; PAM type: NRG; PAM sequence: GAG
ggtgggtgactgatccatgt

SEQ ID NO: 108111 - DNA, 20 bp, Artificial Sequence
  Description of Artificial Sequence: Synthetic oligonucleotide
  Target: ATXN1; (+) strand; PAM type: NRG; PAM sequence: AAG
tgatccatgtgagtgctctt

SEQ ID NO: 108112 - DNA, 20 bp, Artificial Sequence
  Description of Artificial Sequence: Synthetic oligonucleotide
  Target: ATXN1; (+) strand; PAM type: NRG; PAM sequence: TGG
tccatgtgagtgctcttaag

SEQ ID NO: 108113 - DNA, 20 bp, Artificial Sequence
  Description of Artificial Sequence: Synthetic oligonucleotide
  Target: ATXN1; (+) strand; PAM type: NRG; PAM sequence: GGG
ccatgtgagtgctcttaagt

SEQ ID NO: 108114 - DNA, 20 bp, Artificial Sequence
  Description of Artificial Sequence: Synthetic oligonucleotide
  Target: ATXN1; (+) strand; PAM type: NRG; PAM sequence: TAG
tgagtgctcttaagtgggtg

SEQ ID NO: 108115 - DNA, 20 bp, Artificial Sequence
  Description of Artificial Sequence: Synthetic oligonucleotide
  Target: ATXN1; (+) strand; PAM type: NRG; PAM sequence: AAG
gtgctcttaagtgggtgtag

SEQ ID NO: 108116 - DNA, 20 bp, Artificial Sequence
  Description of Artificial Sequence: Synthetic oligonucleotide
  Target: ATXN1; (+) strand; PAM type: NRG; PAM sequence: TGG
agtgggtgtagaagcctgtc

SEQ ID NO: 108117 - DNA, 20 bp, Artificial Sequence
  Description of Artificial Sequence: Synthetic oligonucleotide
  Target: ATXN1; (+) strand; PAM type: NRG; PAM sequence: CAG
cacgcgcattcaaatgtgca

SEQ ID NO: 108118 - DNA, 20 bp, Artificial Sequence
  Description of Artificial Sequence: Synthetic oligonucleotide
  Target: ATXN1; (+) strand; PAM type: NRG; PAM sequence: AGG
acgcgcattcaaatgtgcac

SEQ ID NO: 108119 - DNA, 20 bp, Artificial Sequence
  Description of Artificial Sequence: Synthetic oligonucleotide
  Target: ATXN1; (+) strand; PAM type: NRG; PAM sequence: TAG
ttcaaatgtgcacaggcttg

SEQ ID NO: 108120 - DNA, 20 bp, Artificial Sequence
  Description of Artificial Sequence: Synthetic oligonucleotide
  Target: ATXN1; (+) strand; PAM type: NRG; PAM sequence: AGG
tcaaatgtgcacaggcttgt

SEQ ID NO: 108121 - DNA, 20 bp, Artificial Sequence
  Description of Artificial Sequence: Synthetic oligonucleotide
  Target: ATXN1; (+) strand; PAM type: NRG; PAM sequence: TAG
acaggcttgtaggccataaa

SEQ ID NO: 108122 - DNA, 20 bp, Artificial Sequence
  Description of Artificial Sequence: Synthetic oligonucleotide
  Target: ATXN1; (+) strand; PAM type: NRG; PAM sequence: TAG
tgtaggccataaatagctct

SEQ ID NO: 108123 - DNA, 20 bp, Artificial Sequence
  Description of Artificial Sequence: Synthetic oligonucleotide
  Target: ATXN1; (+) strand; PAM type: NRG; PAM sequence: AGG
gtaggccataaatagctctt

SEQ ID NO: 108124 - DNA, 20 bp, Artificial Sequence
  Description of Artificial Sequence: Synthetic oligonucleotide
  Target: ATXN1; (+) strand; PAM type: NRG; PAM sequence: GGG
taggccataaatagctctta

SEQ ID NO: 108125 - DNA, 20 bp, Artificial Sequence
  Description of Artificial Sequence: Synthetic oligonucleotide
  Target: ATXN1; (+) strand; PAM type: NRG; PAM sequence: GGG
aggccataaatagctcttag

SEQ ID NO: 108126 - DNA, 20 bp, Artificial Sequence
  Description of Artificial Sequence: Synthetic oligonucleotide
  Target: ATXN1; (+) strand; PAM type: NRG; PAM sequence: GAG
gccataaatagctcttaggg

SEQ ID NO: 108127 - DNA, 20 bp, Artificial Sequence
  Description of Artificial Sequence: Synthetic oligonucleotide
  Target: ATXN1; (+) strand; PAM type: NRG; PAM sequence: GAG
aatagctcttaggggagtgt

SEQ ID NO: 108128 - DNA, 20 bp, Artificial Sequence
  Description of Artificial Sequence: Synthetic oligonucleotide
  Target: ATXN1; (+) strand; PAM type: NRG; PAM sequence: CAG
gggagtgtgagattacatca

SEQ ID NO: 108129 - DNA, 20 bp, Artificial Sequence
  Description of Artificial Sequence: Synthetic oligonucleotide
  Target: ATXN1; (+) strand; PAM type: NRG; PAM sequence: AAG
tgagattacatcacagactc

SEQ ID NO: 108130 - DNA, 20 bp, Artificial Sequence
  Description of Artificial Sequence: Synthetic oligonucleotide
  Target: ATXN1; (+) strand; PAM type: NRG; PAM sequence: GAG
agattacatcacagactcaa

SEQ ID NO: 108131 - DNA, 20 bp, Artificial Sequence
  Description of Artificial Sequence: Synthetic oligonucleotide
  Target: ATXN1; (+) strand; PAM type: NRG; PAM sequence: AGG
gattacatcacagactcaag

SEQ ID NO: 108132 - DNA, 20 bp, Artificial Sequence
  Description of Artificial Sequence: Synthetic oligonucleotide
  Target: ATXN1; (+) strand; PAM type: NRG; PAM sequence: GGG
attacatcacagactcaaga

SEQ ID NO: 108133 - DNA, 20 bp, Artificial Sequence
  Description of Artificial Sequence: Synthetic oligonucleotide
  Target: ATXN1; (+) strand; PAM type: NRG; PAM sequence: CAG
agggccccgttacctcaaat

SEQ ID NO: 108134 - DNA, 20 bp, Artificial Sequence
  Description of Artificial Sequence: Synthetic oligonucleotide
  Target: ATXN1; (+) strand; PAM type: NRG; PAM sequence: AAG
ttgacactcatctccccaaa

SEQ ID NO: 108135 - DNA, 20 bp, Artificial Sequence
  Description of Artificial Sequence: Synthetic oligonucleotide
  Target: ATXN1; (+) strand; PAM type: NRG; PAM sequence: AGG
tgacactcatctccccaaaa

SEQ ID NO: 108136 - DNA, 20 bp, Artificial Sequence
  Description of Artificial Sequence: Synthetic oligonucleotide
  Target: ATXN1; (+) strand; PAM type: NRG; PAM sequence: CAG
aaggcatgctgttgaaaatg

SEQ ID NO: 108137 - DNA, 20 bp, Artificial Sequence
  Description of Artificial Sequence: Synthetic oligonucleotide
  Target: ATXN1; (+) strand; PAM type: NRG; PAM sequence: TAG
gctgttgaaaatgcagatac

SEQ ID NO: 108138 - DNA, 20 bp, Artificial Sequence
  Description of Artificial Sequence: Synthetic oligonucleotide
  Target: ATXN1; (+) strand; PAM type: NRG; PAM sequence: TGG
gacccccaaaaaactaccac

SEQ ID NO: 108139 - DNA, 20 bp, Artificial Sequence
  Description of Artificial Sequence: Synthetic oligonucleotide
  Target: ATXN1; (+) strand; PAM type: NRG; PAM sequence: CAG
ccccaaaaaactaccactgg

SEQ ID NO: 108140 - DNA, 20 bp, Artificial Sequence
  Description of Artificial Sequence: Synthetic oligonucleotide
  Target: ATXN1; (+) strand; PAM type: NRG; PAM sequence: AGG
cccaaaaaactaccactggc

SEQ ID NO: 108141 - DNA, 20 bp, Artificial Sequence
  Description of Artificial Sequence: Synthetic oligonucleotide
  Target: ATXN1; (+) strand; PAM type: NRG; PAM sequence: TGG
accactggcaggcattgtta

SEQ ID NO: 108142 - DNA, 20 bp, Artificial Sequence
  Description of Artificial Sequence: Synthetic oligonucleotide
  Target: ATXN1; (+) strand; PAM type: NRG; PAM sequence: GGG
ccactggcaggcattgttat

SEQ ID NO: 108143 - DNA, 20 bp, Artificial Sequence
  Description of Artificial Sequence: Synthetic oligonucleotide
  Target: ATXN1; (+) strand; PAM type: NRG; PAM sequence: TGG
cctctgaatgtgaacttact

SEQ ID NO: 108144 - DNA, 20 bp, Artificial Sequence
  Description of Artificial Sequence: Synthetic oligonucleotide
  Target: ATXN1; (+) strand; PAM type: NRG; PAM sequence: TAG
aatgtgaacttacttggaaa

SEQ ID NO: 108145 - DNA, 20 bp, Artificial Sequence
  Description of Artificial Sequence: Synthetic oligonucleotide
  Target: ATXN1; (+) strand; PAM type: NRG; PAM sequence: AGG
atgtgaacttacttggaaat

SEQ ID NO: 108146 - DNA, 20 bp, Artificial Sequence
  Description of Artificial Sequence: Synthetic oligonucleotide
  Target: ATXN1; (+) strand; PAM type: NRG; PAM sequence: GGG
tgtgaacttacttggaaata

SEQ ID NO: 108147 - DNA, 20 bp, Artificial Sequence
  Description of Artificial Sequence: Synthetic oligonucleotide
  Target: ATXN1; (+) strand; PAM type: NRG; PAM sequence: CAG
acttggaaatagggttgttg

SEQ ID NO: 108148 - DNA, 20 bp, Artificial Sequence
  Description of Artificial Sequence: Synthetic oligonucleotide
  Target: ATXN1; (+) strand; PAM type: NRG; PAM sequence: TAG
agggttgttgcagatataat

SEQ ID NO: 108149 - DNA, 20 bp, Artificial Sequence
  Description of Artificial Sequence: Synthetic oligonucleotide
  Target: ATXN1; (+) strand; PAM type: NRG; PAM sequence: AAG
tgttgcagatataattagtt

SEQ ID NO: 108150 - DNA, 20 bp, Artificial Sequence
  Description of Artificial Sequence: Synthetic oligonucleotide
  Target: ATXN1; (+) strand; PAM type: NRG; PAM sequence: GAG
cagatataattagttaagat

SEQ ID NO: 108151 - DNA, 20 bp, Artificial Sequence
  Description of Artificial Sequence: Synthetic oligonucleotide
  Target: ATXN1; (+) strand; PAM type: NRG; PAM sequence: AGG
agatataattagttaagatg

SEQ ID NO: 108152 - DNA, 20 bp, Artificial Sequence
  Description of Artificial Sequence: Synthetic oligonucleotide
  Target: ATXN1; (+) strand; PAM type: NRG; PAM sequence: TGG
tagttaagatgaggtcatcc

SEQ ID NO: 108153 - DNA, 20 bp, Artificial Sequence
  Description of Artificial Sequence: Synthetic oligonucleotide
  Target: ATXN1; (+) strand; PAM type: NRG; PAM sequence: GAG
gttaagatgaggtcatcctg

SEQ ID NO: 108154 - DNA, 20 bp, Artificial Sequence
  Description of Artificial Sequence: Synthetic oligonucleotide
  Target: ATXN1; (+) strand; PAM type: NRG; PAM sequence: AGG
ttaagatgaggtcatcctgg

SEQ ID NO: 108155 - DNA, 20 bp, Artificial Sequence
  Description of Artificial Sequence: Synthetic oligonucleotide
  Target: ATXN1; (+) strand; PAM type: NRG; PAM sequence: GAG
aagatgaggtcatcctggag

SEQ ID NO: 108156 - DNA, 20 bp, Artificial Sequence
  Description of Artificial Sequence: Synthetic oligonucleotide
  Target: ATXN1; (+) strand; PAM type: NRG; PAM sequence: GAG
gatgaggtcatcctggagga

SEQ ID NO: 108157 - DNA, 20 bp, Artificial Sequence
  Description of Artificial Sequence: Synthetic oligonucleotide
  Target: ATXN1; (+) strand; PAM type: NRG; PAM sequence: AGG
atgaggtcatcctggaggag

SEQ ID NO: 108158 - DNA, 20 bp, Artificial Sequence
  Description of Artificial Sequence: Synthetic oligonucleotide
  Target: ATXN1; (+) strand; PAM type: NRG; PAM sequence: GGG
tgaggtcatcctggaggaga

SEQ ID NO: 108159 - DNA, 20 bp, Artificial Sequence
  Description of Artificial Sequence: Synthetic oligonucleotide
  Target: ATXN1; (+) strand; PAM type: NRG; PAM sequence: GGG
gaggtcatcctggaggagag

SEQ ID NO: 108160 - DNA, 20 bp, Artificial Sequence
  Description of Artificial Sequence: Synthetic oligonucleotide
  Target: ATXN1; (+) strand; PAM type: NRG; PAM sequence: CAG
gagaggggttcctaatctga

SEQ ID NO: 108161 - DNA, 20 bp, Artificial Sequence
  Description of Artificial Sequence: Synthetic oligonucleotide
  Target: ATXN1; (+) strand; PAM type: NRG; PAM sequence: TGG
ggttcctaatctgacagaac

SEQ ID NO: 108162 - DNA, 20 bp, Artificial Sequence
  Description of Artificial Sequence: Synthetic oligonucleotide
  Target: ATXN1; (+) strand; PAM type: NRG; PAM sequence: AAG
agaactggtgtccttgtgaa

SEQ ID NO: 108163 - DNA, 20 bp, Artificial Sequence
  Description of Artificial Sequence: Synthetic oligonucleotide
  Target: ATXN1; (+) strand; PAM type: NRG; PAM sequence: AGG
gaactggtgtccttgtgaaa

SEQ ID NO: 108164 - DNA, 20 bp, Artificial Sequence
  Description of Artificial Sequence: Synthetic oligonucleotide
  Target: ATXN1; (+) strand; PAM type: NRG; PAM sequence: GGG
aactggtgtccttgtgaaaa

SEQ ID NO: 108165 - DNA, 20 bp, Artificial Sequence
  Description of Artificial Sequence: Synthetic oligonucleotide
  Target: ATXN1; (+) strand; PAM type: NRG; PAM sequence: GGG
actggtgtccttgtgaaaag

SEQ ID NO: 108166 - DNA, 20 bp, Artificial Sequence
  Description of Artificial Sequence: Synthetic oligonucleotide
  Target: ATXN1; (+) strand; PAM type: NRG; PAM sequence: TGG
ccttgtgaaaaggggaaatg

SEQ ID NO: 108167 - DNA, 20 bp, Artificial Sequence
  Description of Artificial Sequence: Synthetic oligonucleotide
  Target: ATXN1; (+) strand; PAM type: NRG; PAM sequence: GGG
cttgtgaaaaggggaaatgt

SEQ ID NO: 108168 - DNA, 20 bp, Artificial Sequence
  Description of Artificial Sequence: Synthetic oligonucleotide
  Target: ATXN1; (+) strand; PAM type: NRG; PAM sequence: TGG
tgaaaaggggaaatgtgggc

SEQ ID NO: 108169 - DNA, 20 bp, Artificial Sequence
  Description of Artificial Sequence: Synthetic oligonucleotide
  Target: ATXN1; (+) strand; PAM type: NRG; PAM sequence: GGG
gaaaaggggaaatgtgggct

SEQ ID NO: 108170 - DNA, 20 bp, Artificial Sequence
  Description of Artificial Sequence: Synthetic oligonucleotide
  Target: ATXN1; (+) strand; PAM type: NRG; PAM sequence: CGG
ggggaaatgtgggctgggcg

SEQ ID NO: 108171 - DNA, 20 bp, Artificial Sequence
  Description of Artificial Sequence: Synthetic oligonucleotide
  Target: ATXN1; (+) strand; PAM type: NRG; PAM sequence: TGG
gaaatgtgggctgggcgcgg

SEQ ID NO: 108172 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctgtaatcc

SEQ ID NO: 108173 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagcactt

SEQ ID NO: 108174 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 108175 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 108176 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 108177 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggtc

SEQ ID NO: 108178 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggtcg

SEQ ID NO: 108179 - DNA, 20 bp, Artificial Sequence
  Description of Artificial Sequence: Synthetic oligonucleotide
  Target: ATXN1; (+) strand; PAM type: NRG; PAM sequence: CAG
agcactttgggaggtcgagg

SEQ ID NO: 108180 - DNA, 20 bp, Artificial Sequence
  Description of Artificial Sequence: Synthetic oligonucleotide
  Target: ATXN1; (+) strand; PAM type: NRG; PAM sequence: AGG
gcactttgggaggtcgaggc

SEQ ID NO: 108181 - DNA, 20 bp, Artificial Sequence
  Description of Artificial Sequence: Synthetic oligonucleotide
  Target: ATXN1; (+) strand; PAM type: NRG; PAM sequence: CGG
ctttgggaggtcgaggcagg

SEQ ID NO: 108182 - DNA, 20 bp, Artificial Sequence
  Description of Artificial Sequence: Synthetic oligonucleotide
  Target: ATXN1; (+) strand; PAM type: NRG; PAM sequence: GAG
ggtcgaggcaggcggatcat

SEQ ID NO: 108183 - DNA, 20 bp, Artificial Sequence
  Description of Artificial Sequence: Synthetic oligonucleotide
  Target: ATXN1; (+) strand; PAM type: NRG; PAM sequence: AGG
gtcgaggcaggcggatcatg

SEQ ID NO: 108184 - DNA, 20 bp, Artificial Sequence
  Description of Artificial Sequence: Synthetic oligonucleotide
  Target: ATXN1; (+) strand; PAM type: NRG; PAM sequence: CAG
aggcaggcggatcatgaggt

SEQ ID NO: 108185 - DNA, 20 bp, Artificial Sequence
  Description of Artificial Sequence: Synthetic oligonucleotide
  Target: ATXN1; (+) strand; PAM type: NRG; PAM sequence: AGG
ggcaggcggatcatgaggtc

SEQ ID NO: 108186 - DNA, 20 bp, Artificial Sequence
  Description of Artificial Sequence: Synthetic oligonucleotide
  Target: ATXN1; (+) strand; PAM type: NRG; PAM sequence: GAG
caggcggatcatgaggtcag

SEQ ID NO: 108187 - DNA, 20 bp, Artificial Sequence
  Description of Artificial Sequence: Synthetic oligonucleotide
  Target: ATXN1; (+) strand; PAM type: NRG; PAM sequence: GAG
gatcatgaggtcaggagttc

SEQ ID NO: 108188 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagttcgagac

SEQ ID NO: 108189 - DNA, 20 bp, Artificial Sequence
  Description of Artificial Sequence: Synthetic oligonucleotide
  Target: ATXN1; (+) strand; PAM type: NRG; PAM sequence: TAG
tcaggagttcgagaccagtc

SEQ ID NO: 108190 - DNA, 20 bp, Artificial Sequence
  Description of Artificial Sequence: Synthetic oligonucleotide
  Target: ATXN1; (+) strand; PAM type: NRG; PAM sequence: TGG
cgagaccagtctagccaaca

SEQ ID NO: 108191 - DNA, 20 bp, Artificial Sequence
  Description of Artificial Sequence: Synthetic oligonucleotide
  Target: ATXN1; (+) strand; PAM type: NRG; PAM sequence: TAG
gtctctactattacaaaaat

SEQ ID NO: 108192 - DNA, 20 bp, Artificial Sequence
  Description of Artificial Sequence: Synthetic oligonucleotide
  Target: ATXN1; (+) strand; PAM type: NRG; PAM sequence: TGG
tactattacaaaaattagcc

SEQ ID NO: 108193 - DNA, 20 bp, Artificial Sequence
  Description of Artificial Sequence: Synthetic oligonucleotide
  Target: ATXN1; (+) strand; PAM type: NRG; PAM sequence: TGG
ttacaaaaattagcctggcg

SEQ ID NO: 108194 - DNA, 20 bp, Artificial Sequence
  Description of Artificial Sequence: Synthetic oligonucleotide
  Target: ATXN1; (+) strand; PAM type: NRG; PAM sequence: TGG
caaaaattagcctggcgtgg

SEQ ID NO: 108195 - DNA, 20 bp, Artificial Sequence
  Description of Artificial Sequence: Synthetic oligonucleotide
  Target: ATXN1; (+) strand; PAM type: NRG; PAM sequence: CGG
aaattagcctggcgtggtgg

SEQ ID NO: 108196 - DNA, 20 bp, Artificial Sequence
  Description of Artificial Sequence: Synthetic oligonucleotide
  Target: ATXN1; (+) strand; PAM type: NRG; PAM sequence: GGG
aattagcctggcgtggtggc

SEQ ID NO: 108197 - DNA, 20 bp, Artificial Sequence
  Description of Artificial Sequence: Synthetic oligonucleotide
  Target: ATXN1; (+) strand; PAM type: NRG; PAM sequence: CAG
gtggcgggcgcctataattc

SEQ ID NO: 108198 - DNA, 20 bp, Artificial Sequence
  Description of Artificial Sequence: Synthetic oligonucleotide
  Target: ATXN1; (+) strand; PAM type: NRG; PAM sequence: CGG
cgcctataattccagctact

SEQ ID NO: 108199 - DNA, 20 bp, Artificial Sequence
  Description of Artificial Sequence: Synthetic oligonucleotide
  Target: ATXN1; (+) strand; PAM type: NRG; PAM sequence: GGG
gcctataattccagctactc

SEQ ID NO: 108200 - DNA, 20 bp, Artificial Sequence
  Description of Artificial Sequence: Synthetic oligonucleotide
  Target: ATXN1; (+) strand; PAM type: NRG; PAM sequence: GAG
ctataattccagctactcgg

SEQ ID NO: 108201 - DNA, 20 bp, Artificial Sequence
  Description of Artificial Sequence: Synthetic oligonucleotide
  Target: ATXN1; (+) strand; PAM type: NRG; PAM sequence: GAG
ttccagctactcgggagaat

SEQ ID NO: 108202 - DNA, 20 bp, Artificial Sequence
  Description of Artificial Sequence: Synthetic oligonucleotide
  Target: ATXN1; (+) strand; PAM type: NRG; PAM sequence: AGG
tccagctactcgggagaatg

SEQ ID NO: 108203 - DNA, 20 bp, Artificial Sequence
  Description of Artificial Sequence: Synthetic oligonucleotide
  Target: ATXN1; (+) strand; PAM type: NRG; PAM sequence: GGG
ccagctactcgggagaatga

SEQ ID NO: 108204 - DNA, 20 bp, Artificial Sequence
  Description of Artificial Sequence: Synthetic oligonucleotide
  Target: ATXN1; (+) strand; PAM type: NRG; PAM sequence: GAG
agctactcgggagaatgagg

SEQ ID NO: 108205 - DNA, 20 bp, Artificial Sequence
  Description of Artificial Sequence: Synthetic oligonucleotide
  Target: ATXN1; (+) strand; PAM type: NRG; PAM sequence: AGG
gctactcgggagaatgaggg

SEQ ID NO: 108206 - DNA, 20 bp, Artificial Sequence
  Description of Artificial Sequence: Synthetic oligonucleotide
  Target: ATXN1; (+) strand; PAM type: NRG; PAM sequence: GAG
tactcgggagaatgagggag

SEQ ID NO: 108207 - DNA, 20 bp, Artificial Sequence
  Description of Artificial Sequence: Synthetic oligonucleotide
  Target: ATXN1; (+) strand; PAM type: NRG; PAM sequence: TGG
ggaggagaatctcttgaacc

SEQ ID NO: 108208 - DNA, 20 bp, Artificial Sequence
  Description of Artificial Sequence: Synthetic oligonucleotide
  Target: ATXN1; (+) strand; PAM type: NRG; PAM sequence: GGG
gaggagaatctcttgaacct

SEQ ID NO: 108209 - DNA, 20 bp, Artificial Sequence
  Description of Artificial Sequence: Synthetic oligonucleotide
  Target: ATXN1; (+) strand; PAM type: NRG; PAM sequence: GAG
ggagaatctcttgaacctgg

SEQ ID NO: 108210 - DNA, 20 bp, Artificial Sequence
  Description of Artificial Sequence: Synthetic oligonucleotide
  Target: ATXN1; (+) strand; PAM type: NRG; PAM sequence: AGG
gagaatctcttgaacctggg

SEQ ID NO: 108211 - DNA, 20 bp, Artificial Sequence
  Description of Artificial Sequence: Synthetic oligonucleotide
  Target: ATXN1; (+) strand; PAM type: NRG; PAM sequence: CAG
aatctcttgaacctgggagg

SEQ ID NO: 108212 - DNA, 20 bp, Artificial Sequence
  Description of Artificial Sequence: Synthetic oligonucleotide
  Target: ATXN1; (+) strand; PAM type: NRG; PAM sequence: GAG
tctcttgaacctgggaggca

SEQ ID NO: 108213 - DNA, 20 bp, Artificial Sequence
  Description of Artificial Sequence: Synthetic oligonucleotide
  Target: ATXN1; (+) strand; PAM type: NRG; PAM sequence: AGG
ctcttgaacctgggaggcag

SEQ ID NO: 108214 - DNA, 20 bp, Artificial Sequence
  Description of Artificial Sequence: Synthetic oligonucleotide
  Target: ATXN1; (+) strand; PAM type: NRG; PAM sequence: CAG
aacctgggaggcagaggttg

SEQ ID NO: 108215 - DNA, 20 bp, Artificial Sequence
  Description of Artificial Sequence: Synthetic oligonucleotide
  Target: ATXN1; (+) strand; PAM type: NRG; PAM sequence: AAG
tgggaggcagaggttgcagt

SEQ ID NO: 108216 - DNA, 20 bp, Artificial Sequence
  Description of Artificial Sequence: Synthetic oligonucleotide
  Target: ATXN1; (+) strand; PAM type: NRG; PAM sequence: GAG
aggcagaggttgcagtaagt

SEQ ID NO: 108217 - DNA, 20 bp, Artificial Sequence
  Description of Artificial Sequence: Synthetic oligonucleotide
  Target: ATXN1; (+) strand; PAM type: NRG; PAM sequence: CAG
gagatcgcaccactgcaccc

SEQ ID NO: 108218 - DNA, 20 bp, Artificial Sequence
  Description of Artificial Sequence: Synthetic oligonucleotide
  Target: ATXN1; (+) strand; PAM type: NRG; PAM sequence: TGG
cgcaccactgcaccccagcc

SEQ ID NO: 108219 - DNA, 20 bp, Artificial Sequence
  Description of Artificial Sequence: Synthetic oligonucleotide
  Target: ATXN1; (+) strand; PAM type: NRG; PAM sequence: GGG
gcaccactgcaccccagcct

SEQ ID NO: 108220 - DNA, 20 bp, Artificial Sequence
  Description of Artificial Sequence: Synthetic oligonucleotide
  Target: ATXN1; (+) strand; PAM type: NRG; PAM sequence: CAG
ctgcaccccagcctgggtga

SEQ ID NO: 108221 - DNA, 20 bp, Artificial Sequence
  Description of Artificial Sequence: Synthetic oligonucleotide
  Target: ATXN1; (+) strand; PAM type: NRG; PAM sequence: GAG
gcaccccagcctgggtgaca

SEQ ID NO: 108222 - DNA, 20 bp, Artificial Sequence
  Description of Artificial Sequence: Synthetic oligonucleotide
  Target: ATXN1; (+) strand; PAM type: NRG; PAM sequence: AAG
cccagcctgggtgacagagc

SEQ ID NO: 108223 - DNA, 20 bp, Artificial Sequence
  Description of Artificial Sequence: Synthetic oligonucleotide
  Target: ATXN1; (+) strand; PAM type: NRG; PAM sequence: AAG
agactccatcatgaaaaaaa

SEQ ID NO: 108224 - DNA, 20 bp, Artificial Sequence
  Description of Artificial Sequence: Synthetic oligonucleotide
  Target: ATXN1; (+) strand; PAM type: NRG; PAM sequence: AGG
gactccatcatgaaaaaaaa

SEQ ID NO: 108225 - DNA, 20 bp, Artificial Sequence
  Description of Artificial Sequence: Synthetic oligonucleotide
  Target: ATXN1; (+) strand; PAM type: NRG; PAM sequence: GGG
actccatcatgaaaaaaaaa

SEQ ID NO: 108226 - DNA, 20 bp, Artificial Sequence
  Description of Artificial Sequence: Synthetic oligonucleotide
  Target: ATXN1; (+) strand; PAM type: NRG; PAM sequence: GGG
ctccatcatgaaaaaaaaag

SEQ ID NO: 108227 - DNA, 20 bp, Artificial Sequence
  Description of Artificial Sequence: Synthetic oligonucleotide
  Target: ATXN1; (+) strand; PAM type: NRG; PAM sequence: GGG
tccatcatgaaaaaaaaagg

SEQ ID NO: 108228 - DNA, 20 bp, Artificial Sequence
  Description of Artificial Sequence: Synthetic oligonucleotide
  Target: ATXN1; (+) strand; PAM type: NRG; PAM sequence: TGG
gaaaaaaaaagggggaaatg

SEQ ID NO: 108229 - DNA, 20 bp, Artificial Sequence
  Description of Artificial Sequence: Synthetic oligonucleotide
  Target: ATXN1; (+) strand; PAM type: NRG; PAM sequence: CAG
aaaagggggaaatgtggact

SEQ ID NO: 108230 - DNA, 20 bp, Artificial Sequence
  Description of Artificial Sequence: Synthetic oligonucleotide
  Target: ATXN1; (+) strand; PAM type: NRG; PAM sequence: AGG
aaagggggaaatgtggactc

SEQ ID NO: 108231 - DNA, 20 bp, Artificial Sequence
  Description of Artificial Sequence: Synthetic oligonucleotide
  Target: ATXN1; (+) strand; PAM type: NRG; PAM sequence: CAG
gaaatgtggactcaggcaca

SEQ ID NO: 108232 - DNA, 20 bp, Artificial Sequence
  Description of Artificial Sequence: Synthetic oligonucleotide
  Target: ATXN1; (+) strand; PAM type: NRG; PAM sequence: AGG
aaatgtggactcaggcacac

SEQ ID NO: 108233 - DNA, 20 bp, Artificial Sequence
  Description of Artificial Sequence: Synthetic oligonucleotide
  Target: ATXN1; (+) strand; PAM type: NRG; PAM sequence: CAG
tgtggactcaggcacacagg

SEQ ID NO: 108234 - DNA, 20 bp, Artificial Sequence
  Description of Artificial Sequence: Synthetic oligonucleotide
  Target: ATXN1; (+) strand; PAM type: NRG; PAM sequence: GAG
tggactcaggcacacaggca

SEQ ID NO: 108235 - DNA, 20 bp, Artificial Sequence
  Description of Artificial Sequence: Synthetic oligonucleotide
  Target: ATXN1; (+) strand; PAM type: NRG; PAM sequence: GAG
acacaggcagagtgctctgt

SEQ ID NO: 108236 - DNA, 20 bp, Artificial Sequence
  Description of Artificial Sequence: Synthetic oligonucleotide
  Target: ATXN1; (+) strand; PAM type: NRG; PAM sequence: AGG
cacaggcagagtgctctgtg

SEQ ID NO: 108237 - DNA, 20 bp, Artificial Sequence
  Description of Artificial Sequence: Synthetic oligonucleotide
  Target: ATXN1; (+) strand; PAM type: NRG; PAM sequence: TGG
gcagagtgctctgtgaggac

SEQ ID NO: 108238 - DNA, 20 bp, Artificial Sequence
  Description of Artificial Sequence: Synthetic oligonucleotide
  Target: ATXN1; (+) strand; PAM type: NRG; PAM sequence: GAG
agagtgctctgtgaggactg

SEQ ID NO: 108239 - DNA, 20 bp, Artificial Sequence
  Description of Artificial Sequence: Synthetic oligonucleotide
  Target: ATXN1; (+) strand; PAM type: NRG; PAM sequence: CAG
ctctgtgaggactggagtga

SEQ ID NO: 108240 - DNA, 20 bp, Artificial Sequence
  Description of Artificial Sequence: Synthetic oligonucleotide
  Target: ATXN1; (+) strand; PAM type: NRG; PAM sequence: GAG
ctgtgaggactggagtgaca

SEQ ID NO: 108241 - DNA, 20 bp, Artificial Sequence
  Description of Artificial Sequence: Synthetic oligonucleotide
  Target: ATXN1; (+) strand; PAM type: NRG; PAM sequence: AAG
gagtgacagagccacatgct

SEQ ID NO: 108242 - DNA, 20 bp, Artificial Sequence
  Description of Artificial Sequence: Synthetic oligonucleotide
  Target: ATXN1; (+) strand; PAM type: NRG; PAM sequence: AGG
agtgacagagccacatgcta

SEQ ID NO: 108243 - DNA, 20 bp, Artificial Sequence
  Description of Artificial Sequence: Synthetic oligonucleotide
  Target: ATXN1; (+) strand; PAM type: NRG; PAM sequence: GAG
tgacagagccacatgctaag

SEQ ID NO: 108244 - DNA, 20 bp, Artificial Sequence
  Description of Artificial Sequence: Synthetic oligonucleotide
  Target: ATXN1; (+) strand; PAM type: NRG; PAM sequence: CAG
gccacatgctaaggagccac

SEQ ID NO: 108245 - DNA, 20 bp, Artificial Sequence
  Description of Artificial Sequence: Synthetic oligonucleotide
  Target: ATXN1; (+) strand; PAM type: NRG; PAM sequence: AAG
acatgctaaggagccaccag

SEQ ID NO: 108246 - DNA, 20 bp, Artificial Sequence
  Description of Artificial Sequence: Synthetic oligonucleotide
  Target: ATXN1; (+) strand; PAM type: NRG; PAM sequence: TAG
gctaaggagccaccagaagc

SEQ ID NO: 108247 - DNA, 20 bp, Artificial Sequence
  Description of Artificial Sequence: Synthetic oligonucleotide
  Target: ATXN1; (+) strand; PAM type: NRG; PAM sequence: AGG
ctaaggagccaccagaagct

SEQ ID NO: 108248 - DNA, 20 bp, Artificial Sequence
  Description of Artificial Sequence: Synthetic oligonucleotide
  Target: ATXN1; (+) strand; PAM type: NRG; PAM sequence: GGG
taaggagccaccagaagcta

SEQ ID NO: 108249 - DNA, 20 bp, Artificial Sequence
  Description of Artificial Sequence: Synthetic oligonucleotide
  Target: ATXN1; (+) strand; PAM type: NRG; PAM sequence: GAG
aggagccaccagaagctagg

SEQ ID NO: 108250 - DNA, 20 bp, Artificial Sequence
  Description of Artificial Sequence: Synthetic oligonucleotide
  Target: ATXN1; (+) strand; PAM type: NRG; PAM sequence: TGG
ccagaagctagggagtgacc

SEQ ID NO: 108251 - DNA, 20 bp, Artificial Sequence
  Description of Artificial Sequence: Synthetic oligonucleotide
  Target: ATXN1; (+) strand; PAM type: NRG; PAM sequence: CAG
agctagggagtgacctggaa

SEQ ID NO: 108252 - DNA, 20 bp, Artificial Sequence
  Description of Artificial Sequence: Synthetic oligonucleotide
  Target: ATXN1; (+) strand; PAM type: NRG; PAM sequence: GAG
acctggaacagatccttccc

SEQ ID NO: 108253 - DNA, 20 bp, Artificial Sequence
  Description of Artificial Sequence: Synthetic oligonucleotide
  Target: ATXN1; (+) strand; PAM type: NRG; PAM sequence: CAG
atccttcccgagcatcttca

SEQ ID NO: 108254 - DNA, 20 bp, Artificial Sequence
  Description of Artificial Sequence: Synthetic oligonucleotide
  Target: ATXN1; (+) strand; PAM type: NRG; PAM sequence: AGG
tccttcccgagcatcttcac

SEQ ID NO: 108255 - DNA, 20 bp, Artificial Sequence
  Description of Artificial Sequence: Synthetic oligonucleotide
  Target: ATXN1; (+) strand; PAM type: NRG; PAM sequence: GGG
ccttcccgagcatcttcaca

SEQ ID NO: 108256 - DNA, 20 bp, Artificial Sequence
  Description of Artificial Sequence: Synthetic oligonucleotide
  Target: ATXN1; (+) strand; PAM type: NRG; PAM sequence: GAG
ttcccgagcatcttcacagg

SEQ ID NO: 108257 - DNA, 20 bp, Artificial Sequence
  Description of Artificial Sequence: Synthetic oligonucleotide
  Target: ATXN1; (+) strand; PAM type: NRG; PAM sequence: TGG
gagcatcttcacagggagca

SEQ ID NO: 108258 - DNA, 20 bp, Artificial Sequence
  Description of Artificial Sequence: Synthetic oligonucleotide
  Target: ATXN1; (+) strand; PAM type: NRG; PAM sequence: CAG
acaccttgatctctgacttc

SEQ ID NO: 108259 - DNA, 20 bp, Artificial Sequence
  Description of Artificial Sequence: Synthetic oligonucleotide
  Target: ATXN1; (+) strand; PAM type: NRG; PAM sequence: AGG
caccttgatctctgacttcc

SEQ ID NO: 108260 - DNA, 20 bp, Artificial Sequence
  Description of Artificial Sequence: Synthetic oligonucleotide
  Target: ATXN1; (+) strand; PAM type: NRG; PAM sequence: CAG
tctctgacttccaggccccc

SEQ ID NO: 108261 - DNA, 20 bp, Artificial Sequence
  Description of Artificial Sequence: Synthetic oligonucleotide
  Target: ATXN1; (+) strand; PAM type: NRG; PAM sequence: GAG
cttccaggccccccagctgt

SEQ ID NO: 108262 - DNA, 20 bp, Artificial Sequence
  Description of Artificial Sequence: Synthetic oligonucleotide
  Target: ATXN1; (+) strand; PAM type: NRG; PAM sequence: AAG
tgagacactcaatgtctgtt

SEQ ID NO: 108263 - DNA, 20 bp, Artificial Sequence
  Description of Artificial Sequence: Synthetic oligonucleotide
  Target: ATXN1; (+) strand; PAM type: NRG; PAM sequence: CAG
tcaatgtctgttaagtcacc

SEQ ID NO: 108264 - DNA, 20 bp, Artificial Sequence
  Description of Artificial Sequence: Synthetic oligonucleotide
  Target: ATXN1; (+) strand; PAM type: NRG; PAM sequence: TGG
ctgttaagtcacccagtttc

SEQ ID NO: 108265 - DNA, 20 bp, Artificial Sequence
  Description of Artificial Sequence: Synthetic oligonucleotide
  Target: ATXN1; (+) strand; PAM type: NRG; PAM sequence: TGG
cagtttctggcactttgtaa

SEQ ID NO: 108266 - DNA, 20 bp, Artificial Sequence
  Description of Artificial Sequence: Synthetic oligonucleotide
  Target: ATXN1; (+) strand; PAM type: NRG; PAM sequence: CAG
tttctggcactttgtaatgg

SEQ ID NO: 108267 - DNA, 20 bp, Artificial Sequence
  Description of Artificial Sequence: Synthetic oligonucleotide
  Target: ATXN1; (+) strand; PAM type: NRG; PAM sequence: TGG
gcactttgtaatggcagccc

SEQ ID NO: 108268 - DNA, 20 bp, Artificial Sequence
  Description of Artificial Sequence: Synthetic oligonucleotide
  Target: ATXN1; (+) strand; PAM type: NRG; PAM sequence: CAG
gcagccctggaaaaatatta

SEQ ID NO: 108269 - DNA, 20 bp, Artificial Sequence
  Description of Artificial Sequence: Synthetic oligonucleotide
  Target: ATXN1; (+) strand; PAM type: NRG; PAM sequence: AGG
cagccctggaaaaatattac

SEQ ID NO: 108270 - DNA, 20 bp, Artificial Sequence
  Description of Artificial Sequence: Synthetic oligonucleotide
  Target: ATXN1; (+) strand; PAM type: NRG; PAM sequence: AAG
tataatgccgtttgtgtgtg

SEQ ID NO: 108271 - DNA, 20 bp, Artificial Sequence
  Description of Artificial Sequence: Synthetic oligonucleotide
  Target: ATXN1; (+) strand; PAM type: NRG; PAM sequence: AGG
ataatgccgtttgtgtgtga

SEQ ID NO: 108272 - DNA, 20 bp, Artificial Sequence
  Description of Artificial Sequence: Synthetic oligonucleotide
  Target: ATXN1; (+) strand; PAM type: NRG; PAM sequence: CAG
gaaggaatgacttcatcatc

SEQ ID NO: 108273 - DNA, 20 bp, Artificial Sequence
  Description of Artificial Sequence: Synthetic oligonucleotide
  Target: ATXN1; (+) strand; PAM type: NRG; PAM sequence: TGG
ggaatgacttcatcatccag

SEQ ID NO: 108274 - DNA, 20 bp, Artificial Sequence
  Description of Artificial Sequence: Synthetic oligonucleotide
  Target: ATXN1; (+) strand; PAM type: NRG; PAM sequence: TGG
tgacttcatcatccagtggc

SEQ ID NO: 108275 - DNA, 20 bp, Artificial Sequence
  Description of Artificial Sequence: Synthetic oligonucleotide
  Target: ATXN1; (+) strand; PAM type: NRG; PAM sequence: AAG
gactgcaaaattcccattgc

SEQ ID NO: 108276 - DNA, 20 bp, Artificial Sequence
  Description of Artificial Sequence: Synthetic oligonucleotide
  Target: ATXN1; (+) strand; PAM type: NRG; PAM sequence: AAG
caaaattcccattgcaagtt

SEQ ID NO: 108277 - DNA, 20 bp, Artificial Sequence
  Description of Artificial Sequence: Synthetic oligonucleotide
  Target: ATXN1; (+) strand; PAM type: NRG; PAM sequence: CAG
attcccattgcaagttaaga

SEQ ID NO: 108278 - DNA, 20 bp, Artificial Sequence
  Description of Artificial Sequence: Synthetic oligonucleotide
  Target: ATXN1; (+) strand; PAM type: NRG; PAM sequence: AGG
ttcccattgcaagttaagac

SEQ ID NO: 108279 - DNA, 20 bp, Artificial Sequence
  Description of Artificial Sequence: Synthetic oligonucleotide
  Target: ATXN1; (+) strand; PAM type: NRG; PAM sequence: CAG
gttaagacaggtgccttaca

SEQ ID NO: 108280 - DNA, 20 bp, Artificial Sequence
  Description of Artificial Sequence: Synthetic oligonucleotide
  Target: ATXN1; (+) strand; PAM type: NRG; PAM sequence: GAG
ggtgccttacacagtgacct

SEQ ID NO: 108281 - DNA, 20 bp, Artificial Sequence
  Description of Artificial Sequence: Synthetic oligonucleotide
  Target: ATXN1; (+) strand; PAM type: NRG; PAM sequence: CAG
gacctgagctgcctctcttc

SEQ ID NO: 108282 - DNA, 20 bp, Artificial Sequence
  Description of Artificial Sequence: Synthetic oligonucleotide
  Target: ATXN1; (+) strand; PAM type: NRG; PAM sequence: AAG
ctgagctgcctctcttccag

SEQ ID NO: 108283 - DNA, 20 bp, Artificial Sequence
  Description of Artificial Sequence: Synthetic oligonucleotide
  Target: ATXN1; (+) strand; PAM type: NRG; PAM sequence: AGG
tgagctgcctctcttccaga

SEQ ID NO: 108284 - DNA, 20 bp, Artificial Sequence
  Description of Artificial Sequence: Synthetic oligonucleotide
  Target: ATXN1; (+) strand; PAM type: NRG; PAM sequence: GGG
gagctgcctctcttccagaa

SEQ ID NO: 108285 - DNA, 20 bp, Artificial Sequence
  Description of Artificial Sequence: Synthetic oligonucleotide
  Target: ATXN1; (+) strand; PAM type: NRG; PAM sequence: CAG
tccagaagggacaactctgc

SEQ ID NO: 108286 - DNA, 20 bp, Artificial Sequence
  Description of Artificial Sequence: Synthetic oligonucleotide
  Target: ATXN1; (+) strand; PAM type: NRG; PAM sequence: CAG
gaagggacaactctgccagt

SEQ ID NO: 108287 - DNA, 20 bp, Artificial Sequence
  Description of Artificial Sequence: Synthetic oligonucleotide
  Target: ATXN1; (+) strand; PAM type: NRG; PAM sequence: AGG
aagggacaactctgccagtc

SEQ ID NO: 108288 - DNA, 20 bp, Artificial Sequence
  Description of Artificial Sequence: Synthetic oligonucleotide
  Target: ATXN1; (+) strand; PAM type: NRG; PAM sequence: CAG
tctgccagtcaggttatcca

SEQ ID NO: 108289 - DNA, 20 bp, Artificial Sequence
  Description of Artificial Sequence: Synthetic oligonucleotide
  Target: ATXN1; (+) strand; PAM type: NRG; PAM sequence: CAG
gttatccacagtgaacatta

SEQ ID NO: 108290 - DNA, 20 bp, Artificial Sequence
  Description of Artificial Sequence: Synthetic oligonucleotide
  Target: ATXN1; (+) strand; PAM type: NRG; PAM sequence: CAG
atccacagtgaacattacag

SEQ ID NO: 108291 - DNA, 20 bp, Artificial Sequence
  Description of Artificial Sequence: Synthetic oligonucleotide
  Target: ATXN1; (+) strand; PAM type: NRG; PAM sequence: CAG
cagcagactccactatttct

SEQ ID NO: 108292 - DNA, 20 bp, Artificial Sequence
  Description of Artificial Sequence: Synthetic oligonucleotide
  Target: ATXN1; (+) strand; PAM type: NRG; PAM sequence: AGG
agcagactccactatttctc

SEQ ID NO: 108293 - DNA, 20 bp, Artificial Sequence
  Description of Artificial Sequence: Synthetic oligonucleotide
  Target: ATXN1; (+) strand; PAM type: NRG; PAM sequence: TGG
atttctcaggtatctacgtt

SEQ ID NO: 108294 - DNA, 20 bp, Artificial Sequence
  Description of Artificial Sequence: Synthetic oligonucleotide
  Target: ATXN1; (+) strand; PAM type: NRG; PAM sequence: TAG
tctcaggtatctacgtttgg

SEQ ID NO: 108295 - DNA, 20 bp, Artificial Sequence
  Description of Artificial Sequence: Synthetic oligonucleotide
  Target: ATXN1; (+) strand; PAM type: NRG; PAM sequence: GAG
agatacttctcctgctcctt

SEQ ID NO: 108296 - DNA, 20 bp, Artificial Sequence
  Description of Artificial Sequence: Synthetic oligonucleotide
  Target: ATXN1; (+) strand; PAM type: NRG; PAM sequence: AAG
tacttctcctgctccttgag

SEQ ID NO: 108297 - DNA, 20 bp, Artificial Sequence
  Description of Artificial Sequence: Synthetic oligonucleotide
  Target: ATXN1; (+) strand; PAM type: NRG; PAM sequence: CAG
cctgctccttgagaagtccc

SEQ ID NO: 108298 - DNA, 20 bp, Artificial Sequence
  Description of Artificial Sequence: Synthetic oligonucleotide
  Target: ATXN1; (+) strand; PAM type: NRG; PAM sequence: TGG
gctccttgagaagtccccag

SEQ ID NO: 108299 - DNA, 20 bp, Artificial Sequence
  Description of Artificial Sequence: Synthetic oligonucleotide
  Target: ATXN1; (+) strand; PAM type: NRG; PAM sequence: CAG
cttgagaagtccccagtggt

SEQ ID NO: 108300 - DNA, 20 bp, Artificial Sequence
  Description of Artificial Sequence: Synthetic oligonucleotide
  Target: ATXN1; (+) strand; PAM type: NRG; PAM sequence: TGG
aagtccccagtggtcagtca

SEQ ID NO: 108301 - DNA, 20 bp, Artificial Sequence
  Description of Artificial Sequence: Synthetic oligonucleotide
  Target: ATXN1; (+) strand; PAM type: NRG; PAM sequence: GAG
gtccccagtggtcagtcatg

SEQ ID NO: 108302 - DNA, 20 bp, Artificial Sequence
  Description of Artificial Sequence: Synthetic oligonucleotide
  Target: ATXN1; (+) strand; PAM type: NRG; PAM sequence: GAG
ccccagtggtcagtcatgga

SEQ ID NO: 108303 - DNA, 20 bp, Artificial Sequence
  Description of Artificial Sequence: Synthetic oligonucleotide
  Target: ATXN1; (+) strand; PAM type: NRG; PAM sequence: AAG
gtcatggagagttattatta

SEQ ID NO: 108304 - DNA, 20 bp, Artificial Sequence
  Description of Artificial Sequence: Synthetic oligonucleotide
  Target: ATXN1; (+) strand; PAM type: NRG; PAM sequence: AAG
attattaaagtacccaatct

SEQ ID NO: 108305 - DNA, 20 bp, Artificial Sequence
  Description of Artificial Sequence: Synthetic oligonucleotide
  Target: ATXN1; (+) strand; PAM type: NRG; PAM sequence: GAG
tattaaagtacccaatctaa

SEQ ID NO: 108306 - DNA, 20 bp, Artificial Sequence
  Description of Artificial Sequence: Synthetic oligonucleotide
  Target: ATXN1; (+) strand; PAM type: NRG; PAM sequence: TAG
ctgatgtatgtctacattta

SEQ ID NO: 108307 - DNA, 20 bp, Artificial Sequence
  Description of Artificial Sequence: Synthetic oligonucleotide
  Target: ATXN1; (+) strand; PAM type: NRG; PAM sequence: TAG
tatgtctacatttatagatt

SEQ ID NO: 108308 - DNA, 20 bp, Artificial Sequence
  Description of Artificial Sequence: Synthetic oligonucleotide
  Target: ATXN1; (+) strand; PAM type: NRG; PAM sequence: TGG
tacatttatagatttagaca

SEQ ID NO: 108309 - DNA, 20 bp, Artificial Sequence
  Description of Artificial Sequence: Synthetic oligonucleotide
  Target: ATXN1; (+) strand; PAM type: NRG; PAM sequence: GAG
catttatagatttagacatg

SEQ ID NO: 108310 - DNA, 20 bp, Artificial Sequence
  Description of Artificial Sequence: Synthetic oligonucleotide
  Target: ATXN1; (+) strand; PAM type: NRG; PAM sequence: CAG
gatttagacatggagttata

SEQ ID NO: 108311 - DNA, 20 bp, Artificial Sequence
  Description of Artificial Sequence: Synthetic oligonucleotide
  Target: ATXN1; (+) strand; PAM type: NRG; PAM sequence: AAG
catggagttatacagaatga

SEQ ID NO: 108312 - DNA, 20 bp, Artificial Sequence
  Description of Artificial Sequence: Synthetic oligonucleotide
  Target: ATXN1; (+) strand; PAM type: NRG; PAM sequence: TAG
agaatgaaagtttattcaaa

SEQ ID NO: 108313 - DNA, 20 bp, Artificial Sequence
  Description of Artificial Sequence: Synthetic oligonucleotide
  Target: ATXN1; (+) strand; PAM type: NRG; PAM sequence: AAG
gataaaaacatcccaaattg

SEQ ID NO: 108314 - DNA, 20 bp, Artificial Sequence
  Description of Artificial Sequence: Synthetic oligonucleotide
  Target: ATXN1; (+) strand; PAM type: NRG; PAM sequence: TAG
caaattgaagttccactaac

SEQ ID NO: 108315 - DNA, 20 bp, Artificial Sequence
  Description of Artificial Sequence: Synthetic oligonucleotide
  Target: ATXN1; (+) strand; PAM type: NRG; PAM sequence: TGG
aagttccactaactagtaat

SEQ ID NO: 108316 - DNA, 20 bp, Artificial Sequence
  Description of Artificial Sequence: Synthetic oligonucleotide
  Target: ATXN1; (+) strand; PAM type: NRG; PAM sequence: TAG
actaactagtaattggctat

SEQ ID NO: 108317 - DNA, 20 bp, Artificial Sequence
  Description of Artificial Sequence: Synthetic oligonucleotide
  Target: ATXN1; (+) strand; PAM type: NRG; PAM sequence: TGG
aaacaaattaataattcatt

SEQ ID NO: 108318 - DNA, 20 bp, Artificial Sequence
  Description of Artificial Sequence: Synthetic oligonucleotide
  Target: ATXN1; (+) strand; PAM type: NRG; PAM sequence: GGG
aacaaattaataattcattt

SEQ ID NO: 108319 - DNA, 20 bp, Artificial Sequence
  Description of Artificial Sequence: Synthetic oligonucleotide
  Target: ATXN1; (+) strand; PAM type: NRG; PAM sequence: CAG
aattaataattcatttgggc

SEQ ID NO: 108320 - DNA, 20 bp, Artificial Sequence
  Description of Artificial Sequence: Synthetic oligonucleotide
  Target: ATXN1; (+) strand; PAM type: NRG; PAM sequence: AGG
attaataattcatttgggcc

SEQ ID NO: 108321 - DNA, 20 bp, Artificial Sequence
  Description of Artificial Sequence: Synthetic oligonucleotide
  Target: ATXN1; (+) strand; PAM type: NRG; PAM sequence: TGG
taattcatttgggccaggcc

SEQ ID NO: 108322 - DNA, 20 bp, Artificial Sequence
  Description of Artificial Sequence: Synthetic oligonucleotide
  Target: ATXN1; (+) strand; PAM type: NRG; PAM sequence: TGG
ttcatttgggccaggcctgg

SEQ ID NO: 108323 - DNA, 20 bp, Artificial Sequence
  Description of Artificial Sequence: Synthetic oligonucleotide
  Target: ATXN1; (+) strand; PAM type: NRG; PAM sequence: TGG
gggccaggcctggtggctta

SEQ ID NO: 108324 - DNA, 20 bp, Artificial Sequence
  Description of Artificial Sequence: Synthetic oligonucleotide
  Target: ATXN1; (+) strand; PAM type: NRG; PAM sequence: CAG
gtggcttatggctctaatct

SEQ ID NO: 108325 - DNA, 20 bp, Artificial Sequence
  Description of Artificial Sequence: Synthetic oligonucleotide
  Target: ATXN1; (+) strand; PAM type: NRG; PAM sequence: TGG
tggctctaatctcagcactt

SEQ ID NO: 108326 - DNA, 20 bp, Artificial Sequence
  Description of Artificial Sequence: Synthetic oligonucleotide
  Target: ATXN1; (+) strand; PAM type: NRG; PAM sequence: GGG
ggctctaatctcagcacttt

SEQ ID NO: 108327 - DNA, 20 bp, Artificial Sequence
  Description of Artificial Sequence: Synthetic oligonucleotide
  Target: ATXN1; (+) strand; PAM type: NRG; PAM sequence: GAG
ctctaatctcagcactttgg

SEQ ID NO: 108328 - DNA, 20 bp, Artificial Sequence
  Description of Artificial Sequence: Synthetic oligonucleotide
  Target: ATXN1; (+) strand; PAM type: NRG; PAM sequence: AGG
tctaatctcagcactttggg

SEQ ID NO: 108329 - DNA, 20 bp, Artificial Sequence
  Description of Artificial Sequence: Synthetic oligonucleotide
  Target: ATXN1; (+) strand; PAM type: NRG; PAM sequence: AAG
tctcagcactttgggaggcc

SEQ ID NO: 108330 - DNA, 20 bp, Artificial Sequence
  Description of Artificial Sequence: Synthetic oligonucleotide
  Target: ATXN1; (+) strand; PAM type: NRG; PAM sequence: AGG
ctcagcactttgggaggcca

SEQ ID NO: 108331 - DNA, 20 bp, Artificial Sequence
  Description of Artificial Sequence: Synthetic oligonucleotide
  Target: ATXN1; (+) strand; PAM type: NRG; PAM sequence: CAG
agcactttgggaggccaagg

SEQ ID NO: 108332 - DNA, 20 bp, Artificial Sequence
  Description of Artificial Sequence: Synthetic oligonucleotide
  Target: ATXN1; (+) strand; PAM type: NRG; PAM sequence: AGG
gcactttgggaggccaaggc

SEQ ID NO: 108333 - DNA, 20 bp, Artificial Sequence
  Description of Artificial Sequence: Synthetic oligonucleotide
  Target: ATXN1; (+) strand; PAM type: NRG; PAM sequence: GAG
actttgggaggccaaggcag

SEQ ID NO: 108334 - DNA, 20 bp, Artificial Sequence
  Description of Artificial Sequence: Synthetic oligonucleotide
  Target: ATXN1; (+) strand; PAM type: NRG; PAM sequence: AGG
ctttgggaggccaaggcagg

SEQ ID NO: 108335 - DNA, 20 bp, Artificial Sequence
  Description of Artificial Sequence: Synthetic oligonucleotide
  Target: ATXN1; (+) strand; PAM type: NRG; PAM sequence: GAG
ccaaggcaggaggatccctt

SEQ ID NO: 108336 - DNA, 20 bp, Artificial Sequence
  Description of Artificial Sequence: Synthetic oligonucleotide
  Target: ATXN1; (+) strand; PAM type: NRG; PAM sequence: AGG
caaggcaggaggatcccttg

SEQ ID NO: 108337 - DNA, 20 bp, Artificial Sequence
  Description of Artificial Sequence: Synthetic oligonucleotide
  Target: ATXN1; (+) strand; PAM type: NRG; PAM sequence: CAG
gcaggaggatcccttgaggc

SEQ ID NO: 108338 - DNA, 20 bp, Artificial Sequence
  Description of Artificial Sequence: Synthetic oligonucleotide
  Target: ATXN1; (+) strand; PAM type: NRG; PAM sequence: AGG
caggaggatcccttgaggcc

SEQ ID NO: 108339 - DNA, 20 bp, Artificial Sequence
  Description of Artificial Sequence: Synthetic oligonucleotide
  Target: ATXN1; (+) strand; PAM type: NRG; PAM sequence: GAG
ggaggatcccttgaggccag

SEQ ID NO: 108340 - DNA, 20 bp, Artificial Sequence
  Description of Artificial Sequence: Synthetic oligonucleotide
  Target: ATXN1; (+) strand; PAM type: NRG; PAM sequence: AAG
tcccttgaggccaggagttt

SEQ ID NO: 108341 - DNA, 20 bp, Artificial Sequence
  Description of Artificial Sequence: Synthetic oligonucleotide
  Target: ATXN1; (+) strand; PAM type: NRG; PAM sequence: CAG
tgaggccaggagtttaagac

SEQ ID NO: 108342 - DNA, 20 bp, Artificial Sequence
  Description of Artificial Sequence: Synthetic oligonucleotide
  Target: ATXN1; (+) strand; PAM type: NRG; PAM sequence: TGG
ccaggagtttaagaccagcc

SEQ ID NO: 108343 - DNA, 20 bp, Artificial Sequence
  Description of Artificial Sequence: Synthetic oligonucleotide
  Target: ATXN1; (+) strand; PAM type: NRG; PAM sequence: GGG
caggagtttaagaccagcct

SEQ ID NO: 108344 - DNA, 20 bp, Artificial Sequence
  Description of Artificial Sequence: Synthetic oligonucleotide
  Target: ATXN1; (+) strand; PAM type: NRG; PAM sequence: TAG
taagaccagcctgggcaaca

SEQ ID NO: 108345 - DNA, 20 bp, Artificial Sequence
  Description of Artificial Sequence: Synthetic oligonucleotide
  Target: ATXN1; (+) strand; PAM type: NRG; PAM sequence: AAG
accagcctgggcaacatagc

SEQ ID NO: 108346 - DNA, 20 bp, Artificial Sequence
  Description of Artificial Sequence: Synthetic oligonucleotide
  Target: ATXN1; (+) strand; PAM type: NRG; PAM sequence: AAG
tagcaagaccccatctatac

SEQ ID NO: 108347 - DNA, 20 bp, Artificial Sequence
  Description of Artificial Sequence: Synthetic oligonucleotide
  Target: ATXN1; (+) strand; PAM type: NRG; PAM sequence: AAG
caagaccccatctatacaag

SEQ ID NO: 108348 - DNA, 20 bp, Artificial Sequence
  Description of Artificial Sequence: Synthetic oligonucleotide
  Target: ATXN1; (+) strand; PAM type: NRG; PAM sequence: TAG
atacaagaagcttaaaaaaa

SEQ ID NO: 108349 - DNA, 20 bp, Artificial Sequence
  Description of Artificial Sequence: Synthetic oligonucleotide
  Target: ATXN1; (+) strand; PAM type: NRG; PAM sequence: CAG
aagaagcttaaaaaaatagc

SEQ ID NO: 108350 - DNA, 20 bp, Artificial Sequence
  Description of Artificial Sequence: Synthetic oligonucleotide
  Target: ATXN1; (+) strand; PAM type: NRG; PAM sequence: AGG
agaagcttaaaaaaatagcc

SEQ ID NO: 108351 - DNA, 20 bp, Artificial Sequence
  Description of Artificial Sequence: Synthetic oligonucleotide
  Target: ATXN1; (+) strand; PAM type: NRG; PAM sequence: CAG
agcttaaaaaaatagccagg

SEQ ID NO: 108352 - DNA, 20 bp, Artificial Sequence
  Description of Artificial Sequence: Synthetic oligonucleotide
  Target: ATXN1; (+) strand; PAM type: NRG; PAM sequence: AGG
gcttaaaaaaatagccaggc

SEQ ID NO: 108353 - DNA, 20 bp, Artificial Sequence
  Description of Artificial Sequence: Synthetic oligonucleotide
  Target: ATXN1; (+) strand; PAM type: NRG; PAM sequence: GAG
ttaaaaaaatagccaggcag

SEQ ID NO: 108354 - DNA, 20 bp, Artificial Sequence
  Description of Artificial Sequence: Synthetic oligonucleotide
  Target: ATXN1; (+) strand; PAM type: NRG; PAM sequence: TGG
aaaatagccaggcaggagaa

SEQ ID NO: 108355 - DNA, 20 bp, Artificial Sequence
  Description of Artificial Sequence: Synthetic oligonucleotide
  Target: ATXN1; (+) strand; PAM type: NRG; PAM sequence: TGG
gcaggagaatggtgtgaacc

SEQ ID NO: 108356 - DNA, 20 bp, Artificial Sequence
  Description of Artificial Sequence: Synthetic oligonucleotide
  Target: ATXN1; (+) strand; PAM type: NRG; PAM sequence: GGG
caggagaatggtgtgaacct

SEQ ID NO: 108357 - DNA, 20 bp, Artificial Sequence
  Description of Artificial Sequence: Synthetic oligonucleotide
  Target: ATXN1; (+) strand; PAM type: NRG; PAM sequence: GAG
ggagaatggtgtgaacctgg

SEQ ID NO: 108358 - DNA, 20 bp, Artificial Sequence
  Description of Artificial Sequence: Synthetic oligonucleotide
  Target: ATXN1; (+) strand; PAM type: NRG; PAM sequence: AGG
gagaatggtgtgaacctggg

SEQ ID NO: 108359 - DNA, 20 bp, Artificial Sequence
  Description of Artificial Sequence: Synthetic oligonucleotide
  Target: ATXN1; (+) strand; PAM type: NRG; PAM sequence: CGG
aatggtgtgaacctgggagg

SEQ ID NO: 108360 - DNA, 20 bp, Artificial Sequence
  Description of Artificial Sequence: Synthetic oligonucleotide
  Target: ATXN1; (+) strand; PAM type: NRG; PAM sequence: GAG
tggtgtgaacctgggaggcg

SEQ ID NO: 108361 - DNA, 20 bp, Artificial Sequence
  Description of Artificial Sequence: Synthetic oligonucleotide
  Target: ATXN1; (+) strand; PAM type: NRG; PAM sequence: CAG
aacctgggaggcggagcttg

SEQ ID NO: 108362 - DNA, 20 bp, Artificial Sequence
  Description of Artificial Sequence: Synthetic oligonucleotide
  Target: ATXN1; (+) strand; PAM type: NRG; PAM sequence: GAG
tgggaggcggagcttgcagt

SEQ ID NO: 108363 - DNA, 20 bp, Artificial Sequence
  Description of Artificial Sequence: Synthetic oligonucleotide
  Target: ATXN1; (+) strand; PAM type: NRG; PAM sequence: TGG
aggcggagcttgcagtgagc

SEQ ID NO: 108364 - DNA, 20 bp, Artificial Sequence
  Description of Artificial Sequence: Synthetic oligonucleotide
  Target: ATXN1; (+) strand; PAM type: NRG; PAM sequence: GGG
ggcggagcttgcagtgagct

SEQ ID NO: 108365 - DNA, 20 bp, Artificial Sequence
  Description of Artificial Sequence: Synthetic oligonucleotide
  Target: ATXN1; (+) strand; PAM type: NRG; PAM sequence: CAG
gggatcacactactgcactc

SEQ ID NO: 108366 - DNA, 20 bp, Artificial Sequence
  Description of Artificial Sequence: Synthetic oligonucleotide
  Target: ATXN1; (+) strand; PAM type: NRG; PAM sequence: TGG
cacactactgcactccagcc

SEQ ID NO: 108367 - DNA, 20 bp, Artificial Sequence
  Description of Artificial Sequence: Synthetic oligonucleotide
  Target: ATXN1; (+) strand; PAM type: NRG; PAM sequence: GGG
acactactgcactccagcct

SEQ ID NO: 108368 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggcaa

SEQ ID NO: 108369 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggcaaca

SEQ ID NO: 108370 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggcaacagagc

SEQ ID NO: 108371 - DNA, 20 bp, Artificial Sequence
  Description of Artificial Sequence: Synthetic oligonucleotide
  Target: ATXN1; (+) strand; PAM type: NRG; PAM sequence: CAG
caaaaaaaaaaaaaaatacc

SEQ ID NO: 108372 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaaaaaaaataccc

SEQ ID NO: 108373 - DNA, 20 bp, Artificial Sequence
  Description of Artificial Sequence: Synthetic oligonucleotide
  Target: ATXN1; (+) strand; PAM type: NRG; PAM sequence: CGG
aaaaaaaaaatacccaggta

SEQ ID NO: 108374 - DNA, 20 bp, Artificial Sequence
  Description of Artificial Sequence: Synthetic oligonucleotide
  Target: ATXN1; (+) strand; PAM type: NRG; PAM sequence: TGG
aaaaaaatacccaggtacgg

SEQ ID NO: 108375 - DNA, 20 bp, Artificial Sequence
  Description of Artificial Sequence: Synthetic oligonucleotide
  Target: ATXN1; (+) strand; PAM type: NRG; PAM sequence: TAG
ggtacggtggtgtgcactta

SEQ ID NO: 108376 - DNA, 20 bp, Artificial Sequence
  Description of Artificial Sequence: Synthetic oligonucleotide
  Target: ATXN1; (+) strand; PAM type: NRG; PAM sequence: CAG
gtggtgtgcacttatagtcc

SEQ ID NO: 108377 - DNA, 20 bp, Artificial Sequence
  Description of Artificial Sequence: Synthetic oligonucleotide
  Target: ATXN1; (+) strand; PAM type: NRG; PAM sequence: TGG
cacttatagtcccagcaact

SEQ ID NO: 108378 - DNA, 20 bp, Artificial Sequence
  Description of Artificial Sequence: Synthetic oligonucleotide
  Target: ATXN1; (+) strand; PAM type: NRG; PAM sequence: GGG
acttatagtcccagcaactt

SEQ ID NO: 108379 - DNA, 20 bp, Artificial Sequence
  Description of Artificial Sequence: Synthetic oligonucleotide
  Target: ATXN1; (+) strand; PAM type: NRG; PAM sequence: GAG
ttatagtcccagcaacttgg

SEQ ID NO: 108380 - DNA, 20 bp, Artificial Sequence
  Description of Artificial Sequence: Synthetic oligonucleotide
  Target: ATXN1; (+) strand; PAM type: NRG; PAM sequence: AGG
tatagtcccagcaacttggg

SEQ ID NO: 108381 - DNA, 20 bp, Artificial Sequence
  Description of Artificial Sequence: Synthetic oligonucleotide
  Target: ATXN1; (+) strand; PAM type: NRG; PAM sequence: GAG
tcccagcaacttgggaggct

SEQ ID NO: 108382 - DNA, 20 bp, Artificial Sequence
  Description of Artificial Sequence: Synthetic oligonucleotide
  Target: ATXN1; (+) strand; PAM type: NRG; PAM sequence: AGG
cccagcaacttgggaggctg

SEQ ID NO: 108383 - DNA, 20 bp, Artificial Sequence
  Description of Artificial Sequence: Synthetic oligonucleotide
  Target: ATXN1; (+) strand; PAM type: NRG; PAM sequence: TGG
agcaacttgggaggctgagg

SEQ ID NO: 108384 - DNA, 20 bp, Artificial Sequence
  Description of Artificial Sequence: Synthetic oligonucleotide
  Target: ATXN1; (+) strand; PAM type: NRG; PAM sequence: AAG
aacttgggaggctgaggtgg

SEQ ID NO: 108385 - DNA, 20 bp, Artificial Sequence
  Description of Artificial Sequence: Synthetic oligonucleotide
  Target: ATXN1; (+) strand; PAM type: NRG; PAM sequence: TGG
gctgaggtggaagcatcact

SEQ ID NO: 108386 - DNA, 20 bp, Artificial Sequence
  Description of Artificial Sequence: Synthetic oligonucleotide
  Target: ATXN1; (+) strand; PAM type: NRG; PAM sequence: GGG
ctgaggtggaagcatcactt

SEQ ID NO: 108387 - DNA, 20 bp, Artificial Sequence
  Description of Artificial Sequence: Synthetic oligonucleotide
  Target: ATXN1; (+) strand; PAM type: NRG; PAM sequence: CAG
gtggaagcatcacttgggcc

SEQ ID NO: 108388 - DNA, 20 bp, Artificial Sequence
  Description of Artificial Sequence: Synthetic oligonucleotide
  Target: ATXN1; (+) strand; PAM type: NRG; PAM sequence: AAG
gaagcatcacttgggcccag

SEQ ID NO: 108389 - DNA, 20 bp, Artificial Sequence
  Description of Artificial Sequence: Synthetic oligonucleotide
  Target: ATXN1; (+) strand; PAM type: NRG; PAM sequence: GAG
tcacttgggcccagaagttt

SEQ ID NO: 108390 - DNA, 20 bp, Artificial Sequence
  Description of Artificial Sequence: Synthetic oligonucleotide
  Target: ATXN1; (+) strand; PAM type: NRG; PAM sequence: AGG
cacttgggcccagaagtttg

SEQ ID NO: 108391 - DNA, 20 bp, Artificial Sequence
  Description of Artificial Sequence: Synthetic oligonucleotide
  Target: ATXN1; (+) strand; PAM type: NRG; PAM sequence: CAG
ggcccagaagtttgaggatg

SEQ ID NO: 108392 - DNA, 20 bp, Artificial Sequence
  Description of Artificial Sequence: Synthetic oligonucleotide
  Target: ATXN1; (+) strand; PAM type: NRG; PAM sequence: GAG
cagaagtttgaggatgcagt

SEQ ID NO: 108393 - DNA, 20 bp, Artificial Sequence
  Description of Artificial Sequence: Synthetic oligonucleotide
  Target: ATXN1; (+) strand; PAM type: NRG; PAM sequence: CAG
gcagtgagctatgatcgtgc

SEQ ID NO: 108394 - DNA, 20 bp, Artificial Sequence
  Description of Artificial Sequence: Synthetic oligonucleotide
  Target: ATXN1; (+) strand; PAM type: NRG; PAM sequence: CAG
atgatcgtgccagtgctctc

SEQ ID NO: 108395 - DNA, 20 bp, Artificial Sequence
  Description of Artificial Sequence: Synthetic oligonucleotide
  Target: ATXN1; (+) strand; PAM type: NRG; PAM sequence: TGG
cgtgccagtgctctccagcc

SEQ ID NO: 108396 - DNA, 20 bp, Artificial Sequence
  Description of Artificial Sequence: Synthetic oligonucleotide
  Target: ATXN1; (+) strand; PAM type: NRG; PAM sequence: GGG
gtgccagtgctctccagcct

SEQ ID NO: 108397 - DNA, 20 bp, Artificial Sequence
  Description of Artificial Sequence: Synthetic oligonucleotide
  Target: ATXN1; (+) strand; PAM type: NRG; PAM sequence: AAG
tgctctccagcctgggtgac

SEQ ID NO: 108398 - DNA, 20 bp, Artificial Sequence
  Description of Artificial Sequence: Synthetic oligonucleotide
  Target: ATXN1; (+) strand; PAM type: NRG; PAM sequence: GAG
ctctccagcctgggtgacaa

SEQ ID NO: 108399 - DNA, 20 bp, Artificial Sequence
  Description of Artificial Sequence: Synthetic oligonucleotide
  Target: ATXN1; (+) strand; PAM type: NRG; PAM sequence: GAG
ccagcctgggtgacaagagt

SEQ ID NO: 108400 - DNA, 20 bp, Artificial Sequence
  Description of Artificial Sequence: Synthetic oligonucleotide
  Target: ATXN1; (+) strand; PAM type: NRG; PAM sequence: AAG
agagtgagactctctcccta

SEQ ID NO: 108401 - DNA, 20 bp, Artificial Sequence
  Description of Artificial Sequence: Synthetic oligonucleotide
  Target: ATXN1; (+) strand; PAM type: NRG; PAM sequence: AAG
gagactctctccctaaagaa

SEQ ID NO: 108402 - DNA, 20 bp, Artificial Sequence
  Description of Artificial Sequence: Synthetic oligonucleotide
  Target: ATXN1; (+) strand; PAM type: NRG; PAM sequence: AAG
ctctccctaaagaaaagaaa

SEQ ID NO: 108403 - DNA, 20 bp, Artificial Sequence
  Description of Artificial Sequence: Synthetic oligonucleotide
  Target: ATXN1; (+) strand; PAM type: NRG; PAM sequence: TGG
gaaaagaaaaagaattccct

SEQ ID NO: 108404 - DNA, 20 bp, Artificial Sequence
  Description of Artificial Sequence: Synthetic oligonucleotide
  Target: ATXN1; (+) strand; PAM type: NRG; PAM sequence: AAG
aagaaaaagaattcccttgg

SEQ ID NO: 108405 - DNA, 20 bp, Artificial Sequence
  Description of Artificial Sequence: Synthetic oligonucleotide
  Target: ATXN1; (+) strand; PAM type: NRG; PAM sequence: AGG
agaaaaagaattcccttgga

SEQ ID NO: 108406 - DNA, 20 bp, Artificial Sequence
  Description of Artificial Sequence: Synthetic oligonucleotide
  Target: ATXN1; (+) strand; PAM type: NRG; PAM sequence: TAG
cttggaaggttttgcttttt

SEQ ID NO: 108407 - DNA, 20 bp, Artificial Sequence
  Description of Artificial Sequence: Synthetic oligonucleotide
  Target: ATXN1; (+) strand; PAM type: NRG; PAM sequence: AAG
ggttttgcttttttagaaat

SEQ ID NO: 108408 - DNA, 20 bp, Artificial Sequence
  Description of Artificial Sequence: Synthetic oligonucleotide
  Target: ATXN1; (+) strand; PAM type: NRG; PAM sequence: TAG
tgcttttttagaaataagat

SEQ ID NO: 108409 - DNA, 20 bp, Artificial Sequence
  Description of Artificial Sequence: Synthetic oligonucleotide
  Target: ATXN1; (+) strand; PAM type: NRG; PAM sequence: AAG
ttttagaaataagattagct

SEQ ID NO: 108410 - DNA, 20 bp, Artificial Sequence
  Description of Artificial Sequence: Synthetic oligonucleotide
  Target: ATXN1; (+) strand; PAM type: NRG; PAM sequence: AAG
ctaagaaaattaataatgca

SEQ ID NO: 108411 - DNA, 20 bp, Artificial Sequence
  Description of Artificial Sequence: Synthetic oligonucleotide
  Target: ATXN1; (+) strand; PAM type: NRG; PAM sequence: AAG
agaaaattaataatgcaaag

SEQ ID NO: 108412 - DNA, 20 bp, Artificial Sequence
  Description of Artificial Sequence: Synthetic oligonucleotide
  Target: ATXN1; (+) strand; PAM type: NRG; PAM sequence: TAG
aattaataatgcaaagaagt

SEQ ID NO: 108413 - DNA, 20 bp, Artificial Sequence
  Description of Artificial Sequence: Synthetic oligonucleotide
  Target: ATXN1; (+) strand; PAM type: NRG; PAM sequence: AGG
attaataatgcaaagaagtt

SEQ ID NO: 108414 - DNA, 20 bp, Artificial Sequence
  Description of Artificial Sequence: Synthetic oligonucleotide
  Target: ATXN1; (+) strand; PAM type: NRG; PAM sequence: GGG
ttaataatgcaaagaagtta

SEQ ID NO: 108415 - DNA, 20 bp, Artificial Sequence
  Description of Artificial Sequence: Synthetic oligonucleotide
  Target: ATXN1; (+) strand; PAM type: NRG; PAM sequence: GGG
taataatgcaaagaagttag

SEQ ID NO: 108416 - DNA, 20 bp, Artificial Sequence
  Description of Artificial Sequence: Synthetic oligonucleotide
  Target: ATXN1; (+) strand; PAM type: NRG; PAM sequence: TGG
taatgcaaagaagttagggg

SEQ ID NO: 108417 - DNA, 20 bp, Artificial Sequence
  Description of Artificial Sequence: Synthetic oligonucleotide
  Target: ATXN1; (+) strand; PAM type: NRG; PAM sequence: GGG
aatgcaaagaagttaggggt

SEQ ID NO: 108418 - DNA, 20 bp, Artificial Sequence
  Description of Artificial Sequence: Synthetic oligonucleotide
  Target: ATXN1; (+) strand; PAM type: NRG; PAM sequence: TGG
gcaaagaagttaggggtggg

SEQ ID NO: 108419 - DNA, 20 bp, Artificial Sequence
  Description of Artificial Sequence: Synthetic oligonucleotide
  Target: ATXN1; (+) strand; PAM type: NRG; PAM sequence: GGG
caaagaagttaggggtgggt

SEQ ID NO: 108420 - DNA, 20 bp, Artificial Sequence
  Description of Artificial Sequence: Synthetic oligonucleotide
  Target: ATXN1; (+) strand; PAM type: NRG; PAM sequence: GGG
aaagaagttaggggtgggtg

SEQ ID NO: 108421 - DNA, 20 bp, Artificial Sequence
  Description of Artificial Sequence: Synthetic oligonucleotide
  Target: ATXN1; (+) strand; PAM type: NRG; PAM sequence: GAG
aagttaggggtgggtggggt

SEQ ID NO: 108422 - DNA, 20 bp, Artificial Sequence
  Description of Artificial Sequence: Synthetic oligonucleotide
  Target: ATXN1; (+) strand; PAM type: NRG; PAM sequence: GAG
gttaggggtgggtggggtga

SEQ ID NO: 108423 - DNA, 20 bp, Artificial Sequence
  Description of Artificial Sequence: Synthetic oligonucleotide
  Target: ATXN1; (+) strand; PAM type: NRG; PAM sequence: CAG
gggtgggtggggtgagagaa

SEQ ID NO: 108424 - DNA, 20 bp, Artificial Sequence
  Description of Artificial Sequence: Synthetic oligonucleotide
  Target: ATXN1; (+) strand; PAM type: NRG; PAM sequence: AGG
ggtgggtggggtgagagaac

SEQ ID NO: 108425 - DNA, 20 bp, Artificial Sequence
  Description of Artificial Sequence: Synthetic oligonucleotide
  Target: ATXN1; (+) strand; PAM type: NRG; PAM sequence: TAG
aatccaaaattgttttaaaa

SEQ ID NO: 108426 - DNA, 20 bp, Artificial Sequence
  Description of Artificial Sequence: Synthetic oligonucleotide
  Target: ATXN1; (+) strand; PAM type: NRG; PAM sequence: AAG
tccattcctccataacaatg

SEQ ID NO: 108427 - DNA, 20 bp, Artificial Sequence
  Description of Artificial Sequence: Synthetic oligonucleotide
  Target: ATXN1; (+) strand; PAM type: NRG; PAM sequence: TAG
actttcaacgtctgttactg

SEQ ID NO: 108428 - DNA, 20 bp, Artificial Sequence
  Description of Artificial Sequence: Synthetic oligonucleotide
  Target: ATXN1; (+) strand; PAM type: NRG; PAM sequence: TAG
caacgtctgttactgtagcc

SEQ ID NO: 108429 - DNA, 20 bp, Artificial Sequence
  Description of Artificial Sequence: Synthetic oligonucleotide
  Target: ATXN1; (+) strand; PAM type: NRG; PAM sequence: AGG
aacgtctgttactgtagcct

SEQ ID NO: 108430 - DNA, 20 bp, Artificial Sequence
  Description of Artificial Sequence: Synthetic oligonucleotide
  Target: ATXN1; (+) strand; PAM type: NRG; PAM sequence: TAG
gtctgttactgtagcctagg

SEQ ID NO: 108431 - DNA, 20 bp, Artificial Sequence
  Description of Artificial Sequence: Synthetic oligonucleotide
  Target: ATXN1; (+) strand; PAM type: NRG; PAM sequence: GAG
ctgttactgtagcctaggta

SEQ ID NO: 108432 - DNA, 20 bp, Artificial Sequence
  Description of Artificial Sequence: Synthetic oligonucleotide
  Target: ATXN1; (+) strand; PAM type: NRG; PAM sequence: AAG
actgtagcctaggtagagtg

SEQ ID NO: 108433 - DNA, 20 bp, Artificial Sequence
  Description of Artificial Sequence: Synthetic oligonucleotide
  Target: ATXN1; (+) strand; PAM type: NRG; PAM sequence: AGG
ctgtagcctaggtagagtga

SEQ ID NO: 108434 - DNA, 20 bp, Artificial Sequence
  Description of Artificial Sequence: Synthetic oligonucleotide
  Target: ATXN1; (+) strand; PAM type: NRG; PAM sequence: GGG
tgtagcctaggtagagtgaa

SEQ ID NO: 108435 - DNA, 20 bp, Artificial Sequence
  Description of Artificial Sequence: Synthetic oligonucleotide
  Target: ATXN1; (+) strand; PAM type: NRG; PAM sequence: TGG
agcctaggtagagtgaaggg

SEQ ID NO: 108436 - DNA, 20 bp, Artificial Sequence
  Description of Artificial Sequence: Synthetic oligonucleotide
  Target: ATXN1; (+) strand; PAM type: NRG; PAM sequence: AAG
agagtgaagggtggtcatcc

SEQ ID NO: 108437 - DNA, 20 bp, Artificial Sequence
  Description of Artificial Sequence: Synthetic oligonucleotide
  Target: ATXN1; (+) strand; PAM type: NRG; PAM sequence: TAG
ggtcatccaagactcacatc

SEQ ID NO: 108438 - DNA, 20 bp, Artificial Sequence
  Description of Artificial Sequence: Synthetic oligonucleotide
  Target: ATXN1; (+) strand; PAM type: NRG; PAM sequence: GAG
tcatccaagactcacatcta

SEQ ID NO: 108439 - DNA, 20 bp, Artificial Sequence
  Description of Artificial Sequence: Synthetic oligonucleotide
  Target: ATXN1; (+) strand; PAM type: NRG; PAM sequence: CAG
tccaagactcacatctagag

SEQ ID NO: 108440 - DNA, 20 bp, Artificial Sequence
  Description of Artificial Sequence: Synthetic oligonucleotide
  Target: ATXN1; (+) strand; PAM type: NRG; PAM sequence: AGG
ccaagactcacatctagagc

SEQ ID NO: 108441 - DNA, 20 bp, Artificial Sequence
  Description of Artificial Sequence: Synthetic oligonucleotide
  Target: ATXN1; (+) strand; PAM type: NRG; PAM sequence: GGG
caagactcacatctagagca

SEQ ID NO: 108442 - DNA, 20 bp, Artificial Sequence
  Description of Artificial Sequence: Synthetic oligonucleotide
  Target: ATXN1; (+) strand; PAM type: NRG; PAM sequence: GGG
aagactcacatctagagcag

SEQ ID NO: 108443 - DNA, 20 bp, Artificial Sequence
  Description of Artificial Sequence: Synthetic oligonucleotide
  Target: ATXN1; (+) strand; PAM type: NRG; PAM sequence: TGG
agcaggggtgtccaatcttt

SEQ ID NO: 108444 - DNA, 20 bp, Artificial Sequence
  Description of Artificial Sequence: Synthetic oligonucleotide
  Target: ATXN1; (+) strand; PAM type: NRG; PAM sequence: TGG
gtccaatcttttggcttccc

SEQ ID NO: 108445 - DNA, 20 bp, Artificial Sequence
  Description of Artificial Sequence: Synthetic oligonucleotide
  Target: ATXN1; (+) strand; PAM type: NRG; PAM sequence: GGG
tccaatcttttggcttccct

SEQ ID NO: 108446 - DNA, 20 bp, Artificial Sequence
  Description of Artificial Sequence: Synthetic oligonucleotide
  Target: ATXN1; (+) strand; PAM type: NRG; PAM sequence: TGG
ttggcttccctgggccacac

SEQ ID NO: 108447 - DNA, 20 bp, Artificial Sequence
  Description of Artificial Sequence: Synthetic oligonucleotide
  Target: ATXN1; (+) strand; PAM type: NRG; PAM sequence: AAG
gcttccctgggccacactgg

SEQ ID NO: 108448 - DNA, 20 bp, Artificial Sequence
  Description of Artificial Sequence: Synthetic oligonucleotide
  Target: ATXN1; (+) strand; PAM type: NRG; PAM sequence: AGG
cttccctgggccacactgga

SEQ ID NO: 108449 - DNA, 20 bp, Artificial Sequence
  Description of Artificial Sequence: Synthetic oligonucleotide
  Target: ATXN1; (+) strand; PAM type: NRG; PAM sequence: GAG
tccctgggccacactggaag

SEQ ID NO: 108450 - DNA, 20 bp, Artificial Sequence
  Description of Artificial Sequence: Synthetic oligonucleotide
  Target: ATXN1; (+) strand; PAM type: NRG; PAM sequence: TGG
tggaaggagaaaaattgtct

SEQ ID NO: 108451 - DNA, 20 bp, Artificial Sequence
  Description of Artificial Sequence: Synthetic oligonucleotide
  Target: ATXN1; (+) strand; PAM type: NRG; PAM sequence: GGG
ggaaggagaaaaattgtctt

SEQ ID NO: 108452 - DNA, 20 bp, Artificial Sequence
  Description of Artificial Sequence: Synthetic oligonucleotide
  Target: ATXN1; (+) strand; PAM type: NRG; PAM sequence: AAG
ttgtcttgggctgcacataa

SEQ ID NO: 108453 - DNA, 20 bp, Artificial Sequence
  Description of Artificial Sequence: Synthetic oligonucleotide
  Target: ATXN1; (+) strand; PAM type: NRG; PAM sequence: CAG
aaagacactatcactaatga

SEQ ID NO: 108454 - DNA, 20 bp, Artificial Sequence
  Description of Artificial Sequence: Synthetic oligonucleotide
  Target: ATXN1; (+) strand; PAM type: NRG; PAM sequence: GAG
tatcactaatgacagctgat

SEQ ID NO: 108455 - DNA, 20 bp, Artificial Sequence
  Description of Artificial Sequence: Synthetic oligonucleotide
  Target: ATXN1; (+) strand; PAM type: NRG; PAM sequence: AAG
aaaaaaataaataaacttgc

SEQ ID NO: 108456 - DNA, 20 bp, Artificial Sequence
  Description of Artificial Sequence: Synthetic oligonucleotide
  Target: ATXN1; (+) strand; PAM type: NRG; PAM sequence: TGG
ataaataaacttgcaagtct

SEQ ID NO: 108457 - DNA, 20 bp, Artificial Sequence
  Description of Artificial Sequence: Synthetic oligonucleotide
  Target: ATXN1; (+) strand; PAM type: NRG; PAM sequence: AAG
taaacttgcaagtcttggcc

SEQ ID NO: 108458 - DNA, 20 bp, Artificial Sequence
  Description of Artificial Sequence: Synthetic oligonucleotide
  Target: ATXN1; (+) strand; PAM type: NRG; PAM sequence: TGG
aagtcttggccaagtgttcc

SEQ ID NO: 108459 - DNA, 20 bp, Artificial Sequence
  Description of Artificial Sequence: Synthetic oligonucleotide
  Target: ATXN1; (+) strand; PAM type: NRG; PAM sequence: GGG
agtcttggccaagtgttcct

SEQ ID NO: 108460 - DNA, 20 bp, Artificial Sequence
  Description of Artificial Sequence: Synthetic oligonucleotide
  Target: ATXN1; (+) strand; PAM type: NRG; PAM sequence: AAG
cttggccaagtgttcctggg

SEQ ID NO: 108461 - DNA, 20 bp, Artificial Sequence
  Description of Artificial Sequence: Synthetic oligonucleotide
  Target: ATXN1; (+) strand; PAM type: NRG; PAM sequence: AGG
ttggccaagtgttcctggga

SEQ ID NO: 108462 - DNA, 20 bp, Artificial Sequence
  Description of Artificial Sequence: Synthetic oligonucleotide
  Target: ATXN1; (+) strand; PAM type: NRG; PAM sequence: TGG
caagtgttcctgggaaggcc

SEQ ID NO: 108463 - DNA, 20 bp, Artificial Sequence
  Description of Artificial Sequence: Synthetic oligonucleotide
  Target: ATXN1; (+) strand; PAM type: NRG; PAM sequence: TGG
tgttcctgggaaggcctgga

SEQ ID NO: 108464 - DNA, 20 bp, Artificial Sequence
  Description of Artificial Sequence: Synthetic oligonucleotide
  Target: ATXN1; (+) strand; PAM type: NRG; PAM sequence: CAG
tcctgggaaggcctggatgg

SEQ ID NO: 108465 - DNA, 20 bp, Artificial Sequence
  Description of Artificial Sequence: Synthetic oligonucleotide
  Target: ATXN1; (+) strand; PAM type: NRG; PAM sequence: GAG
ctgggaaggcctggatggca

SEQ ID NO: 108466 - DNA, 20 bp, Artificial Sequence
  Description of Artificial Sequence: Synthetic oligonucleotide
  Target: ATXN1; (+) strand; PAM type: NRG; PAM sequence: AGG
tgggaaggcctggatggcag

SEQ ID NO: 108467 - DNA, 20 bp, Artificial Sequence
  Description of Artificial Sequence: Synthetic oligonucleotide
  Target: ATXN1; (+) strand; PAM type: NRG; PAM sequence: TGG
gcctggatggcagaggtgaa

SEQ ID NO: 108468 - DNA, 20 bp, Artificial Sequence
  Description of Artificial Sequence: Synthetic oligonucleotide
  Target: ATXN1; (+) strand; PAM type: NRG; PAM sequence: GGG
cctggatggcagaggtgaat

SEQ ID NO: 108469 - DNA, 20 bp, Artificial Sequence
  Description of Artificial Sequence: Synthetic oligonucleotide
  Target: ATXN1; (+) strand; PAM type: NRG; PAM sequence: GAG
tggatggcagaggtgaatgg

SEQ ID NO: 108470 - DNA, 20 bp, Artificial Sequence
  Description of Artificial Sequence: Synthetic oligonucleotide
  Target: ATXN1; (+) strand; PAM type: NRG; PAM sequence: AGG
ggatggcagaggtgaatggg

SEQ ID NO: 108471 - DNA, 20 bp, Artificial Sequence
  Description of Artificial Sequence: Synthetic oligonucleotide
  Target: ATXN1; (+) strand; PAM type: NRG; PAM sequence: GGG
gatggcagaggtgaatggga

SEQ ID NO: 108472 - DNA, 20 bp, Artificial Sequence
  Description of Artificial Sequence: Synthetic oligonucleotide
  Target: ATXN1; (+) strand; PAM type: NRG; PAM sequence: GGG
atggcagaggtgaatgggag

SEQ ID NO: 108473 - DNA, 20 bp, Artificial Sequence
  Description of Artificial Sequence: Synthetic oligonucleotide
  Target: ATXN1; (+) strand; PAM type: NRG; PAM sequence: GGG
tggcagaggtgaatgggagg

SEQ ID NO: 108474 - DNA, 20 bp, Artificial Sequence
  Description of Artificial Sequence: Synthetic oligonucleotide
  Target: ATXN1; (+) strand; PAM type: NRG; PAM sequence: GGG
ggcagaggtgaatgggaggg

SEQ ID NO: 108475 - DNA, 20 bp, Artificial Sequence
  Description of Artificial Sequence: Synthetic oligonucleotide
  Target: ATXN1; (+) strand; PAM type: NRG; PAM sequence: GGG
gcagaggtgaatgggagggg

SEQ ID NO: 108476 - DNA, 20 bp, Artificial Sequence
  Description of Artificial Sequence: Synthetic oligonucleotide
  Target: ATXN1; (+) strand; PAM type: NRG; PAM sequence: GAG
agaggtgaatgggagggggg

SEQ ID NO: 108477 - DNA, 20 bp, Artificial Sequence
  Description of Artificial Sequence: Synthetic oligonucleotide
  Target: ATXN1; (+) strand; PAM type: NRG; PAM sequence: TGG
ggtgaatgggagggggggag

SEQ ID NO: 108478 - DNA, 20 bp, Artificial Sequence
  Description of Artificial Sequence: Synthetic oligonucleotide
  Target: ATXN1; (+) strand; PAM type: NRG; PAM sequence: GGG
gtgaatgggagggggggagt

SEQ ID NO: 108479 - DNA, 20 bp, Artificial Sequence
  Description of Artificial Sequence: Synthetic oligonucleotide
  Target: ATXN1; (+) strand; PAM type: NRG; PAM sequence: GGG
tgaatgggagggggggagtg

SEQ ID NO: 108480 - DNA, 20 bp, Artificial Sequence
  Description of Artificial Sequence: Synthetic oligonucleotide
  Target: ATXN1; (+) strand; PAM type: NRG; PAM sequence: GAG
aatgggagggggggagtggg

SEQ ID NO: 108481 - DNA, 20 bp, Artificial Sequence
  Description of Artificial Sequence: Synthetic oligonucleotide
  Target: ATXN1; (+) strand; PAM type: NRG; PAM sequence: AGG
atgggagggggggagtgggg

SEQ ID NO: 108482 - DNA, 20 bp, Artificial Sequence
  Description of Artificial Sequence: Synthetic oligonucleotide
  Target: ATXN1; (+) strand; PAM type: NRG; PAM sequence: GGG
tgggagggggggagtgggga

SEQ ID NO: 108483 - DNA, 20 bp, Artificial Sequence
  Description of Artificial Sequence: Synthetic oligonucleotide
  Target: ATXN1; (+) strand; PAM type: NRG; PAM sequence: TGG
gagggggggagtggggaggg

SEQ ID NO: 108484 - DNA, 20 bp, Artificial Sequence
  Description of Artificial Sequence: Synthetic oligonucleotide
  Target: ATXN1; (+) strand; PAM type: NRG; PAM sequence: AAG
ggggggagtggggagggtgg

SEQ ID NO: 108485 - DNA, 20 bp, Artificial Sequence
  Description of Artificial Sequence: Synthetic oligonucleotide
  Target: ATXN1; (+) strand; PAM type: NRG; PAM sequence: TGG
gggagtggggagggtggaag

SEQ ID NO: 108486 - DNA, 20 bp, Artificial Sequence
  Description of Artificial Sequence: Synthetic oligonucleotide
  Target: ATXN1; (+) strand; PAM type: NRG; PAM sequence: GGG
ggagtggggagggtggaagt

SEQ ID NO: 108487 - DNA, 20 bp, Artificial Sequence
  Description of Artificial Sequence: Synthetic oligonucleotide
  Target: ATXN1; (+) strand; PAM type: NRG; PAM sequence: GGG
gagtggggagggtggaagtg

SEQ ID NO: 108488 - DNA, 20 bp, Artificial Sequence
  Description of Artificial Sequence: Synthetic oligonucleotide
  Target: ATXN1; (+) strand; PAM type: NRG; PAM sequence: GAG
gtggggagggtggaagtggg

SEQ ID NO: 108489 - DNA, 20 bp, Artificial Sequence
  Description of Artificial Sequence: Synthetic oligonucleotide
  Target: ATXN1; (+) strand; PAM type: NRG; PAM sequence: TAG
gggagggtggaagtggggag

SEQ ID NO: 108490 - DNA, 20 bp, Artificial Sequence
  Description of Artificial Sequence: Synthetic oligonucleotide
  Target: ATXN1; (+) strand; PAM type: NRG; PAM sequence: AGG
ggagggtggaagtggggagt

SEQ ID NO: 108491 - DNA, 20 bp, Artificial Sequence
  Description of Artificial Sequence: Synthetic oligonucleotide
  Target: ATXN1; (+) strand; PAM type: NRG; PAM sequence: GGG
gagggtggaagtggggagta

SEQ ID NO: 108492 - DNA, 20 bp, Artificial Sequence
  Description of Artificial Sequence: Synthetic oligonucleotide
  Target: ATXN1; (+) strand; PAM type: NRG; PAM sequence: GAG
gggtggaagtggggagtagg

SEQ ID NO: 108493 - DNA, 20 bp, Artificial Sequence
  Description of Artificial Sequence: Synthetic oligonucleotide
  Target: ATXN1; (+) strand; PAM type: NRG; PAM sequence: TGG
gaagtggggagtagggagca

SEQ ID NO: 108494 - DNA, 20 bp, Artificial Sequence
  Description of Artificial Sequence: Synthetic oligonucleotide
  Target: ATXN1; (+) strand; PAM type: NRG; PAM sequence: CAG
agggagcatggcaccatgct

SEQ ID NO: 108495 - DNA, 20 bp, Artificial Sequence
  Description of Artificial Sequence: Synthetic oligonucleotide
  Target: ATXN1; (+) strand; PAM type: NRG; PAM sequence: AAG
agcatggcaccatgctcaga

SEQ ID NO: 108496 - DNA, 20 bp, Artificial Sequence
  Description of Artificial Sequence: Synthetic oligonucleotide
  Target: ATXN1; (+) strand; PAM type: NRG; PAM sequence: AAG
tgctcagaaagactccctga

SEQ ID NO: 108497 - DNA, 20 bp, Artificial Sequence
  Description of Artificial Sequence: Synthetic oligonucleotide
  Target: ATXN1; (+) strand; PAM type: NRG; PAM sequence: AAG
ttgttactcctctctgtccc

SEQ ID NO: 108498 - DNA, 20 bp, Artificial Sequence
  Description of Artificial Sequence: Synthetic oligonucleotide
  Target: ATXN1; (+) strand; PAM type: NRG; PAM sequence: CAG
tgtcccaagttcccttttcc

SEQ ID NO: 108499 - DNA, 20 bp, Artificial Sequence
  Description of Artificial Sequence: Synthetic oligonucleotide
  Target: ATXN1; (+) strand; PAM type: NRG; PAM sequence: AGG
gtcccaagttcccttttccc

SEQ ID NO: 108500 - DNA, 20 bp, Artificial Sequence
  Description of Artificial Sequence: Synthetic oligonucleotide
  Target: ATXN1; (+) strand; PAM type: NRG; PAM sequence: CAG
catctcgccctcctctctta

SEQ ID NO: 108501 - DNA, 20 bp, Artificial Sequence
  Description of Artificial Sequence: Synthetic oligonucleotide
  Target: ATXN1; (+) strand; PAM type: NRG; PAM sequence: AGG
atctcgccctcctctcttac

SEQ ID NO: 108502 - DNA, 20 bp, Artificial Sequence
  Description of Artificial Sequence: Synthetic oligonucleotide
  Target: ATXN1; (+) strand; PAM type: NRG; PAM sequence: TGG
tctcttacaggtccctataa

SEQ ID NO: 108503 - DNA, 20 bp, Artificial Sequence
  Description of Artificial Sequence: Synthetic oligonucleotide
  Target: ATXN1; (+) strand; PAM type: NRG; PAM sequence: AAG
cccgcaccatatcttctctt

SEQ ID NO: 108504 - DNA, 20 bp, Artificial Sequence
  Description of Artificial Sequence: Synthetic oligonucleotide
  Target: ATXN1; (+) strand; PAM type: NRG; PAM sequence: AGG
ccgcaccatatcttctctta

SEQ ID NO: 108505 - DNA, 20 bp, Artificial Sequence
  Description of Artificial Sequence: Synthetic oligonucleotide
  Target: ATXN1; (+) strand; PAM type: NRG; PAM sequence: GAG
gcaccatatcttctcttaag

SEQ ID NO: 108506 - DNA, 20 bp, Artificial Sequence
  Description of Artificial Sequence: Synthetic oligonucleotide
  Target: ATXN1; (+) strand; PAM type: NRG; PAM sequence: AGG
caccatatcttctcttaagg

SEQ ID NO: 108507 - DNA, 20 bp, Artificial Sequence
  Description of Artificial Sequence: Synthetic oligonucleotide
  Target: ATXN1; (+) strand; PAM type: NRG; PAM sequence: TGG
tcttctcttaaggaggaatt

SEQ ID NO: 108508 - DNA, 20 bp, Artificial Sequence
  Description of Artificial Sequence: Synthetic oligonucleotide
  Target: ATXN1; (+) strand; PAM type: NRG; PAM sequence: AAG
ggaggaatttggcctaatct

SEQ ID NO: 108509 - DNA, 20 bp, Artificial Sequence
  Description of Artificial Sequence: Synthetic oligonucleotide
  Target: ATXN1; (+) strand; PAM type: NRG; PAM sequence: AAG
attgacctttctgacctcac

SEQ ID NO: 108510 - DNA, 20 bp, Artificial Sequence
  Description of Artificial Sequence: Synthetic oligonucleotide
  Target: ATXN1; (+) strand; PAM type: NRG; PAM sequence: AGG
ttgacctttctgacctcaca

SEQ ID NO: 108511 - DNA, 20 bp, Artificial Sequence
  Description of Artificial Sequence: Synthetic oligonucleotide
  Target: ATXN1; (+) strand; PAM type: NRG; PAM sequence: TAG
ctttctgacctcacaaggaa

SEQ ID NO: 108512 - DNA, 20 bp, Artificial Sequence
  Description of Artificial Sequence: Synthetic oligonucleotide
  Target: ATXN1; (+) strand; PAM type: NRG; PAM sequence: AAG
ctgacctcacaaggaatagc

SEQ ID NO: 108513 - DNA, 20 bp, Artificial Sequence
  Description of Artificial Sequence: Synthetic oligonucleotide
  Target: ATXN1; (+) strand; PAM type: NRG; PAM sequence: AAG
caaggaatagcaagctaaat

SEQ ID NO: 108514 - DNA, 20 bp, Artificial Sequence
  Description of Artificial Sequence: Synthetic oligonucleotide
  Target: ATXN1; (+) strand; PAM type: NRG; PAM sequence: CAG
aatagcaagctaaataagca

SEQ ID NO: 108515 - DNA, 20 bp, Artificial Sequence
  Description of Artificial Sequence: Synthetic oligonucleotide
  Target: ATXN1; (+) strand; PAM type: NRG; PAM sequence: TAG
agcacagaacttgtcctcct

SEQ ID NO: 108516 - DNA, 20 bp, Artificial Sequence
  Description of Artificial Sequence: Synthetic oligonucleotide
  Target: ATXN1; (+) strand; PAM type: NRG; PAM sequence: TGG
cagaacttgtcctccttaga

SEQ ID NO: 108517 - DNA, 20 bp, Artificial Sequence
  Description of Artificial Sequence: Synthetic oligonucleotide
  Target: ATXN1; (+) strand; PAM type: NRG; PAM sequence: GAG
acttgtcctccttagatggt

SEQ ID NO: 108518 - DNA, 20 bp, Artificial Sequence
  Description of Artificial Sequence: Synthetic oligonucleotide
  Target: ATXN1; (+) strand; PAM type: NRG; PAM sequence: AGG
cttgtcctccttagatggtg

SEQ ID NO: 108519 - DNA, 20 bp, Artificial Sequence
  Description of Artificial Sequence: Synthetic oligonucleotide
  Target: ATXN1; (+) strand; PAM type: NRG; PAM sequence: AAG
tcctccttagatggtgagga

SEQ ID NO: 108520 - DNA, 20 bp, Artificial Sequence
  Description of Artificial Sequence: Synthetic oligonucleotide
  Target: ATXN1; (+) strand; PAM type: NRG; PAM sequence: GAG
ctccttagatggtgaggaaa

SEQ ID NO: 108521 - DNA, 20 bp, Artificial Sequence
  Description of Artificial Sequence: Synthetic oligonucleotide
  Target: ATXN1; (+) strand; PAM type: NRG; PAM sequence: TGG
ctatatttttctttaattca

SEQ ID NO: 108522 - DNA, 20 bp, Artificial Sequence
  Description of Artificial Sequence: Synthetic oligonucleotide
  Target: ATXN1; (+) strand; PAM type: NRG; PAM sequence: AAG
acattttatattaatgtaaa

SEQ ID NO: 108523 - DNA, 20 bp, Artificial Sequence
  Description of Artificial Sequence: Synthetic oligonucleotide
  Target: ATXN1; (+) strand; PAM type: NRG; PAM sequence: TGG
tatattaatgtaaaaagaac

SEQ ID NO: 108524 - DNA, 20 bp, Artificial Sequence
  Description of Artificial Sequence: Synthetic oligonucleotide
  Target: ATXN1; (+) strand; PAM type: NRG; PAM sequence: GGG
atattaatgtaaaaagaact

SEQ ID NO: 108525 - DNA, 20 bp, Artificial Sequence
  Description of Artificial Sequence: Synthetic oligonucleotide
  Target: ATXN1; (+) strand; PAM type: NRG; PAM sequence: GAG
attaatgtaaaaagaactgg

SEQ ID NO: 108526 - DNA, 20 bp, Artificial Sequence
  Description of Artificial Sequence: Synthetic oligonucleotide
  Target: ATXN1; (+) strand; PAM type: NRG; PAM sequence: AGG
ttaatgtaaaaagaactggg

SEQ ID NO: 108527 - DNA, 20 bp, Artificial Sequence
  Description of Artificial Sequence: Synthetic oligonucleotide
  Target: ATXN1; (+) strand; PAM type: NRG; PAM sequence: TGG
aaaagaactgggaggactgt

SEQ ID NO: 108528 - DNA, 20 bp, Artificial Sequence
  Description of Artificial Sequence: Synthetic oligonucleotide
  Target: ATXN1; (+) strand; PAM type: NRG; PAM sequence: GGG
aaagaactgggaggactgtt

SEQ ID NO: 108529 - DNA, 20 bp, Artificial Sequence
  Description of Artificial Sequence: Synthetic oligonucleotide
  Target: ATXN1; (+) strand; PAM type: NRG; PAM sequence: CAG
ttgggaatactctgtcatac

SEQ ID NO: 108530 - DNA, 20 bp, Artificial Sequence
  Description of Artificial Sequence: Synthetic oligonucleotide
  Target: ATXN1; (+) strand; PAM type: NRG; PAM sequence: GAG
ataccagcatcattccactt

SEQ ID NO: 108531 - DNA, 20 bp, Artificial Sequence
  Description of Artificial Sequence: Synthetic oligonucleotide
  Target: ATXN1; (+) strand; PAM type: NRG; PAM sequence: TAG
ttatgctataatattaaatg

SEQ ID NO: 108532 - DNA, 20 bp, Artificial Sequence
  Description of Artificial Sequence: Synthetic oligonucleotide
  Target: ATXN1; (+) strand; PAM type: NRG; PAM sequence: TAG
tcttttcaaactataaaact

SEQ ID NO: 108533 - DNA, 20 bp, Artificial Sequence
  Description of Artificial Sequence: Synthetic oligonucleotide
  Target: ATXN1; (+) strand; PAM type: NRG; PAM sequence: TGG
aaacttagtctttcacgtaa

SEQ ID NO: 108534 - DNA, 20 bp, Artificial Sequence
  Description of Artificial Sequence: Synthetic oligonucleotide
  Target: ATXN1; (+) strand; PAM type: NRG; PAM sequence: GGG
aacttagtctttcacgtaat

SEQ ID NO: 108535 - DNA, 20 bp, Artificial Sequence
  Description of Artificial Sequence: Synthetic oligonucleotide
  Target: ATXN1; (+) strand; PAM type: NRG; PAM sequence: GAG
cttagtctttcacgtaatgg

SEQ ID NO: 108536 - DNA, 20 bp, Artificial Sequence
  Description of Artificial Sequence: Synthetic oligonucleotide
  Target: ATXN1; (+) strand; PAM type: NRG; PAM sequence: GAG
tagtctttcacgtaatggga

SEQ ID NO: 108537 - DNA, 20 bp, Artificial Sequence
  Description of Artificial Sequence: Synthetic oligonucleotide
  Target: ATXN1; (+) strand; PAM type: NRG; PAM sequence: AGG
agtctttcacgtaatgggag

SEQ ID NO: 108538 - DNA, 20 bp, Artificial Sequence
  Description of Artificial Sequence: Synthetic oligonucleotide
  Target: ATXN1; (+) strand; PAM type: NRG; PAM sequence: TAG
tcacgtaatgggagaggcga

SEQ ID NO: 108539 - DNA, 20 bp, Artificial Sequence
  Description of Artificial Sequence: Synthetic oligonucleotide
  Target: ATXN1; (+) strand; PAM type: NRG; PAM sequence: TGG
atgggagaggcgatagaata

SEQ ID NO: 108540 - DNA, 20 bp, Artificial Sequence
  Description of Artificial Sequence: Synthetic oligonucleotide
  Target: ATXN1; (+) strand; PAM type: NRG; PAM sequence: TGG
gcgatagaatatggtgctta

SEQ ID NO: 108541 - DNA, 20 bp, Artificial Sequence
  Description of Artificial Sequence: Synthetic oligonucleotide
  Target: ATXN1; (+) strand; PAM type: NRG; PAM sequence: TGG
tctattattaatgataatac

SEQ ID NO: 108542 - DNA, 20 bp, Artificial Sequence
  Description of Artificial Sequence: Synthetic oligonucleotide
  Target: ATXN1; (+) strand; PAM type: NRG; PAM sequence: AAG
aaacacaattcttaaaatat

SEQ ID NO: 108543 - DNA, 20 bp, Artificial Sequence
  Description of Artificial Sequence: Synthetic oligonucleotide
  Target: ATXN1; (+) strand; PAM type: NRG; PAM sequence: TGG
cacacacacttttctgtttg

SEQ ID NO: 108544 - DNA, 20 bp, Artificial Sequence
  Description of Artificial Sequence: Synthetic oligonucleotide
  Target: ATXN1; (+) strand; PAM type: NRG; PAM sequence: TAG
acttttctgtttgtggtcat

SEQ ID NO: 108545 - DNA, 20 bp, Artificial Sequence
  Description of Artificial Sequence: Synthetic oligonucleotide
  Target: ATXN1; (+) strand; PAM type: NRG; PAM sequence: CGG
tcattagatcatgctactaa

SEQ ID NO: 108546 - DNA, 20 bp, Artificial Sequence
  Description of Artificial Sequence: Synthetic oligonucleotide
  Target: ATXN1; (+) strand; PAM type: NRG; PAM sequence: CAG
ttcatttaacatctacacac

SEQ ID NO: 108547 - DNA, 20 bp, Artificial Sequence
  Description of Artificial Sequence: Synthetic oligonucleotide
  Target: ATXN1; (+) strand; PAM type: NRG; PAM sequence: AGG
tcatttaacatctacacacc

SEQ ID NO: 108548 - DNA, 20 bp, Artificial Sequence
  Description of Artificial Sequence: Synthetic oligonucleotide
  Target: ATXN1; (+) strand; PAM type: NRG; PAM sequence: CAG
acatctacacaccaggcacc

SEQ ID NO: 108549 - DNA, 20 bp, Artificial Sequence
  Description of Artificial Sequence: Synthetic oligonucleotide
  Target: ATXN1; (+) strand; PAM type: NRG; PAM sequence: TAG
ctacacaccaggcacccagc

SEQ ID NO: 108550 - DNA, 20 bp, Artificial Sequence
  Description of Artificial Sequence: Synthetic oligonucleotide
  Target: ATXN1; (+) strand; PAM type: NRG; PAM sequence: TGG
caccaggcacccagctagtc

SEQ ID NO: 108551 - DNA, 20 bp, Artificial Sequence
  Description of Artificial Sequence: Synthetic oligonucleotide
  Target: ATXN1; (+) strand; PAM type: NRG; PAM sequence: GGG
accaggcacccagctagtct

SEQ ID NO: 108552 - DNA, 20 bp, Artificial Sequence
  Description of Artificial Sequence: Synthetic oligonucleotide
  Target: ATXN1; (+) strand; PAM type: NRG; PAM sequence: GGG
ccaggcacccagctagtctg

SEQ ID NO: 108553 - DNA, 20 bp, Artificial Sequence
  Description of Artificial Sequence: Synthetic oligonucleotide
  Target: ATXN1; (+) strand; PAM type: NRG; PAM sequence: CGG
agctagtctggggacaaaaa

SEQ ID NO: 108554 - DNA, 20 bp, Artificial Sequence
  Description of Artificial Sequence: Synthetic oligonucleotide
  Target: ATXN1; (+) strand; PAM type: NRG; PAM sequence: GGG
gctagtctggggacaaaaac

SEQ ID NO: 108555 - DNA, 20 bp, Artificial Sequence
  Description of Artificial Sequence: Synthetic oligonucleotide
  Target: ATXN1; (+) strand; PAM type: NRG; PAM sequence: AAG
gtctggggacaaaaacgggt

SEQ ID NO: 108556 - DNA, 20 bp, Artificial Sequence
  Description of Artificial Sequence: Synthetic oligonucleotide
  Target: ATXN1; (+) strand; PAM type: NRG; PAM sequence: CAG
ggggacaaaaacgggtaaga

SEQ ID NO: 108557 - DNA, 20 bp, Artificial Sequence
  Description of Artificial Sequence: Synthetic oligonucleotide
  Target: ATXN1; (+) strand; PAM type: NRG; PAM sequence: AAG
acagcatcttttctgcccca

SEQ ID NO: 108558 - DNA, 20 bp, Artificial Sequence
  Description of Artificial Sequence: Synthetic oligonucleotide
  Target: ATXN1; (+) strand; PAM type: NRG; PAM sequence: AGG
cagcatcttttctgccccaa

SEQ ID NO: 108559 - DNA, 20 bp, Artificial Sequence
  Description of Artificial Sequence: Synthetic oligonucleotide
  Target: ATXN1; (+) strand; PAM type: NRG; PAM sequence: GGG
agcatcttttctgccccaaa

SEQ ID NO: 108560 - DNA, 20 bp, Artificial Sequence
  Description of Artificial Sequence: Synthetic oligonucleotide
  Target: ATXN1; (+) strand; PAM type: NRG; PAM sequence: TGG
tttctgccccaaagggatga

SEQ ID NO: 108561 - DNA, 20 bp, Artificial Sequence
  Description of Artificial Sequence: Synthetic oligonucleotide
  Target: ATXN1; (+) strand; PAM type: NRG; PAM sequence: TGG
gccccaaagggatgatggaa

SEQ ID NO: 108562 - DNA, 20 bp, Artificial Sequence
  Description of Artificial Sequence: Synthetic oligonucleotide
  Target: ATXN1; (+) strand; PAM type: NRG; PAM sequence: GAG
cccaaagggatgatggaatg

SEQ ID NO: 108563 - DNA, 20 bp, Artificial Sequence
  Description of Artificial Sequence: Synthetic oligonucleotide
  Target: ATXN1; (+) strand; PAM type: NRG; PAM sequence: AGG
ccaaagggatgatggaatgg

SEQ ID NO: 108564 - DNA, 20 bp, Artificial Sequence
  Description of Artificial Sequence: Synthetic oligonucleotide
  Target: ATXN1; (+) strand; PAM type: NRG; PAM sequence: GAG
ggatgatggaatggaggaac

SEQ ID NO: 108565 - DNA, 20 bp, Artificial Sequence
  Description of Artificial Sequence: Synthetic oligonucleotide
  Target: ATXN1; (+) strand; PAM type: NRG; PAM sequence: AGG
gatgatggaatggaggaacg

SEQ ID NO: 108566 - DNA, 20 bp, Artificial Sequence
  Description of Artificial Sequence: Synthetic oligonucleotide
  Target: ATXN1; (+) strand; PAM type: NRG; PAM sequence: TGG
acgaggacattactttgaca

SEQ ID NO: 108567 - DNA, 20 bp, Artificial Sequence
  Description of Artificial Sequence: Synthetic oligonucleotide
  Target: ATXN1; (+) strand; PAM type: NRG; PAM sequence: GGG
cgaggacattactttgacat

SEQ ID NO: 108568 - DNA, 20 bp, Artificial Sequence
  Description of Artificial Sequence: Synthetic oligonucleotide
  Target: ATXN1; (+) strand; PAM type: NRG; PAM sequence: GGG
gaggacattactttgacatg

SEQ ID NO: 108569 - DNA, 20 bp, Artificial Sequence
  Description of Artificial Sequence: Synthetic oligonucleotide
  Target: ATXN1; (+) strand; PAM type: NRG; PAM sequence: TGG
tttgacatggggcactcctt

SEQ ID NO: 108570 - DNA, 20 bp, Artificial Sequence
  Description of Artificial Sequence: Synthetic oligonucleotide
  Target: ATXN1; (+) strand; PAM type: NRG; PAM sequence: AAG
gggcactcctttggccaatg

SEQ ID NO: 108571 - DNA, 20 bp, Artificial Sequence
  Description of Artificial Sequence: Synthetic oligonucleotide
  Target: ATXN1; (+) strand; PAM type: NRG; PAM sequence: AAG
ctcctttggccaatgaagta

SEQ ID NO: 108572 - DNA, 20 bp, Artificial Sequence
  Description of Artificial Sequence: Synthetic oligonucleotide
  Target: ATXN1; (+) strand; PAM type: NRG; PAM sequence: AGG
tcctttggccaatgaagtaa

SEQ ID NO: 108573 - DNA, 20 bp, Artificial Sequence
  Description of Artificial Sequence: Synthetic oligonucleotide
  Target: ATXN1; (+) strand; PAM type: NRG; PAM sequence: CAG
ttggccaatgaagtaaaggt

SEQ ID NO: 108574 - DNA, 20 bp, Artificial Sequence
  Description of Artificial Sequence: Synthetic oligonucleotide
  Target: ATXN1; (+) strand; PAM type: NRG; PAM sequence: GAG
ccaatgaagtaaaggtcagt

SEQ ID NO: 108575 - DNA, 20 bp, Artificial Sequence
  Description of Artificial Sequence: Synthetic oligonucleotide
  Target: ATXN1; (+) strand; PAM type: NRG; PAM sequence: AAG
ggtcagtgagtgaacacaca

SEQ ID NO: 108576 - DNA, 20 bp, Artificial Sequence
  Description of Artificial Sequence: Synthetic oligonucleotide
  Target: ATXN1; (+) strand; PAM type: NRG; PAM sequence: TAG
aagaaatgattaacctgtca

SEQ ID NO: 108577 - DNA, 20 bp, Artificial Sequence
  Description of Artificial Sequence: Synthetic oligonucleotide
  Target: ATXN1; (+) strand; PAM type: NRG; PAM sequence: AAG
atgattaacctgtcatagaa

SEQ ID NO: 108578 - DNA, 20 bp, Artificial Sequence
  Description of Artificial Sequence: Synthetic oligonucleotide
  Target: ATXN1; (+) strand; PAM type: NRG; PAM sequence: AGG
tgattaacctgtcatagaaa

SEQ ID NO: 108579 - DNA, 20 bp, Artificial Sequence
  Description of Artificial Sequence: Synthetic oligonucleotide
  Target: ATXN1; (+) strand; PAM type: NRG; PAM sequence: TAG
catagaaaaggtcatgaatg

SEQ ID NO: 108580 - DNA, 20 bp, Artificial Sequence
  Description of Artificial Sequence: Synthetic oligonucleotide
  Target: ATXN1; (+) strand; PAM type: NRG; PAM sequence: CAG
aaaggtcatgaatgtagtgc

SEQ ID NO: 108581 - DNA, 20 bp, Artificial Sequence
  Description of Artificial Sequence: Synthetic oligonucleotide
  Target: ATXN1; (+) strand; PAM type: NRG; PAM sequence: CAG
catgaatgtagtgccagcta

SEQ ID NO: 108582 - DNA, 20 bp, Artificial Sequence
  Description of Artificial Sequence: Synthetic oligonucleotide
  Target: ATXN1; (+) strand; PAM type: NRG; PAM sequence: AGG
atgaatgtagtgccagctac

SEQ ID NO: 108583 - DNA, 20 bp, Artificial Sequence
  Description of Artificial Sequence: Synthetic oligonucleotide
  Target: ATXN1; (+) strand; PAM type: NRG; PAM sequence: GAG
atacttcactttgctctcat

SEQ ID NO: 108584 - DNA, 20 bp, Artificial Sequence
  Description of Artificial Sequence: Synthetic oligonucleotide
  Target: ATXN1; (+) strand; PAM type: NRG; PAM sequence: TGG
cactttgctctcatgagatt

SEQ ID NO: 108585 - DNA, 20 bp, Artificial Sequence
  Description of Artificial Sequence: Synthetic oligonucleotide
  Target: ATXN1; (+) strand; PAM type: NRG; PAM sequence: CAG
ttgctctcatgagatttggt

SEQ ID NO: 108586 - DNA, 20 bp, Artificial Sequence
  Description of Artificial Sequence: Synthetic oligonucleotide
  Target: ATXN1; (+) strand; PAM type: NRG; PAM sequence: AAG
ctcatgagatttggtcagta

SEQ ID NO: 108587 - DNA, 20 bp, Artificial Sequence
  Description of Artificial Sequence: Synthetic oligonucleotide
  Target: ATXN1; (+) strand; PAM type: NRG; PAM sequence: AGG
tcatgagatttggtcagtaa

SEQ ID NO: 108588 - DNA, 20 bp, Artificial Sequence
  Description of Artificial Sequence: Synthetic oligonucleotide
  Target: ATXN1; (+) strand; PAM type: NRG; PAM sequence: AAG
gtaaaggaattatccgtgta

SEQ ID NO: 108589 - DNA, 20 bp, Artificial Sequence
  Description of Artificial Sequence: Synthetic oligonucleotide
  Target: ATXN1; (+) strand; PAM type: NRG; PAM sequence: GAG
aaaggaattatccgtgtaaa

SEQ ID NO: 108590 - DNA, 20 bp, Artificial Sequence
  Description of Artificial Sequence: Synthetic oligonucleotide
  Target: ATXN1; (+) strand; PAM type: NRG; PAM sequence: CAG
tatccgtgtaaagagaaaat

SEQ ID NO: 108591 - DNA, 20 bp, Artificial Sequence
  Description of Artificial Sequence: Synthetic oligonucleotide
  Target: ATXN1; (+) strand; PAM type: NRG; PAM sequence: AGG
atccgtgtaaagagaaaatc

SEQ ID NO: 108592 - DNA, 20 bp, Artificial Sequence
  Description of Artificial Sequence: Synthetic oligonucleotide
  Target: ATXN1; (+) strand; PAM type: NRG; PAM sequence: GAG
ccgtgtaaagagaaaatcag

SEQ ID NO: 108593 - DNA, 20 bp, Artificial Sequence
  Description of Artificial Sequence: Synthetic oligonucleotide
  Target: ATXN1; (+) strand; PAM type: NRG; PAM sequence: CAG
aaaatcaggagcaaccttgc

SEQ ID NO: 108594 - DNA, 20 bp, Artificial Sequence
  Description of Artificial Sequence: Synthetic oligonucleotide
  Target: ATXN1; (+) strand; PAM type: NRG; PAM sequence: AAG
ccttgccagcctgtgaacaa

SEQ ID NO: 108595 - DNA, 20 bp, Artificial Sequence
  Description of Artificial Sequence: Synthetic oligonucleotide
  Target: ATXN1; (+) strand; PAM type: NRG; PAM sequence: TAG
ccagcctgtgaacaaaagac

SEQ ID NO: 108596 - DNA, 20 bp, Artificial Sequence
  Description of Artificial Sequence: Synthetic oligonucleotide
  Target: ATXN1; (+) strand; PAM type: NRG; PAM sequence: CAG
tagccaatgccacttcttac

SEQ ID NO: 108597 - DNA, 20 bp, Artificial Sequence
  Description of Artificial Sequence: Synthetic oligonucleotide
  Target: ATXN1; (+) strand; PAM type: NRG; PAM sequence: AAG
caatgccacttcttaccagc

SEQ ID NO: 108598 - DNA, 20 bp, Artificial Sequence
  Description of Artificial Sequence: Synthetic oligonucleotide
  Target: ATXN1; (+) strand; PAM type: NRG; PAM sequence: AGG
aatgccacttcttaccagca

SEQ ID NO: 108599 - DNA, 20 bp, Artificial Sequence
  Description of Artificial Sequence: Synthetic oligonucleotide
  Target: ATXN1; (+) strand; PAM type: NRG; PAM sequence: CAG
tcttaccagcaaggtccaaa

SEQ ID NO: 108600 - DNA, 20 bp, Artificial Sequence
  Description of Artificial Sequence: Synthetic oligonucleotide
  Target: ATXN1; (+) strand; PAM type: NRG; PAM sequence: AAG
aaggtccaaacagtcatgcc

SEQ ID NO: 108601 - DNA, 20 bp, Artificial Sequence
  Description of Artificial Sequence: Synthetic oligonucleotide
  Target: ATXN1; (+) strand; PAM type: NRG; PAM sequence: AGG
aggtccaaacagtcatgcca

SEQ ID NO: 108602 - DNA, 20 bp, Artificial Sequence
  Description of Artificial Sequence: Synthetic oligonucleotide
  Target: ATXN1; (+) strand; PAM type: NRG; PAM sequence: TGG
acagtcatgccaaggttatg

SEQ ID NO: 108603 - DNA, 20 bp, Artificial Sequence
  Description of Artificial Sequence: Synthetic oligonucleotide
  Target: ATXN1; (+) strand; PAM type: NRG; PAM sequence: GGG
cagtcatgccaaggttatgt

SEQ ID NO: 108604 - DNA, 20 bp, Artificial Sequence
  Description of Artificial Sequence: Synthetic oligonucleotide
  Target: ATXN1; (+) strand; PAM type: NRG; PAM sequence: GGG
agtcatgccaaggttatgtg

SEQ ID NO: 108605 - DNA, 20 bp, Artificial Sequence
  Description of Artificial Sequence: Synthetic oligonucleotide
  Target: ATXN1; (+) strand; PAM type: NRG; PAM sequence: TAG
ccaaggttatgtggggtatg

SEQ ID NO: 108606 - DNA, 20 bp, Artificial Sequence
  Description of Artificial Sequence: Synthetic oligonucleotide
  Target: ATXN1; (+) strand; PAM type: NRG; PAM sequence: CAG
tgaattctattttgcacatc

SEQ ID NO: 108607 - DNA, 20 bp, Artificial Sequence
  Description of Artificial Sequence: Synthetic oligonucleotide
  Target: ATXN1; (+) strand; PAM type: NRG; PAM sequence: AGG
gaattctattttgcacatcc

SEQ ID NO: 108608 - DNA, 20 bp, Artificial Sequence
  Description of Artificial Sequence: Synthetic oligonucleotide
  Target: ATXN1; (+) strand; PAM type: NRG; PAM sequence: AAG
tctattttgcacatccagga

SEQ ID NO: 108609 - DNA, 20 bp, Artificial Sequence
  Description of Artificial Sequence: Synthetic oligonucleotide
  Target: ATXN1; (+) strand; PAM type: NRG; PAM sequence: AAG
tttgcacatccaggaaagcc

SEQ ID NO: 108610 - DNA, 20 bp, Artificial Sequence
  Description of Artificial Sequence: Synthetic oligonucleotide
  Target: ATXN1; (+) strand; PAM type: NRG; PAM sequence: TAG
gcacctgattgcaacatata

SEQ ID NO: 108611 - DNA, 20 bp, Artificial Sequence
  Description of Artificial Sequence: Synthetic oligonucleotide
  Target: ATXN1; (+) strand; PAM type: NRG; PAM sequence: CAG
atagtcatattttgatacca

SEQ ID NO: 108612 - DNA, 20 bp, Artificial Sequence
  Description of Artificial Sequence: Synthetic oligonucleotide
  Target: ATXN1; (+) strand; PAM type: NRG; PAM sequence: TGG
catattttgataccacagtt

SEQ ID NO: 108613 - DNA, 20 bp, Artificial Sequence
  Description of Artificial Sequence: Synthetic oligonucleotide
  Target: ATXN1; (+) strand; PAM type: NRG; PAM sequence: TGG
ttttgataccacagtttgga

SEQ ID NO: 108614 - DNA, 20 bp, Artificial Sequence
  Description of Artificial Sequence: Synthetic oligonucleotide
  Target: ATXN1; (+) strand; PAM type: NRG; PAM sequence: AAG
gataccacagtttggatggc

SEQ ID NO: 108615 - DNA, 20 bp, Artificial Sequence
  Description of Artificial Sequence: Synthetic oligonucleotide
  Target: ATXN1; (+) strand; PAM type: NRG; PAM sequence: CAG
tattcaatcctttttcctat

SEQ ID NO: 108616 - DNA, 20 bp, Artificial Sequence
  Description of Artificial Sequence: Synthetic oligonucleotide
  Target: ATXN1; (+) strand; PAM type: NRG; PAM sequence: GAG
ttcaatcctttttcctatca

SEQ ID NO: 108617 - DNA, 20 bp, Artificial Sequence
  Description of Artificial Sequence: Synthetic oligonucleotide
  Target: ATXN1; (+) strand; PAM type: NRG; PAM sequence: GAG
caatcctttttcctatcaga

SEQ ID NO: 108618 - DNA, 20 bp, Artificial Sequence
  Description of Artificial Sequence: Synthetic oligonucleotide
  Target: ATXN1; (+) strand; PAM type: NRG; PAM sequence: TGG
tgttttctctgacttctcca

SEQ ID NO: 108619 - DNA, 20 bp, Artificial Sequence
  Description of Artificial Sequence: Synthetic oligonucleotide
  Target: ATXN1; (+) strand; PAM type: NRG; PAM sequence: CAG
acttctccatggatccacaa

SEQ ID NO: 108620 - DNA, 20 bp, Artificial Sequence
  Description of Artificial Sequence: Synthetic oligonucleotide
  Target: ATXN1; (+) strand; PAM type: NRG; PAM sequence: CAG
tcaatgctttaaaaaatact

SEQ ID NO: 108621 - DNA, 20 bp, Artificial Sequence
  Description of Artificial Sequence: Synthetic oligonucleotide
  Target: ATXN1; (+) strand; PAM type: NRG; PAM sequence: AGG
caatgctttaaaaaatactc

SEQ ID NO: 108622 - DNA, 20 bp, Artificial Sequence
  Description of Artificial Sequence: Synthetic oligonucleotide
  Target: ATXN1; (+) strand; PAM type: NRG; PAM sequence: TGG
tttaaaaaatactcaggaca

SEQ ID NO: 108623 - DNA, 20 bp, Artificial Sequence
  Description of Artificial Sequence: Synthetic oligonucleotide
  Target: ATXN1; (+) strand; PAM type: NRG; PAM sequence: AAG
catggaccaatacaaaaata

SEQ ID NO: 108624 - DNA, 20 bp, Artificial Sequence
  Description of Artificial Sequence: Synthetic oligonucleotide
  Target: ATXN1; (+) strand; PAM type: NRG; PAM sequence: AGG
atggaccaatacaaaaataa

SEQ ID NO: 108625 - DNA, 20 bp, Artificial Sequence
  Description of Artificial Sequence: Synthetic oligonucleotide
  Target: ATXN1; (+) strand; PAM type: NRG; PAM sequence: TGG
cgtgattaaacaactgaaca

SEQ ID NO: 108626 - DNA, 20 bp, Artificial Sequence
  Description of Artificial Sequence: Synthetic oligonucleotide
  Target: ATXN1; (+) strand; PAM type: NRG; PAM sequence: AAG
taaacaactgaacatggaat

SEQ ID NO: 108627 - DNA, 20 bp, Artificial Sequence
  Description of Artificial Sequence: Synthetic oligonucleotide
  Target: ATXN1; (+) strand; PAM type: NRG; PAM sequence: AGG
aaacaactgaacatggaata

SEQ ID NO: 108628 - DNA, 20 bp, Artificial Sequence
  Description of Artificial Sequence: Synthetic oligonucleotide
  Target: ATXN1; (+) strand; PAM type: NRG; PAM sequence: CAG
ctgaacatggaataaggcca

SEQ ID NO: 108629 - DNA, 20 bp, Artificial Sequence
  Description of Artificial Sequence: Synthetic oligonucleotide
  Target: ATXN1; (+) strand; PAM type: NRG; PAM sequence: AAG
aacatggaataaggccacag

SEQ ID NO: 108630 - DNA, 20 bp, Artificial Sequence
  Description of Artificial Sequence: Synthetic oligonucleotide
  Target: ATXN1; (+) strand; PAM type: NRG; PAM sequence: AGG
acatggaataaggccacaga

SEQ ID NO: 108631 - DNA, 20 bp, Artificial Sequence
  Description of Artificial Sequence: Synthetic oligonucleotide
  Target: ATXN1; (+) strand; PAM type: NRG; PAM sequence: AAG
gccacagaaggttctctaaa

SEQ ID NO: 108632 - DNA, 20 bp, Artificial Sequence
  Description of Artificial Sequence: Synthetic oligonucleotide
  Target: ATXN1; (+) strand; PAM type: NRG; PAM sequence: GAG
cacagaaggttctctaaaaa

SEQ ID NO: 108633 - DNA, 20 bp, Artificial Sequence
  Description of Artificial Sequence: Synthetic oligonucleotide
  Target: ATXN1; (+) strand; PAM type: NRG; PAM sequence: CAG
aaagagtatctgaccttgct

SEQ ID NO: 108634 - DNA, 20 bp, Artificial Sequence
  Description of Artificial Sequence: Synthetic oligonucleotide
  Target: ATXN1; (+) strand; PAM type: NRG; PAM sequence: TGG
gtatctgaccttgctcagac

SEQ ID NO: 108635 - DNA, 20 bp, Artificial Sequence
  Description of Artificial Sequence: Synthetic oligonucleotide
  Target: ATXN1; (+) strand; PAM type: NRG; PAM sequence: GAG
gctcagactggtgtgaccat

SEQ ID NO: 108636 - DNA, 20 bp, Artificial Sequence
  Description of Artificial Sequence: Synthetic oligonucleotide
  Target: ATXN1; (+) strand; PAM type: NRG; PAM sequence: GAG
ctggtgtgaccatgagatat

SEQ ID NO: 108637 - DNA, 20 bp, Artificial Sequence
  Description of Artificial Sequence: Synthetic oligonucleotide
  Target: ATXN1; (+) strand; PAM type: NRG; PAM sequence: TGG
tgtgaccatgagatatgaga

SEQ ID NO: 108638 - DNA, 20 bp, Artificial Sequence
  Description of Artificial Sequence: Synthetic oligonucleotide
  Target: ATXN1; (+) strand; PAM type: NRG; PAM sequence: TGG
gagatatgagatggaacaaa

SEQ ID NO: 108639 - DNA, 20 bp, Artificial Sequence
  Description of Artificial Sequence: Synthetic oligonucleotide
  Target: ATXN1; (+) strand; PAM type: NRG; PAM sequence: CAG
atgagatggaacaaatggca

SEQ ID NO: 108640 - DNA, 20 bp, Artificial Sequence
  Description of Artificial Sequence: Synthetic oligonucleotide
  Target: ATXN1; (+) strand; PAM type: NRG; PAM sequence: TAG
gatggaacaaatggcacaga

SEQ ID NO: 108641 - DNA, 20 bp, Artificial Sequence
  Description of Artificial Sequence: Synthetic oligonucleotide
  Target: ATXN1; (+) strand; PAM type: NRG; PAM sequence: AAG
gaacaaatggcacagatagc

SEQ ID NO: 108642 - DNA, 20 bp, Artificial Sequence
  Description of Artificial Sequence: Synthetic oligonucleotide
  Target: ATXN1; (+) strand; PAM type: NRG; PAM sequence: AGG
aacaaatggcacagatagca

SEQ ID NO: 108643 - DNA, 20 bp, Artificial Sequence
  Description of Artificial Sequence: Synthetic oligonucleotide
  Target: ATXN1; (+) strand; PAM type: NRG; PAM sequence: CAG
ggcacagatagcaaggaatg

SEQ ID NO: 108644 - DNA, 20 bp, Artificial Sequence
  Description of Artificial Sequence: Synthetic oligonucleotide
  Target: ATXN1; (+) strand; PAM type: NRG; PAM sequence: AGG
gcacagatagcaaggaatgc

SEQ ID NO: 108645 - DNA, 20 bp, Artificial Sequence
  Description of Artificial Sequence: Synthetic oligonucleotide
  Target: ATXN1; (+) strand; PAM type: NRG; PAM sequence: TGG
tagcaaggaatgcaggtgtg

SEQ ID NO: 108646 - DNA, 20 bp, Artificial Sequence
  Description of Artificial Sequence: Synthetic oligonucleotide
  Target: ATXN1; (+) strand; PAM type: NRG; PAM sequence: CAG
cttcatattcattcccactt

SEQ ID NO: 108647 - DNA, 20 bp, Artificial Sequence
  Description of Artificial Sequence: Synthetic oligonucleotide
  Target: ATXN1; (+) strand; PAM type: NRG; PAM sequence: CAG
tattcattcccacttcagtt

SEQ ID NO: 108648 - DNA, 20 bp, Artificial Sequence
  Description of Artificial Sequence: Synthetic oligonucleotide
  Target: ATXN1; (+) strand; PAM type: NRG; PAM sequence: GAG
taacacttcattcaccaaat

SEQ ID NO: 108649 - DNA, 20 bp, Artificial Sequence
  Description of Artificial Sequence: Synthetic oligonucleotide
  Target: ATXN1; (+) strand; PAM type: NRG; PAM sequence: CAG
accaactgcctactatgcat

SEQ ID NO: 108650 - DNA, 20 bp, Artificial Sequence
  Description of Artificial Sequence: Synthetic oligonucleotide
  Target: ATXN1; (+) strand; PAM type: NRG; PAM sequence: CAG
tatgcatcagacatataaaa

SEQ ID NO: 108651 - DNA, 20 bp, Artificial Sequence
  Description of Artificial Sequence: Synthetic oligonucleotide
  Target: ATXN1; (+) strand; PAM type: NRG; PAM sequence: AAG
gcatcagacatataaaacag

SEQ ID NO: 108652 - DNA, 20 bp, Artificial Sequence
  Description of Artificial Sequence: Synthetic oligonucleotide
  Target: ATXN1; (+) strand; PAM type: NRG; PAM sequence: AAG
atataaaacagaagatctaa

SEQ ID NO: 108653 - DNA, 20 bp, Artificial Sequence
  Description of Artificial Sequence: Synthetic oligonucleotide
  Target: ATXN1; (+) strand; PAM type: NRG; PAM sequence: CAG
aacagaagatctaaaagaca

SEQ ID NO: 108654 - DNA, 20 bp, Artificial Sequence
  Description of Artificial Sequence: Synthetic oligonucleotide
  Target: ATXN1; (+) strand; PAM type: NRG; PAM sequence: AAG
aagacacagttcctgttctc

SEQ ID NO: 108655 - DNA, 20 bp, Artificial Sequence
  Description of Artificial Sequence: Synthetic oligonucleotide
  Target: ATXN1; (+) strand; PAM type: NRG; PAM sequence: AGG
agacacagttcctgttctca

SEQ ID NO: 108656 - DNA, 20 bp, Artificial Sequence
  Description of Artificial Sequence: Synthetic oligonucleotide
  Target: ATXN1; (+) strand; PAM type: NRG; PAM sequence: GAG
acacagttcctgttctcaag

SEQ ID NO: 108657 - DNA, 20 bp, Artificial Sequence
  Description of Artificial Sequence: Synthetic oligonucleotide
  Target: ATXN1; (+) strand; PAM type: NRG; PAM sequence: TGG
ctcaaggagctccattgata

SEQ ID NO: 108658 - DNA, 20 bp, Artificial Sequence
  Description of Artificial Sequence: Synthetic oligonucleotide
  Target: ATXN1; (+) strand; PAM type: NRG; PAM sequence: TGG
aggagctccattgatatggt

SEQ ID NO: 108659 - DNA, 20 bp, Artificial Sequence
  Description of Artificial Sequence: Synthetic oligonucleotide
  Target: ATXN1; (+) strand; PAM type: NRG; PAM sequence: CAG
tcatgtcaaattgtaatccc

SEQ ID NO: 108660 - DNA, 20 bp, Artificial Sequence
  Description of Artificial Sequence: Synthetic oligonucleotide
  Target: ATXN1; (+) strand; PAM type: NRG; PAM sequence: TGG
aaattgtaatccccagtgtt

SEQ ID NO: 108661 - DNA, 20 bp, Artificial Sequence
  Description of Artificial Sequence: Synthetic oligonucleotide
  Target: ATXN1; (+) strand; PAM type: NRG; PAM sequence: GAG
attgtaatccccagtgtttg

SEQ ID NO: 108662 - DNA, 20 bp, Artificial Sequence
  Description of Artificial Sequence: Synthetic oligonucleotide
  Target: ATXN1; (+) strand; PAM type: NRG; PAM sequence: AGG
ttgtaatccccagtgtttgg

SEQ ID NO: 108663 - DNA, 20 bp, Artificial Sequence
  Description of Artificial Sequence: Synthetic oligonucleotide
  Target: ATXN1; (+) strand; PAM type: NRG; PAM sequence: AAG
taatccccagtgtttggagg

SEQ ID NO: 108664 - DNA, 20 bp, Artificial Sequence
  Description of Artificial Sequence: Synthetic oligonucleotide
  Target: ATXN1; (+) strand; PAM type: NRG; PAM sequence: AGG
aatccccagtgtttggagga

SEQ ID NO: 108665 - DNA, 20 bp, Artificial Sequence
  Description of Artificial Sequence: Synthetic oligonucleotide
  Target: ATXN1; (+) strand; PAM type: NRG; PAM sequence: GGG
atccccagtgtttggaggaa

SEQ ID NO: 108666 - DNA, 20 bp, Artificial Sequence
  Description of Artificial Sequence: Synthetic oligonucleotide
  Target: ATXN1; (+) strand; PAM type: NRG; PAM sequence: TGG
cagtgtttggaggaagggcc

SEQ ID NO: 108667 - DNA, 20 bp, Artificial Sequence
  Description of Artificial Sequence: Synthetic oligonucleotide
  Target: ATXN1; (+) strand; PAM type: NRG; PAM sequence: TGG
tgtttggaggaagggcctgg

SEQ ID NO: 108668 - DNA, 20 bp, Artificial Sequence
  Description of Artificial Sequence: Synthetic oligonucleotide
  Target: ATXN1; (+) strand; PAM type: NRG; PAM sequence: GGG
gtttggaggaagggcctggt

SEQ ID NO: 108669 - DNA, 20 bp, Artificial Sequence
  Description of Artificial Sequence: Synthetic oligonucleotide
  Target: ATXN1; (+) strand; PAM type: NRG; PAM sequence: GAG
ttggaggaagggcctggtgg

SEQ ID NO: 108670 - DNA, 20 bp, Artificial Sequence
  Description of Artificial Sequence: Synthetic oligonucleotide
  Target: ATXN1; (+) strand; PAM type: NRG; PAM sequence: TGG
agggcctggtgggagatgac

SEQ ID NO: 108671 - DNA, 20 bp, Artificial Sequence
  Description of Artificial Sequence: Synthetic oligonucleotide
  Target: ATXN1; (+) strand; PAM type: NRG; PAM sequence: CGG
ggtgggagatgactggatca

SEQ ID NO: 108672 - DNA, 20 bp, Artificial Sequence
  Description of Artificial Sequence: Synthetic oligonucleotide
  Target: ATXN1; (+) strand; PAM type: NRG; PAM sequence: GGG
gtgggagatgactggatcac

SEQ ID NO: 108673 - DNA, 20 bp, Artificial Sequence
  Description of Artificial Sequence: Synthetic oligonucleotide
  Target: ATXN1; (+) strand; PAM type: NRG; PAM sequence: TAG
agatgactggatcacgggct

SEQ ID NO: 108674 - DNA, 20 bp, Artificial Sequence
  Description of Artificial Sequence: Synthetic oligonucleotide
  Target: ATXN1; (+) strand; PAM type: NRG; PAM sequence: TAG
ctccctctctgttctcatga

SEQ ID NO: 108675 - DNA, 20 bp, Artificial Sequence
  Description of Artificial Sequence: Synthetic oligonucleotide
  Target: ATXN1; (+) strand; PAM type: NRG; PAM sequence: GAG
ctctctgttctcatgatagt

SEQ ID NO: 108676 - DNA, 20 bp, Artificial Sequence
  Description of Artificial Sequence: Synthetic oligonucleotide
  Target: ATXN1; (+) strand; PAM type: NRG; PAM sequence: GAG
tcatgatagtgagttctcat

SEQ ID NO: 108677 - DNA, 20 bp, Artificial Sequence
  Description of Artificial Sequence: Synthetic oligonucleotide
  Target: ATXN1; (+) strand; PAM type: NRG; PAM sequence: TGG
tagtgagttctcatgagatc

SEQ ID NO: 108678 - DNA, 20 bp, Artificial Sequence
  Description of Artificial Sequence: Synthetic oligonucleotide
  Target: ATXN1; (+) strand; PAM type: NRG; PAM sequence: AAG
catgagatctggttgtttaa

SEQ ID NO: 108679 - DNA, 20 bp, Artificial Sequence
  Description of Artificial Sequence: Synthetic oligonucleotide
  Target: ATXN1; (+) strand; PAM type: NRG; PAM sequence: TAG
tctggttgtttaaaagtgtg

SEQ ID NO: 108680 - DNA, 20 bp, Artificial Sequence
  Description of Artificial Sequence: Synthetic oligonucleotide
  Target: ATXN1; (+) strand; PAM type: NRG; PAM sequence: CAG
cctttcccttcctcctgctc

SEQ ID NO: 108681 - DNA, 20 bp, Artificial Sequence
  Description of Artificial Sequence: Synthetic oligonucleotide
  Target: ATXN1; (+) strand; PAM type: NRG; PAM sequence: TAG
ttcctcctgctccagccacg

SEQ ID NO: 108682 - DNA, 20 bp, Artificial Sequence
  Description of Artificial Sequence: Synthetic oligonucleotide
  Target: ATXN1; (+) strand; PAM type: NRG; PAM sequence: AGG
tcctcctgctccagccacgt

SEQ ID NO: 108683 - DNA, 20 bp, Artificial Sequence
  Description of Artificial Sequence: Synthetic oligonucleotide
  Target: ATXN1; (+) strand; PAM type: NRG; PAM sequence: TGG
tccagccacgtaggacgtgc

SEQ ID NO: 108684 - DNA, 20 bp, Artificial Sequence
  Description of Artificial Sequence: Synthetic oligonucleotide
  Target: ATXN1; (+) strand; PAM type: NRG; PAM sequence: AAG
tctccttctgccatgattgt

SEQ ID NO: 108685 - DNA, 20 bp, Artificial Sequence
  Description of Artificial Sequence: Synthetic oligonucleotide
  Target: ATXN1; (+) strand; PAM type: NRG; PAM sequence: GAG
gccatgattgtaagtttcct

SEQ ID NO: 108686 - DNA, 20 bp, Artificial Sequence
  Description of Artificial Sequence: Synthetic oligonucleotide
  Target: ATXN1; (+) strand; PAM type: NRG; PAM sequence: AGG
ccatgattgtaagtttcctg

SEQ ID NO: 108687 - DNA, 20 bp, Artificial Sequence
  Description of Artificial Sequence: Synthetic oligonucleotide
  Target: ATXN1; (+) strand; PAM type: NRG; PAM sequence: CAG
taagtttcctgaggcctccc

SEQ ID NO: 108688 - DNA, 20 bp, Artificial Sequence
  Description of Artificial Sequence: Synthetic oligonucleotide
  Target: ATXN1; (+) strand; PAM type: NRG; PAM sequence: CAG
ccccagccatgtttcctgta

SEQ ID NO: 108689 - DNA, 20 bp, Artificial Sequence
  Description of Artificial Sequence: Synthetic oligonucleotide
  Target: ATXN1; (+) strand; PAM type: NRG; PAM sequence: TGG
catgtttcctgtacagcctg

SEQ ID NO: 108690 - DNA, 20 bp, Artificial Sequence
  Description of Artificial Sequence: Synthetic oligonucleotide
  Target: ATXN1; (+) strand; PAM type: NRG; PAM sequence: GAG
tgtacagcctgtggaaacat

SEQ ID NO: 108691 - DNA, 20 bp, Artificial Sequence
  Description of Artificial Sequence: Synthetic oligonucleotide
  Target: ATXN1; (+) strand; PAM type: NRG; PAM sequence: CAG
tcttttctttacacattatc

SEQ ID NO: 108692 - DNA, 20 bp, Artificial Sequence
  Description of Artificial Sequence: Synthetic oligonucleotide
  Target: ATXN1; (+) strand; PAM type: NRG; PAM sequence: CAG
ctttacacattatccagtct

SEQ ID NO: 108693 - DNA, 20 bp, Artificial Sequence
  Description of Artificial Sequence: Synthetic oligonucleotide
  Target: ATXN1; (+) strand; PAM type: NRG; PAM sequence: AGG
tttacacattatccagtctc

SEQ ID NO: 108694 - DNA, 20 bp, Artificial Sequence
  Description of Artificial Sequence: Synthetic oligonucleotide
  Target: ATXN1; (+) strand; PAM type: NRG; PAM sequence: TAG
acacattatccagtctcagg

SEQ ID NO: 108695 - DNA, 20 bp, Artificial Sequence
  Description of Artificial Sequence: Synthetic oligonucleotide
  Target: ATXN1; (+) strand; PAM type: NRG; PAM sequence: TAG
ccagtctcaggtagttctca

SEQ ID NO: 108696 - DNA, 20 bp, Artificial Sequence
  Description of Artificial Sequence: Synthetic oligonucleotide
  Target: ATXN1; (+) strand; PAM type: NRG; PAM sequence: GAG
ggtagttctcatagcaatgt

SEQ ID NO: 108697 - DNA, 20 bp, Artificial Sequence
  Description of Artificial Sequence: Synthetic oligonucleotide
  Target: ATXN1; (+) strand; PAM type: NRG; PAM sequence: AAG
agttctcatagcaatgtgag

SEQ ID NO: 108698 - DNA, 20 bp, Artificial Sequence
  Description of Artificial Sequence: Synthetic oligonucleotide
  Target: ATXN1; (+) strand; PAM type: NRG; PAM sequence: GAG
ttctcatagcaatgtgagaa

SEQ ID NO: 108699 - DNA, 20 bp, Artificial Sequence
  Description of Artificial Sequence: Synthetic oligonucleotide
  Target: ATXN1; (+) strand; PAM type: NRG; PAM sequence: CAG
gagactaatacatctgtatc

SEQ ID NO: 108700 - DNA, 20 bp, Artificial Sequence
  Description of Artificial Sequence: Synthetic oligonucleotide
  Target: ATXN1; (+) strand; PAM type: NRG; PAM sequence: CAG
atacatctgtatccagtgtg

SEQ ID NO: 108701 - DNA, 20 bp, Artificial Sequence
  Description of Artificial Sequence: Synthetic oligonucleotide
  Target: ATXN1; (+) strand; PAM type: NRG; PAM sequence: GAG
acatctgtatccagtgtgca

SEQ ID NO: 108702 - DNA, 20 bp, Artificial Sequence
  Description of Artificial Sequence: Synthetic oligonucleotide
  Target: ATXN1; (+) strand; PAM type: NRG; PAM sequence: TGG
ctgtatccagtgtgcagaga

SEQ ID NO: 108703 - DNA, 20 bp, Artificial Sequence
  Description of Artificial Sequence: Synthetic oligonucleotide
  Target: ATXN1; (+) strand; PAM type: NRG; PAM sequence: AAG
tccagtgtgcagagatggtc

SEQ ID NO: 108704 - DNA, 20 bp, Artificial Sequence
  Description of Artificial Sequence: Synthetic oligonucleotide
  Target: ATXN1; (+) strand; PAM type: NRG; PAM sequence: GAG
cagtgtgcagagatggtcaa

SEQ ID NO: 108705 - DNA, 20 bp, Artificial Sequence
  Description of Artificial Sequence: Synthetic oligonucleotide
  Target: ATXN1; (+) strand; PAM type: NRG; PAM sequence: CAG
tgcagagatggtcaagagaa

SEQ ID NO: 108706 - DNA, 20 bp, Artificial Sequence
  Description of Artificial Sequence: Synthetic oligonucleotide
  Target: ATXN1; (+) strand; PAM type: NRG; PAM sequence: GAG
acactaaaaatcttacatat

SEQ ID NO: 108707 - DNA, 20 bp, Artificial Sequence
  Description of Artificial Sequence: Synthetic oligonucleotide
  Target: ATXN1; (+) strand; PAM type: NRG; PAM sequence: TGG
aatcttacatatgagtttca

SEQ ID NO: 108708 - DNA, 20 bp, Artificial Sequence
  Description of Artificial Sequence: Synthetic oligonucleotide
  Target: ATXN1; (+) strand; PAM type: NRG; PAM sequence: GGG
atcttacatatgagtttcat

SEQ ID NO: 108709 - DNA, 20 bp, Artificial Sequence
  Description of Artificial Sequence: Synthetic oligonucleotide
  Target: ATXN1; (+) strand; PAM type: NRG; PAM sequence: TGG
ttacatatgagtttcatggg

SEQ ID NO: 108710 - DNA, 20 bp, Artificial Sequence
  Description of Artificial Sequence: Synthetic oligonucleotide
  Target: ATXN1; (+) strand; PAM type: NRG; PAM sequence: GGG
tacatatgagtttcatgggt

SEQ ID NO: 108711 - DNA, 20 bp, Artificial Sequence
  Description of Artificial Sequence: Synthetic oligonucleotide
  Target: ATXN1; (+) strand; PAM type: NRG; PAM sequence: AAG
atatgagtttcatgggtggg

SEQ ID NO: 108712 - DNA, 20 bp, Artificial Sequence
  Description of Artificial Sequence: Synthetic oligonucleotide
  Target: ATXN1; (+) strand; PAM type: NRG; PAM sequence: CAG
agtttcatgggtgggaagca

SEQ ID NO: 108713 - DNA, 20 bp, Artificial Sequence
  Description of Artificial Sequence: Synthetic oligonucleotide
  Target: ATXN1; (+) strand; PAM type: NRG; PAM sequence: GAG
tttcatgggtgggaagcaca

SEQ ID NO: 108714 - DNA, 20 bp, Artificial Sequence
  Description of Artificial Sequence: Synthetic oligonucleotide
  Target: ATXN1; (+) strand; PAM type: NRG; PAM sequence: TGG
catgggtgggaagcacagag

SEQ ID NO: 108715 - DNA, 20 bp, Artificial Sequence
  Description of Artificial Sequence: Synthetic oligonucleotide
  Target: ATXN1; (+) strand; PAM type: NRG; PAM sequence: CAG
gtgggaagcacagagtggct

SEQ ID NO: 108716 - DNA, 20 bp, Artificial Sequence
  Description of Artificial Sequence: Synthetic oligonucleotide
  Target: ATXN1; (+) strand; PAM type: NRG; PAM sequence: GAG
gaagcacagagtggctcagt

SEQ ID NO: 108717 - DNA, 20 bp, Artificial Sequence
  Description of Artificial Sequence: Synthetic oligonucleotide
  Target: ATXN1; (+) strand; PAM type: NRG; PAM sequence: CAG
acagagtggctcagtgagac

SEQ ID NO: 108718 - DNA, 20 bp, Artificial Sequence
  Description of Artificial Sequence: Synthetic oligonucleotide
  Target: ATXN1; (+) strand; PAM type: NRG; PAM sequence: AGG
cagagtggctcagtgagacc

SEQ ID NO: 108719 - DNA, 20 bp, Artificial Sequence
  Description of Artificial Sequence: Synthetic oligonucleotide
  Target: ATXN1; (+) strand; PAM type: NRG; PAM sequence: GAG
gagtggctcagtgagaccag

SEQ ID NO: 108720 - DNA, 20 bp, Artificial Sequence
  Description of Artificial Sequence: Synthetic oligonucleotide
  Target: ATXN1; (+) strand; PAM type: NRG; PAM sequence: AGG
agtggctcagtgagaccagg

SEQ ID NO: 108721 - DNA, 20 bp, Artificial Sequence
  Description of Artificial Sequence: Synthetic oligonucleotide
  Target: ATXN1; (+) strand; PAM type: NRG; PAM sequence: GGG
gtggctcagtgagaccagga

SEQ ID NO: 108722 - DNA, 20 bp, Artificial Sequence
  Description of Artificial Sequence: Synthetic oligonucleotide
  Target: ATXN1; (+) strand; PAM type: NRG; PAM sequence: AAG
tcagtgagaccaggagggaa

SEQ ID NO: 108723 - DNA, 20 bp, Artificial Sequence
  Description of Artificial Sequence: Synthetic oligonucleotide
  Target: ATXN1; (+) strand; PAM type: NRG; PAM sequence: TAG
tgagaccaggagggaaaagt

SEQ ID NO: 108724 - DNA, 20 bp, Artificial Sequence
  Description of Artificial Sequence: Synthetic oligonucleotide
  Target: ATXN1; (+) strand; PAM type: NRG; PAM sequence: AGG
gagaccaggagggaaaagtt

SEQ ID NO: 108725 - DNA, 20 bp, Artificial Sequence
  Description of Artificial Sequence: Synthetic oligonucleotide
  Target: ATXN1; (+) strand; PAM type: NRG; PAM sequence: GGG
agaccaggagggaaaagtta

SEQ ID NO: 108726 - DNA, 20 bp, Artificial Sequence
  Description of Artificial Sequence: Synthetic oligonucleotide
  Target: ATXN1; (+) strand; PAM type: NRG; PAM sequence: TGG
ccaggagggaaaagttaggg

SEQ ID NO: 108727 - DNA, 20 bp, Artificial Sequence
  Description of Artificial Sequence: Synthetic oligonucleotide
  Target: ATXN1; (+) strand; PAM type: NRG; PAM sequence: GGG
caggagggaaaagttagggt

SEQ ID NO: 108728 - DNA, 20 bp, Artificial Sequence
  Description of Artificial Sequence: Synthetic oligonucleotide
  Target: ATXN1; (+) strand; PAM type: NRG; PAM sequence: TGG
aaaagttagggtgggctcct

SEQ ID NO: 108729 - DNA, 20 bp, Artificial Sequence
  Description of Artificial Sequence: Synthetic oligonucleotide
  Target: ATXN1; (+) strand; PAM type: NRG; PAM sequence: GAG
aagttagggtgggctccttg

SEQ ID NO: 108730 - DNA, 20 bp, Artificial Sequence
  Description of Artificial Sequence: Synthetic oligonucleotide
  Target: ATXN1; (+) strand; PAM type: NRG; PAM sequence: TGG
ggtgggctccttggagctga

SEQ ID NO: 108731 - DNA, 20 bp, Artificial Sequence
  Description of Artificial Sequence: Synthetic oligonucleotide
  Target: ATXN1; (+) strand; PAM type: NRG; PAM sequence: CAG
gggctccttggagctgatgg

SEQ ID NO: 108732 - DNA, 20 bp, Artificial Sequence
  Description of Artificial Sequence: Synthetic oligonucleotide
  Target: ATXN1; (+) strand; PAM type: NRG; PAM sequence: AGG
ggctccttggagctgatggc

SEQ ID NO: 108733 - DNA, 20 bp, Artificial Sequence
  Description of Artificial Sequence: Synthetic oligonucleotide
  Target: ATXN1; (+) strand; PAM type: NRG; PAM sequence: GGG
gctccttggagctgatggca

SEQ ID NO: 108734 - DNA, 20 bp, Artificial Sequence
  Description of Artificial Sequence: Synthetic oligonucleotide
  Target: ATXN1; (+) strand; PAM type: NRG; PAM sequence: GAG
ttggagctgatggcagggtt

SEQ ID NO: 108735 - DNA, 20 bp, Artificial Sequence
  Description of Artificial Sequence: Synthetic oligonucleotide
  Target: ATXN1; (+) strand; PAM type: NRG; PAM sequence: AAG
gatggcagggttgagttttg

SEQ ID NO: 108736 - DNA, 20 bp, Artificial Sequence
  Description of Artificial Sequence: Synthetic oligonucleotide
  Target: ATXN1; (+) strand; PAM type: NRG; PAM sequence: GAG
tggcagggttgagttttgaa

SEQ ID NO: 108737 - DNA, 20 bp, Artificial Sequence
  Description of Artificial Sequence: Synthetic oligonucleotide
  Target: ATXN1; (+) strand; PAM type: NRG; PAM sequence: CAG
gttgagttttgaagagtaca

SEQ ID NO: 108738 - DNA, 20 bp, Artificial Sequence
  Description of Artificial Sequence: Synthetic oligonucleotide
  Target: ATXN1; (+) strand; PAM type: NRG; PAM sequence: AGG
ttgagttttgaagagtacac

SEQ ID NO: 108739 - DNA, 20 bp, Artificial Sequence
  Description of Artificial Sequence: Synthetic oligonucleotide
  Target: ATXN1; (+) strand; PAM type: NRG; PAM sequence: GAG
tgtgtgactgcatgtgatgt

SEQ ID NO: 108740 - DNA, 20 bp, Artificial Sequence
  Description of Artificial Sequence: Synthetic oligonucleotide
  Target: ATXN1; (+) strand; PAM type: NRG; PAM sequence: GAG
tgtgactgcatgtgatgtga

SEQ ID NO: 108741 - DNA, 20 bp, Artificial Sequence
  Description of Artificial Sequence: Synthetic oligonucleotide
  Target: ATXN1; (+) strand; PAM type: NRG; PAM sequence: AGG
gtgactgcatgtgatgtgag

SEQ ID NO: 108742 - DNA, 20 bp, Artificial Sequence
  Description of Artificial Sequence: Synthetic oligonucleotide
  Target: ATXN1; (+) strand; PAM type: NRG; PAM sequence: GGG
tgactgcatgtgatgtgaga

SEQ ID NO: 108743 - DNA, 20 bp, Artificial Sequence
  Description of Artificial Sequence: Synthetic oligonucleotide
  Target: ATXN1; (+) strand; PAM type: NRG; PAM sequence: TAG
atgtgagagggaacattgtc

SEQ ID NO: 108744 - DNA, 20 bp, Artificial Sequence
  Description of Artificial Sequence: Synthetic oligonucleotide
  Target: ATXN1; (+) strand; PAM type: NRG; PAM sequence: CAG
gagagggaacattgtctaga

SEQ ID NO: 108745 - DNA, 20 bp, Artificial Sequence
  Description of Artificial Sequence: Synthetic oligonucleotide
  Target: ATXN1; (+) strand; PAM type: NRG; PAM sequence: GAG
gagggaacattgtctagaca

SEQ ID NO: 108746 - DNA, 20 bp, Artificial Sequence
  Description of Artificial Sequence: Synthetic oligonucleotide
  Target: ATXN1; (+) strand; PAM type: NRG; PAM sequence: AGG
agggaacattgtctagacag

SEQ ID NO: 108747 - DNA, 20 bp, Artificial Sequence
  Description of Artificial Sequence: Synthetic oligonucleotide
  Target: ATXN1; (+) strand; PAM type: NRG; PAM sequence: GAG
ggaacattgtctagacagag

SEQ ID NO: 108748 - DNA, 20 bp, Artificial Sequence
  Description of Artificial Sequence: Synthetic oligonucleotide
  Target: ATXN1; (+) strand; PAM type: NRG; PAM sequence: AGG
gaacattgtctagacagagg

SEQ ID NO: 108749 - DNA, 20 bp, Artificial Sequence
  Description of Artificial Sequence: Synthetic oligonucleotide
  Target: ATXN1; (+) strand; PAM type: NRG; PAM sequence: GGG
aacattgtctagacagagga

SEQ ID NO: 108750 - DNA, 20 bp, Artificial Sequence
  Description of Artificial Sequence: Synthetic oligonucleotide
  Target: ATXN1; (+) strand; PAM type: NRG; PAM sequence: GAG
cattgtctagacagaggagg

SEQ ID NO: 108751 - DNA, 20 bp, Artificial Sequence
  Description of Artificial Sequence: Synthetic oligonucleotide
  Target: ATXN1; (+) strand; PAM type: NRG; PAM sequence: CAG
gacagaggagggagctcatg

SEQ ID NO: 108752 - DNA, 20 bp, Artificial Sequence
  Description of Artificial Sequence: Synthetic oligonucleotide
  Target: ATXN1; (+) strand; PAM type: NRG; PAM sequence: GAG
cagaggagggagctcatgca

SEQ ID NO: 108753 - DNA, 20 bp, Artificial Sequence
  Description of Artificial Sequence: Synthetic oligonucleotide
  Target: ATXN1; (+) strand; PAM type: NRG; PAM sequence: AAG
gagctcatgcagagtcacat

SEQ ID NO: 108754 - DNA, 20 bp, Artificial Sequence
  Description of Artificial Sequence: Synthetic oligonucleotide
  Target: ATXN1; (+) strand; PAM type: NRG; PAM sequence: AGG
agctcatgcagagtcacata

SEQ ID NO: 108755 - DNA, 20 bp, Artificial Sequence
  Description of Artificial Sequence: Synthetic oligonucleotide
  Target: ATXN1; (+) strand; PAM type: NRG; PAM sequence: GGG
gctcatgcagagtcacataa

SEQ ID NO: 108756 - DNA, 20 bp, Artificial Sequence
  Description of Artificial Sequence: Synthetic oligonucleotide
  Target: ATXN1; (+) strand; PAM type: NRG; PAM sequence: GGG
ctcatgcagagtcacataag

SEQ ID NO: 108757 - DNA, 20 bp, Artificial Sequence
  Description of Artificial Sequence: Synthetic oligonucleotide
  Target: ATXN1; (+) strand; PAM type: NRG; PAM sequence: CAG
ataaggggacatgccacatt

SEQ ID NO: 108758 - DNA, 20 bp, Artificial Sequence
  Description of Artificial Sequence: Synthetic oligonucleotide
  Target: ATXN1; (+) strand; PAM type: NRG; PAM sequence: AGG
taaggggacatgccacattc

SEQ ID NO: 108759 - DNA, 20 bp, Artificial Sequence
  Description of Artificial Sequence: Synthetic oligonucleotide
  Target: ATXN1; (+) strand; PAM type: NRG; PAM sequence: GGG
aaggggacatgccacattca

SEQ ID NO: 108760 - DNA, 20 bp, Artificial Sequence
  Description of Artificial Sequence: Synthetic oligonucleotide
  Target: ATXN1; (+) strand; PAM type: NRG; PAM sequence: AAG
gggacatgccacattcaggg

SEQ ID NO: 108761 - DNA, 20 bp, Artificial Sequence
  Description of Artificial Sequence: Synthetic oligonucleotide
  Target: ATXN1; (+) strand; PAM type: NRG; PAM sequence: AAG
tgccacattcagggaagcac

SEQ ID NO: 108762 - DNA, 20 bp, Artificial Sequence
  Description of Artificial Sequence: Synthetic oligonucleotide
  Target: ATXN1; (+) strand; PAM type: NRG; PAM sequence: TGG
cattcagggaagcacaagta

SEQ ID NO: 108763 - DNA, 20 bp, Artificial Sequence
  Description of Artificial Sequence: Synthetic oligonucleotide
  Target: ATXN1; (+) strand; PAM type: NRG; PAM sequence: CAG
gaagcacaagtatggcatgc

SEQ ID NO: 108764 - DNA, 20 bp, Artificial Sequence
  Description of Artificial Sequence: Synthetic oligonucleotide
  Target: ATXN1; (+) strand; PAM type: NRG; PAM sequence: AGG
aagcacaagtatggcatgcc

SEQ ID NO: 108765 - DNA, 20 bp, Artificial Sequence
  Description of Artificial Sequence: Synthetic oligonucleotide
  Target: ATXN1; (+) strand; PAM type: NRG; PAM sequence: GAG
gcacaagtatggcatgccag

SEQ ID NO: 108766 - DNA, 20 bp, Artificial Sequence
  Description of Artificial Sequence: Synthetic oligonucleotide
  Target: ATXN1; (+) strand; PAM type: NRG; PAM sequence: AGG
cacaagtatggcatgccagg

SEQ ID NO: 108767 - DNA, 20 bp, Artificial Sequence
  Description of Artificial Sequence: Synthetic oligonucleotide
  Target: ATXN1; (+) strand; PAM type: NRG; PAM sequence: GGG
acaagtatggcatgccagga

SEQ ID NO: 108768 - DNA, 20 bp, Artificial Sequence
  Description of Artificial Sequence: Synthetic oligonucleotide
  Target: ATXN1; (+) strand; PAM type: NRG; PAM sequence: GGG
caagtatggcatgccaggag

SEQ ID NO: 108769 - DNA, 20 bp, Artificial Sequence
  Description of Artificial Sequence: Synthetic oligonucleotide
  Target: ATXN1; (+) strand; PAM type: NRG; PAM sequence: GAG
agtatggcatgccaggaggg

SEQ ID NO: 108770 - DNA, 20 bp, Artificial Sequence
  Description of Artificial Sequence: Synthetic oligonucleotide
  Target: ATXN1; (+) strand; PAM type: NRG; PAM sequence: AGG
gtatggcatgccaggagggg

SEQ ID NO: 108771 - DNA, 20 bp, Artificial Sequence
  Description of Artificial Sequence: Synthetic oligonucleotide
  Target: ATXN1; (+) strand; PAM type: NRG; PAM sequence: AAG
tggcatgccaggaggggagg

SEQ ID NO: 108772 - DNA, 20 bp, Artificial Sequence
  Description of Artificial Sequence: Synthetic oligonucleotide
  Target: ATXN1; (+) strand; PAM type: NRG; PAM sequence: AGG
ggcatgccaggaggggagga

SEQ ID NO: 108773 - DNA, 20 bp, Artificial Sequence
  Description of Artificial Sequence: Synthetic oligonucleotide
  Target: ATXN1; (+) strand; PAM type: NRG; PAM sequence: GAG
catgccaggaggggaggaag

SEQ ID NO: 108774 - DNA, 20 bp, Artificial Sequence
  Description of Artificial Sequence: Synthetic oligonucleotide
  Target: ATXN1; (+) strand; PAM type: NRG; PAM sequence: AGG
atgccaggaggggaggaagg

SEQ ID NO: 108775 - DNA, 20 bp, Artificial Sequence
  Description of Artificial Sequence: Synthetic oligonucleotide
  Target: ATXN1; (+) strand; PAM type: NRG; PAM sequence: GAG
gaggggaggaaggaggtaac

SEQ ID NO: 108776 - DNA, 20 bp, Artificial Sequence
  Description of Artificial Sequence: Synthetic oligonucleotide
  Target: ATXN1; (+) strand; PAM type: NRG; PAM sequence: AAG
acgagtgcccttctctcccc

SEQ ID NO: 108777 - DNA, 20 bp, Artificial Sequence
  Description of Artificial Sequence: Synthetic oligonucleotide
  Target: ATXN1; (+) strand; PAM type: NRG; PAM sequence: AAG
tctccccaagatatctcttg

SEQ ID NO: 108778 - DNA, 20 bp, Artificial Sequence
  Description of Artificial Sequence: Synthetic oligonucleotide
  Target: ATXN1; (+) strand; PAM type: NRG; PAM sequence: AGG
ctccccaagatatctcttga

SEQ ID NO: 108779 - DNA, 20 bp, Artificial Sequence
  Description of Artificial Sequence: Synthetic oligonucleotide
  Target: ATXN1; (+) strand; PAM type: NRG; PAM sequence: TGG
caagatatctcttgaaggta

SEQ ID NO: 108780 - DNA, 20 bp, Artificial Sequence
  Description of Artificial Sequence: Synthetic oligonucleotide
  Target: ATXN1; (+) strand; PAM type: NRG; PAM sequence: GAG
agatatctcttgaaggtatg

SEQ ID NO: 108781 - DNA, 20 bp, Artificial Sequence
  Description of Artificial Sequence: Synthetic oligonucleotide
  Target: ATXN1; (+) strand; PAM type: NRG; PAM sequence: CAG
cttgaaggtatggagaatct

SEQ ID NO: 108782 - DNA, 20 bp, Artificial Sequence
  Description of Artificial Sequence: Synthetic oligonucleotide
  Target: ATXN1; (+) strand; PAM type: NRG; PAM sequence: AAG
gaaggtatggagaatctcag

SEQ ID NO: 108783 - DNA, 20 bp, Artificial Sequence
  Description of Artificial Sequence: Synthetic oligonucleotide
  Target: ATXN1; (+) strand; PAM type: NRG; PAM sequence: AGG
aaggtatggagaatctcaga

SEQ ID NO: 108784 - DNA, 20 bp, Artificial Sequence
  Description of Artificial Sequence: Synthetic oligonucleotide
  Target: ATXN1; (+) strand; PAM type: NRG; PAM sequence: GGG
aggtatggagaatctcagaa

SEQ ID NO: 108785 - DNA, 20 bp, Artificial Sequence
  Description of Artificial Sequence: Synthetic oligonucleotide
  Target: ATXN1; (+) strand; PAM type: NRG; PAM sequence: TAG
atggagaatctcagaagggt

SEQ ID NO: 108786 - DNA, 20 bp, Artificial Sequence
  Description of Artificial Sequence: Synthetic oligonucleotide
  Target: ATXN1; (+) strand; PAM type: NRG; PAM sequence: AGG
tggagaatctcagaagggtt

SEQ ID NO: 108787 - DNA, 20 bp, Artificial Sequence
  Description of Artificial Sequence: Synthetic oligonucleotide
  Target: ATXN1; (+) strand; PAM type: NRG; PAM sequence: CAG
agaatctcagaagggttagg

SEQ ID NO: 108788 - DNA, 20 bp, Artificial Sequence
  Description of Artificial Sequence: Synthetic oligonucleotide
  Target: ATXN1; (+) strand; PAM type: NRG; PAM sequence: AGG
gaatctcagaagggttaggc

SEQ ID NO: 108789 - DNA, 20 bp, Artificial Sequence
  Description of Artificial Sequence: Synthetic oligonucleotide
  Target: ATXN1; (+) strand; PAM type: NRG; PAM sequence: TGG
tttgattaaaaatgtcactc

SEQ ID NO: 108790 - DNA, 20 bp, Artificial Sequence
  Description of Artificial Sequence: Synthetic oligonucleotide
  Target: ATXN1; (+) strand; PAM type: NRG; PAM sequence: TAG
taaaaatgtcactctggtca

SEQ ID NO: 108791 - DNA, 20 bp, Artificial Sequence
  Description of Artificial Sequence: Synthetic oligonucleotide
  Target: ATXN1; (+) strand; PAM type: NRG; PAM sequence: GAG
aaaatgtcactctggtcata

SEQ ID NO: 108792 - DNA, 20 bp, Artificial Sequence
  Description of Artificial Sequence: Synthetic oligonucleotide
  Target: ATXN1; (+) strand; PAM type: NRG; PAM sequence: TAG
atgtcactctggtcatagag

SEQ ID NO: 108793 - DNA, 20 bp, Artificial Sequence
  Description of Artificial Sequence: Synthetic oligonucleotide
  Target: ATXN1; (+) strand; PAM type: NRG; PAM sequence: AAG
tcactctggtcatagagtag

SEQ ID NO: 108794 - DNA, 20 bp, Artificial Sequence
  Description of Artificial Sequence: Synthetic oligonucleotide
  Target: ATXN1; (+) strand; PAM type: NRG; PAM sequence: TGG
tctggtcatagagtagaaga

SEQ ID NO: 108795 - DNA, 20 bp, Artificial Sequence
  Description of Artificial Sequence: Synthetic oligonucleotide
  Target: ATXN1; (+) strand; PAM type: NRG; PAM sequence: GAG
tcatagagtagaagatggat

SEQ ID NO: 108796 - DNA, 20 bp, Artificial Sequence
  Description of Artificial Sequence: Synthetic oligonucleotide
  Target: ATXN1; (+) strand; PAM type: NRG; PAM sequence: AAG
tagagtagaagatggatgag

SEQ ID NO: 108797 - DNA, 20 bp, Artificial Sequence
  Description of Artificial Sequence: Synthetic oligonucleotide
  Target: ATXN1; (+) strand; PAM type: NRG; PAM sequence: AGG
agagtagaagatggatgaga

SEQ ID NO: 108798 - DNA, 20 bp, Artificial Sequence
  Description of Artificial Sequence: Synthetic oligonucleotide
  Target: ATXN1; (+) strand; PAM type: NRG; PAM sequence: GGG
gagtagaagatggatgagaa

SEQ ID NO: 108799 - DNA, 20 bp, Artificial Sequence
  Description of Artificial Sequence: Synthetic oligonucleotide
  Target: ATXN1; (+) strand; PAM type: NRG; PAM sequence: CAG
gaagatggatgagaagggac

SEQ ID NO: 108800 - DNA, 20 bp, Artificial Sequence
  Description of Artificial Sequence: Synthetic oligonucleotide
  Target: ATXN1; (+) strand; PAM type: NRG; PAM sequence: AGG
aagatggatgagaagggacc

SEQ ID NO: 108801 - DNA, 20 bp, Artificial Sequence
  Description of Artificial Sequence: Synthetic oligonucleotide
  Target: ATXN1; (+) strand; PAM type: NRG; PAM sequence: CAG
tgagaagggaccaggttcta

SEQ ID NO: 108802 - DNA, 20 bp, Artificial Sequence
  Description of Artificial Sequence: Synthetic oligonucleotide
  Target: ATXN1; (+) strand; PAM type: NRG; PAM sequence: AGG
gagaagggaccaggttctac

SEQ ID NO: 108803 - DNA, 20 bp, Artificial Sequence
  Description of Artificial Sequence: Synthetic oligonucleotide
  Target: ATXN1; (+) strand; PAM type: NRG; PAM sequence: AAG
agggaccaggttctacaggc

SEQ ID NO: 108804 - DNA, 20 bp, Artificial Sequence
  Description of Artificial Sequence: Synthetic oligonucleotide
  Target: ATXN1; (+) strand; PAM type: NRG; PAM sequence: AGG
gggaccaggttctacaggca

SEQ ID NO: 108805 - DNA, 20 bp, Artificial Sequence
  Description of Artificial Sequence: Synthetic oligonucleotide
  Target: ATXN1; (+) strand; PAM type: NRG; PAM sequence: CAG
ggttctacaggcaaggcaaa

SEQ ID NO: 108806 - DNA, 20 bp, Artificial Sequence
  Description of Artificial Sequence: Synthetic oligonucleotide
  Target: ATXN1; (+) strand; PAM type: NRG; PAM sequence: CGG
ctacaggcaaggcaaacagt

SEQ ID NO: 108807 - DNA, 20 bp, Artificial Sequence
  Description of Artificial Sequence: Synthetic oligonucleotide
  Target: ATXN1; (+) strand; PAM type: NRG; PAM sequence: GGG
tacaggcaaggcaaacagtc

SEQ ID NO: 108808 - DNA, 20 bp, Artificial Sequence
  Description of Artificial Sequence: Synthetic oligonucleotide
  Target: ATXN1; (+) strand; PAM type: NRG; PAM sequence: GAG
caggcaaggcaaacagtcgg

SEQ ID NO: 108809 - DNA, 20 bp, Artificial Sequence
  Description of Artificial Sequence: Synthetic oligonucleotide
  Target: ATXN1; (+) strand; PAM type: NRG; PAM sequence: AGG
aggcaaggcaaacagtcggg

SEQ ID NO: 108810 - DNA, 20 bp, Artificial Sequence
  Description of Artificial Sequence: Synthetic oligonucleotide
  Target: ATXN1; (+) strand; PAM type: NRG; PAM sequence: GAG
gaacttgctgcaatgccact

SEQ ID NO: 108811 - DNA, 20 bp, Artificial Sequence
  Description of Artificial Sequence: Synthetic oligonucleotide
  Target: ATXN1; (+) strand; PAM type: NRG; PAM sequence: CAG
caatgccactgagctgtcat

SEQ ID NO: 108812 - DNA, 20 bp, Artificial Sequence
  Description of Artificial Sequence: Synthetic oligonucleotide
  Target: ATXN1; (+) strand; PAM type: NRG; PAM sequence: AGG
aatgccactgagctgtcatc

SEQ ID NO: 108813 - DNA, 20 bp, Artificial Sequence
  Description of Artificial Sequence: Synthetic oligonucleotide
  Target: ATXN1; (+) strand; PAM type: NRG; PAM sequence: TGG
cactgagctgtcatcaggtt

SEQ ID NO: 108814 - DNA, 20 bp, Artificial Sequence
  Description of Artificial Sequence: Synthetic oligonucleotide
  Target: ATXN1; (+) strand; PAM type: NRG; PAM sequence: CAG
tcatcaggtttggcctgctg

SEQ ID NO: 108815 - DNA, 20 bp, Artificial Sequence
  Description of Artificial Sequence: Synthetic oligonucleotide
  Target: ATXN1; (+) strand; PAM type: NRG; PAM sequence: AGG
catcaggtttggcctgctgc

SEQ ID NO: 108816 - DNA, 20 bp, Artificial Sequence
  Description of Artificial Sequence: Synthetic oligonucleotide
  Target: ATXN1; (+) strand; PAM type: NRG; PAM sequence: GGG
atcaggtttggcctgctgca

SEQ ID NO: 108817 - DNA, 20 bp, Artificial Sequence
  Description of Artificial Sequence: Synthetic oligonucleotide
  Target: ATXN1; (+) strand; PAM type: NRG; PAM sequence: GGG
tcaggtttggcctgctgcag

SEQ ID NO: 108818 - DNA, 20 bp, Artificial Sequence
  Description of Artificial Sequence: Synthetic oligonucleotide
  Target: ATXN1; (+) strand; PAM type: NRG; PAM sequence: CAG
ggtttggcctgctgcagggg

SEQ ID NO: 108819 - DNA, 20 bp, Artificial Sequence
  Description of Artificial Sequence: Synthetic oligonucleotide
  Target: ATXN1; (+) strand; PAM type: NRG; PAM sequence: AAG
tggcctgctgcaggggcagt

SEQ ID NO: 108820 - DNA, 20 bp, Artificial Sequence
  Description of Artificial Sequence: Synthetic oligonucleotide
  Target: ATXN1; (+) strand; PAM type: NRG; PAM sequence: TGG
tgctgcaggggcagtaagca

SEQ ID NO: 108821 - DNA, 20 bp, Artificial Sequence
  Description of Artificial Sequence: Synthetic oligonucleotide
  Target: ATXN1; (+) strand; PAM type: NRG; PAM sequence: GAG
ctgcaggggcagtaagcatg

SEQ ID NO: 108822 - DNA, 20 bp, Artificial Sequence
  Description of Artificial Sequence: Synthetic oligonucleotide
  Target: ATXN1; (+) strand; PAM type: NRG; PAM sequence: AAG
caggggcagtaagcatggag

SEQ ID NO: 108823 - DNA, 20 bp, Artificial Sequence
  Description of Artificial Sequence: Synthetic oligonucleotide
  Target: ATXN1; (+) strand; PAM type: NRG; PAM sequence: GAG
ggggcagtaagcatggagaa

SEQ ID NO: 108824 - DNA, 20 bp, Artificial Sequence
  Description of Artificial Sequence: Synthetic oligonucleotide
  Target: ATXN1; (+) strand; PAM type: NRG; PAM sequence: AGG
gggcagtaagcatggagaag

SEQ ID NO: 108825 - DNA, 20 bp, Artificial Sequence
  Description of Artificial Sequence: Synthetic oligonucleotide
  Target: ATXN1; (+) strand; PAM type: NRG; PAM sequence: GAG
gcagtaagcatggagaagag

SEQ ID NO: 108826 - DNA, 20 bp, Artificial Sequence
  Description of Artificial Sequence: Synthetic oligonucleotide
  Target: ATXN1; (+) strand; PAM type: NRG; PAM sequence: AGG
cagtaagcatggagaagagg

SEQ ID NO: 108827 - DNA, 20 bp, Artificial Sequence
  Description of Artificial Sequence: Synthetic oligonucleotide
  Target: ATXN1; (+) strand; PAM type: NRG; PAM sequence: CGG
taagcatggagaagaggagg

SEQ ID NO: 108828 - DNA, 20 bp, Artificial Sequence
  Description of Artificial Sequence: Synthetic oligonucleotide
  Target: ATXN1; (+) strand; PAM type: NRG; PAM sequence: CAG
catggagaagaggaggcgga

SEQ ID NO: 108829 - DNA, 20 bp, Artificial Sequence
  Description of Artificial Sequence: Synthetic oligonucleotide
  Target: ATXN1; (+) strand; PAM type: NRG; PAM sequence: AGG
atggagaagaggaggcggac

SEQ ID NO: 108830 - DNA, 20 bp, Artificial Sequence
  Description of Artificial Sequence: Synthetic oligonucleotide
  Target: ATXN1; (+) strand; PAM type: NRG; PAM sequence: GGG
tggagaagaggaggcggaca

SEQ ID NO: 108831 - DNA, 20 bp, Artificial Sequence
  Description of Artificial Sequence: Synthetic oligonucleotide
  Target: ATXN1; (+) strand; PAM type: NRG; PAM sequence: GGG
ggagaagaggaggcggacag

SEQ ID NO: 108832 - DNA, 20 bp, Artificial Sequence
  Description of Artificial Sequence: Synthetic oligonucleotide
  Target: ATXN1; (+) strand; PAM type: NRG; PAM sequence: GAG
agaagaggaggcggacaggg

SEQ ID NO: 108833 - DNA, 20 bp, Artificial Sequence
  Description of Artificial Sequence: Synthetic oligonucleotide
  Target: ATXN1; (+) strand; PAM type: NRG; PAM sequence: CAG
ggcggacaggggagatgtcc

SEQ ID NO: 108834 - DNA, 20 bp, Artificial Sequence
  Description of Artificial Sequence: Synthetic oligonucleotide
  Target: ATXN1; (+) strand; PAM type: NRG; PAM sequence: AGG
gcggacaggggagatgtccc

SEQ ID NO: 108835 - DNA, 20 bp, Artificial Sequence
  Description of Artificial Sequence: Synthetic oligonucleotide
  Target: ATXN1; (+) strand; PAM type: NRG; PAM sequence: CAG
gacaggggagatgtcccagg

SEQ ID NO: 108836 - DNA, 20 bp, Artificial Sequence
  Description of Artificial Sequence: Synthetic oligonucleotide
  Target: ATXN1; (+) strand; PAM type: NRG; PAM sequence: CAG
ggagatgtcccaggcagact

SEQ ID NO: 108837 - DNA, 20 bp, Artificial Sequence
  Description of Artificial Sequence: Synthetic oligonucleotide
  Target: ATXN1; (+) strand; PAM type: NRG; PAM sequence: AAG
tcccaggcagactcagcacc

SEQ ID NO: 108838 - DNA, 20 bp, Artificial Sequence
  Description of Artificial Sequence: Synthetic oligonucleotide
  Target: ATXN1; (+) strand; PAM type: NRG; PAM sequence: AGG
cccaggcagactcagcacca

SEQ ID NO: 108839 - DNA, 20 bp, Artificial Sequence
  Description of Artificial Sequence: Synthetic oligonucleotide
  Target: ATXN1; (+) strand; PAM type: NRG; PAM sequence: TGG
tcagcaccaaggctgctgaa

SEQ ID NO: 108840 - DNA, 20 bp, Artificial Sequence
  Description of Artificial Sequence: Synthetic oligonucleotide
  Target: ATXN1; (+) strand; PAM type: NRG; PAM sequence: TGG
caccaaggctgctgaatggc

SEQ ID NO: 108841 - DNA, 20 bp, Artificial Sequence
  Description of Artificial Sequence: Synthetic oligonucleotide
  Target: ATXN1; (+) strand; PAM type: NRG; PAM sequence: GGG
accaaggctgctgaatggct

SEQ ID NO: 108842 - DNA, 20 bp, Artificial Sequence
  Description of Artificial Sequence: Synthetic oligonucleotide
  Target: ATXN1; (+) strand; PAM type: NRG; PAM sequence: CAG
aaggctgctgaatggctggg

SEQ ID NO: 108843 - DNA, 20 bp, Artificial Sequence
  Description of Artificial Sequence: Synthetic oligonucleotide
  Target: ATXN1; (+) strand; PAM type: NRG; PAM sequence: AGG
aggctgctgaatggctgggc

SEQ ID NO: 108844 - DNA, 20 bp, Artificial Sequence
  Description of Artificial Sequence: Synthetic oligonucleotide
  Target: ATXN1; (+) strand; PAM type: NRG; PAM sequence: GGG
ggctgctgaatggctgggca

SEQ ID NO: 108845 - DNA, 20 bp, Artificial Sequence
  Description of Artificial Sequence: Synthetic oligonucleotide
  Target: ATXN1; (+) strand; PAM type: NRG; PAM sequence: GGG
gctgctgaatggctgggcag

SEQ ID NO: 108846 - DNA, 20 bp, Artificial Sequence
  Description of Artificial Sequence: Synthetic oligonucleotide
  Target: ATXN1; (+) strand; PAM type: NRG; PAM sequence: TGG
aatggctgggcaggggcaca

SEQ ID NO: 108847 - DNA, 20 bp, Artificial Sequence
  Description of Artificial Sequence: Synthetic oligonucleotide
  Target: ATXN1; (+) strand; PAM type: NRG; PAM sequence: GAG
tggctgggcaggggcacatg

SEQ ID NO: 108848 - DNA, 20 bp, Artificial Sequence
  Description of Artificial Sequence: Synthetic oligonucleotide
  Target: ATXN1; (+) strand; PAM type: NRG; PAM sequence: AGG
ggctgggcaggggcacatgg

SEQ ID NO: 108849 - DNA, 20 bp, Artificial Sequence
  Description of Artificial Sequence: Synthetic oligonucleotide
  Target: ATXN1; (+) strand; PAM type: NRG; PAM sequence: CAG
ggcaggggcacatggaggaa

SEQ ID NO: 108850 - DNA, 20 bp, Artificial Sequence
  Description of Artificial Sequence: Synthetic oligonucleotide
  Target: ATXN1; (+) strand; PAM type: NRG; PAM sequence: TAG
gggcacatggaggaacagca

SEQ ID NO: 108851 - DNA, 20 bp, Artificial Sequence
  Description of Artificial Sequence: Synthetic oligonucleotide
  Target: ATXN1; (+) strand; PAM type: NRG; PAM sequence: AGG
ggcacatggaggaacagcat

SEQ ID NO: 108852 - DNA, 20 bp, Artificial Sequence
  Description of Artificial Sequence: Synthetic oligonucleotide
  Target: ATXN1; (+) strand; PAM type: NRG; PAM sequence: GGG
gcacatggaggaacagcata

SEQ ID NO: 108853 - DNA, 20 bp, Artificial Sequence
  Description of Artificial Sequence: Synthetic oligonucleotide
  Target: ATXN1; (+) strand; PAM type: NRG; PAM sequence: GGG
cacatggaggaacagcatag

SEQ ID NO: 108854 - DNA, 20 bp, Artificial Sequence
  Description of Artificial Sequence: Synthetic oligonucleotide
  Target: ATXN1; (+) strand; PAM type: NRG; PAM sequence: TGG
aggaacagcataggggcttc

SEQ ID NO: 108855 - DNA, 20 bp, Artificial Sequence
  Description of Artificial Sequence: Synthetic oligonucleotide
  Target: ATXN1; (+) strand; PAM type: NRG; PAM sequence: TGG
cagcataggggcttctggct

SEQ ID NO: 108856 - DNA, 20 bp, Artificial Sequence
  Description of Artificial Sequence: Synthetic oligonucleotide
  Target: ATXN1; (+) strand; PAM type: NRG; PAM sequence: TAG
ataggggcttctggcttggc

SEQ ID NO: 108857 - DNA, 20 bp, Artificial Sequence
  Description of Artificial Sequence: Synthetic oligonucleotide
  Target: ATXN1; (+) strand; PAM type: NRG; PAM sequence: AAG
ttggctagtgccatttgcac

SEQ ID NO: 108858 - DNA, 20 bp, Artificial Sequence
  Description of Artificial Sequence: Synthetic oligonucleotide
  Target: ATXN1; (+) strand; PAM type: NRG; PAM sequence: GAG
ggctagtgccatttgcacaa

SEQ ID NO: 108859 - DNA, 20 bp, Artificial Sequence
  Description of Artificial Sequence: Synthetic oligonucleotide
  Target: ATXN1; (+) strand; PAM type: NRG; PAM sequence: TGG
tgccatttgcacaagagata

SEQ ID NO: 108860 - DNA, 20 bp, Artificial Sequence
  Description of Artificial Sequence: Synthetic oligonucleotide
  Target: ATXN1; (+) strand; PAM type: NRG; PAM sequence: GGG
gccatttgcacaagagatat

SEQ ID NO: 108861 - DNA, 20 bp, Artificial Sequence
  Description of Artificial Sequence: Synthetic oligonucleotide
  Target: ATXN1; (+) strand; PAM type: NRG; PAM sequence: GAG
catttgcacaagagatatgg

SEQ ID NO: 108862 - DNA, 20 bp, Artificial Sequence
  Description of Artificial Sequence: Synthetic oligonucleotide
  Target: ATXN1; (+) strand; PAM type: NRG; PAM sequence: TGG
aagagatatgggagaaatca

SEQ ID NO: 108863 - DNA, 20 bp, Artificial Sequence
  Description of Artificial Sequence: Synthetic oligonucleotide
  Target: ATXN1; (+) strand; PAM type: NRG; PAM sequence: TAG
atatgggagaaatcatggtc

SEQ ID NO: 108864 - DNA, 20 bp, Artificial Sequence
  Description of Artificial Sequence: Synthetic oligonucleotide
  Target: ATXN1; (+) strand; PAM type: NRG; PAM sequence: CAG
ggtctagctcctttctaact

SEQ ID NO: 108865 - DNA, 20 bp, Artificial Sequence
  Description of Artificial Sequence: Synthetic oligonucleotide
  Target: ATXN1; (+) strand; PAM type: NRG; PAM sequence: TAG
ttaatttctcgttttacttc

SEQ ID NO: 108866 - DNA, 20 bp, Artificial Sequence
  Description of Artificial Sequence: Synthetic oligonucleotide
  Target: ATXN1; (+) strand; PAM type: NRG; PAM sequence: AGG
taatttctcgttttacttct

SEQ ID NO: 108867 - DNA, 20 bp, Artificial Sequence
  Description of Artificial Sequence: Synthetic oligonucleotide
  Target: ATXN1; (+) strand; PAM type: NRG; PAM sequence: AAG
ctcgttttacttctaggata

SEQ ID NO: 108868 - DNA, 20 bp, Artificial Sequence
  Description of Artificial Sequence: Synthetic oligonucleotide
  Target: ATXN1; (+) strand; PAM type: NRG; PAM sequence: AAG
aatctctaacttgacgctga

SEQ ID NO: 108869 - DNA, 20 bp, Artificial Sequence
  Description of Artificial Sequence: Synthetic oligonucleotide
  Target: ATXN1; (+) strand; PAM type: NRG; PAM sequence: CAG
ctctacaatccccctacatg

SEQ ID NO: 108870 - DNA, 20 bp, Artificial Sequence
  Description of Artificial Sequence: Synthetic oligonucleotide
  Target: ATXN1; (+) strand; PAM type: NRG; PAM sequence: TAG
tacaatccccctacatgcag

SEQ ID NO: 108871 - DNA, 20 bp, Artificial Sequence
  Description of Artificial Sequence: Synthetic oligonucleotide
  Target: ATXN1; (+) strand; PAM type: NRG; PAM sequence: AGG
acaatccccctacatgcagt

SEQ ID NO: 108872 - DNA, 20 bp, Artificial Sequence
  Description of Artificial Sequence: Synthetic oligonucleotide
  Target: ATXN1; (+) strand; PAM type: NRG; PAM sequence: CAG
agtaggtactcgatacatac

SEQ ID NO: 108873 - DNA, 20 bp, Artificial Sequence
  Description of Artificial Sequence: Synthetic oligonucleotide
  Target: ATXN1; (+) strand; PAM type: NRG; PAM sequence: CAG
tatcaatatttttctgatta

SEQ ID NO: 108874 - DNA, 20 bp, Artificial Sequence
  Description of Artificial Sequence: Synthetic oligonucleotide
  Target: ATXN1; (+) strand; PAM type: NRG; PAM sequence: AGG
atcaatatttttctgattac

SEQ ID NO: 108875 - DNA, 20 bp, Artificial Sequence
  Description of Artificial Sequence: Synthetic oligonucleotide
  Target: ATXN1; (+) strand; PAM type: NRG; PAM sequence: TGG
tatttttctgattacaggtt

SEQ ID NO: 108876 - DNA, 20 bp, Artificial Sequence
  Description of Artificial Sequence: Synthetic oligonucleotide
  Target: ATXN1; (+) strand; PAM type: NRG; PAM sequence: AAG
ttactactttgcctttgtga

SEQ ID NO: 108877 - DNA, 20 bp, Artificial Sequence
  Description of Artificial Sequence: Synthetic oligonucleotide
  Target: ATXN1; (+) strand; PAM type: NRG; PAM sequence: AAG
ctactttgcctttgtgaaag

SEQ ID NO: 108878 - DNA, 20 bp, Artificial Sequence
  Description of Artificial Sequence: Synthetic oligonucleotide
  Target: ATXN1; (+) strand; PAM type: NRG; PAM sequence: GAG
actttgcctttgtgaaagaa

SEQ ID NO: 108879 - DNA, 20 bp, Artificial Sequence
  Description of Artificial Sequence: Synthetic oligonucleotide
  Target: ATXN1; (+) strand; PAM type: NRG; PAM sequence: TAG
cctttgtgaaagaagagaaa

SEQ ID NO: 108880 - DNA, 20 bp, Artificial Sequence
  Description of Artificial Sequence: Synthetic oligonucleotide
  Target: ATXN1; (+) strand; PAM type: NRG; PAM sequence: AAG
aatagcttgcaacttattca

SEQ ID NO: 108881 - DNA, 20 bp, Artificial Sequence
  Description of Artificial Sequence: Synthetic oligonucleotide
  Target: ATXN1; (+) strand; PAM type: NRG; PAM sequence: AAG
ttgcaacttattcaaagaat

SEQ ID NO: 108882 - DNA, 20 bp, Artificial Sequence
  Description of Artificial Sequence: Synthetic oligonucleotide
  Target: ATXN1; (+) strand; PAM type: NRG; PAM sequence: AAG
acttattcaaagaataagat

SEQ ID NO: 108883 - DNA, 20 bp, Artificial Sequence
  Description of Artificial Sequence: Synthetic oligonucleotide
  Target: ATXN1; (+) strand; PAM type: NRG; PAM sequence: CAG
acacattttctctcctgata

SEQ ID NO: 108884 - DNA, 20 bp, Artificial Sequence
  Description of Artificial Sequence: Synthetic oligonucleotide
  Target: ATXN1; (+) strand; PAM type: NRG; PAM sequence: AGG
cacattttctctcctgatac

SEQ ID NO: 108885 - DNA, 20 bp, Artificial Sequence
  Description of Artificial Sequence: Synthetic oligonucleotide
  Target: ATXN1; (+) strand; PAM type: NRG; PAM sequence: GGG
acattttctctcctgataca

SEQ ID NO: 108886 - DNA, 20 bp, Artificial Sequence
  Description of Artificial Sequence: Synthetic oligonucleotide
  Target: ATXN1; (+) strand; PAM type: NRG; PAM sequence: CAG
tctctcctgatacagggcta

SEQ ID NO: 108887 - DNA, 20 bp, Artificial Sequence
  Description of Artificial Sequence: Synthetic oligonucleotide
  Target: ATXN1; (+) strand; PAM type: NRG; PAM sequence: TGG
taatcattcctatcttactc

SEQ ID NO: 108888 - DNA, 20 bp, Artificial Sequence
  Description of Artificial Sequence: Synthetic oligonucleotide
  Target: ATXN1; (+) strand; PAM type: NRG; PAM sequence: GGG
aatcattcctatcttactct

SEQ ID NO: 108889 - DNA, 20 bp, Artificial Sequence
  Description of Artificial Sequence: Synthetic oligonucleotide
  Target: ATXN1; (+) strand; PAM type: NRG; PAM sequence: TAG
attcctatcttactctgggt

SEQ ID NO: 108890 - DNA, 20 bp, Artificial Sequence
  Description of Artificial Sequence: Synthetic oligonucleotide
  Target: ATXN1; (+) strand; PAM type: NRG; PAM sequence: AGG
ttcctatcttactctgggtt

SEQ ID NO: 108891 - DNA, 20 bp, Artificial Sequence
  Description of Artificial Sequence: Synthetic oligonucleotide
  Target: ATXN1; (+) strand; PAM type: NRG; PAM sequence: GGG
tcctatcttactctgggtta

SEQ ID NO: 108892 - DNA, 20 bp, Artificial Sequence
  Description of Artificial Sequence: Synthetic oligonucleotide
  Target: ATXN1; (+) strand; PAM type: NRG; PAM sequence: AAG
ctgtcctctccttcaccctt

SEQ ID NO: 108893 - DNA, 20 bp, Artificial Sequence
  Description of Artificial Sequence: Synthetic oligonucleotide
  Target: ATXN1; (+) strand; PAM type: NRG; PAM sequence: AGG
tgtcctctccttcaccctta

SEQ ID NO: 108894 - DNA, 20 bp, Artificial Sequence
  Description of Artificial Sequence: Synthetic oligonucleotide
  Target: ATXN1; (+) strand; PAM type: NRG; PAM sequence: TAG
tccttcacccttaaggctat

SEQ ID NO: 108895 - DNA, 20 bp, Artificial Sequence
  Description of Artificial Sequence: Synthetic oligonucleotide
  Target: ATXN1; (+) strand; PAM type: NRG; PAM sequence: TAG
tcttcacgataaaaaatttc

SEQ ID NO: 108896 - DNA, 20 bp, Artificial Sequence
  Description of Artificial Sequence: Synthetic oligonucleotide
  Target: ATXN1; (+) strand; PAM type: NRG; PAM sequence: AGG
cttcacgataaaaaatttct

SEQ ID NO: 108897 - DNA, 20 bp, Artificial Sequence
  Description of Artificial Sequence: Synthetic oligonucleotide
  Target: ATXN1; (+) strand; PAM type: NRG; PAM sequence: TAG
cacgataaaaaatttctagg

SEQ ID NO: 108898 - DNA, 20 bp, Artificial Sequence
  Description of Artificial Sequence: Synthetic oligonucleotide
  Target: ATXN1; (+) strand; PAM type: NRG; PAM sequence: GAG
cgataaaaaatttctaggta

SEQ ID NO: 108899 - DNA, 20 bp, Artificial Sequence
  Description of Artificial Sequence: Synthetic oligonucleotide
  Target: ATXN1; (+) strand; PAM type: NRG; PAM sequence: TAG
aaaaaatttctaggtagaga

SEQ ID NO: 108900 - DNA, 20 bp, Artificial Sequence
  Description of Artificial Sequence: Synthetic oligonucleotide
  Target: ATXN1; (+) strand; PAM type: NRG; PAM sequence: TGG
tctaggtagagatagatgct

SEQ ID NO: 108901 - DNA, 20 bp, Artificial Sequence
  Description of Artificial Sequence: Synthetic oligonucleotide
  Target: ATXN1; (+) strand; PAM type: NRG; PAM sequence: GGG
ctaggtagagatagatgctt

SEQ ID NO: 108902 - DNA, 20 bp, Artificial Sequence
  Description of Artificial Sequence: Synthetic oligonucleotide
  Target: ATXN1; (+) strand; PAM type: NRG; PAM sequence: GGG
taggtagagatagatgcttg

SEQ ID NO: 108903 - DNA, 20 bp, Artificial Sequence
  Description of Artificial Sequence: Synthetic oligonucleotide
  Target: ATXN1; (+) strand; PAM type: NRG; PAM sequence: AAG
atagatgcttggggttctaa

SEQ ID NO: 108904 - DNA, 20 bp, Artificial Sequence
  Description of Artificial Sequence: Synthetic oligonucleotide
  Target: ATXN1; (+) strand; PAM type: NRG; PAM sequence: GAG
agatgcttggggttctaaaa

SEQ ID NO: 108905 - DNA, 20 bp, Artificial Sequence
  Description of Artificial Sequence: Synthetic oligonucleotide
  Target: ATXN1; (+) strand; PAM type: NRG; PAM sequence: AAG
gcttggggttctaaaagagc

SEQ ID NO: 108906 - DNA, 20 bp, Artificial Sequence
  Description of Artificial Sequence: Synthetic oligonucleotide
  Target: ATXN1; (+) strand; PAM type: NRG; PAM sequence: TGG
tggggttctaaaagagcaag

SEQ ID NO: 108907 - DNA, 20 bp, Artificial Sequence
  Description of Artificial Sequence: Synthetic oligonucleotide
  Target: ATXN1; (+) strand; PAM type: NRG; PAM sequence: CAG
tcacatacgatgacacattc

SEQ ID NO: 108908 - DNA, 20 bp, Artificial Sequence
  Description of Artificial Sequence: Synthetic oligonucleotide
  Target: ATXN1; (+) strand; PAM type: NRG; PAM sequence: AAG
atgacacattccagcctcta

SEQ ID NO: 108909 - DNA, 20 bp, Artificial Sequence
  Description of Artificial Sequence: Synthetic oligonucleotide
  Target: ATXN1; (+) strand; PAM type: NRG; PAM sequence: CAG
acacattccagcctctaaag

SEQ ID NO: 108910 - DNA, 20 bp, Artificial Sequence
  Description of Artificial Sequence: Synthetic oligonucleotide
  Target: ATXN1; (+) strand; PAM type: NRG; PAM sequence: CAG
ctctaaagcagtctgcatta

SEQ ID NO: 108911 - DNA, 20 bp, Artificial Sequence
  Description of Artificial Sequence: Synthetic oligonucleotide
  Target: ATXN1; (+) strand; PAM type: NRG; PAM sequence: AGG
tctaaagcagtctgcattac

SEQ ID NO: 108912 - DNA, 20 bp, Artificial Sequence
  Description of Artificial Sequence: Synthetic oligonucleotide
  Target: ATXN1; (+) strand; PAM type: NRG; PAM sequence: CAG
aggatcattattattttttc

SEQ ID NO: 108913 - DNA, 20 bp, Artificial Sequence
  Description of Artificial Sequence: Synthetic oligonucleotide
  Target: ATXN1; (+) strand; PAM type: NRG; PAM sequence: AAG
cattattattttttccagca

SEQ ID NO: 108914 - DNA, 20 bp, Artificial Sequence
  Description of Artificial Sequence: Synthetic oligonucleotide
  Target: ATXN1; (+) strand; PAM type: NRG; PAM sequence: AAG
tattattttttccagcaaag

SEQ ID NO: 108915 - DNA, 20 bp, Artificial Sequence
  Description of Artificial Sequence: Synthetic oligonucleotide
  Target: ATXN1; (+) strand; PAM type: NRG; PAM sequence: CAG
ccagcaaagaagccacaatt

SEQ ID NO: 108916 - DNA, 20 bp, Artificial Sequence
  Description of Artificial Sequence: Synthetic oligonucleotide
  Target: ATXN1; (+) strand; PAM type: NRG; PAM sequence: AGG
cagcaaagaagccacaattc

SEQ ID NO: 108917 - DNA, 20 bp, Artificial Sequence
  Description of Artificial Sequence: Synthetic oligonucleotide
  Target: ATXN1; (+) strand; PAM type: NRG; PAM sequence: AAG
gaatctatgcaaaaataatt

SEQ ID NO: 108918 - DNA, 20 bp, Artificial Sequence
  Description of Artificial Sequence: Synthetic oligonucleotide
  Target: ATXN1; (+) strand; PAM type: NRG; PAM sequence: AAG
tatgcaaaaataattaagtg

SEQ ID NO: 108919 - DNA, 20 bp, Artificial Sequence
  Description of Artificial Sequence: Synthetic oligonucleotide
  Target: ATXN1; (+) strand; PAM type: NRG; PAM sequence: AGG
atgcaaaaataattaagtga

SEQ ID NO: 108920 - DNA, 20 bp, Artificial Sequence
  Description of Artificial Sequence: Synthetic oligonucleotide
  Target: ATXN1; (+) strand; PAM type: NRG; PAM sequence: AAG
taagtgaaggttgctccatc

SEQ ID NO: 108921 - DNA, 20 bp, Artificial Sequence
  Description of Artificial Sequence: Synthetic oligonucleotide
  Target: ATXN1; (+) strand; PAM type: NRG; PAM sequence: GAG
cttgccattctgcccttcct

SEQ ID NO: 108922 - DNA, 20 bp, Artificial Sequence
  Description of Artificial Sequence: Synthetic oligonucleotide
  Target: ATXN1; (+) strand; PAM type: NRG; PAM sequence: CAG
ttcctgagatgacaacatgt

SEQ ID NO: 108923 - DNA, 20 bp, Artificial Sequence
  Description of Artificial Sequence: Synthetic oligonucleotide
  Target: ATXN1; (+) strand; PAM type: NRG; PAM sequence: AAG
acatgtcagctgctttgaac

SEQ ID NO: 108924 - DNA, 20 bp, Artificial Sequence
  Description of Artificial Sequence: Synthetic oligonucleotide
  Target: ATXN1; (+) strand; PAM type: NRG; PAM sequence: TAG
ttgcacttgctgctgctttg

SEQ ID NO: 108925 - DNA, 20 bp, Artificial Sequence
  Description of Artificial Sequence: Synthetic oligonucleotide
  Target: ATXN1; (+) strand; PAM type: NRG; PAM sequence: TGG
gctgctgctttgtagtctgc

SEQ ID NO: 108926 - DNA, 20 bp, Artificial Sequence
  Description of Artificial Sequence: Synthetic oligonucleotide
  Target: ATXN1; (+) strand; PAM type: NRG; PAM sequence: GGG
ctgctgctttgtagtctgct

SEQ ID NO: 108927 - DNA, 20 bp, Artificial Sequence
  Description of Artificial Sequence: Synthetic oligonucleotide
  Target: ATXN1; (+) strand; PAM type: NRG; PAM sequence: TAG
ctgctttgtagtctgctggg

SEQ ID NO: 108928 - DNA, 20 bp, Artificial Sequence
  Description of Artificial Sequence: Synthetic oligonucleotide
  Target: ATXN1; (+) strand; PAM type: NRG; PAM sequence: TGG
ctttgtagtctgctgggtag

SEQ ID NO: 108929 - DNA, 20 bp, Artificial Sequence
  Description of Artificial Sequence: Synthetic oligonucleotide
  Target: ATXN1; (+) strand; PAM type: NRG; PAM sequence: CAG
agtctgctgggtagtggtga

SEQ ID NO: 108930 - DNA, 20 bp, Artificial Sequence
  Description of Artificial Sequence: Synthetic oligonucleotide
  Target: ATXN1; (+) strand; PAM type: NRG; PAM sequence: TGG
gcgcgttaaccataaaaaaa

SEQ ID NO: 108931 - DNA, 20 bp, Artificial Sequence
  Description of Artificial Sequence: Synthetic oligonucleotide
  Target: ATXN1; (+) strand; PAM type: NRG; PAM sequence: GGG
cgcgttaaccataaaaaaat

SEQ ID NO: 108932 - DNA, 20 bp, Artificial Sequence
  Description of Artificial Sequence: Synthetic oligonucleotide
  Target: ATXN1; (+) strand; PAM type: NRG; PAM sequence: GGG
gcgttaaccataaaaaaatg

SEQ ID NO: 108933 - DNA, 20 bp, Artificial Sequence
  Description of Artificial Sequence: Synthetic oligonucleotide
  Target: ATXN1; (+) strand; PAM type: NRG; PAM sequence: GAG
gttaaccataaaaaaatggg

SEQ ID NO: 108934 - DNA, 20 bp, Artificial Sequence
  Description of Artificial Sequence: Synthetic oligonucleotide
  Target: ATXN1; (+) strand; PAM type: NRG; PAM sequence: CAG
ccataaaaaaatggggagtt

SEQ ID NO: 108935 - DNA, 20 bp, Artificial Sequence
  Description of Artificial Sequence: Synthetic oligonucleotide
  Target: ATXN1; (+) strand; PAM type: NRG; PAM sequence: AGG
cataaaaaaatggggagttc

SEQ ID NO: 108936 - DNA, 20 bp, Artificial Sequence
  Description of Artificial Sequence: Synthetic oligonucleotide
  Target: ATXN1; (+) strand; PAM type: NRG; PAM sequence: TGG
aaaaatggggagttcaggac

SEQ ID NO: 108937 - DNA, 20 bp, Artificial Sequence
  Description of Artificial Sequence: Synthetic oligonucleotide
  Target: ATXN1; (+) strand; PAM type: NRG; PAM sequence: GAG
aaatggggagttcaggactg

SEQ ID NO: 108938 - DNA, 20 bp, Artificial Sequence
  Description of Artificial Sequence: Synthetic oligonucleotide
  Target: ATXN1; (+) strand; PAM type: NRG; PAM sequence: AGG
aatggggagttcaggactgg

SEQ ID NO: 108939 - DNA, 20 bp, Artificial Sequence
  Description of Artificial Sequence: Synthetic oligonucleotide
  Target: ATXN1; (+) strand; PAM type: NRG; PAM sequence: GGG
atggggagttcaggactgga

SEQ ID NO: 108940 - DNA, 20 bp, Artificial Sequence
  Description of Artificial Sequence: Synthetic oligonucleotide
  Target: ATXN1; (+) strand; PAM type: NRG; PAM sequence: GGG
tggggagttcaggactggag

SEQ ID NO: 108941 - DNA, 20 bp, Artificial Sequence
  Description of Artificial Sequence: Synthetic oligonucleotide
  Target: ATXN1; (+) strand; PAM type: NRG; PAM sequence: GGG
ggggagttcaggactggagg

SEQ ID NO: 108942 - DNA, 20 bp, Artificial Sequence
  Description of Artificial Sequence: Synthetic oligonucleotide
  Target: ATXN1; (+) strand; PAM type: NRG; PAM sequence: GAG
gttcaggactggagggggct

SEQ ID NO: 108943 - DNA, 20 bp, Artificial Sequence
  Description of Artificial Sequence: Synthetic oligonucleotide
  Target: ATXN1; (+) strand; PAM type: NRG; PAM sequence: AAG
aacattttaacatatttgca

SEQ ID NO: 108944 - DNA, 20 bp, Artificial Sequence
  Description of Artificial Sequence: Synthetic oligonucleotide
  Target: ATXN1; (+) strand; PAM type: NRG; PAM sequence: AGG
acattttaacatatttgcaa

SEQ ID NO: 108945 - DNA, 20 bp, Artificial Sequence
  Description of Artificial Sequence: Synthetic oligonucleotide
  Target: ATXN1; (+) strand; PAM type: NRG; PAM sequence: AAG
taacatatttgcaaaggcac

SEQ ID NO: 108946 - DNA, 20 bp, Artificial Sequence
  Description of Artificial Sequence: Synthetic oligonucleotide
  Target: ATXN1; (+) strand; PAM type: NRG; PAM sequence: AAG
ttgcaaaggcacaagattgt

SEQ ID NO: 108947 - DNA, 20 bp, Artificial Sequence
  Description of Artificial Sequence: Synthetic oligonucleotide
  Target: ATXN1; (+) strand; PAM type: NRG; PAM sequence: TAG
aaggcacaagattgtaagaa

SEQ ID NO: 108948 - DNA, 20 bp, Artificial Sequence
  Description of Artificial Sequence: Synthetic oligonucleotide
  Target: ATXN1; (+) strand; PAM type: NRG; PAM sequence: GAG
attgtaagaatagttatgct

SEQ ID NO: 108949 - DNA, 20 bp, Artificial Sequence
  Description of Artificial Sequence: Synthetic oligonucleotide
  Target: ATXN1; (+) strand; PAM type: NRG; PAM sequence: CAG
agaacttaaacttttgcttt

SEQ ID NO: 108950 - DNA, 20 bp, Artificial Sequence
  Description of Artificial Sequence: Synthetic oligonucleotide
  Target: ATXN1; (+) strand; PAM type: NRG; PAM sequence: CAG
ttaaacttttgctttcagat

SEQ ID NO: 108951 - DNA, 20 bp, Artificial Sequence
  Description of Artificial Sequence: Synthetic oligonucleotide
  Target: ATXN1; (+) strand; PAM type: NRG; PAM sequence: AAG
ctcttaacacttttacatga

SEQ ID NO: 108952 - DNA, 20 bp, Artificial Sequence
  Description of Artificial Sequence: Synthetic oligonucleotide
  Target: ATXN1; (+) strand; PAM type: NRG; PAM sequence: AAG
cttttacatgaaagaaatgc

SEQ ID NO: 108953 - DNA, 20 bp, Artificial Sequence
  Description of Artificial Sequence: Synthetic oligonucleotide
  Target: ATXN1; (+) strand; PAM type: NRG; PAM sequence: AGG
ttttacatgaaagaaatgca

SEQ ID NO: 108954 - DNA, 20 bp, Artificial Sequence
  Description of Artificial Sequence: Synthetic oligonucleotide
  Target: ATXN1; (+) strand; PAM type: NRG; PAM sequence: GAG
ttacatgaaagaaatgcaag

SEQ ID NO: 108955 - DNA, 20 bp, Artificial Sequence
  Description of Artificial Sequence: Synthetic oligonucleotide
  Target: ATXN1; (+) strand; PAM type: NRG; PAM sequence: TGG
aaccaatacattaacatatg

SEQ ID NO: 108956 - DNA, 20 bp, Artificial Sequence
  Description of Artificial Sequence: Synthetic oligonucleotide
  Target: ATXN1; (+) strand; PAM type: NRG; PAM sequence: TAG
atgtggatatcgtgtgcctc

SEQ ID NO: 108957 - DNA, 20 bp, Artificial Sequence
  Description of Artificial Sequence: Synthetic oligonucleotide
  Target: ATXN1; (+) strand; PAM type: NRG; PAM sequence: AAG
ggatatcgtgtgcctctaga

SEQ ID NO: 108958 - DNA, 20 bp, Artificial Sequence
  Description of Artificial Sequence: Synthetic oligonucleotide
  Target: ATXN1; (+) strand; PAM type: NRG; PAM sequence: CAG
atcgtgtgcctctagaaagt

SEQ ID NO: 108959 - DNA, 20 bp, Artificial Sequence
  Description of Artificial Sequence: Synthetic oligonucleotide
  Target: ATXN1; (+) strand; PAM type: NRG; PAM sequence: AGG
tcgtgtgcctctagaaagtc

SEQ ID NO: 108960 - DNA, 20 bp, Artificial Sequence
  Description of Artificial Sequence: Synthetic oligonucleotide
  Target: ATXN1; (+) strand; PAM type: NRG; PAM sequence: GAG
gtgtgcctctagaaagtcag

SEQ ID NO: 108961 - DNA, 20 bp, Artificial Sequence
  Description of Artificial Sequence: Synthetic oligonucleotide
  Target: ATXN1; (+) strand; PAM type: NRG; PAM sequence: GAG
gtgcctctagaaagtcagga

SEQ ID NO: 108962 - DNA, 20 bp, Artificial Sequence
  Description of Artificial Sequence: Synthetic oligonucleotide
  Target: ATXN1; (+) strand; PAM type: NRG; PAM sequence: TGG
gaaagtcaggagagcaaatg

SEQ ID NO: 108963 - DNA, 20 bp, Artificial Sequence
  Description of Artificial Sequence: Synthetic oligonucleotide
  Target: ATXN1; (+) strand; PAM type: NRG; PAM sequence: GGG
aaagtcaggagagcaaatgt

SEQ ID NO: 108964 - DNA, 20 bp, Artificial Sequence
  Description of Artificial Sequence: Synthetic oligonucleotide
  Target: ATXN1; (+) strand; PAM type: NRG; PAM sequence: GAG
agtcaggagagcaaatgtgg

SEQ ID NO: 108965 - DNA, 20 bp, Artificial Sequence
  Description of Artificial Sequence: Synthetic oligonucleotide
  Target: ATXN1; (+) strand; PAM type: NRG; PAM sequence: GAG
agcaaatgtgggagctcctt

SEQ ID NO: 108966 - DNA, 20 bp, Artificial Sequence
  Description of Artificial Sequence: Synthetic oligonucleotide
  Target: ATXN1; (+) strand; PAM type: NRG; PAM sequence: AAG
gttattctgatctgctgcac

SEQ ID NO: 108967 - DNA, 20 bp, Artificial Sequence
  Description of Artificial Sequence: Synthetic oligonucleotide
  Target: ATXN1; (+) strand; PAM type: NRG; PAM sequence: AGG
ttattctgatctgctgcaca

SEQ ID NO: 108968 - DNA, 20 bp, Artificial Sequence
  Description of Artificial Sequence: Synthetic oligonucleotide
  Target: ATXN1; (+) strand; PAM type: NRG; PAM sequence: CAG
gatctgctgcacaaggccac

SEQ ID NO: 108969 - DNA, 20 bp, Artificial Sequence
  Description of Artificial Sequence: Synthetic oligonucleotide
  Target: ATXN1; (+) strand; PAM type: NRG; PAM sequence: AGG
atctgctgcacaaggccacc

SEQ ID NO: 108970 - DNA, 20 bp, Artificial Sequence
  Description of Artificial Sequence: Synthetic oligonucleotide
  Target: ATXN1; (+) strand; PAM type: NRG; PAM sequence: GGG
tctgctgcacaaggccacca

SEQ ID NO: 108971 - DNA, 20 bp, Artificial Sequence
  Description of Artificial Sequence: Synthetic oligonucleotide
  Target: ATXN1; (+) strand; PAM type: NRG; PAM sequence: TGG
ctgcacaaggccaccagggc

SEQ ID NO: 108972 - DNA, 20 bp, Artificial Sequence
  Description of Artificial Sequence: Synthetic oligonucleotide
  Target: ATXN1; (+) strand; PAM type: NRG; PAM sequence: GGG
tgcacaaggccaccagggct

SEQ ID NO: 108973 - DNA, 20 bp, Artificial Sequence
  Description of Artificial Sequence: Synthetic oligonucleotide
  Target: ATXN1; (+) strand; PAM type: NRG; PAM sequence: CAG
tgggtctctgacactgataa

SEQ ID NO: 108974 - DNA, 20 bp, Artificial Sequence
  Description of Artificial Sequence: Synthetic oligonucleotide
  Target: ATXN1; (+) strand; PAM type: NRG; PAM sequence: AGG
gggtctctgacactgataac

SEQ ID NO: 108975 - DNA, 20 bp, Artificial Sequence
  Description of Artificial Sequence: Synthetic oligonucleotide
  Target: ATXN1; (+) strand; PAM type: NRG; PAM sequence: TGG
tgacactgataacaggtctc

SEQ ID NO: 108976 - DNA, 20 bp, Artificial Sequence
  Description of Artificial Sequence: Synthetic oligonucleotide
  Target: ATXN1; (+) strand; PAM type: NRG; PAM sequence: AAG
ctgataacaggtctctggtg

SEQ ID NO: 108977 - DNA, 20 bp, Artificial Sequence
  Description of Artificial Sequence: Synthetic oligonucleotide
  Target: ATXN1; (+) strand; PAM type: NRG; PAM sequence: AGG
tgataacaggtctctggtga

SEQ ID NO: 108978 - DNA, 20 bp, Artificial Sequence
  Description of Artificial Sequence: Synthetic oligonucleotide
  Target: ATXN1; (+) strand; PAM type: NRG; PAM sequence: AAG
ctggtgaaggaccttgtgta

SEQ ID NO: 108979 - DNA, 20 bp, Artificial Sequence
  Description of Artificial Sequence: Synthetic oligonucleotide
  Target: ATXN1; (+) strand; PAM type: NRG; PAM sequence: GAG
ggtgaaggaccttgtgtaaa

SEQ ID NO: 108980 - DNA, 20 bp, Artificial Sequence
  Description of Artificial Sequence: Synthetic oligonucleotide
  Target: ATXN1; (+) strand; PAM type: NRG; PAM sequence: TGG
accttgtgtaaagagtataa

SEQ ID NO: 108981 - DNA, 20 bp, Artificial Sequence
  Description of Artificial Sequence: Synthetic oligonucleotide
  Target: ATXN1; (+) strand; PAM type: NRG; PAM sequence: AAG
tataatggtaacaaaaataa

SEQ ID NO: 108982 - DNA, 20 bp, Artificial Sequence
  Description of Artificial Sequence: Synthetic oligonucleotide
  Target: ATXN1; (+) strand; PAM type: NRG; PAM sequence: AAG
taacaaaaataaaagaaatg

SEQ ID NO: 108983 - DNA, 20 bp, Artificial Sequence
  Description of Artificial Sequence: Synthetic oligonucleotide
  Target: ATXN1; (+) strand; PAM type: NRG; PAM sequence: TAG
agaaatgaagaaacgcatat

SEQ ID NO: 108984 - DNA, 20 bp, Artificial Sequence
  Description of Artificial Sequence: Synthetic oligonucleotide
  Target: ATXN1; (+) strand; PAM type: NRG; PAM sequence: AGG
gaaatgaagaaacgcatatt

SEQ ID NO: 108985 - DNA, 20 bp, Artificial Sequence
  Description of Artificial Sequence: Synthetic oligonucleotide
  Target: ATXN1; (+) strand; PAM type: NRG; PAM sequence: AAG
gaaacgcatattaggactaa

SEQ ID NO: 108986 - DNA, 20 bp, Artificial Sequence
  Description of Artificial Sequence: Synthetic oligonucleotide
  Target: ATXN1; (+) strand; PAM type: NRG; PAM sequence: TAG
ttaggactaaaagatgtaca

SEQ ID NO: 108987 - DNA, 20 bp, Artificial Sequence
  Description of Artificial Sequence: Synthetic oligonucleotide
  Target: ATXN1; (+) strand; PAM type: NRG; PAM sequence: GAG
aggactaaaagatgtacata

SEQ ID NO: 108988 - DNA, 20 bp, Artificial Sequence
  Description of Artificial Sequence: Synthetic oligonucleotide
  Target: ATXN1; (+) strand; PAM type: NRG; PAM sequence: GAG
gactaaaagatgtacataga

SEQ ID NO: 108989 - DNA, 20 bp, Artificial Sequence
  Description of Artificial Sequence: Synthetic oligonucleotide
  Target: ATXN1; (+) strand; PAM type: NRG; PAM sequence: GAG
agatgtacatagagagaaat

SEQ ID NO: 108990 - DNA, 20 bp, Artificial Sequence
  Description of Artificial Sequence: Synthetic oligonucleotide
  Target: ATXN1; (+) strand; PAM type: NRG; PAM sequence: TGG
gagaaatgagcgtaactcct

SEQ ID NO: 108991 - DNA, 20 bp, Artificial Sequence
  Description of Artificial Sequence: Synthetic oligonucleotide
  Target: ATXN1; (+) strand; PAM type: NRG; PAM sequence: GGG
agaaatgagcgtaactcctt

SEQ ID NO: 108992 - DNA, 20 bp, Artificial Sequence
  Description of Artificial Sequence: Synthetic oligonucleotide
  Target: ATXN1; (+) strand; PAM type: NRG; PAM sequence: TAG
agcgtaactccttgggctca

SEQ ID NO: 108993 - DNA, 20 bp, Artificial Sequence
  Description of Artificial Sequence: Synthetic oligonucleotide
  Target: ATXN1; (+) strand; PAM type: NRG; PAM sequence: AGG
gcgtaactccttgggctcat

SEQ ID NO: 108994 - DNA, 20 bp, Artificial Sequence
  Description of Artificial Sequence: Synthetic oligonucleotide
  Target: ATXN1; (+) strand; PAM type: NRG; PAM sequence: CAG
tgaatgcctctgaacatgaa

SEQ ID NO: 108995 - DNA, 20 bp, Artificial Sequence
  Description of Artificial Sequence: Synthetic oligonucleotide
  Target: ATXN1; (+) strand; PAM type: NRG; PAM sequence: AGG
gaatgcctctgaacatgaac

SEQ ID NO: 108996 - DNA, 20 bp, Artificial Sequence
  Description of Artificial Sequence: Synthetic oligonucleotide
  Target: ATXN1; (+) strand; PAM type: NRG; PAM sequence: AAG
aaatattttgattattttta

SEQ ID NO: 108997 - DNA, 20 bp, Artificial Sequence
  Description of Artificial Sequence: Synthetic oligonucleotide
  Target: ATXN1; (+) strand; PAM type: NRG; PAM sequence: AGG
aatattttgattatttttaa

SEQ ID NO: 108998 - DNA, 20 bp, Artificial Sequence
  Description of Artificial Sequence: Synthetic oligonucleotide
  Target: ATXN1; (+) strand; PAM type: NRG; PAM sequence: GAG
tattttgattatttttaaag

SEQ ID NO: 108999 - DNA, 20 bp, Artificial Sequence
  Description of Artificial Sequence: Synthetic oligonucleotide
  Target: ATXN1; (+) strand; PAM type: NRG; PAM sequence: CGG
ttgattatttttaaaggaga

SEQ ID NO: 109000 - DNA, 20 bp, Artificial Sequence
  Description of Artificial Sequence: Synthetic oligonucleotide
  Target: ATXN1; (+) strand; PAM type: NRG; PAM sequence: GGG
tgattatttttaaaggagac

SEQ ID NO: 109001 - DNA, 20 bp, Artificial Sequence
  Description of Artificial Sequence: Synthetic oligonucleotide
  Target: ATXN1; (+) strand; PAM type: NRG; PAM sequence: GGG
gattatttttaaaggagacg

SEQ ID NO: 109002 - DNA, 20 bp, Artificial Sequence
  Description of Artificial Sequence: Synthetic oligonucleotide
  Target: ATXN1; (+) strand; PAM type: NRG; PAM sequence: CAG
cggggtttcactatgttgcc

SEQ ID NO: 109003 - DNA, 20 bp, Artificial Sequence
  Description of Artificial Sequence: Synthetic oligonucleotide
  Target: ATXN1; (+) strand; PAM type: NRG; PAM sequence: AGG
ggggtttcactatgttgccc

SEQ ID NO: 109004 - DNA, 20 bp, Artificial Sequence
  Description of Artificial Sequence: Synthetic oligonucleotide
  Target: ATXN1; (+) strand; PAM type: NRG; PAM sequence: TGG
tttcactatgttgcccaggc

SEQ ID NO: 109005 - DNA, 20 bp, Artificial Sequence
  Description of Artificial Sequence: Synthetic oligonucleotide
  Target: ATXN1; (+) strand; PAM type: NRG; PAM sequence: TGG
ccaggctggtctcaaactcc

SEQ ID NO: 109006 - DNA, 20 bp, Artificial Sequence
  Description of Artificial Sequence: Synthetic oligonucleotide
  Target: ATXN1; (+) strand; PAM type: NRG; PAM sequence: GGG
caggctggtctcaaactcct

SEQ ID NO: 109007 - DNA, 20 bp, Artificial Sequence
  Description of Artificial Sequence: Synthetic oligonucleotide
  Target: ATXN1; (+) strand; PAM type: NRG; PAM sequence: AAG
ggtctcaaactcctgggctc

SEQ ID NO: 109008 - DNA, 20 bp, Artificial Sequence
  Description of Artificial Sequence: Synthetic oligonucleotide
  Target: ATXN1; (+) strand; PAM type: NRG; PAM sequence: CAG
ctcaagcaatctgcctgcct

SEQ ID NO: 109009 - DNA, 20 bp, Artificial Sequence
  Description of Artificial Sequence: Synthetic oligonucleotide
  Target: ATXN1; (+) strand; PAM type: NRG; PAM sequence: AAG
ctgcctgcctcagcctccca

SEQ ID NO: 109010 - DNA, 20 bp, Artificial Sequence
  Description of Artificial Sequence: Synthetic oligonucleotide
  Target: ATXN1; (+) strand; PAM type: NRG; PAM sequence: TAG
gcctcagcctcccaaagtgc

SEQ ID NO: 109011 - DNA, 20 bp, Artificial Sequence
  Description of Artificial Sequence: Synthetic oligonucleotide
  Target: ATXN1; (+) strand; PAM type: NRG; PAM sequence: AGG
cctcagcctcccaaagtgct

SEQ ID NO: 109012 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctaggatta

SEQ ID NO: 109013 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctaggattac

SEQ ID NO: 109014 - DNA, 20 bp, Artificial Sequence
  Description of Artificial Sequence: Synthetic oligonucleotide
  Target: ATXN1; (+) strand; PAM type: NRG; PAM sequence: CAG
caggcgtgaactaccgtgcc

SEQ ID NO: 109015 - DNA, 20 bp, Artificial Sequence
  Description of Artificial Sequence: Synthetic oligonucleotide
  Target: ATXN1; (+) strand; PAM type: NRG; PAM sequence: CAG
ccctatatcatttttactcc

SEQ ID NO: 109016 - DNA, 20 bp, Artificial Sequence
  Description of Artificial Sequence: Synthetic oligonucleotide
  Target: ATXN1; (+) strand; PAM type: NRG; PAM sequence: AGG
cctatatcatttttactccc

SEQ ID NO: 109017 - DNA, 20 bp, Artificial Sequence
  Description of Artificial Sequence: Synthetic oligonucleotide
  Target: ATXN1; (+) strand; PAM type: NRG; PAM sequence: GGG
ctatatcatttttactccca

SEQ ID NO: 109018 - DNA, 20 bp, Artificial Sequence
  Description of Artificial Sequence: Synthetic oligonucleotide
  Target: ATXN1; (+) strand; PAM type: NRG; PAM sequence: GAG
cccagggctactatttcttt

SEQ ID NO: 109019 - DNA, 20 bp, Artificial Sequence
  Description of Artificial Sequence: Synthetic oligonucleotide
  Target: ATXN1; (+) strand; PAM type: NRG; PAM sequence: AGG
ccagggctactatttctttg

SEQ ID NO: 109020 - DNA, 20 bp, Artificial Sequence
  Description of Artificial Sequence: Synthetic oligonucleotide
  Target: ATXN1; (+) strand; PAM type: NRG; PAM sequence: AAG
gctactatttctttgaggac

SEQ ID NO: 109021 - DNA, 20 bp, Artificial Sequence
  Description of Artificial Sequence: Synthetic oligonucleotide
  Target: ATXN1; (+) strand; PAM type: NRG; PAM sequence: AGG
ctactatttctttgaggaca

SEQ ID NO: 109022 - DNA, 20 bp, Artificial Sequence
  Description of Artificial Sequence: Synthetic oligonucleotide
  Target: ATXN1; (+) strand; PAM type: NRG; PAM sequence: TAG
tgaggacaaggactgtgtct

SEQ ID NO: 109023 - DNA, 20 bp, Artificial Sequence
  Description of Artificial Sequence: Synthetic oligonucleotide
  Target: ATXN1; (+) strand; PAM type: NRG; PAM sequence: TAG
ggactgtgtcttagtcattg

SEQ ID NO: 109024 - DNA, 20 bp, Artificial Sequence
  Description of Artificial Sequence: Synthetic oligonucleotide
  Target: ATXN1; (+) strand; PAM type: NRG; PAM sequence: TAG
ttgtagtatgatgcgtctaa

SEQ ID NO: 109025 - DNA, 20 bp, Artificial Sequence
  Description of Artificial Sequence: Synthetic oligonucleotide
  Target: ATXN1; (+) strand; PAM type: NRG; PAM sequence: TAG
gtctaatagtacctgacaca

SEQ ID NO: 109026 - DNA, 20 bp, Artificial Sequence
  Description of Artificial Sequence: Synthetic oligonucleotide
  Target: ATXN1; (+) strand; PAM type: NRG; PAM sequence: CAG
taatagtacctgacacatag

SEQ ID NO: 109027 - DNA, 20 bp, Artificial Sequence
  Description of Artificial Sequence: Synthetic oligonucleotide
  Target: ATXN1; (+) strand; PAM type: NRG; PAM sequence: TAG
cctgacacatagcagatgct

SEQ ID NO: 109028 - DNA, 20 bp, Artificial Sequence
  Description of Artificial Sequence: Synthetic oligonucleotide
  Target: ATXN1; (+) strand; PAM type: NRG; PAM sequence: TAG
agcagatgcttagtgcatgt

SEQ ID NO: 109029 - DNA, 20 bp, Artificial Sequence
  Description of Artificial Sequence: Synthetic oligonucleotide
  Target: ATXN1; (+) strand; PAM type: NRG; PAM sequence: TGG
gcttgttaaatacatgcatc

SEQ ID NO: 109030 - DNA, 20 bp, Artificial Sequence
  Description of Artificial Sequence: Synthetic oligonucleotide
  Target: ATXN1; (+) strand; PAM type: NRG; PAM sequence: AAG
taaatacatgcatctggcac

SEQ ID NO: 109031 - DNA, 20 bp, Artificial Sequence
  Description of Artificial Sequence: Synthetic oligonucleotide
  Target: ATXN1; (+) strand; PAM type: NRG; PAM sequence: AGG
aaatacatgcatctggcaca

SEQ ID NO: 109032 - DNA, 20 bp, Artificial Sequence
  Description of Artificial Sequence: Synthetic oligonucleotide
  Target: ATXN1; (+) strand; PAM type: NRG; PAM sequence: GGG
aatacatgcatctggcacaa

SEQ ID NO: 109033 - DNA, 20 bp, Artificial Sequence
  Description of Artificial Sequence: Synthetic oligonucleotide
  Target: ATXN1; (+) strand; PAM type: NRG; PAM sequence: AAG
tgcatctggcacaagggatc

SEQ ID NO: 109034 - DNA, 20 bp, Artificial Sequence
  Description of Artificial Sequence: Synthetic oligonucleotide
  Target: ATXN1; (+) strand; PAM type: NRG; PAM sequence: CAG
tcaagcaaatctctgaatga

SEQ ID NO: 109035 - DNA, 20 bp, Artificial Sequence
  Description of Artificial Sequence: Synthetic oligonucleotide
  Target: ATXN1; (+) strand; PAM type: NRG; PAM sequence: TAG
tctctgaatgacagattgac

SEQ ID NO: 109036 - DNA, 20 bp, Artificial Sequence
  Description of Artificial Sequence: Synthetic oligonucleotide
  Target: ATXN1; (+) strand; PAM type: NRG; PAM sequence: AGG
ctctgaatgacagattgact

SEQ ID NO: 109037 - DNA, 20 bp, Artificial Sequence
  Description of Artificial Sequence: Synthetic oligonucleotide
  Target: ATXN1; (+) strand; PAM type: NRG; PAM sequence: AAG
tgaatgacagattgactagg

SEQ ID NO: 109038 - DNA, 20 bp, Artificial Sequence
  Description of Artificial Sequence: Synthetic oligonucleotide
  Target: ATXN1; (+) strand; PAM type: NRG; PAM sequence: GAG
aatgacagattgactaggaa

SEQ ID NO: 109039 - DNA, 20 bp, Artificial Sequence
  Description of Artificial Sequence: Synthetic oligonucleotide
  Target: ATXN1; (+) strand; PAM type: NRG; PAM sequence: CGG
gacagattgactaggaagag

SEQ ID NO: 109040 - DNA, 20 bp, Artificial Sequence
  Description of Artificial Sequence: Synthetic oligonucleotide
  Target: ATXN1; (+) strand; PAM type: NRG; PAM sequence: GGG
acagattgactaggaagagc

SEQ ID NO: 109041 - DNA, 20 bp, Artificial Sequence
  Description of Artificial Sequence: Synthetic oligonucleotide
  Target: ATXN1; (+) strand; PAM type: NRG; PAM sequence: GAG
agattgactaggaagagcgg

SEQ ID NO: 109042 - DNA, 20 bp, Artificial Sequence
  Description of Artificial Sequence: Synthetic oligonucleotide
  Target: ATXN1; (+) strand; PAM type: NRG; PAM sequence: TGG
gcgggagatcaatgactcaa

SEQ ID NO: 109043 - DNA, 20 bp, Artificial Sequence
  Description of Artificial Sequence: Synthetic oligonucleotide
  Target: ATXN1; (+) strand; PAM type: NRG; PAM sequence: TGG
ggagatcaatgactcaatgg

SEQ ID NO: 109044 - DNA, 20 bp, Artificial Sequence
  Description of Artificial Sequence: Synthetic oligonucleotide
  Target: ATXN1; (+) strand; PAM type: NRG; PAM sequence: CGG
caatgactcaatggtggtca

SEQ ID NO: 109045 - DNA, 20 bp, Artificial Sequence
  Description of Artificial Sequence: Synthetic oligonucleotide
  Target: ATXN1; (+) strand; PAM type: NRG; PAM sequence: CAG
actcaatggtggtcacggat

SEQ ID NO: 109046 - DNA, 20 bp, Artificial Sequence
  Description of Artificial Sequence: Synthetic oligonucleotide
  Target: ATXN1; (+) strand; PAM type: NRG; PAM sequence: GAG
cagcactctcaactaaccat

SEQ ID NO: 109047 - DNA, 20 bp, Artificial Sequence
  Description of Artificial Sequence: Synthetic oligonucleotide
  Target: ATXN1; (+) strand; PAM type: NRG; PAM sequence: CGG
ctcaactaaccatgagaacc

SEQ ID NO: 109048 - DNA, 20 bp, Artificial Sequence
  Description of Artificial Sequence: Synthetic oligonucleotide
  Target: ATXN1; (+) strand; PAM type: NRG; PAM sequence: AAG
taaccatgagaacccggatg

SEQ ID NO: 109049 - DNA, 20 bp, Artificial Sequence
  Description of Artificial Sequence: Synthetic oligonucleotide
  Target: ATXN1; (+) strand; PAM type: NRG; PAM sequence: TAG
ccatgagaacccggatgaag

SEQ ID NO: 109050 - DNA, 20 bp, Artificial Sequence
  Description of Artificial Sequence: Synthetic oligonucleotide
  Target: ATXN1; (+) strand; PAM type: NRG; PAM sequence: AAG
tgagaacccggatgaagtag

SEQ ID NO: 109051 - DNA, 20 bp, Artificial Sequence
  Description of Artificial Sequence: Synthetic oligonucleotide
  Target: ATXN1; (+) strand; PAM type: NRG; PAM sequence: TAG
aacccggatgaagtagaagc

SEQ ID NO: 109052 - DNA, 20 bp, Artificial Sequence
  Description of Artificial Sequence: Synthetic oligonucleotide
  Target: ATXN1; (+) strand; PAM type: NRG; PAM sequence: AGG
acccggatgaagtagaagct

SEQ ID NO: 109053 - DNA, 20 bp, Artificial Sequence
  Description of Artificial Sequence: Synthetic oligonucleotide
  Target: ATXN1; (+) strand; PAM type: NRG; PAM sequence: AAG
gatgaagtagaagctaggtt

SEQ ID NO: 109054 - DNA, 20 bp, Artificial Sequence
  Description of Artificial Sequence: Synthetic oligonucleotide
  Target: ATXN1; (+) strand; PAM type: NRG; PAM sequence: TAG
taaattgccattgctcccta

SEQ ID NO: 109055 - DNA, 20 bp, Artificial Sequence
  Description of Artificial Sequence: Synthetic oligonucleotide
  Target: ATXN1; (+) strand; PAM type: NRG; PAM sequence: AGG
aaattgccattgctccctat

SEQ ID NO: 109056 - DNA, 20 bp, Artificial Sequence
  Description of Artificial Sequence: Synthetic oligonucleotide
  Target: ATXN1; (+) strand; PAM type: NRG; PAM sequence: GGG
aattgccattgctccctata

SEQ ID NO: 109057 - DNA, 20 bp, Artificial Sequence
  Description of Artificial Sequence: Synthetic oligonucleotide
  Target: ATXN1; (+) strand; PAM type: NRG; PAM sequence: CAG
attgctccctatagggtcat

SEQ ID NO: 109058 - DNA, 20 bp, Artificial Sequence
  Description of Artificial Sequence: Synthetic oligonucleotide
  Target: ATXN1; (+) strand; PAM type: NRG; PAM sequence: AAG
ctccctatagggtcatcaga

SEQ ID NO: 109059 - DNA, 20 bp, Artificial Sequence
  Description of Artificial Sequence: Synthetic oligonucleotide
  Target: ATXN1; (+) strand; PAM type: NRG; PAM sequence: TGG
tatagggtcatcagaaagcc

SEQ ID NO: 109060 - DNA, 20 bp, Artificial Sequence
  Description of Artificial Sequence: Synthetic oligonucleotide
  Target: ATXN1; (+) strand; PAM type: NRG; PAM sequence: TGG
gtcatcagaaagcctggata

SEQ ID NO: 109061 - DNA, 20 bp, Artificial Sequence
  Description of Artificial Sequence: Synthetic oligonucleotide
  Target: ATXN1; (+) strand; PAM type: NRG; PAM sequence: TGG
aagcctggatatggcccctg

SEQ ID NO: 109062 - DNA, 20 bp, Artificial Sequence
  Description of Artificial Sequence: Synthetic oligonucleotide
  Target: ATXN1; (+) strand; PAM type: NRG; PAM sequence: GAG
gcctggatatggcccctgtg

SEQ ID NO: 109063 - DNA, 20 bp, Artificial Sequence
  Description of Artificial Sequence: Synthetic oligonucleotide
  Target: ATXN1; (+) strand; PAM type: NRG; PAM sequence: AGG
cctggatatggcccctgtgg

SEQ ID NO: 109064 - DNA, 20 bp, Artificial Sequence
  Description of Artificial Sequence: Synthetic oligonucleotide
  Target: ATXN1; (+) strand; PAM type: NRG; PAM sequence: GAG
accacatatctctgaatgct

SEQ ID NO: 109065 - DNA, 20 bp, Artificial Sequence
  Description of Artificial Sequence: Synthetic oligonucleotide
  Target: ATXN1; (+) strand; PAM type: NRG; PAM sequence: CAG
tctctgaatgctgagtaaaa

SEQ ID NO: 109066 - DNA, 20 bp, Artificial Sequence
  Description of Artificial Sequence: Synthetic oligonucleotide
  Target: ATXN1; (+) strand; PAM type: NRG; PAM sequence: TAG
gctgagtaaaacagataatg

SEQ ID NO: 109067 - DNA, 20 bp, Artificial Sequence
  Description of Artificial Sequence: Synthetic oligonucleotide
  Target: ATXN1; (+) strand; PAM type: NRG; PAM sequence: GAG
tgagtaaaacagataatgta

SEQ ID NO: 109068 - DNA, 20 bp, Artificial Sequence
  Description of Artificial Sequence: Synthetic oligonucleotide
  Target: ATXN1; (+) strand; PAM type: NRG; PAM sequence: GAG
agtaaaacagataatgtaga

SEQ ID NO: 109069 - DNA, 20 bp, Artificial Sequence
  Description of Artificial Sequence: Synthetic oligonucleotide
  Target: ATXN1; (+) strand; PAM type: NRG; PAM sequence: AAG
gacatgaacttcttcactga

SEQ ID NO: 109070 - DNA, 20 bp, Artificial Sequence
  Description of Artificial Sequence: Synthetic oligonucleotide
  Target: ATXN1; (+) strand; PAM type: NRG; PAM sequence: TGG
tcttcactgaaagttcactg

SEQ ID NO: 109071 - DNA, 20 bp, Artificial Sequence
  Description of Artificial Sequence: Synthetic oligonucleotide
  Target: ATXN1; (+) strand; PAM type: NRG; PAM sequence: AAG
tcactgaaagttcactgtgg

SEQ ID NO: 109072 - DNA, 20 bp, Artificial Sequence
  Description of Artificial Sequence: Synthetic oligonucleotide
  Target: ATXN1; (+) strand; PAM type: NRG; PAM sequence: CAG
actgtggaagacctctccat

SEQ ID NO: 109073 - DNA, 20 bp, Artificial Sequence
  Description of Artificial Sequence: Synthetic oligonucleotide
  Target: ATXN1; (+) strand; PAM type: NRG; PAM sequence: GAG
agacctctccatcagccact

SEQ ID NO: 109074 - DNA, 20 bp, Artificial Sequence
  Description of Artificial Sequence: Synthetic oligonucleotide
  Target: ATXN1; (+) strand; PAM type: NRG; PAM sequence: GAG
acctctccatcagccactga

SEQ ID NO: 109075 - DNA, 20 bp, Artificial Sequence
  Description of Artificial Sequence: Synthetic oligonucleotide
  Target: ATXN1; (+) strand; PAM type: NRG; PAM sequence: AGG
cctctccatcagccactgag

SEQ ID NO: 109076 - DNA, 20 bp, Artificial Sequence
  Description of Artificial Sequence: Synthetic oligonucleotide
  Target: ATXN1; (+) strand; PAM type: NRG; PAM sequence: GGG
ctctccatcagccactgaga

SEQ ID NO: 109077 - DNA, 20 bp, Artificial Sequence
  Description of Artificial Sequence: Synthetic oligonucleotide
  Target: ATXN1; (+) strand; PAM type: NRG; PAM sequence: GAG
ctccatcagccactgagagg

SEQ ID NO: 109078 - DNA, 20 bp, Artificial Sequence
  Description of Artificial Sequence: Synthetic oligonucleotide
  Target: ATXN1; (+) strand; PAM type: NRG; PAM sequence: AGG
tccatcagccactgagaggg

SEQ ID NO: 109079 - DNA, 20 bp, Artificial Sequence
  Description of Artificial Sequence: Synthetic oligonucleotide
  Target: ATXN1; (+) strand; PAM type: NRG; PAM sequence: TGG
atcagccactgagagggagg

SEQ ID NO: 109080 - DNA, 20 bp, Artificial Sequence
  Description of Artificial Sequence: Synthetic oligonucleotide
  Target: ATXN1; (+) strand; PAM type: NRG; PAM sequence: TGG
ggaggtggtgccctgctact

SEQ ID NO: 109081 - DNA, 20 bp, Artificial Sequence
  Description of Artificial Sequence: Synthetic oligonucleotide
  Target: ATXN1; (+) strand; PAM type: NRG; PAM sequence: GGG
gaggtggtgccctgctactt

SEQ ID NO: 109082 - DNA, 20 bp, Artificial Sequence
  Description of Artificial Sequence: Synthetic oligonucleotide
  Target: ATXN1; (+) strand; PAM type: NRG; PAM sequence: CAG
ggtgccctgctacttgggta

SEQ ID NO: 109083 - DNA, 20 bp, Artificial Sequence
  Description of Artificial Sequence: Synthetic oligonucleotide
  Target: ATXN1; (+) strand; PAM type: NRG; PAM sequence: AAG
gccctgctacttgggtacag

SEQ ID NO: 109084 - DNA, 20 bp, Artificial Sequence
  Description of Artificial Sequence: Synthetic oligonucleotide
  Target: ATXN1; (+) strand; PAM type: NRG; PAM sequence: CAG
ttgggtacagaagtcaaact

SEQ ID NO: 109085 - DNA, 20 bp, Artificial Sequence
  Description of Artificial Sequence: Synthetic oligonucleotide
  Target: ATXN1; (+) strand; PAM type: NRG; PAM sequence: AAG
cttgctcgtgattctcaaac

SEQ ID NO: 109086 - DNA, 20 bp, Artificial Sequence
  Description of Artificial Sequence: Synthetic oligonucleotide
  Target: ATXN1; (+) strand; PAM type: NRG; PAM sequence: AGG
ttgctcgtgattctcaaaca

SEQ ID NO: 109087 - DNA, 20 bp, Artificial Sequence
  Description of Artificial Sequence: Synthetic oligonucleotide
  Target: ATXN1; (+) strand; PAM type: NRG; PAM sequence: CAG
ctcgtgattctcaaacaagg

SEQ ID NO: 109088 - DNA, 20 bp, Artificial Sequence
  Description of Artificial Sequence: Synthetic oligonucleotide
  Target: ATXN1; (+) strand; PAM type: NRG; PAM sequence: AGG
tcgtgattctcaaacaaggc

SEQ ID NO: 109089 - DNA, 20 bp, Artificial Sequence
  Description of Artificial Sequence: Synthetic oligonucleotide
  Target: ATXN1; (+) strand; PAM type: NRG; PAM sequence: GGG
cgtgattctcaaacaaggca

SEQ ID NO: 109090 - DNA, 20 bp, Artificial Sequence
  Description of Artificial Sequence: Synthetic oligonucleotide
  Target: ATXN1; (+) strand; PAM type: NRG; PAM sequence: GGG
gtgattctcaaacaaggcag

SEQ ID NO: 109091 - DNA, 20 bp, Artificial Sequence
  Description of Artificial Sequence: Synthetic oligonucleotide
  Target: ATXN1; (+) strand; PAM type: NRG; PAM sequence: CAG
caaggcaggggttaccctcc

SEQ ID NO: 109092 - DNA, 20 bp, Artificial Sequence
  Description of Artificial Sequence: Synthetic oligonucleotide
  Target: ATXN1; (+) strand; PAM type: NRG; PAM sequence: AGG
aaggcaggggttaccctccc

SEQ ID NO: 109093 - DNA, 20 bp, Artificial Sequence
  Description of Artificial Sequence: Synthetic oligonucleotide
  Target: ATXN1; (+) strand; PAM type: NRG; PAM sequence: GGG
aggcaggggttaccctccca

SEQ ID NO: 109094 - DNA, 20 bp, Artificial Sequence
  Description of Artificial Sequence: Synthetic oligonucleotide
  Target: ATXN1; (+) strand; PAM type: NRG; PAM sequence: AAG
ccctcccagggacatctgaa

SEQ ID NO: 109095 - DNA, 20 bp, Artificial Sequence
  Description of Artificial Sequence: Synthetic oligonucleotide
  Target: ATXN1; (+) strand; PAM type: NRG; PAM sequence: AGG
cctcccagggacatctgaaa

SEQ ID NO: 109096 - DNA, 20 bp, Artificial Sequence
  Description of Artificial Sequence: Synthetic oligonucleotide
  Target: ATXN1; (+) strand; PAM type: NRG; PAM sequence: GAG
tcccagggacatctgaaaag

SEQ ID NO: 109097 - DNA, 20 bp, Artificial Sequence
  Description of Artificial Sequence: Synthetic oligonucleotide
  Target: ATXN1; (+) strand; PAM type: NRG; PAM sequence: TGG
cagggacatctgaaaaggag

SEQ ID NO: 109098 - DNA, 20 bp, Artificial Sequence
  Description of Artificial Sequence: Synthetic oligonucleotide
  Target: ATXN1; (+) strand; PAM type: NRG; PAM sequence: GGG
agggacatctgaaaaggagt

SEQ ID NO: 109099 - DNA, 20 bp, Artificial Sequence
  Description of Artificial Sequence: Synthetic oligonucleotide
  Target: ATXN1; (+) strand; PAM type: NRG; PAM sequence: GGG
gggacatctgaaaaggagtg

SEQ ID NO: 109100 - DNA, 20 bp, Artificial Sequence
  Description of Artificial Sequence: Synthetic oligonucleotide
  Target: ATXN1; (+) strand; PAM type: NRG; PAM sequence: TGG
tctgaatccttaaaacaact

SEQ ID NO: 109101 - DNA, 20 bp, Artificial Sequence
  Description of Artificial Sequence: Synthetic oligonucleotide
  Target: ATXN1; (+) strand; PAM type: NRG; PAM sequence: TGG
aaacaacttggaaacattgt

SEQ ID NO: 109102 - DNA, 20 bp, Artificial Sequence
  Description of Artificial Sequence: Synthetic oligonucleotide
  Target: ATXN1; (+) strand; PAM type: NRG; PAM sequence: GGG
aacaacttggaaacattgtt

SEQ ID NO: 109103 - DNA, 20 bp, Artificial Sequence
  Description of Artificial Sequence: Synthetic oligonucleotide
  Target: ATXN1; (+) strand; PAM type: NRG; PAM sequence: GAG
cttggaaacattgttgggat

SEQ ID NO: 109104 - DNA, 20 bp, Artificial Sequence
  Description of Artificial Sequence: Synthetic oligonucleotide
  Target: ATXN1; (+) strand; PAM type: NRG; PAM sequence: TAG
ggaaacattgttgggatgag

SEQ ID NO: 109105 - DNA, 20 bp, Artificial Sequence
  Description of Artificial Sequence: Synthetic oligonucleotide
  Target: ATXN1; (+) strand; PAM type: NRG; PAM sequence: AGG
gaaacattgttgggatgagt

SEQ ID NO: 109106 - DNA, 20 bp, Artificial Sequence
  Description of Artificial Sequence: Synthetic oligonucleotide
  Target: ATXN1; (+) strand; PAM type: NRG; PAM sequence: TAG
acattgttgggatgagtagg

SEQ ID NO: 109107 - DNA, 20 bp, Artificial Sequence
  Description of Artificial Sequence: Synthetic oligonucleotide
  Target: ATXN1; (+) strand; PAM type: NRG; PAM sequence: AGG
cattgttgggatgagtaggt

SEQ ID NO: 109108 - DNA, 20 bp, Artificial Sequence
  Description of Artificial Sequence: Synthetic oligonucleotide
  Target: ATXN1; (+) strand; PAM type: NRG; PAM sequence: GGG
attgttgggatgagtaggta

SEQ ID NO: 109109 - DNA, 20 bp, Artificial Sequence
  Description of Artificial Sequence: Synthetic oligonucleotide
  Target: ATXN1; (+) strand; PAM type: NRG; PAM sequence: CGG
atgagtaggtagggatgaac

SEQ ID NO: 109110 - DNA, 20 bp, Artificial Sequence
  Description of Artificial Sequence: Synthetic oligonucleotide
  Target: ATXN1; (+) strand; PAM type: NRG; PAM sequence: GGG
tgagtaggtagggatgaacc

SEQ ID NO: 109111 - DNA, 20 bp, Artificial Sequence
  Description of Artificial Sequence: Synthetic oligonucleotide
  Target: ATXN1; (+) strand; PAM type: NRG; PAM sequence: GAG
agtaggtagggatgaaccgg

SEQ ID NO: 109112 - DNA, 20 bp, Artificial Sequence
  Description of Artificial Sequence: Synthetic oligonucleotide
  Target: ATXN1; (+) strand; PAM type: NRG; PAM sequence: GAG
agtgcttgttgtgttgtcat

SEQ ID NO: 109113 - DNA, 20 bp, Artificial Sequence
  Description of Artificial Sequence: Synthetic oligonucleotide
  Target: ATXN1; (+) strand; PAM type: NRG; PAM sequence: CGG
gcttgttgtgttgtcatgag

SEQ ID NO: 109114 - DNA, 20 bp, Artificial Sequence
  Description of Artificial Sequence: Synthetic oligonucleotide
  Target: ATXN1; (+) strand; PAM type: NRG; PAM sequence: GGG
cttgttgtgttgtcatgagc

SEQ ID NO: 109115 - DNA, 20 bp, Artificial Sequence
  Description of Artificial Sequence: Synthetic oligonucleotide
  Target: ATXN1; (+) strand; PAM type: NRG; PAM sequence: GAG
tgttgtgttgtcatgagcgg

SEQ ID NO: 109116 - DNA, 20 bp, Artificial Sequence
  Description of Artificial Sequence: Synthetic oligonucleotide
  Target: ATXN1; (+) strand; PAM type: NRG; PAM sequence: GAG
ttgtgttgtcatgagcggga

SEQ ID NO: 109117 - DNA, 20 bp, Artificial Sequence
  Description of Artificial Sequence: Synthetic oligonucleotide
  Target: ATXN1; (+) strand; PAM type: NRG; PAM sequence: TAG
atgagcgggagagctctgca

SEQ ID NO: 109118 - DNA, 20 bp, Artificial Sequence
  Description of Artificial Sequence: Synthetic oligonucleotide
  Target: ATXN1; (+) strand; PAM type: NRG; PAM sequence: CAG
agcgggagagctctgcatag

SEQ ID NO: 109119 - DNA, 20 bp, Artificial Sequence
  Description of Artificial Sequence: Synthetic oligonucleotide
  Target: ATXN1; (+) strand; PAM type: NRG; PAM sequence: GAG
cgggagagctctgcatagca

SEQ ID NO: 109120 - DNA, 20 bp, Artificial Sequence
  Description of Artificial Sequence: Synthetic oligonucleotide
  Target: ATXN1; (+) strand; PAM type: NRG; PAM sequence: AGG
gggagagctctgcatagcag

SEQ ID NO: 109121 - DNA, 20 bp, Artificial Sequence
  Description of Artificial Sequence: Synthetic oligonucleotide
  Target: ATXN1; (+) strand; PAM type: NRG; PAM sequence: GGG
ggagagctctgcatagcaga

SEQ ID NO: 109122 - DNA, 20 bp, Artificial Sequence
  Description of Artificial Sequence: Synthetic oligonucleotide
  Target: ATXN1; (+) strand; PAM type: NRG; PAM sequence: TAG
aactttaacgaaacactctc

SEQ ID NO: 109123 - DNA, 20 bp, Artificial Sequence
  Description of Artificial Sequence: Synthetic oligonucleotide
  Target: ATXN1; (+) strand; PAM type: NRG; PAM sequence: CAG
taacgaaacactctctagaa

SEQ ID NO: 109124 - DNA, 20 bp, Artificial Sequence
  Description of Artificial Sequence: Synthetic oligonucleotide
  Target: ATXN1; (+) strand; PAM type: NRG; PAM sequence: TAG
gaaacactctctagaacaga

SEQ ID NO: 109125 - DNA, 20 bp, Artificial Sequence
  Description of Artificial Sequence: Synthetic oligonucleotide
  Target: ATXN1; (+) strand; PAM type: NRG; PAM sequence: TAG
tagaacagatagcattgtct

SEQ ID NO: 109126 - DNA, 20 bp, Artificial Sequence
  Description of Artificial Sequence: Synthetic oligonucleotide
  Target: ATXN1; (+) strand; PAM type: NRG; PAM sequence: AGG
agaacagatagcattgtctt

SEQ ID NO: 109127 - DNA, 20 bp, Artificial Sequence
  Description of Artificial Sequence: Synthetic oligonucleotide
  Target: ATXN1; (+) strand; PAM type: NRG; PAM sequence: GGG
gaacagatagcattgtctta

SEQ ID NO: 109128 - DNA, 20 bp, Artificial Sequence
  Description of Artificial Sequence: Synthetic oligonucleotide
  Target: ATXN1; (+) strand; PAM type: NRG; PAM sequence: CAG
ttccacataaaatatcgaat

SEQ ID NO: 109129 - DNA, 20 bp, Artificial Sequence
  Description of Artificial Sequence: Synthetic oligonucleotide
  Target: ATXN1; (+) strand; PAM type: NRG; PAM sequence: AGG
tccacataaaatatcgaatc

SEQ ID NO: 109130 - DNA, 20 bp, Artificial Sequence
  Description of Artificial Sequence: Synthetic oligonucleotide
  Target: ATXN1; (+) strand; PAM type: NRG; PAM sequence: CAG
aaaatatcgaatcaggctat

SEQ ID NO: 109131 - DNA, 20 bp, Artificial Sequence
  Description of Artificial Sequence: Synthetic oligonucleotide
  Target: ATXN1; (+) strand; PAM type: NRG; PAM sequence: GAG
ctgtcaaaaatataatacct

SEQ ID NO: 109132 - DNA, 20 bp, Artificial Sequence
  Description of Artificial Sequence: Synthetic oligonucleotide
  Target: ATXN1; (+) strand; PAM type: NRG; PAM sequence: AGG
tgtcaaaaatataatacctg

SEQ ID NO: 109133 - DNA, 20 bp, Artificial Sequence
  Description of Artificial Sequence: Synthetic oligonucleotide
  Target: ATXN1; (+) strand; PAM type: NRG; PAM sequence: TAG
gatatctgcaataattttaa

SEQ ID NO: 109134 - DNA, 20 bp, Artificial Sequence
  Description of Artificial Sequence: Synthetic oligonucleotide
  Target: ATXN1; (+) strand; PAM type: NRG; PAM sequence: CAG
accaaacatccactacatgc

SEQ ID NO: 109135 - DNA, 20 bp, Artificial Sequence
  Description of Artificial Sequence: Synthetic oligonucleotide
  Target: ATXN1; (+) strand; PAM type: NRG; PAM sequence: AGG
ccaaacatccactacatgcc

SEQ ID NO: 109136 - DNA, 20 bp, Artificial Sequence
  Description of Artificial Sequence: Synthetic oligonucleotide
  Target: ATXN1; (+) strand; PAM type: NRG; PAM sequence: TAG
aacatccactacatgccagg

SEQ ID NO: 109137 - DNA, 20 bp, Artificial Sequence
  Description of Artificial Sequence: Synthetic oligonucleotide
  Target: ATXN1; (+) strand; PAM type: NRG; PAM sequence: TAG
aacaacaacaacaatgaatt

SEQ ID NO: 109138 - DNA, 20 bp, Artificial Sequence
  Description of Artificial Sequence: Synthetic oligonucleotide
  Target: ATXN1; (+) strand; PAM type: NRG; PAM sequence: TGG
aacaacaacaatgaatttag

SEQ ID NO: 109139 - DNA, 20 bp, Artificial Sequence
  Description of Artificial Sequence: Synthetic oligonucleotide
  Target: ATXN1; (+) strand; PAM type: NRG; PAM sequence: CAG
aactcccaattgcataaatt

SEQ ID NO: 109140 - DNA, 20 bp, Artificial Sequence
  Description of Artificial Sequence: Synthetic oligonucleotide
  Target: ATXN1; (+) strand; PAM type: NRG; PAM sequence: CAG
cccaattgcataaattcagc

SEQ ID NO: 109141 - DNA, 20 bp, Artificial Sequence
  Description of Artificial Sequence: Synthetic oligonucleotide
  Target: ATXN1; (+) strand; PAM type: NRG; PAM sequence: GAG
caattgcataaattcagcca

SEQ ID NO: 109142 - DNA, 20 bp, Artificial Sequence
  Description of Artificial Sequence: Synthetic oligonucleotide
  Target: ATXN1; (+) strand; PAM type: NRG; PAM sequence: GAG
attgcataaattcagccaga

SEQ ID NO: 109143 - DNA, 20 bp, Artificial Sequence
  Description of Artificial Sequence: Synthetic oligonucleotide
  Target: ATXN1; (+) strand; PAM type: NRG; PAM sequence: AGG
ttgcataaattcagccagag

SEQ ID NO: 109144 - DNA, 20 bp, Artificial Sequence
  Description of Artificial Sequence: Synthetic oligonucleotide
  Target: ATXN1; (+) strand; PAM type: NRG; PAM sequence: AAG
aattcagccagagaggaaaa

SEQ ID NO: 109145 - DNA, 20 bp, Artificial Sequence
  Description of Artificial Sequence: Synthetic oligonucleotide
  Target: ATXN1; (+) strand; PAM type: NRG; PAM sequence: AAG
aggaaaaaagcaactaatct

SEQ ID NO: 109146 - DNA, 20 bp, Artificial Sequence
  Description of Artificial Sequence: Synthetic oligonucleotide
  Target: ATXN1; (+) strand; PAM type: NRG; PAM sequence: CAG
aactaatctaagcaacttac

SEQ ID NO: 109147 - DNA, 20 bp, Artificial Sequence
  Description of Artificial Sequence: Synthetic oligonucleotide
  Target: ATXN1; (+) strand; PAM type: NRG; PAM sequence: CAG
aatctaagcaacttaccagt

SEQ ID NO: 109148 - DNA, 20 bp, Artificial Sequence
  Description of Artificial Sequence: Synthetic oligonucleotide
  Target: ATXN1; (+) strand; PAM type: NRG; PAM sequence: TGG
ctaagcaacttaccagtcag

SEQ ID NO: 109149 - DNA, 20 bp, Artificial Sequence
  Description of Artificial Sequence: Synthetic oligonucleotide
  Target: ATXN1; (+) strand; PAM type: NRG; PAM sequence: GAG
aagcaacttaccagtcagtg

SEQ ID NO: 109150 - DNA, 20 bp, Artificial Sequence
  Description of Artificial Sequence: Synthetic oligonucleotide
  Target: ATXN1; (+) strand; PAM type: NRG; PAM sequence: AGG
agcaacttaccagtcagtgg

SEQ ID NO: 109151 - DNA, 20 bp, Artificial Sequence
  Description of Artificial Sequence: Synthetic oligonucleotide
  Target: ATXN1; (+) strand; PAM type: NRG; PAM sequence: GAG
caacttaccagtcagtggag

SEQ ID NO: 109152 - DNA, 20 bp, Artificial Sequence
  Description of Artificial Sequence: Synthetic oligonucleotide
  Target: ATXN1; (+) strand; PAM type: NRG; PAM sequence: AAG
taccagtcagtggaggagcc

SEQ ID NO: 109153 - DNA, 20 bp, Artificial Sequence
  Description of Artificial Sequence: Synthetic oligonucleotide
  Target: ATXN1; (+) strand; PAM type: NRG; PAM sequence: CAG
gaggagccaagatgtgaatc

SEQ ID NO: 109154 - DNA, 20 bp, Artificial Sequence
  Description of Artificial Sequence: Synthetic oligonucleotide
  Target: ATXN1; (+) strand; PAM type: NRG; PAM sequence: AGG
aggagccaagatgtgaatcc

SEQ ID NO: 109155 - DNA, 20 bp, Artificial Sequence
  Description of Artificial Sequence: Synthetic oligonucleotide
  Target: ATXN1; (+) strand; PAM type: NRG; PAM sequence: AAG
atccaggttcctccgacccc

SEQ ID NO: 109156 - DNA, 20 bp, Artificial Sequence
  Description of Artificial Sequence: Synthetic oligonucleotide
  Target: ATXN1; (+) strand; PAM type: NRG; PAM sequence: TAG
ttcctccgaccccaagtcca

SEQ ID NO: 109157 - DNA, 20 bp, Artificial Sequence
  Description of Artificial Sequence: Synthetic oligonucleotide
  Target: ATXN1; (+) strand; PAM type: NRG; PAM sequence: TGG
tgatcattaaacgacaatct

SEQ ID NO: 109158 - DNA, 20 bp, Artificial Sequence
  Description of Artificial Sequence: Synthetic oligonucleotide
  Target: ATXN1; (+) strand; PAM type: NRG; PAM sequence: TGG
gacaatcttggttttcatga

SEQ ID NO: 109159 - DNA, 20 bp, Artificial Sequence
  Description of Artificial Sequence: Synthetic oligonucleotide
  Target: ATXN1; (+) strand; PAM type: NRG; PAM sequence: AAG
tcatgatggccaataaccca

SEQ ID NO: 109160 - DNA, 20 bp, Artificial Sequence
  Description of Artificial Sequence: Synthetic oligonucleotide
  Target: ATXN1; (+) strand; PAM type: NRG; PAM sequence: CAG
aacccaaagcctactatgca

SEQ ID NO: 109161 - DNA, 20 bp, Artificial Sequence
  Description of Artificial Sequence: Synthetic oligonucleotide
  Target: ATXN1; (+) strand; PAM type: NRG; PAM sequence: AGG
acccaaagcctactatgcac

SEQ ID NO: 109162 - DNA, 20 bp, Artificial Sequence
  Description of Artificial Sequence: Synthetic oligonucleotide
  Target: ATXN1; (+) strand; PAM type: NRG; PAM sequence: GGG
cccaaagcctactatgcaca

SEQ ID NO: 109163 - DNA, 20 bp, Artificial Sequence
  Description of Artificial Sequence: Synthetic oligonucleotide
  Target: ATXN1; (+) strand; PAM type: NRG; PAM sequence: GGG
ccaaagcctactatgcacag

SEQ ID NO: 109164 - DNA, 20 bp, Artificial Sequence
  Description of Artificial Sequence: Synthetic oligonucleotide
  Target: ATXN1; (+) strand; PAM type: NRG; PAM sequence: GAG
aaagcctactatgcacaggg

SEQ ID NO: 109165 - DNA, 20 bp, Artificial Sequence
  Description of Artificial Sequence: Synthetic oligonucleotide
  Target: ATXN1; (+) strand; PAM type: NRG; PAM sequence: AAG
actatgcacaggggagtgtg

SEQ ID NO: 109166 - DNA, 20 bp, Artificial Sequence
  Description of Artificial Sequence: Synthetic oligonucleotide
  Target: ATXN1; (+) strand; PAM type: NRG; PAM sequence: GAG
caggggagtgtgaagatccc

SEQ ID NO: 109167 - DNA, 20 bp, Artificial Sequence
  Description of Artificial Sequence: Synthetic oligonucleotide
  Target: ATXN1; (+) strand; PAM type: NRG; PAM sequence: AAG
gggagtgtgaagatcccgag

SEQ ID NO: 109168 - DNA, 20 bp, Artificial Sequence
  Description of Artificial Sequence: Synthetic oligonucleotide
  Target: ATXN1; (+) strand; PAM type: NRG; PAM sequence: CGG
gtgtgaagatcccgagaagc

SEQ ID NO: 109169 - DNA, 20 bp, Artificial Sequence
  Description of Artificial Sequence: Synthetic oligonucleotide
  Target: ATXN1; (+) strand; PAM type: NRG; PAM sequence: GGG
tgtgaagatcccgagaagcc

SEQ ID NO: 109170 - DNA, 20 bp, Artificial Sequence
  Description of Artificial Sequence: Synthetic oligonucleotide
  Target: ATXN1; (+) strand; PAM type: NRG; PAM sequence: GGG
gtgaagatcccgagaagccg

SEQ ID NO: 109171 - DNA, 20 bp, Artificial Sequence
  Description of Artificial Sequence: Synthetic oligonucleotide
  Target: ATXN1; (+) strand; PAM type: NRG; PAM sequence: CAG
aagatcccgagaagccgggg

SEQ ID NO: 109172 - DNA, 20 bp, Artificial Sequence
  Description of Artificial Sequence: Synthetic oligonucleotide
  Target: ATXN1; (+) strand; PAM type: NRG; PAM sequence: GAG
gatcccgagaagccggggca

SEQ ID NO: 109173 - DNA, 20 bp, Artificial Sequence
  Description of Artificial Sequence: Synthetic oligonucleotide
  Target: ATXN1; (+) strand; PAM type: NRG; PAM sequence: CAG
ggcagagccttgaccactga

SEQ ID NO: 109174 - DNA, 20 bp, Artificial Sequence
  Description of Artificial Sequence: Synthetic oligonucleotide
  Target: ATXN1; (+) strand; PAM type: NRG; PAM sequence: AAG
cactgacagtctcttaacca

SEQ ID NO: 109175 - DNA, 20 bp, Artificial Sequence
  Description of Artificial Sequence: Synthetic oligonucleotide
  Target: ATXN1; (+) strand; PAM type: NRG; PAM sequence: CAG
tctcttaaccaaagaatctg

SEQ ID NO: 109176 - DNA, 20 bp, Artificial Sequence
  Description of Artificial Sequence: Synthetic oligonucleotide
  Target: ATXN1; (+) strand; PAM type: NRG; PAM sequence: CGG
aaccaaagaatctgcagtca

SEQ ID NO: 109177 - DNA, 20 bp, Artificial Sequence
  Description of Artificial Sequence: Synthetic oligonucleotide
  Target: ATXN1; (+) strand; PAM type: NRG; PAM sequence: AAG
agaatctgcagtcacggtga

SEQ ID NO: 109178 - DNA, 20 bp, Artificial Sequence
  Description of Artificial Sequence: Synthetic oligonucleotide
  Target: ATXN1; (+) strand; PAM type: NRG; PAM sequence: AGG
gaatctgcagtcacggtgaa

SEQ ID NO: 109179 - DNA, 20 bp, Artificial Sequence
  Description of Artificial Sequence: Synthetic oligonucleotide
  Target: ATXN1; (+) strand; PAM type: NRG; PAM sequence: GGG
aatctgcagtcacggtgaaa

SEQ ID NO: 109180 - DNA, 20 bp, Artificial Sequence
  Description of Artificial Sequence: Synthetic oligonucleotide
  Target: ATXN1; (+) strand; PAM type: NRG; PAM sequence: GGG
atctgcagtcacggtgaaag

SEQ ID NO: 109181 - DNA, 20 bp, Artificial Sequence
  Description of Artificial Sequence: Synthetic oligonucleotide
  Target: ATXN1; (+) strand; PAM type: NRG; PAM sequence: CAG
agtcacggtgaaaggggctg

SEQ ID NO: 109182 - DNA, 20 bp, Artificial Sequence
  Description of Artificial Sequence: Synthetic oligonucleotide
  Target: ATXN1; (+) strand; PAM type: NRG; PAM sequence: AGG
gtcacggtgaaaggggctgc

SEQ ID NO: 109183 - DNA, 20 bp, Artificial Sequence
  Description of Artificial Sequence: Synthetic oligonucleotide
  Target: ATXN1; (+) strand; PAM type: NRG; PAM sequence: CAG
caggtcccatgcaatgctgt

SEQ ID NO: 109184 - DNA, 20 bp, Artificial Sequence
  Description of Artificial Sequence: Synthetic oligonucleotide
  Target: ATXN1; (+) strand; PAM type: NRG; PAM sequence: CAG
ccatgcaatgctgtcagctg

SEQ ID NO: 109185 - DNA, 20 bp, Artificial Sequence
  Description of Artificial Sequence: Synthetic oligonucleotide
  Target: ATXN1; (+) strand; PAM type: NRG; PAM sequence: AGG
catgcaatgctgtcagctgc

SEQ ID NO: 109186 - DNA, 20 bp, Artificial Sequence
  Description of Artificial Sequence: Synthetic oligonucleotide
  Target: ATXN1; (+) strand; PAM type: NRG; PAM sequence: TGG
aatgctgtcagctgcaggcc

SEQ ID NO: 109187 - DNA, 20 bp, Artificial Sequence
  Description of Artificial Sequence: Synthetic oligonucleotide
  Target: ATXN1; (+) strand; PAM type: NRG; PAM sequence: GGG
atgctgtcagctgcaggcct

SEQ ID NO: 109188 - DNA, 20 bp, Artificial Sequence
  Description of Artificial Sequence: Synthetic oligonucleotide
  Target: ATXN1; (+) strand; PAM type: NRG; PAM sequence: AAG
ctgtcagctgcaggcctggg

SEQ ID NO: 109189 - DNA, 20 bp, Artificial Sequence
  Description of Artificial Sequence: Synthetic oligonucleotide
  Target: ATXN1; (+) strand; PAM type: NRG; PAM sequence: GAG
gtcagctgcaggcctgggaa

SEQ ID NO: 109190 - DNA, 20 bp, Artificial Sequence
  Description of Artificial Sequence: Synthetic oligonucleotide
  Target: ATXN1; (+) strand; PAM type: NRG; PAM sequence: CAG
aggcctgggaagagttccat

SEQ ID NO: 109191 - DNA, 20 bp, Artificial Sequence
  Description of Artificial Sequence: Synthetic oligonucleotide
  Target: ATXN1; (+) strand; PAM type: NRG; PAM sequence: CAG
cctgggaagagttccatcag

SEQ ID NO: 109192 - DNA, 20 bp, Artificial Sequence
  Description of Artificial Sequence: Synthetic oligonucleotide
  Target: ATXN1; (+) strand; PAM type: NRG; PAM sequence: CAG
ccatcagcagtaatgatgaa

SEQ ID NO: 109193 - DNA, 20 bp, Artificial Sequence
  Description of Artificial Sequence: Synthetic oligonucleotide
  Target: ATXN1; (+) strand; PAM type: NRG; PAM sequence: CAG
ctatctcactgccttcttga

SEQ ID NO: 109194 - DNA, 20 bp, Artificial Sequence
  Description of Artificial Sequence: Synthetic oligonucleotide
  Target: ATXN1; (+) strand; PAM type: NRG; PAM sequence: AGG
tatctcactgccttcttgac

SEQ ID NO: 109195 - DNA, 20 bp, Artificial Sequence
  Description of Artificial Sequence: Synthetic oligonucleotide
  Target: ATXN1; (+) strand; PAM type: NRG; PAM sequence: CAG
ggatctctgctaccaaaata

SEQ ID NO: 109196 - DNA, 20 bp, Artificial Sequence
  Description of Artificial Sequence: Synthetic oligonucleotide
  Target: ATXN1; (+) strand; PAM type: NRG; PAM sequence: GAG
ccaaaatacagaactttcct

SEQ ID NO: 109197 - DNA, 20 bp, Artificial Sequence
  Description of Artificial Sequence: Synthetic oligonucleotide
  Target: ATXN1; (+) strand; PAM type: NRG; PAM sequence: GAG
aaaatacagaactttcctga

SEQ ID NO: 109198 - DNA, 20 bp, Artificial Sequence
  Description of Artificial Sequence: Synthetic oligonucleotide
  Target: ATXN1; (+) strand; PAM type: NRG; PAM sequence: GAG
tgaaattcctcaaaaaaact

SEQ ID NO: 109199 - DNA, 20 bp, Artificial Sequence
  Description of Artificial Sequence: Synthetic oligonucleotide
  Target: ATXN1; (+) strand; PAM type: NRG; PAM sequence: AGG
gaaattcctcaaaaaaactg

SEQ ID NO: 109200 - DNA, 20 bp, Artificial Sequence
  Description of Artificial Sequence: Synthetic oligonucleotide
  Target: ATXN1; (+) strand; PAM type: NRG; PAM sequence: AAG
cctcaaaaaaactgaggatc

SEQ ID NO: 109201 - DNA, 20 bp, Artificial Sequence
  Description of Artificial Sequence: Synthetic oligonucleotide
  Target: ATXN1; (+) strand; PAM type: NRG; PAM sequence: TGG
caaaaaaactgaggatcaag

SEQ ID NO: 109202 - DNA, 20 bp, Artificial Sequence
  Description of Artificial Sequence: Synthetic oligonucleotide
  Target: ATXN1; (+) strand; PAM type: NRG; PAM sequence: TGG
aaaaactgaggatcaagtgg

SEQ ID NO: 109203 - DNA, 20 bp, Artificial Sequence
  Description of Artificial Sequence: Synthetic oligonucleotide
  Target: ATXN1; (+) strand; PAM type: NRG; PAM sequence: GAG
gatcaagtggtggtttctct

SEQ ID NO: 109204 - DNA, 20 bp, Artificial Sequence
  Description of Artificial Sequence: Synthetic oligonucleotide
  Target: ATXN1; (+) strand; PAM type: NRG; PAM sequence: TAG
caagtggtggtttctctgag

SEQ ID NO: 109205 - DNA, 20 bp, Artificial Sequence
  Description of Artificial Sequence: Synthetic oligonucleotide
  Target: ATXN1; (+) strand; PAM type: NRG; PAM sequence: TAG
gtggtttctctgagtagcac

SEQ ID NO: 109206 - DNA, 20 bp, Artificial Sequence
  Description of Artificial Sequence: Synthetic oligonucleotide
  Target: ATXN1; (+) strand; PAM type: NRG; PAM sequence: CAG
actagattgtctgcttccat

SEQ ID NO: 109207 - DNA, 20 bp, Artificial Sequence
  Description of Artificial Sequence: Synthetic oligonucleotide
  Target: ATXN1; (+) strand; PAM type: NRG; PAM sequence: TGG
gtctgcttccatcagacata

SEQ ID NO: 109208 - DNA, 20 bp, Artificial Sequence
  Description of Artificial Sequence: Synthetic oligonucleotide
  Target: ATXN1; (+) strand; PAM type: NRG; PAM sequence: AAG
tcagacatatggactctcct

SEQ ID NO: 109209 - DNA, 20 bp, Artificial Sequence
  Description of Artificial Sequence: Synthetic oligonucleotide
  Target: ATXN1; (+) strand; PAM type: NRG; PAM sequence: CGG
atatggactctcctaagacc

SEQ ID NO: 109210 - DNA, 20 bp, Artificial Sequence
  Description of Artificial Sequence: Synthetic oligonucleotide
  Target: ATXN1; (+) strand; PAM type: NRG; PAM sequence: GGG
tatggactctcctaagaccc

SEQ ID NO: 109211 - DNA, 20 bp, Artificial Sequence
  Description of Artificial Sequence: Synthetic oligonucleotide
  Target: ATXN1; (+) strand; PAM type: NRG; PAM sequence: AAG
ggactctcctaagacccggg

SEQ ID NO: 109212 - DNA, 20 bp, Artificial Sequence
  Description of Artificial Sequence: Synthetic oligonucleotide
  Target: ATXN1; (+) strand; PAM type: NRG; PAM sequence: CAG
cctaagacccgggaagacca

SEQ ID NO: 109213 - DNA, 20 bp, Artificial Sequence
  Description of Artificial Sequence: Synthetic oligonucleotide
  Target: ATXN1; (+) strand; PAM type: NRG; PAM sequence: AGG
ctaagacccgggaagaccac

SEQ ID NO: 109214 - DNA, 20 bp, Artificial Sequence
  Description of Artificial Sequence: Synthetic oligonucleotide
  Target: ATXN1; (+) strand; PAM type: NRG; PAM sequence: CAG
agacccgggaagaccacagg

SEQ ID NO: 109215 - DNA, 20 bp, Artificial Sequence
  Description of Artificial Sequence: Synthetic oligonucleotide
  Target: ATXN1; (+) strand; PAM type: NRG; PAM sequence: AGG
gacccgggaagaccacaggc

SEQ ID NO: 109216 - DNA, 20 bp, Artificial Sequence
  Description of Artificial Sequence: Synthetic oligonucleotide
  Target: ATXN1; (+) strand; PAM type: NRG; PAM sequence: AAG
ggcaggtatgcttttgaaat

SEQ ID NO: 109217 - DNA, 20 bp, Artificial Sequence
  Description of Artificial Sequence: Synthetic oligonucleotide
  Target: ATXN1; (+) strand; PAM type: NRG; PAM sequence: AGG
gcaggtatgcttttgaaata

SEQ ID NO: 109218 - DNA, 20 bp, Artificial Sequence
  Description of Artificial Sequence: Synthetic oligonucleotide
  Target: ATXN1; (+) strand; PAM type: NRG; PAM sequence: CAG
atgcttttgaaataaggatg

SEQ ID NO: 109219 - DNA, 20 bp, Artificial Sequence
  Description of Artificial Sequence: Synthetic oligonucleotide
  Target: ATXN1; (+) strand; PAM type: NRG; PAM sequence: AGG
tgcttttgaaataaggatgc

SEQ ID NO: 109220 - DNA, 20 bp, Artificial Sequence
  Description of Artificial Sequence: Synthetic oligonucleotide
  Target: ATXN1; (+) strand; PAM type: NRG; PAM sequence: GAG
cttttgaaataaggatgcag

SEQ ID NO: 109221 - DNA, 20 bp, Artificial Sequence
  Description of Artificial Sequence: Synthetic oligonucleotide
  Target: ATXN1; (+) strand; PAM type: NRG; PAM sequence: AAG
aaattctgctacgtcaaata

SEQ ID NO: 109222 - DNA, 20 bp, Artificial Sequence
  Description of Artificial Sequence: Synthetic oligonucleotide
  Target: ATXN1; (+) strand; PAM type: NRG; PAM sequence: TAG
ctacgtcaaataaagtgtat

SEQ ID NO: 109223 - DNA, 20 bp, Artificial Sequence
  Description of Artificial Sequence: Synthetic oligonucleotide
  Target: ATXN1; (+) strand; PAM type: NRG; PAM sequence: TAG
tcaaataaagtgtattagat

SEQ ID NO: 109224 - DNA, 20 bp, Artificial Sequence
  Description of Artificial Sequence: Synthetic oligonucleotide
  Target: ATXN1; (+) strand; PAM type: NRG; PAM sequence: AGG
caaataaagtgtattagatt

SEQ ID NO: 109225 - DNA, 20 bp, Artificial Sequence
  Description of Artificial Sequence: Synthetic oligonucleotide
  Target: ATXN1; (+) strand; PAM type: NRG; PAM sequence: TAG
aaagtgtattagattaggtc

SEQ ID NO: 109226 - DNA, 20 bp, Artificial Sequence
  Description of Artificial Sequence: Synthetic oligonucleotide
  Target: ATXN1; (+) strand; PAM type: NRG; PAM sequence: AAG
ggtctagtatttatcttcta

SEQ ID NO: 109227 - DNA, 20 bp, Artificial Sequence
  Description of Artificial Sequence: Synthetic oligonucleotide
  Target: ATXN1; (+) strand; PAM type: NRG; PAM sequence: AGG
gtctagtatttatcttctaa

SEQ ID NO: 109228 - DNA, 20 bp, Artificial Sequence
  Description of Artificial Sequence: Synthetic oligonucleotide
  Target: ATXN1; (+) strand; PAM type: NRG; PAM sequence: AAG
tagtatttatcttctaaagg

SEQ ID NO: 109229 - DNA, 20 bp, Artificial Sequence
  Description of Artificial Sequence: Synthetic oligonucleotide
  Target: ATXN1; (+) strand; PAM type: NRG; PAM sequence: CAG
aaggaagtctgctgtcctca

SEQ ID NO: 109230 - DNA, 20 bp, Artificial Sequence
  Description of Artificial Sequence: Synthetic oligonucleotide
  Target: ATXN1; (+) strand; PAM type: NRG; PAM sequence: TGG
aagtctgctgtcctcacagt

SEQ ID NO: 109231 - DNA, 20 bp, Artificial Sequence
  Description of Artificial Sequence: Synthetic oligonucleotide
  Target: ATXN1; (+) strand; PAM type: NRG; PAM sequence: GGG
agtctgctgtcctcacagtt

SEQ ID NO: 109232 - DNA, 20 bp, Artificial Sequence
  Description of Artificial Sequence: Synthetic oligonucleotide
  Target: ATXN1; (+) strand; PAM type: NRG; PAM sequence: CAG
acttcacatgtgatttctat

SEQ ID NO: 109233 - DNA, 20 bp, Artificial Sequence
  Description of Artificial Sequence: Synthetic oligonucleotide
  Target: ATXN1; (+) strand; PAM type: NRG; PAM sequence: TGG
tgatttctatcagcatttta

SEQ ID NO: 109234 - DNA, 20 bp, Artificial Sequence
  Description of Artificial Sequence: Synthetic oligonucleotide
  Target: ATXN1; (+) strand; PAM type: NRG; PAM sequence: CAG
cagcattttatggaccatat

SEQ ID NO: 109235 - DNA, 20 bp, Artificial Sequence
  Description of Artificial Sequence: Synthetic oligonucleotide
  Target: ATXN1; (+) strand; PAM type: NRG; PAM sequence: AAG
attttatggaccatatcaga

SEQ ID NO: 109236 - DNA, 20 bp, Artificial Sequence
  Description of Artificial Sequence: Synthetic oligonucleotide
  Target: ATXN1; (+) strand; PAM type: NRG; PAM sequence: TGG
tatggaccatatcagaaagc

SEQ ID NO: 109237 - DNA, 20 bp, Artificial Sequence
  Description of Artificial Sequence: Synthetic oligonucleotide
  Target: ATXN1; (+) strand; PAM type: NRG; PAM sequence: AAG
gaaagctggcatgattcaat

SEQ ID NO: 109238 - DNA, 20 bp, Artificial Sequence
  Description of Artificial Sequence: Synthetic oligonucleotide
  Target: ATXN1; (+) strand; PAM type: NRG; PAM sequence: CAG
tggcatgattcaataagatt

SEQ ID NO: 109239 - DNA, 20 bp, Artificial Sequence
  Description of Artificial Sequence: Synthetic oligonucleotide
  Target: ATXN1; (+) strand; PAM type: NRG; PAM sequence: AAG
tgattcaataagattcagaa

SEQ ID NO: 109240 - DNA, 20 bp, Artificial Sequence
  Description of Artificial Sequence: Synthetic oligonucleotide
  Target: ATXN1; (+) strand; PAM type: NRG; PAM sequence: GAG
caataagattcagaaaagat

SEQ ID NO: 109241 - DNA, 20 bp, Artificial Sequence
  Description of Artificial Sequence: Synthetic oligonucleotide
  Target: ATXN1; (+) strand; PAM type: NRG; PAM sequence: CAG
attcagaaaagatgagaccc

SEQ ID NO: 109242 - DNA, 20 bp, Artificial Sequence
  Description of Artificial Sequence: Synthetic oligonucleotide
  Target: ATXN1; (+) strand; PAM type: NRG; PAM sequence: AGG
ttcagaaaagatgagacccc

SEQ ID NO: 109243 - DNA, 20 bp, Artificial Sequence
  Description of Artificial Sequence: Synthetic oligonucleotide
  Target: ATXN1; (+) strand; PAM type: NRG; PAM sequence: GAG
cagaaaagatgagaccccag

SEQ ID NO: 109244 - DNA, 20 bp, Artificial Sequence
  Description of Artificial Sequence: Synthetic oligonucleotide
  Target: ATXN1; (+) strand; PAM type: NRG; PAM sequence: AGG
agaaaagatgagaccccagg

SEQ ID NO: 109245 - DNA, 20 bp, Artificial Sequence
  Description of Artificial Sequence: Synthetic oligonucleotide
  Target: ATXN1; (+) strand; PAM type: NRG; PAM sequence: GAG
atgagaccccaggaggtcat

SEQ ID NO: 109246 - DNA, 20 bp, Artificial Sequence
  Description of Artificial Sequence: Synthetic oligonucleotide
  Target: ATXN1; (+) strand; PAM type: NRG; PAM sequence: CAG
gaggtcatgagtgctaacca

SEQ ID NO: 109247 - DNA, 20 bp, Artificial Sequence
  Description of Artificial Sequence: Synthetic oligonucleotide
  Target: ATXN1; (+) strand; PAM type: NRG; PAM sequence: CAG
catgagtgctaaccacagcc

SEQ ID NO: 109248 - DNA, 20 bp, Artificial Sequence
  Description of Artificial Sequence: Synthetic oligonucleotide
  Target: ATXN1; (+) strand; PAM type: NRG; PAM sequence: TAG
agtgctaaccacagcccagc

SEQ ID NO: 109249 - DNA, 20 bp, Artificial Sequence
  Description of Artificial Sequence: Synthetic oligonucleotide
  Target: ATXN1; (+) strand; PAM type: NRG; PAM sequence: TGG
gctaaccacagcccagctag

SEQ ID NO: 109250 - DNA, 20 bp, Artificial Sequence
  Description of Artificial Sequence: Synthetic oligonucleotide
  Target: ATXN1; (+) strand; PAM type: NRG; PAM sequence: TAG
gtggaatgctatgtgacctt

SEQ ID NO: 109251 - DNA, 20 bp, Artificial Sequence
  Description of Artificial Sequence: Synthetic oligonucleotide
  Target: ATXN1; (+) strand; PAM type: NRG; PAM sequence: TGG
cattctcatgcctctgctca

SEQ ID NO: 109252 - DNA, 20 bp, Artificial Sequence
  Description of Artificial Sequence: Synthetic oligonucleotide
  Target: ATXN1; (+) strand; PAM type: NRG; PAM sequence: GGG
attctcatgcctctgctcat

SEQ ID NO: 109253 - DNA, 20 bp, Artificial Sequence
  Description of Artificial Sequence: Synthetic oligonucleotide
  Target: ATXN1; (+) strand; PAM type: NRG; PAM sequence: AAG
ttactgaacttttctaatcc

SEQ ID NO: 109254 - DNA, 20 bp, Artificial Sequence
  Description of Artificial Sequence: Synthetic oligonucleotide
  Target: ATXN1; (+) strand; PAM type: NRG; PAM sequence: AGG
tactgaacttttctaatcca

SEQ ID NO: 109255 - DNA, 20 bp, Artificial Sequence
  Description of Artificial Sequence: Synthetic oligonucleotide
  Target: ATXN1; (+) strand; PAM type: NRG; PAM sequence: GGG
actgaacttttctaatccaa

SEQ ID NO: 109256 - DNA, 20 bp, Artificial Sequence
  Description of Artificial Sequence: Synthetic oligonucleotide
  Target: ATXN1; (+) strand; PAM type: NRG; PAM sequence: CAG
ccaagggtctctgcatccta

SEQ ID NO: 109257 - DNA, 20 bp, Artificial Sequence
  Description of Artificial Sequence: Synthetic oligonucleotide
  Target: ATXN1; (+) strand; PAM type: NRG; PAM sequence: AAG
tctgcatcctacagtctgta

SEQ ID NO: 109258 - DNA, 20 bp, Artificial Sequence
  Description of Artificial Sequence: Synthetic oligonucleotide
  Target: ATXN1; (+) strand; PAM type: NRG; PAM sequence: TAG
cagtctgtaaagctaattca

SEQ ID NO: 109259 - DNA, 20 bp, Artificial Sequence
  Description of Artificial Sequence: Synthetic oligonucleotide
  Target: ATXN1; (+) strand; PAM type: NRG; PAM sequence: AGG
agtctgtaaagctaattcat

SEQ ID NO: 109260 - DNA, 20 bp, Artificial Sequence
  Description of Artificial Sequence: Synthetic oligonucleotide
  Target: ATXN1; (+) strand; PAM type: NRG; PAM sequence: AAG
taattcataggcttgctgca

SEQ ID NO: 109261 - DNA, 20 bp, Artificial Sequence
  Description of Artificial Sequence: Synthetic oligonucleotide
  Target: ATXN1; (+) strand; PAM type: NRG; PAM sequence: TAG
tgcaaagataaatactgctt

SEQ ID NO: 109262 - DNA, 20 bp, Artificial Sequence
  Description of Artificial Sequence: Synthetic oligonucleotide
  Target: ATXN1; (+) strand; PAM type: NRG; PAM sequence: AAG
ataaatactgctttagattc

SEQ ID NO: 109263 - DNA, 20 bp, Artificial Sequence
  Description of Artificial Sequence: Synthetic oligonucleotide
  Target: ATXN1; (+) strand; PAM type: NRG; PAM sequence: AAG
atactgctttagattcaagt

SEQ ID NO: 109264 - DNA, 20 bp, Artificial Sequence
  Description of Artificial Sequence: Synthetic oligonucleotide
  Target: ATXN1; (+) strand; PAM type: NRG; PAM sequence: TGG
ctttagattcaagtaagctc

SEQ ID NO: 109265 - DNA, 20 bp, Artificial Sequence
  Description of Artificial Sequence: Synthetic oligonucleotide
  Target: ATXN1; (+) strand; PAM type: NRG; PAM sequence: AAG
taagctctggatatgactgt

SEQ ID NO: 109266 - DNA, 20 bp, Artificial Sequence
  Description of Artificial Sequence: Synthetic oligonucleotide
  Target: ATXN1; (+) strand; PAM type: NRG; PAM sequence: TAG
ttatcattatttaaaaaaaa

SEQ ID NO: 109267 - DNA, 20 bp, Artificial Sequence
  Description of Artificial Sequence: Synthetic oligonucleotide
  Target: ATXN1; (+) strand; PAM type: NRG; PAM sequence: AAG
ttatttaaaaaaaatagaac

SEQ ID NO: 109268 - DNA, 20 bp, Artificial Sequence
  Description of Artificial Sequence: Synthetic oligonucleotide
  Target: ATXN1; (+) strand; PAM type: NRG; PAM sequence: GAG
atttaaaaaaaatagaacaa

SEQ ID NO: 109269 - DNA, 20 bp, Artificial Sequence
  Description of Artificial Sequence: Synthetic oligonucleotide
  Target: ATXN1; (+) strand; PAM type: NRG; PAM sequence: GAG
catcatccttgtcttttcct

SEQ ID NO: 109270 - DNA, 20 bp, Artificial Sequence
  Description of Artificial Sequence: Synthetic oligonucleotide
  Target: ATXN1; (+) strand; PAM type: NRG; PAM sequence: AAG
cactatgtgcctaaattaaa

SEQ ID NO: 109271 - DNA, 20 bp, Artificial Sequence
  Description of Artificial Sequence: Synthetic oligonucleotide
  Target: ATXN1; (+) strand; PAM type: NRG; PAM sequence: TAG
tgcctaaattaaaaagatga

SEQ ID NO: 109272 - DNA, 20 bp, Artificial Sequence
  Description of Artificial Sequence: Synthetic oligonucleotide
  Target: ATXN1; (+) strand; PAM type: NRG; PAM sequence: TGG
ctaaattaaaaagatgatag

SEQ ID NO: 109273 - DNA, 20 bp, Artificial Sequence
  Description of Artificial Sequence: Synthetic oligonucleotide
  Target: ATXN1; (+) strand; PAM type: NRG; PAM sequence: CGG
ttaaaaagatgatagtggcc

SEQ ID NO: 109274 - DNA, 20 bp, Artificial Sequence
  Description of Artificial Sequence: Synthetic oligonucleotide
  Target: ATXN1; (+) strand; PAM type: NRG; PAM sequence: TGG
aagatgatagtggcccggcg

SEQ ID NO: 109275 - DNA, 20 bp, Artificial Sequence
  Description of Artificial Sequence: Synthetic oligonucleotide
  Target: ATXN1; (+) strand; PAM type: NRG; PAM sequence: TGG
atgatagtggcccggcgtgg

SEQ ID NO: 109276 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctgtaatcc

SEQ ID NO: 109277 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagcactt

SEQ ID NO: 109278 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 109279 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 109280 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 109281 - DNA, 20 bp, Artificial Sequence
  Description of Artificial Sequence: Synthetic oligonucleotide
  Target: ATXN1; (+) strand; PAM type: NRG; PAM sequence: AAG
tcccagcactttgggaggcc

SEQ ID NO: 109282 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggcca

SEQ ID NO: 109283 - DNA, 20 bp, Artificial Sequence
  Description of Artificial Sequence: Synthetic oligonucleotide
  Target: ATXN1; (+) strand; PAM type: NRG; PAM sequence: CGG
agcactttgggaggccaagg

SEQ ID NO: 109284 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccaaggc

SEQ ID NO: 109285 - DNA, 20 bp, Artificial Sequence
  Description of Artificial Sequence: Synthetic oligonucleotide
  Target: ATXN1; (+) strand; PAM type: NRG; PAM sequence: CAG
ctttgggaggccaaggcggg

SEQ ID NO: 109286 - DNA, 20 bp, Artificial Sequence
  Description of Artificial Sequence: Synthetic oligonucleotide
  Target: ATXN1; (+) strand; PAM type: NRG; PAM sequence: GAG
ggccaaggcgggcagatcac

SEQ ID NO: 109287 - DNA, 20 bp, Artificial Sequence
  Description of Artificial Sequence: Synthetic oligonucleotide
  Target: ATXN1; (+) strand; PAM type: NRG; PAM sequence: AGG
gccaaggcgggcagatcacg

SEQ ID NO: 109288 - DNA, 20 bp, Artificial Sequence
  Description of Artificial Sequence: Synthetic oligonucleotide
  Target: ATXN1; (+) strand; PAM type: NRG; PAM sequence: GAG
aggcgggcagatcacgaggt

SEQ ID NO: 109289 - DNA, 20 bp, Artificial Sequence
  Description of Artificial Sequence: Synthetic oligonucleotide
  Target: ATXN1; (+) strand; PAM type: NRG; PAM sequence: AGG
ggcgggcagatcacgaggtg

SEQ ID NO: 109290 - DNA, 20 bp, Artificial Sequence
  Description of Artificial Sequence: Synthetic oligonucleotide
  Target: ATXN1; (+) strand; PAM type: NRG; PAM sequence: GAG
cgggcagatcacgaggtgag

SEQ ID NO: 109291 - DNA, 20 bp, Artificial Sequence
  Description of Artificial Sequence: Synthetic oligonucleotide
  Target: ATXN1; (+) strand; PAM type: NRG; PAM sequence: GAG
gatcacgaggtgaggagttc

SEQ ID NO: 109292 - DNA, 20 bp, Artificial Sequence
  Description of Artificial Sequence: Synthetic oligonucleotide
  Target: ATXN1; (+) strand; PAM type: NRG; PAM sequence: GAG
tcacgaggtgaggagttcga

SEQ ID NO: 109293 - DNA, 20 bp, Artificial Sequence
  Description of Artificial Sequence: Synthetic oligonucleotide
  Target: ATXN1; (+) strand; PAM type: NRG; PAM sequence: CAG
aggtgaggagttcgagagac

SEQ ID NO: 109294 - DNA, 20 bp, Artificial Sequence
  Description of Artificial Sequence: Synthetic oligonucleotide
  Target: ATXN1; (+) strand; PAM type: NRG; PAM sequence: TGG
agagaccagcctgaccaaca

SEQ ID NO: 109295 - DNA, 20 bp, Artificial Sequence
  Description of Artificial Sequence: Synthetic oligonucleotide
  Target: ATXN1; (+) strand; PAM type: NRG; PAM sequence: AAG
tgaaacctcgtctgtactaa

SEQ ID NO: 109296 - DNA, 20 bp, Artificial Sequence
  Description of Artificial Sequence: Synthetic oligonucleotide
  Target: ATXN1; (+) strand; PAM type: NRG; PAM sequence: TAG
tgtactaaaagtacaaaaat

SEQ ID NO: 109297 - DNA, 20 bp, Artificial Sequence
  Description of Artificial Sequence: Synthetic oligonucleotide
  Target: ATXN1; (+) strand; PAM type: NRG; PAM sequence: CGG
ctaaaagtacaaaaattagc

SEQ ID NO: 109298 - DNA, 20 bp, Artificial Sequence
  Description of Artificial Sequence: Synthetic oligonucleotide
  Target: ATXN1; (+) strand; PAM type: NRG; PAM sequence: GGG
taaaagtacaaaaattagcc

SEQ ID NO: 109299 - DNA, 20 bp, Artificial Sequence
  Description of Artificial Sequence: Synthetic oligonucleotide
  Target: ATXN1; (+) strand; PAM type: NRG; PAM sequence: TGG
gtacaaaaattagccgggcg

SEQ ID NO: 109300 - DNA, 20 bp, Artificial Sequence
  Description of Artificial Sequence: Synthetic oligonucleotide
  Target: ATXN1; (+) strand; PAM type: NRG; PAM sequence: TGG
caaaaattagccgggcgtgg

SEQ ID NO: 109301 - DNA, 20 bp, Artificial Sequence
  Description of Artificial Sequence: Synthetic oligonucleotide
  Target: ATXN1; (+) strand; PAM type: NRG; PAM sequence: CAG
gtggcacgcgcctgtcatct

SEQ ID NO: 109302 - DNA, 20 bp, Artificial Sequence
  Description of Artificial Sequence: Synthetic oligonucleotide
  Target: ATXN1; (+) strand; PAM type: NRG; PAM sequence: CGG
cgcctgtcatctcagctact

SEQ ID NO: 109303 - DNA, 20 bp, Artificial Sequence
  Description of Artificial Sequence: Synthetic oligonucleotide
  Target: ATXN1; (+) strand; PAM type: NRG; PAM sequence: GGG
gcctgtcatctcagctactc

SEQ ID NO: 109304 - DNA, 20 bp, Artificial Sequence
  Description of Artificial Sequence: Synthetic oligonucleotide
  Target: ATXN1; (+) strand; PAM type: NRG; PAM sequence: GAG
ctgtcatctcagctactcgg

SEQ ID NO: 109305 - DNA, 20 bp, Artificial Sequence
  Description of Artificial Sequence: Synthetic oligonucleotide
  Target: ATXN1; (+) strand; PAM type: NRG; PAM sequence: AGG
tgtcatctcagctactcggg

SEQ ID NO: 109306 - DNA, 20 bp, Artificial Sequence
  Description of Artificial Sequence: Synthetic oligonucleotide
  Target: ATXN1; (+) strand; PAM type: NRG; PAM sequence: GAG
tctcagctactcgggaggct

SEQ ID NO: 109307 - DNA, 20 bp, Artificial Sequence
  Description of Artificial Sequence: Synthetic oligonucleotide
  Target: ATXN1; (+) strand; PAM type: NRG; PAM sequence: AGG
ctcagctactcgggaggctg

SEQ ID NO: 109308 - DNA, 20 bp, Artificial Sequence
  Description of Artificial Sequence: Synthetic oligonucleotide
  Target: ATXN1; (+) strand; PAM type: NRG; PAM sequence: CAG
agctactcgggaggctgagg

SEQ ID NO: 109309 - DNA, 20 bp, Artificial Sequence
  Description of Artificial Sequence: Synthetic oligonucleotide
  Target: ATXN1; (+) strand; PAM type: NRG; PAM sequence: AGG
gctactcgggaggctgaggc

SEQ ID NO: 109310 - DNA, 20 bp, Artificial Sequence
  Description of Artificial Sequence: Synthetic oligonucleotide
  Target: ATXN1; (+) strand; PAM type: NRG; PAM sequence: GAG
tactcgggaggctgaggcag

SEQ ID NO: 109311 - DNA, 20 bp, Artificial Sequence
  Description of Artificial Sequence: Synthetic oligonucleotide
  Target: ATXN1; (+) strand; PAM type: NRG; PAM sequence: CGG
gcaggagaatcgcttgaacc

SEQ ID NO: 109312 - DNA, 20 bp, Artificial Sequence
  Description of Artificial Sequence: Synthetic oligonucleotide
  Target: ATXN1; (+) strand; PAM type: NRG; PAM sequence: GGG
caggagaatcgcttgaaccc

SEQ ID NO: 109313 - DNA, 20 bp, Artificial Sequence
  Description of Artificial Sequence: Synthetic oligonucleotide
  Target: ATXN1; (+) strand; PAM type: NRG; PAM sequence: GAG
ggagaatcgcttgaacccgg

SEQ ID NO: 109314 - DNA, 20 bp, Artificial Sequence
  Description of Artificial Sequence: Synthetic oligonucleotide
  Target: ATXN1; (+) strand; PAM type: NRG; PAM sequence: AGG
gagaatcgcttgaacccggg

SEQ ID NO: 109315 - DNA, 20 bp, Artificial Sequence
  Description of Artificial Sequence: Synthetic oligonucleotide
  Target: ATXN1; (+) strand; PAM type: NRG; PAM sequence: CGG
aatcgcttgaacccgggagg

SEQ ID NO: 109316 - DNA, 20 bp, Artificial Sequence
  Description of Artificial Sequence: Synthetic oligonucleotide
  Target: ATXN1; (+) strand; PAM type: NRG; PAM sequence: GAG
tcgcttgaacccgggaggcg

SEQ ID NO: 109317 - DNA, 20 bp, Artificial Sequence
  Description of Artificial Sequence: Synthetic oligonucleotide
  Target: ATXN1; (+) strand; PAM type: NRG; PAM sequence: AGG
cgcttgaacccgggaggcgg

SEQ ID NO: 109318 - DNA, 20 bp, Artificial Sequence
  Description of Artificial Sequence: Synthetic oligonucleotide
  Target: ATXN1; (+) strand; PAM type: NRG; PAM sequence: TAG
aacccgggaggcggaggttg

SEQ ID NO: 109319 - DNA, 20 bp, Artificial Sequence
  Description of Artificial Sequence: Synthetic oligonucleotide
  Target: ATXN1; (+) strand; PAM type: NRG; PAM sequence: GAG
cgggaggcggaggttgtagt

SEQ ID NO: 109320 - DNA, 20 bp, Artificial Sequence
  Description of Artificial Sequence: Synthetic oligonucleotide
  Target: ATXN1; (+) strand; PAM type: NRG; PAM sequence: TGG
gaggcggaggttgtagtgag

SEQ ID NO: 109321 - DNA, 20 bp, Artificial Sequence
  Description of Artificial Sequence: Synthetic oligonucleotide
  Target: ATXN1; (+) strand; PAM type: NRG; PAM sequence: GAG
ggcggaggttgtagtgagtg

SEQ ID NO: 109322 - DNA, 20 bp, Artificial Sequence
  Description of Artificial Sequence: Synthetic oligonucleotide
  Target: ATXN1; (+) strand; PAM type: NRG; PAM sequence: TGG
gaggttgtagtgagtggaga

SEQ ID NO: 109323 - DNA, 20 bp, Artificial Sequence
  Description of Artificial Sequence: Synthetic oligonucleotide
  Target: ATXN1; (+) strand; PAM type: NRG; PAM sequence: CAG
gagatggcgccactgcactc

SEQ ID NO: 109324 - DNA, 20 bp, Artificial Sequence
  Description of Artificial Sequence: Synthetic oligonucleotide
  Target: ATXN1; (+) strand; PAM type: NRG; PAM sequence: GAG
gcgccactgcactccagcct

SEQ ID NO: 109325 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgagtga

SEQ ID NO: 109326 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgagtgaca

SEQ ID NO: 109327 - DNA, 20 bp, Artificial Sequence
  Description of Artificial Sequence: Synthetic oligonucleotide
  Target: ATXN1; (+) strand; PAM type: NRG; PAM sequence: GAG
tccagcctgagtgacagagc

SEQ ID NO: 109328 - DNA, 20 bp, Artificial Sequence
  Description of Artificial Sequence: Synthetic oligonucleotide
  Target: ATXN1; (+) strand; PAM type: NRG; PAM sequence: AAG
agactccatctccaaaaaaa

SEQ ID NO: 109329 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaagaaaaaaaaaa

SEQ ID NO: 109330 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaagaaaaaaaaaaa

SEQ ID NO: 109331 - DNA, 20 bp, Artificial Sequence
  Description of Artificial Sequence: Synthetic oligonucleotide
  Target: ATXN1; (+) strand; PAM type: NRG; PAM sequence: AAG
aaaagaaaaaaaaaaaagga

SEQ ID NO: 109332 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaggaaagaaa

SEQ ID NO: 109333 - DNA, 20 bp, Artificial Sequence
  Description of Artificial Sequence: Synthetic oligonucleotide
  Target: ATXN1; (+) strand; PAM type: NRG; PAM sequence: TAG
aaaaggaaagaaaaagatga

SEQ ID NO: 109334 - DNA, 20 bp, Artificial Sequence
  Description of Artificial Sequence: Synthetic oligonucleotide
  Target: ATXN1; (+) strand; PAM type: NRG; PAM sequence: TGG
aaaaagatgatagcatccct

SEQ ID NO: 109335 - DNA, 20 bp, Artificial Sequence
  Description of Artificial Sequence: Synthetic oligonucleotide
  Target: ATXN1; (+) strand; PAM type: NRG; PAM sequence: TAG
aagatgatagcatcccttgg

SEQ ID NO: 109336 - DNA, 20 bp, Artificial Sequence
  Description of Artificial Sequence: Synthetic oligonucleotide
  Target: ATXN1; (+) strand; PAM type: NRG; PAM sequence: CGG
cccttggtagcaaatataca

SEQ ID NO: 109337 - DNA, 20 bp, Artificial Sequence
  Description of Artificial Sequence: Synthetic oligonucleotide
  Target: ATXN1; (+) strand; PAM type: NRG; PAM sequence: TGG
atacacggaaaatttccatg

SEQ ID NO: 109338 - DNA, 20 bp, Artificial Sequence
  Description of Artificial Sequence: Synthetic oligonucleotide
  Target: ATXN1; (+) strand; PAM type: NRG; PAM sequence: CAG
aaatttccatgtggtttatg

SEQ ID NO: 109339 - DNA, 20 bp, Artificial Sequence
  Description of Artificial Sequence: Synthetic oligonucleotide
  Target: ATXN1; (+) strand; PAM type: NRG; PAM sequence: AAG
tgtggtttatgcagttctaa

SEQ ID NO: 109340 - DNA, 20 bp, Artificial Sequence
  Description of Artificial Sequence: Synthetic oligonucleotide
  Target: ATXN1; (+) strand; PAM type: NRG; PAM sequence: AAG
gtttatgcagttctaaaaga

SEQ ID NO: 109341 - DNA, 20 bp, Artificial Sequence
  Description of Artificial Sequence: Synthetic oligonucleotide
  Target: ATXN1; (+) strand; PAM type: NRG; PAM sequence: CAG
gcagttctaaaagaaagcga

SEQ ID NO: 109342 - DNA, 20 bp, Artificial Sequence
  Description of Artificial Sequence: Synthetic oligonucleotide
  Target: ATXN1; (+) strand; PAM type: NRG; PAM sequence: TAG
gacagatattgcatttactg

SEQ ID NO: 109343 - DNA, 20 bp, Artificial Sequence
  Description of Artificial Sequence: Synthetic oligonucleotide
  Target: ATXN1; (+) strand; PAM type: NRG; PAM sequence: GAG
atttgacttccttttgcctt

SEQ ID NO: 109344 - DNA, 20 bp, Artificial Sequence
  Description of Artificial Sequence: Synthetic oligonucleotide
  Target: ATXN1; (+) strand; PAM type: NRG; PAM sequence: GAG
ttgacttccttttgccttga

SEQ ID NO: 109345 - DNA, 20 bp, Artificial Sequence
  Description of Artificial Sequence: Synthetic oligonucleotide
  Target: ATXN1; (+) strand; PAM type: NRG; PAM sequence: TAG
cttaattttcttgtcttctt

SEQ ID NO: 109346 - DNA, 20 bp, Artificial Sequence
  Description of Artificial Sequence: Synthetic oligonucleotide
  Target: ATXN1; (+) strand; PAM type: NRG; PAM sequence: AGG
ttaattttcttgtcttcttt

SEQ ID NO: 109347 - DNA, 20 bp, Artificial Sequence
  Description of Artificial Sequence: Synthetic oligonucleotide
  Target: ATXN1; (+) strand; PAM type: NRG; PAM sequence: AAG
tcttgtcttctttaggctgt

SEQ ID NO: 109348 - DNA, 20 bp, Artificial Sequence
  Description of Artificial Sequence: Synthetic oligonucleotide
  Target: ATXN1; (+) strand; PAM type: NRG; PAM sequence: AAG
gtaagactactgaatgaatg

SEQ ID NO: 109349 - DNA, 20 bp, Artificial Sequence
  Description of Artificial Sequence: Synthetic oligonucleotide
  Target: ATXN1; (+) strand; PAM type: NRG; PAM sequence: AGG
taagactactgaatgaatga

SEQ ID NO: 109350 - DNA, 20 bp, Artificial Sequence
  Description of Artificial Sequence: Synthetic oligonucleotide
  Target: ATXN1; (+) strand; PAM type: NRG; PAM sequence: GGG
aagactactgaatgaatgaa

SEQ ID NO: 109351 - DNA, 20 bp, Artificial Sequence
  Description of Artificial Sequence: Synthetic oligonucleotide
  Target: ATXN1; (+) strand; PAM type: NRG; PAM sequence: GGG
agactactgaatgaatgaag

SEQ ID NO: 109352 - DNA, 20 bp, Artificial Sequence
  Description of Artificial Sequence: Synthetic oligonucleotide
  Target: ATXN1; (+) strand; PAM type: NRG; PAM sequence: GAG
actactgaatgaatgaaggg

SEQ ID NO: 109353 - DNA, 20 bp, Artificial Sequence
  Description of Artificial Sequence: Synthetic oligonucleotide
  Target: ATXN1; (+) strand; PAM type: NRG; PAM sequence: AGG
ctactgaatgaatgaagggg

SEQ ID NO: 109354 - DNA, 20 bp, Artificial Sequence
  Description of Artificial Sequence: Synthetic oligonucleotide
  Target: ATXN1; (+) strand; PAM type: NRG; PAM sequence: CAG
ctgaatgaatgaaggggagg

SEQ ID NO: 109355 - DNA, 20 bp, Artificial Sequence
  Description of Artificial Sequence: Synthetic oligonucleotide
  Target: ATXN1; (+) strand; PAM type: NRG; PAM sequence: CAG
aatgaatgaaggggaggcag

SEQ ID NO: 109356 - DNA, 20 bp, Artificial Sequence
  Description of Artificial Sequence: Synthetic oligonucleotide
  Target: ATXN1; (+) strand; PAM type: NRG; PAM sequence: TAG
gaatgaaggggaggcagcag

SEQ ID NO: 109357 - DNA, 20 bp, Artificial Sequence
  Description of Artificial Sequence: Synthetic oligonucleotide
  Target: ATXN1; (+) strand; PAM type: NRG; PAM sequence: TGG
aggggaggcagcagtagtct

SEQ ID NO: 109358 - DNA, 20 bp, Artificial Sequence
  Description of Artificial Sequence: Synthetic oligonucleotide
  Target: ATXN1; (+) strand; PAM type: NRG; PAM sequence: AAG
atcgacaatcctttcactac

SEQ ID NO: 109359 - DNA, 20 bp, Artificial Sequence
  Description of Artificial Sequence: Synthetic oligonucleotide
  Target: ATXN1; (+) strand; PAM type: NRG; PAM sequence: CAG
ctttcactacaagaactacg

SEQ ID NO: 109360 - DNA, 20 bp, Artificial Sequence
  Description of Artificial Sequence: Synthetic oligonucleotide
  Target: ATXN1; (+) strand; PAM type: NRG; PAM sequence: CAG
tcactacaagaactacgcag

SEQ ID NO: 109361 - DNA, 20 bp, Artificial Sequence
  Description of Artificial Sequence: Synthetic oligonucleotide
  Target: ATXN1; (+) strand; PAM type: NRG; PAM sequence: AAG
agaactacgcagcagataaa

SEQ ID NO: 109362 - DNA, 20 bp, Artificial Sequence
  Description of Artificial Sequence: Synthetic oligonucleotide
  Target: ATXN1; (+) strand; PAM type: NRG; PAM sequence: GAG
ctacgcagcagataaaaagc

SEQ ID NO: 109363 - DNA, 20 bp, Artificial Sequence
  Description of Artificial Sequence: Synthetic oligonucleotide
  Target: ATXN1; (+) strand; PAM type: NRG; PAM sequence: TGG
ccttctgctcattttccttc

SEQ ID NO: 109364 - DNA, 20 bp, Artificial Sequence
  Description of Artificial Sequence: Synthetic oligonucleotide
  Target: ATXN1; (+) strand; PAM type: NRG; PAM sequence: GAG
ttctgctcattttccttctg

SEQ ID NO: 109365 - DNA, 20 bp, Artificial Sequence
  Description of Artificial Sequence: Synthetic oligonucleotide
  Target: ATXN1; (+) strand; PAM type: NRG; PAM sequence: AGG
tctgctcattttccttctgg

SEQ ID NO: 109366 - DNA, 20 bp, Artificial Sequence
  Description of Artificial Sequence: Synthetic oligonucleotide
  Target: ATXN1; (+) strand; PAM type: NRG; PAM sequence: AAG
tcattttccttctggaggaa

SEQ ID NO: 109367 - DNA, 20 bp, Artificial Sequence
  Description of Artificial Sequence: Synthetic oligonucleotide
  Target: ATXN1; (+) strand; PAM type: NRG; PAM sequence: TAG
ttctggaggaaaagaaaaca

SEQ ID NO: 109368 - DNA, 20 bp, Artificial Sequence
  Description of Artificial Sequence: Synthetic oligonucleotide
  Target: ATXN1; (+) strand; PAM type: NRG; PAM sequence: AAG
tggaggaaaagaaaacatag

SEQ ID NO: 109369 - DNA, 20 bp, Artificial Sequence
  Description of Artificial Sequence: Synthetic oligonucleotide
  Target: ATXN1; (+) strand; PAM type: NRG; PAM sequence: AAG
aacatagaagcaaaattgaa

SEQ ID NO: 109370 - DNA, 20 bp, Artificial Sequence
  Description of Artificial Sequence: Synthetic oligonucleotide
  Target: ATXN1; (+) strand; PAM type: NRG; PAM sequence: AGG
acatagaagcaaaattgaaa

SEQ ID NO: 109371 - DNA, 20 bp, Artificial Sequence
  Description of Artificial Sequence: Synthetic oligonucleotide
  Target: ATXN1; (+) strand; PAM type: NRG; PAM sequence: GGG
catagaagcaaaattgaaaa

SEQ ID NO: 109372 - DNA, 20 bp, Artificial Sequence
  Description of Artificial Sequence: Synthetic oligonucleotide
  Target: ATXN1; (+) strand; PAM type: NRG; PAM sequence: TGG
gcaaaattgaaaagggttaa

SEQ ID NO: 109373 - DNA, 20 bp, Artificial Sequence
  Description of Artificial Sequence: Synthetic oligonucleotide
  Target: ATXN1; (+) strand; PAM type: NRG; PAM sequence: AAG
aattgaaaagggttaatgga

SEQ ID NO: 109374 - DNA, 20 bp, Artificial Sequence
  Description of Artificial Sequence: Synthetic oligonucleotide
  Target: ATXN1; (+) strand; PAM type: NRG; PAM sequence: CAG
gaaagcactaactaaacatt

SEQ ID NO: 109375 - DNA, 20 bp, Artificial Sequence
  Description of Artificial Sequence: Synthetic oligonucleotide
  Target: ATXN1; (+) strand; PAM type: NRG; PAM sequence: AGG
aaagcactaactaaacattc

SEQ ID NO: 109376 - DNA, 20 bp, Artificial Sequence
  Description of Artificial Sequence: Synthetic oligonucleotide
  Target: ATXN1; (+) strand; PAM type: NRG; PAM sequence: TAG
caggtgtaccctgactcaca

SEQ ID NO: 109377 - DNA, 20 bp, Artificial Sequence
  Description of Artificial Sequence: Synthetic oligonucleotide
  Target: ATXN1; (+) strand; PAM type: NRG; PAM sequence: AGG
aggtgtaccctgactcacat

SEQ ID NO: 109378 - DNA, 20 bp, Artificial Sequence
  Description of Artificial Sequence: Synthetic oligonucleotide
  Target: ATXN1; (+) strand; PAM type: NRG; PAM sequence: AAG
gcaatcgttctatttcaaat

SEQ ID NO: 109379 - DNA, 20 bp, Artificial Sequence
  Description of Artificial Sequence: Synthetic oligonucleotide
  Target: ATXN1; (+) strand; PAM type: NRG; PAM sequence: TGG
atcgttctatttcaaataag

SEQ ID NO: 109380 - DNA, 20 bp, Artificial Sequence
  Description of Artificial Sequence: Synthetic oligonucleotide
  Target: ATXN1; (+) strand; PAM type: NRG; PAM sequence: GGG
tcgttctatttcaaataagt

SEQ ID NO: 109381 - DNA, 20 bp, Artificial Sequence
  Description of Artificial Sequence: Synthetic oligonucleotide
  Target: ATXN1; (+) strand; PAM type: NRG; PAM sequence: CAG
ctatttcaaataagtgggac

SEQ ID NO: 109382 - DNA, 20 bp, Artificial Sequence
  Description of Artificial Sequence: Synthetic oligonucleotide
  Target: ATXN1; (+) strand; PAM type: NRG; PAM sequence: CAG
aaataagtgggaccagccca

SEQ ID NO: 109383 - DNA, 20 bp, Artificial Sequence
  Description of Artificial Sequence: Synthetic oligonucleotide
  Target: ATXN1; (+) strand; PAM type: NRG; PAM sequence: AGG
aataagtgggaccagcccac

SEQ ID NO: 109384 - DNA, 20 bp, Artificial Sequence
  Description of Artificial Sequence: Synthetic oligonucleotide
  Target: ATXN1; (+) strand; PAM type: NRG; PAM sequence: GGG
ataagtgggaccagcccaca

SEQ ID NO: 109385 - DNA, 20 bp, Artificial Sequence
  Description of Artificial Sequence: Synthetic oligonucleotide
  Target: ATXN1; (+) strand; PAM type: NRG; PAM sequence: CAG
ggaccagcccacagggctca

SEQ ID NO: 109386 - DNA, 20 bp, Artificial Sequence
  Description of Artificial Sequence: Synthetic oligonucleotide
  Target: ATXN1; (+) strand; PAM type: NRG; PAM sequence: AGG
gaccagcccacagggctcac

SEQ ID NO: 109387 - DNA, 20 bp, Artificial Sequence
  Description of Artificial Sequence: Synthetic oligonucleotide
  Target: ATXN1; (+) strand; PAM type: NRG; PAM sequence: CAG
gcttaacctgttccttccaa

SEQ ID NO: 109388 - DNA, 20 bp, Artificial Sequence
  Description of Artificial Sequence: Synthetic oligonucleotide
  Target: ATXN1; (+) strand; PAM type: NRG; PAM sequence: CAG
taacctgttccttccaacag

SEQ ID NO: 109389 - DNA, 20 bp, Artificial Sequence
  Description of Artificial Sequence: Synthetic oligonucleotide
  Target: ATXN1; (+) strand; PAM type: NRG; PAM sequence: AGG
aacctgttccttccaacagc

SEQ ID NO: 109390 - DNA, 20 bp, Artificial Sequence
  Description of Artificial Sequence: Synthetic oligonucleotide
  Target: ATXN1; (+) strand; PAM type: NRG; PAM sequence: TAG
gtcatgtgcaatgacatgac

SEQ ID NO: 109391 - DNA, 20 bp, Artificial Sequence
  Description of Artificial Sequence: Synthetic oligonucleotide
  Target: ATXN1; (+) strand; PAM type: NRG; PAM sequence: CAG
gtgcaatgacatgactagcc

SEQ ID NO: 109392 - DNA, 20 bp, Artificial Sequence
  Description of Artificial Sequence: Synthetic oligonucleotide
  Target: ATXN1; (+) strand; PAM type: NRG; PAM sequence: AGG
tgcaatgacatgactagccc

SEQ ID NO: 109393 - DNA, 20 bp, Artificial Sequence
  Description of Artificial Sequence: Synthetic oligonucleotide
  Target: ATXN1; (+) strand; PAM type: NRG; PAM sequence: CAG
tgacatgactagcccaggat

SEQ ID NO: 109394 - DNA, 20 bp, Artificial Sequence
  Description of Artificial Sequence: Synthetic oligonucleotide
  Target: ATXN1; (+) strand; PAM type: NRG; PAM sequence: AAG
actagcccaggatcagtatt

SEQ ID NO: 109395 - DNA, 20 bp, Artificial Sequence
  Description of Artificial Sequence: Synthetic oligonucleotide
  Target: ATXN1; (+) strand; PAM type: NRG; PAM sequence: GAG
tagcccaggatcagtattaa

SEQ ID NO: 109396 - DNA, 20 bp, Artificial Sequence
  Description of Artificial Sequence: Synthetic oligonucleotide
  Target: ATXN1; (+) strand; PAM type: NRG; PAM sequence: AAG
tctcactgactcactgcacc

SEQ ID NO: 109397 - DNA, 20 bp, Artificial Sequence
  Description of Artificial Sequence: Synthetic oligonucleotide
  Target: ATXN1; (+) strand; PAM type: NRG; PAM sequence: TAG
tgctattcatttcccaaaat

SEQ ID NO: 109398 - DNA, 20 bp, Artificial Sequence
  Description of Artificial Sequence: Synthetic oligonucleotide
  Target: ATXN1; (+) strand; PAM type: NRG; PAM sequence: AAG
aaattagatttccttactgc

SEQ ID NO: 109399 - DNA, 20 bp, Artificial Sequence
  Description of Artificial Sequence: Synthetic oligonucleotide
  Target: ATXN1; (+) strand; PAM type: NRG; PAM sequence: CAG
cttactgcaagaaatacata

SEQ ID NO: 109400 - DNA, 20 bp, Artificial Sequence
  Description of Artificial Sequence: Synthetic oligonucleotide
  Target: ATXN1; (+) strand; PAM type: NRG; PAM sequence: TAG
aaatacatacagattattaa

SEQ ID NO: 109401 - DNA, 20 bp, Artificial Sequence
  Description of Artificial Sequence: Synthetic oligonucleotide
  Target: ATXN1; (+) strand; PAM type: NRG; PAM sequence: AGG
aatacatacagattattaat

SEQ ID NO: 109402 - DNA, 20 bp, Artificial Sequence
  Description of Artificial Sequence: Synthetic oligonucleotide
  Target: ATXN1; (+) strand; PAM type: NRG; PAM sequence: AAG
ctactccttattttaaatat

SEQ ID NO: 109403 - DNA, 20 bp, Artificial Sequence
  Description of Artificial Sequence: Synthetic oligonucleotide
  Target: ATXN1; (+) strand; PAM type: NRG; PAM sequence: AGG
tactccttattttaaatata

SEQ ID NO: 109404 - DNA, 20 bp, Artificial Sequence
  Description of Artificial Sequence: Synthetic oligonucleotide
  Target: ATXN1; (+) strand; PAM type: NRG; PAM sequence: TAG
ccttattttaaatataagga

SEQ ID NO: 109405 - DNA, 20 bp, Artificial Sequence
  Description of Artificial Sequence: Synthetic oligonucleotide
  Target: ATXN1; (+) strand; PAM type: NRG; PAM sequence: AAG
ttttaaatataaggatagtg

SEQ ID NO: 109406 - DNA, 20 bp, Artificial Sequence
  Description of Artificial Sequence: Synthetic oligonucleotide
  Target: ATXN1; (+) strand; PAM type: NRG; PAM sequence: AAG
aaggatagtgaagcttgttc

SEQ ID NO: 109407 - DNA, 20 bp, Artificial Sequence
  Description of Artificial Sequence: Synthetic oligonucleotide
  Target: ATXN1; (+) strand; PAM type: NRG; PAM sequence: AGG
aggatagtgaagcttgttca

SEQ ID NO: 109408 - DNA, 20 bp, Artificial Sequence
  Description of Artificial Sequence: Synthetic oligonucleotide
  Target: ATXN1; (+) strand; PAM type: NRG; PAM sequence: AAG
cttgttcaaggtgacataaa

SEQ ID NO: 109409 - DNA, 20 bp, Artificial Sequence
  Description of Artificial Sequence: Synthetic oligonucleotide
  Target: ATXN1; (+) strand; PAM type: NRG; PAM sequence: TGG
taaaaagtatctgtaatgtc

SEQ ID NO: 109410 - DNA, 20 bp, Artificial Sequence
  Description of Artificial Sequence: Synthetic oligonucleotide
  Target: ATXN1; (+) strand; PAM type: NRG; PAM sequence: GAG
ctgtaatgtctggctaacac

SEQ ID NO: 109411 - DNA, 20 bp, Artificial Sequence
  Description of Artificial Sequence: Synthetic oligonucleotide
  Target: ATXN1; (+) strand; PAM type: NRG; PAM sequence: CAG
tctggctaacacgagcttcc

SEQ ID NO: 109412 - DNA, 20 bp, Artificial Sequence
  Description of Artificial Sequence: Synthetic oligonucleotide
  Target: ATXN1; (+) strand; PAM type: NRG; PAM sequence: AGG
ctggctaacacgagcttccc

SEQ ID NO: 109413 - DNA, 20 bp, Artificial Sequence
  Description of Artificial Sequence: Synthetic oligonucleotide
  Target: ATXN1; (+) strand; PAM type: NRG; PAM sequence: AAG
acacgagcttcccaggcttt

SEQ ID NO: 109414 - DNA, 20 bp, Artificial Sequence
  Description of Artificial Sequence: Synthetic oligonucleotide
  Target: ATXN1; (+) strand; PAM type: NRG; PAM sequence: TAG
gagcttcccaggctttaagt

SEQ ID NO: 109415 - DNA, 20 bp, Artificial Sequence
  Description of Artificial Sequence: Synthetic oligonucleotide
  Target: ATXN1; (+) strand; PAM type: NRG; PAM sequence: CAG
cttcccaggctttaagttag

SEQ ID NO: 109416 - DNA, 20 bp, Artificial Sequence
  Description of Artificial Sequence: Synthetic oligonucleotide
  Target: ATXN1; (+) strand; PAM type: NRG; PAM sequence: TGG
ccaggctttaagttagcagc

SEQ ID NO: 109417 - DNA, 20 bp, Artificial Sequence
  Description of Artificial Sequence: Synthetic oligonucleotide
  Target: ATXN1; (+) strand; PAM type: NRG; PAM sequence: CAG
tagcagctggtcccaaacta

SEQ ID NO: 109418 - DNA, 20 bp, Artificial Sequence
  Description of Artificial Sequence: Synthetic oligonucleotide
  Target: ATXN1; (+) strand; PAM type: NRG; PAM sequence: AAG
tggtcccaaactacagactc

SEQ ID NO: 109419 - DNA, 20 bp, Artificial Sequence
  Description of Artificial Sequence: Synthetic oligonucleotide
  Target: ATXN1; (+) strand; PAM type: NRG; PAM sequence: TAG
caagtccaccctactgctac

SEQ ID NO: 109420 - DNA, 20 bp, Artificial Sequence
  Description of Artificial Sequence: Synthetic oligonucleotide
  Target: ATXN1; (+) strand; PAM type: NRG; PAM sequence: GAG
gctactagtactctaactgt

SEQ ID NO: 109421 - DNA, 20 bp, Artificial Sequence
  Description of Artificial Sequence: Synthetic oligonucleotide
  Target: ATXN1; (+) strand; PAM type: NRG; PAM sequence: TAG
actgtgagatccttgaccca

SEQ ID NO: 109422 - DNA, 20 bp, Artificial Sequence
  Description of Artificial Sequence: Synthetic oligonucleotide
  Target: ATXN1; (+) strand; PAM type: NRG; PAM sequence: AAG
ctgtacttgttttacttccc

SEQ ID NO: 109423 - DNA, 20 bp, Artificial Sequence
  Description of Artificial Sequence: Synthetic oligonucleotide
  Target: ATXN1; (+) strand; PAM type: NRG; PAM sequence: TGG
ttttacttcccaagaacttc

SEQ ID NO: 109424 - DNA, 20 bp, Artificial Sequence
  Description of Artificial Sequence: Synthetic oligonucleotide
  Target: ATXN1; (+) strand; PAM type: NRG; PAM sequence: TGG
ttcccaagaacttctggcaa

SEQ ID NO: 109425 - DNA, 20 bp, Artificial Sequence
  Description of Artificial Sequence: Synthetic oligonucleotide
  Target: ATXN1; (+) strand; PAM type: NRG; PAM sequence: CAG
ttttttcattgccatgtttt

SEQ ID NO: 109426 - DNA, 20 bp, Artificial Sequence
  Description of Artificial Sequence: Synthetic oligonucleotide
  Target: ATXN1; (+) strand; PAM type: NRG; PAM sequence: TGG
ctgttgtcctatcaccttcc

SEQ ID NO: 109427 - DNA, 20 bp, Artificial Sequence
  Description of Artificial Sequence: Synthetic oligonucleotide
  Target: ATXN1; (+) strand; PAM type: NRG; PAM sequence: TGG
accctccatgccctgcatct

SEQ ID NO: 109428 - DNA, 20 bp, Artificial Sequence
  Description of Artificial Sequence: Synthetic oligonucleotide
  Target: ATXN1; (+) strand; PAM type: NRG; PAM sequence: GGG
ccctccatgccctgcatctt

SEQ ID NO: 109429 - DNA, 20 bp, Artificial Sequence
  Description of Artificial Sequence: Synthetic oligonucleotide
  Target: ATXN1; (+) strand; PAM type: NRG; PAM sequence: GAG
cctgcatcttgggccccact

SEQ ID NO: 109430 - DNA, 20 bp, Artificial Sequence
  Description of Artificial Sequence: Synthetic oligonucleotide
  Target: ATXN1; (+) strand; PAM type: NRG; PAM sequence: GAG
tgcatcttgggccccactga

SEQ ID NO: 109431 - DNA, 20 bp, Artificial Sequence
  Description of Artificial Sequence: Synthetic oligonucleotide
  Target: ATXN1; (+) strand; PAM type: NRG; PAM sequence: TGG
ggccccactgagagctttgc

SEQ ID NO: 109432 - DNA, 20 bp, Artificial Sequence
  Description of Artificial Sequence: Synthetic oligonucleotide
  Target: ATXN1; (+) strand; PAM type: NRG; PAM sequence: GGG
gccccactgagagctttgct

SEQ ID NO: 109433 - DNA, 20 bp, Artificial Sequence
  Description of Artificial Sequence: Synthetic oligonucleotide
  Target: ATXN1; (+) strand; PAM type: NRG; PAM sequence: GAG
cccactgagagctttgctgg

SEQ ID NO: 109434 - DNA, 20 bp, Artificial Sequence
  Description of Artificial Sequence: Synthetic oligonucleotide
  Target: ATXN1; (+) strand; PAM type: NRG; PAM sequence: AAG
tttgctgggagtatgcatgc

SEQ ID NO: 109435 - DNA, 20 bp, Artificial Sequence
  Description of Artificial Sequence: Synthetic oligonucleotide
  Target: ATXN1; (+) strand; PAM type: NRG; PAM sequence: TGG
ctcatacactgcactgcctt

SEQ ID NO: 109436 - DNA, 20 bp, Artificial Sequence
  Description of Artificial Sequence: Synthetic oligonucleotide
  Target: ATXN1; (+) strand; PAM type: NRG; PAM sequence: GGG
tcatacactgcactgccttt

SEQ ID NO: 109437 - DNA, 20 bp, Artificial Sequence
  Description of Artificial Sequence: Synthetic oligonucleotide
  Target: ATXN1; (+) strand; PAM type: NRG; PAM sequence: GAG
gcactgcctttgggatgcct

SEQ ID NO: 109438 - DNA, 20 bp, Artificial Sequence
  Description of Artificial Sequence: Synthetic oligonucleotide
  Target: ATXN1; (+) strand; PAM type: NRG; PAM sequence: TAG
ataactgcccatccctgaaa

SEQ ID NO: 109439 - DNA, 20 bp, Artificial Sequence
  Description of Artificial Sequence: Synthetic oligonucleotide
  Target: ATXN1; (+) strand; PAM type: NRG; PAM sequence: CAG
ccatccctgaaatagatgaa

SEQ ID NO: 109440 - DNA, 20 bp, Artificial Sequence
  Description of Artificial Sequence: Synthetic oligonucleotide
  Target: ATXN1; (+) strand; PAM type: NRG; PAM sequence: TGG
tccctgaaatagatgaacag

SEQ ID NO: 109441 - DNA, 20 bp, Artificial Sequence
  Description of Artificial Sequence: Synthetic oligonucleotide
  Target: ATXN1; (+) strand; PAM type: NRG; PAM sequence: TAG
atgaacagtggccttctctc

SEQ ID NO: 109442 - DNA, 20 bp, Artificial Sequence
  Description of Artificial Sequence: Synthetic oligonucleotide
  Target: ATXN1; (+) strand; PAM type: NRG; PAM sequence: TAG
cagtggccttctctctagtt

SEQ ID NO: 109443 - DNA, 20 bp, Artificial Sequence
  Description of Artificial Sequence: Synthetic oligonucleotide
  Target: ATXN1; (+) strand; PAM type: NRG; PAM sequence: TGG
cttctctctagtttagaact

SEQ ID NO: 109444 - DNA, 20 bp, Artificial Sequence
  Description of Artificial Sequence: Synthetic oligonucleotide
  Target: ATXN1; (+) strand; PAM type: NRG; PAM sequence: GGG
ttctctctagtttagaactt

SEQ ID NO: 109445 - DNA, 20 bp, Artificial Sequence
  Description of Artificial Sequence: Synthetic oligonucleotide
  Target: ATXN1; (+) strand; PAM type: NRG; PAM sequence: TAG
tagtttagaacttgggttgt

SEQ ID NO: 109446 - DNA, 20 bp, Artificial Sequence
  Description of Artificial Sequence: Synthetic oligonucleotide
  Target: ATXN1; (+) strand; PAM type: NRG; PAM sequence: TGG
acttgggttgttagactcct

SEQ ID NO: 109447 - DNA, 20 bp, Artificial Sequence
  Description of Artificial Sequence: Synthetic oligonucleotide
  Target: ATXN1; (+) strand; PAM type: NRG; PAM sequence: GGG
cttgggttgttagactcctt

SEQ ID NO: 109448 - DNA, 20 bp, Artificial Sequence
  Description of Artificial Sequence: Synthetic oligonucleotide
  Target: ATXN1; (+) strand; PAM type: NRG; PAM sequence: TAG
tagactccttgggtctatct

SEQ ID NO: 109449 - DNA, 20 bp, Artificial Sequence
  Description of Artificial Sequence: Synthetic oligonucleotide
  Target: ATXN1; (+) strand; PAM type: NRG; PAM sequence: CAG
ttagcttctctccctgtttt

SEQ ID NO: 109450 - DNA, 20 bp, Artificial Sequence
  Description of Artificial Sequence: Synthetic oligonucleotide
  Target: ATXN1; (+) strand; PAM type: NRG; PAM sequence: TGG
ttctctccctgttttcagtt

SEQ ID NO: 109451 - DNA, 20 bp, Artificial Sequence
  Description of Artificial Sequence: Synthetic oligonucleotide
  Target: ATXN1; (+) strand; PAM type: NRG; PAM sequence: TGG
ttggattttctacctccatt

SEQ ID NO: 109452 - DNA, 20 bp, Artificial Sequence
  Description of Artificial Sequence: Synthetic oligonucleotide
  Target: ATXN1; (+) strand; PAM type: NRG; PAM sequence: TAG
ccatttggcttatctatctc

SEQ ID NO: 109453 - DNA, 20 bp, Artificial Sequence
  Description of Artificial Sequence: Synthetic oligonucleotide
  Target: ATXN1; (+) strand; PAM type: NRG; PAM sequence: TGG
catatctccctgatgatccg

SEQ ID NO: 109454 - DNA, 20 bp, Artificial Sequence
  Description of Artificial Sequence: Synthetic oligonucleotide
  Target: ATXN1; (+) strand; PAM type: NRG; PAM sequence: TAG
atctccctgatgatccgtgg

SEQ ID NO: 109455 - DNA, 20 bp, Artificial Sequence
  Description of Artificial Sequence: Synthetic oligonucleotide
  Target: ATXN1; (+) strand; PAM type: NRG; PAM sequence: TGG
tccctgatgatccgtggtag

SEQ ID NO: 109456 - DNA, 20 bp, Artificial Sequence
  Description of Artificial Sequence: Synthetic oligonucleotide
  Target: ATXN1; (+) strand; PAM type: NRG; PAM sequence: AAG
ttaatccatttacgaaaaac

SEQ ID NO: 109457 - DNA, 20 bp, Artificial Sequence
  Description of Artificial Sequence: Synthetic oligonucleotide
  Target: ATXN1; (+) strand; PAM type: NRG; PAM sequence: TAG
ttacgaaaaacaagacaaca

SEQ ID NO: 109458 - DNA, 20 bp, Artificial Sequence
  Description of Artificial Sequence: Synthetic oligonucleotide
  Target: ATXN1; (+) strand; PAM type: NRG; PAM sequence: AAG
aaacaagacaacatagattc

SEQ ID NO: 109459 - DNA, 20 bp, Artificial Sequence
  Description of Artificial Sequence: Synthetic oligonucleotide
  Target: ATXN1; (+) strand; PAM type: NRG; PAM sequence: AGG
aacaagacaacatagattca

SEQ ID NO: 109460 - DNA, 20 bp, Artificial Sequence
  Description of Artificial Sequence: Synthetic oligonucleotide
  Target: ATXN1; (+) strand; PAM type: NRG; PAM sequence: GAG
caagacaacatagattcaag

SEQ ID NO: 109461 - DNA, 20 bp, Artificial Sequence
  Description of Artificial Sequence: Synthetic oligonucleotide
  Target: ATXN1; (+) strand; PAM type: NRG; PAM sequence: AAG
acacacacacgcatgcacac

SEQ ID NO: 109462 - DNA, 20 bp, Artificial Sequence
  Description of Artificial Sequence: Synthetic oligonucleotide
  Target: ATXN1; (+) strand; PAM type: NRG; PAM sequence: AAG
acgcatgcacacaagcaatg

SEQ ID NO: 109463 - DNA, 20 bp, Artificial Sequence
  Description of Artificial Sequence: Synthetic oligonucleotide
  Target: ATXN1; (+) strand; PAM type: NRG; PAM sequence: TGG
atgcacacaagcaatgaaga

SEQ ID NO: 109464 - DNA, 20 bp, Artificial Sequence
  Description of Artificial Sequence: Synthetic oligonucleotide
  Target: ATXN1; (+) strand; PAM type: NRG; PAM sequence: CAG
cacaagcaatgaagatggaa

SEQ ID NO: 109465 - DNA, 20 bp, Artificial Sequence
  Description of Artificial Sequence: Synthetic oligonucleotide
  Target: ATXN1; (+) strand; PAM type: NRG; PAM sequence: CAG
aagcaatgaagatggaacag

SEQ ID NO: 109466 - DNA, 20 bp, Artificial Sequence
  Description of Artificial Sequence: Synthetic oligonucleotide
  Target: ATXN1; (+) strand; PAM type: NRG; PAM sequence: GAG
gcaatgaagatggaacagca

SEQ ID NO: 109467 - DNA, 20 bp, Artificial Sequence
  Description of Artificial Sequence: Synthetic oligonucleotide
  Target: ATXN1; (+) strand; PAM type: NRG; PAM sequence: GAG
aatgaagatggaacagcaga

SEQ ID NO: 109468 - DNA, 20 bp, Artificial Sequence
  Description of Artificial Sequence: Synthetic oligonucleotide
  Target: ATXN1; (+) strand; PAM type: NRG; PAM sequence: CAG
tggaacagcagagagtacac

SEQ ID NO: 109469 - DNA, 20 bp, Artificial Sequence
  Description of Artificial Sequence: Synthetic oligonucleotide
  Target: ATXN1; (+) strand; PAM type: NRG; PAM sequence: AAG
cagcagagagtacaccagac

SEQ ID NO: 109470 - DNA, 20 bp, Artificial Sequence
  Description of Artificial Sequence: Synthetic oligonucleotide
  Target: ATXN1; (+) strand; PAM type: NRG; PAM sequence: AAG
cagagagtacaccagacaag

SEQ ID NO: 109471 - DNA, 20 bp, Artificial Sequence
  Description of Artificial Sequence: Synthetic oligonucleotide
  Target: ATXN1; (+) strand; PAM type: NRG; PAM sequence: AAG
tacaccagacaagaagccgt

SEQ ID NO: 109472 - DNA, 20 bp, Artificial Sequence
  Description of Artificial Sequence: Synthetic oligonucleotide
  Target: ATXN1; (+) strand; PAM type: NRG; PAM sequence: CGG
agacaagaagccgtaagtgt

SEQ ID NO: 109473 - DNA, 20 bp, Artificial Sequence
  Description of Artificial Sequence: Synthetic oligonucleotide
  Target: ATXN1; (+) strand; PAM type: NRG; PAM sequence: TAG
gaagccgtaagtgtcggttc

SEQ ID NO: 109474 - DNA, 20 bp, Artificial Sequence
  Description of Artificial Sequence: Synthetic oligonucleotide
  Target: ATXN1; (+) strand; PAM type: NRG; PAM sequence: CAG
gttccaattcctctccactg

SEQ ID NO: 109475 - DNA, 20 bp, Artificial Sequence
  Description of Artificial Sequence: Synthetic oligonucleotide
  Target: ATXN1; (+) strand; PAM type: NRG; PAM sequence: CAG
tcctctccactgcagcatct

SEQ ID NO: 109476 - DNA, 20 bp, Artificial Sequence
  Description of Artificial Sequence: Synthetic oligonucleotide
  Target: ATXN1; (+) strand; PAM type: NRG; PAM sequence: TGG
gcagcatctcagatgtaaac

SEQ ID NO: 109477 - DNA, 20 bp, Artificial Sequence
  Description of Artificial Sequence: Synthetic oligonucleotide
  Target: ATXN1; (+) strand; PAM type: NRG; PAM sequence: CAG
tctcagatgtaaactggcgt

SEQ ID NO: 109478 - DNA, 20 bp, Artificial Sequence
  Description of Artificial Sequence: Synthetic oligonucleotide
  Target: ATXN1; (+) strand; PAM type: NRG; PAM sequence: CAG
atgtaaactggcgtcagtaa

SEQ ID NO: 109479 - DNA, 20 bp, Artificial Sequence
  Description of Artificial Sequence: Synthetic oligonucleotide
  Target: ATXN1; (+) strand; PAM type: NRG; PAM sequence: AGG
tgtaaactggcgtcagtaac

SEQ ID NO: 109480 - DNA, 20 bp, Artificial Sequence
  Description of Artificial Sequence: Synthetic oligonucleotide
  Target: ATXN1; (+) strand; PAM type: NRG; PAM sequence: CAG
aggtcctgtcatccacctcc

SEQ ID NO: 109481 - DNA, 20 bp, Artificial Sequence
  Description of Artificial Sequence: Synthetic oligonucleotide
  Target: ATXN1; (+) strand; PAM type: NRG; PAM sequence: AGG
ggtcctgtcatccacctccc

SEQ ID NO: 109482 - DNA, 20 bp, Artificial Sequence
  Description of Artificial Sequence: Synthetic oligonucleotide
  Target: ATXN1; (+) strand; PAM type: NRG; PAM sequence: AAG
acctcccaggaaaattgtca

SEQ ID NO: 109483 - DNA, 20 bp, Artificial Sequence
  Description of Artificial Sequence: Synthetic oligonucleotide
  Target: ATXN1; (+) strand; PAM type: NRG; PAM sequence: TAG
aggaaaattgtcaaagataa

SEQ ID NO: 109484 - DNA, 20 bp, Artificial Sequence
  Description of Artificial Sequence: Synthetic oligonucleotide
  Target: ATXN1; (+) strand; PAM type: NRG; PAM sequence: TGG
attgtcaaagataatagtta

SEQ ID NO: 109485 - DNA, 20 bp, Artificial Sequence
  Description of Artificial Sequence: Synthetic oligonucleotide
  Target: ATXN1; (+) strand; PAM type: NRG; PAM sequence: CAG
tcaaagataatagttatggc

SEQ ID NO: 109486 - DNA, 20 bp, Artificial Sequence
  Description of Artificial Sequence: Synthetic oligonucleotide
  Target: ATXN1; (+) strand; PAM type: NRG; PAM sequence: AGG
caaagataatagttatggcc

SEQ ID NO: 109487 - DNA, 20 bp, Artificial Sequence
  Description of Artificial Sequence: Synthetic oligonucleotide
  Target: ATXN1; (+) strand; PAM type: NRG; PAM sequence: TGG
ataatagttatggccaggcg

SEQ ID NO: 109488 - DNA, 20 bp, Artificial Sequence
  Description of Artificial Sequence: Synthetic oligonucleotide
  Target: ATXN1; (+) strand; PAM type: NRG; PAM sequence: TGG
atagttatggccaggcgtgg

SEQ ID NO: 109489 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccaccactt

SEQ ID NO: 109490 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccaccacttt

SEQ ID NO: 109491 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccaccactttgg

SEQ ID NO: 109492 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccaccactttggg

SEQ ID NO: 109493 - DNA, 20 bp, Artificial Sequence
  Description of Artificial Sequence: Synthetic oligonucleotide
  Target: ATXN1; (+) strand; PAM type: NRG; PAM sequence: GAG
tcccaccactttgggaggcc

SEQ ID NO: 109494 - DNA, 20 bp, Artificial Sequence
  Description of Artificial Sequence: Synthetic oligonucleotide
  Target: ATXN1; (+) strand; PAM type: NRG; PAM sequence: AGG
cccaccactttgggaggccg

SEQ ID NO: 109495 - DNA, 20 bp, Artificial Sequence
  Description of Artificial Sequence: Synthetic oligonucleotide
  Target: ATXN1; (+) strand; PAM type: NRG; PAM sequence: CAG
accactttgggaggccgagg

SEQ ID NO: 109496 - DNA, 20 bp, Artificial Sequence
  Description of Artificial Sequence: Synthetic oligonucleotide
  Target: ATXN1; (+) strand; PAM type: NRG; PAM sequence: AGG
ccactttgggaggccgaggc

SEQ ID NO: 109497 - DNA, 20 bp, Artificial Sequence
  Description of Artificial Sequence: Synthetic oligonucleotide
  Target: ATXN1; (+) strand; PAM type: NRG; PAM sequence: GAG
ccgaggcaggtgaaccatct

SEQ ID NO: 109498 - DNA, 20 bp, Artificial Sequence
  Description of Artificial Sequence: Synthetic oligonucleotide
  Target: ATXN1; (+) strand; PAM type: NRG; PAM sequence: AGG
cgaggcaggtgaaccatctg

SEQ ID NO: 109499 - DNA, 20 bp, Artificial Sequence
  Description of Artificial Sequence: Synthetic oligonucleotide
  Target: ATXN1; (+) strand; PAM type: NRG; PAM sequence: TGG
gcaggtgaaccatctgaggt

SEQ ID NO: 109500 - DNA, 20 bp, Artificial Sequence
  Description of Artificial Sequence: Synthetic oligonucleotide
  Target: ATXN1; (+) strand; PAM type: NRG; PAM sequence: GGG
caggtgaaccatctgaggtt

SEQ ID NO: 109501 - DNA, 20 bp, Artificial Sequence
  Description of Artificial Sequence: Synthetic oligonucleotide
  Target: ATXN1; (+) strand; PAM type: NRG; PAM sequence: GAG
ggtgaaccatctgaggttgg

SEQ ID NO: 109502 - DNA, 20 bp, Artificial Sequence
  Description of Artificial Sequence: Synthetic oligonucleotide
  Target: ATXN1; (+) strand; PAM type: NRG; PAM sequence: GAG
ccatctgaggttgggagttt

SEQ ID NO: 109503 - DNA, 20 bp, Artificial Sequence
  Description of Artificial Sequence: Synthetic oligonucleotide
  Target: ATXN1; (+) strand; PAM type: NRG; PAM sequence: CAG
tgaggttgggagtttgagat

SEQ ID NO: 109504 - DNA, 20 bp, Artificial Sequence
  Description of Artificial Sequence: Synthetic oligonucleotide
  Target: ATXN1; (+) strand; PAM type: NRG; PAM sequence: TGG
ttgggagtttgagatcagcc

SEQ ID NO: 109505 - DNA, 20 bp, Artificial Sequence
  Description of Artificial Sequence: Synthetic oligonucleotide
  Target: ATXN1; (+) strand; PAM type: NRG; PAM sequence: TGG
tgagatcagcctggacaaca

SEQ ID NO: 109506 - DNA, 20 bp, Artificial Sequence
  Description of Artificial Sequence: Synthetic oligonucleotide
  Target: ATXN1; (+) strand; PAM type: NRG; PAM sequence: TAG
ctactaaaaatataaaaaat

SEQ ID NO: 109507 - DNA, 20 bp, Artificial Sequence
  Description of Artificial Sequence: Synthetic oligonucleotide
  Target: ATXN1; (+) strand; PAM type: NRG; PAM sequence: TGG
taaaaatataaaaaattagc

SEQ ID NO: 109508 - DNA, 20 bp, Artificial Sequence
  Description of Artificial Sequence: Synthetic oligonucleotide
  Target: ATXN1; (+) strand; PAM type: NRG; PAM sequence: GGG
aaaaatataaaaaattagct

SEQ ID NO: 109509 - DNA, 20 bp, Artificial Sequence
  Description of Artificial Sequence: Synthetic oligonucleotide
  Target: ATXN1; (+) strand; PAM type: NRG; PAM sequence: TAG
tataaaaaattagctgggcg

SEQ ID NO: 109510 - DNA, 20 bp, Artificial Sequence
  Description of Artificial Sequence: Synthetic oligonucleotide
  Target: ATXN1; (+) strand; PAM type: NRG; PAM sequence: AGG
ataaaaaattagctgggcgt

SEQ ID NO: 109511 - DNA, 20 bp, Artificial Sequence
  Description of Artificial Sequence: Synthetic oligonucleotide
  Target: ATXN1; (+) strand; PAM type: NRG; PAM sequence: GAG
aaaaaattagctgggcgtag

SEQ ID NO: 109512 - DNA, 20 bp, Artificial Sequence
  Description of Artificial Sequence: Synthetic oligonucleotide
  Target: ATXN1; (+) strand; PAM type: NRG; PAM sequence: CAG
ggagcacacgtctgtaatcc

SEQ ID NO: 109513 - DNA, 20 bp, Artificial Sequence
  Description of Artificial Sequence: Synthetic oligonucleotide
  Target: ATXN1; (+) strand; PAM type: NRG; PAM sequence: CAG
cgtctgtaatcccagctaat

SEQ ID NO: 109514 - DNA, 20 bp, Artificial Sequence
  Description of Artificial Sequence: Synthetic oligonucleotide
  Target: ATXN1; (+) strand; PAM type: NRG; PAM sequence: AGG
gtctgtaatcccagctaatc

SEQ ID NO: 109515 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctaatcag

SEQ ID NO: 109516 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctaatcagg

SEQ ID NO: 109517 - DNA, 20 bp, Artificial Sequence
  Description of Artificial Sequence: Synthetic oligonucleotide
  Target: ATXN1; (+) strand; PAM type: NRG; PAM sequence: GAG
tcccagctaatcaggaggct

SEQ ID NO: 109518 - DNA, 20 bp, Artificial Sequence
  Description of Artificial Sequence: Synthetic oligonucleotide
  Target: ATXN1; (+) strand; PAM type: NRG; PAM sequence: AGG
cccagctaatcaggaggctg

SEQ ID NO: 109519 - DNA, 20 bp, Artificial Sequence
  Description of Artificial Sequence: Synthetic oligonucleotide
  Target: ATXN1; (+) strand; PAM type: NRG; PAM sequence: CAG
agctaatcaggaggctgagg

SEQ ID NO: 109520 - DNA, 20 bp, Artificial Sequence
  Description of Artificial Sequence: Synthetic oligonucleotide
  Target: ATXN1; (+) strand; PAM type: NRG; PAM sequence: AGG
gctaatcaggaggctgaggc

SEQ ID NO: 109521 - DNA, 20 bp, Artificial Sequence
  Description of Artificial Sequence: Synthetic oligonucleotide
  Target: ATXN1; (+) strand; PAM type: NRG; PAM sequence: GAG
taatcaggaggctgaggcag

SEQ ID NO: 109522 - DNA, 20 bp, Artificial Sequence
  Description of Artificial Sequence: Synthetic oligonucleotide
  Target: ATXN1; (+) strand; PAM type: NRG; PAM sequence: TGG
gcaggagaatcacatgaacc

SEQ ID NO: 109523 - DNA, 20 bp, Artificial Sequence
  Description of Artificial Sequence: Synthetic oligonucleotide
  Target: ATXN1; (+) strand; PAM type: NRG; PAM sequence: GGG
caggagaatcacatgaacct

SEQ ID NO: 109524 - DNA, 20 bp, Artificial Sequence
  Description of Artificial Sequence: Synthetic oligonucleotide
  Target: ATXN1; (+) strand; PAM type: NRG; PAM sequence: GAG
ggagaatcacatgaacctgg

SEQ ID NO: 109525 - DNA, 20 bp, Artificial Sequence
  Description of Artificial Sequence: Synthetic oligonucleotide
  Target: ATXN1; (+) strand; PAM type: NRG; PAM sequence: AGG
gagaatcacatgaacctggg

SEQ ID NO: 109526 - DNA, 20 bp, Artificial Sequence
  Description of Artificial Sequence: Synthetic oligonucleotide
  Target: ATXN1; (+) strand; PAM type: NRG; PAM sequence: CGG
aatcacatgaacctgggagg

SEQ ID NO: 109527 - DNA, 20 bp, Artificial Sequence
  Description of Artificial Sequence: Synthetic oligonucleotide
  Target: ATXN1; (+) strand; PAM type: NRG; PAM sequence: GAG
tcacatgaacctgggaggcg

SEQ ID NO: 109528 - DNA, 20 bp, Artificial Sequence
  Description of Artificial Sequence: Synthetic oligonucleotide
  Target: ATXN1; (+) strand; PAM type: NRG; PAM sequence: AGG
cacatgaacctgggaggcgg

SEQ ID NO: 109529 - DNA, 20 bp, Artificial Sequence
  Description of Artificial Sequence: Synthetic oligonucleotide
  Target: ATXN1; (+) strand; PAM type: NRG; PAM sequence: CAG
aacctgggaggcggaggttg

SEQ ID NO: 109530 - DNA, 20 bp, Artificial Sequence
  Description of Artificial Sequence: Synthetic oligonucleotide
  Target: ATXN1; (+) strand; PAM type: NRG; PAM sequence: GAG
tgggaggcggaggttgcagt

SEQ ID NO: 109531 - DNA, 20 bp, Artificial Sequence
  Description of Artificial Sequence: Synthetic oligonucleotide
  Target: ATXN1; (+) strand; PAM type: NRG; PAM sequence: GAG
ggcggaggttgcagtgagcc

SEQ ID NO: 109532 - DNA, 20 bp, Artificial Sequence
  Description of Artificial Sequence: Synthetic oligonucleotide
  Target: ATXN1; (+) strand; PAM type: NRG; PAM sequence: CAG
gagattgcgtcactgcactc

SEQ ID NO: 109533 - DNA, 20 bp, Artificial Sequence
  Description of Artificial Sequence: Synthetic oligonucleotide
  Target: ATXN1; (+) strand; PAM type: NRG; PAM sequence: TGG
tgcgtcactgcactccagcc

SEQ ID NO: 109534 - DNA, 20 bp, Artificial Sequence
  Description of Artificial Sequence: Synthetic oligonucleotide
  Target: ATXN1; (+) strand; PAM type: NRG; PAM sequence: GGG
gcgtcactgcactccagcct

SEQ ID NO: 109535 - DNA, 20 bp, Artificial Sequence
  Description of Artificial Sequence: Synthetic oligonucleotide
  Target: ATXN1; (+) strand; PAM type: NRG; PAM sequence: CAG
gcactccagcctgggtgaca

SEQ ID NO: 109536 - DNA, 20 bp, Artificial Sequence
  Description of Artificial Sequence: Synthetic oligonucleotide
  Target: ATXN1; (+) strand; PAM type: NRG; PAM sequence: AAG
tccagcctgggtgacacagc

SEQ ID NO: 109537 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaaaaaaaaaa

SEQ ID NO: 109538 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaaaagttatg

SEQ ID NO: 109539 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaaaaaagttatga

SEQ ID NO: 109540 - DNA, 20 bp, Artificial Sequence
  Description of Artificial Sequence: Synthetic oligonucleotide
  Target: ATXN1; (+) strand; PAM type: NRG; PAM sequence: AAG
tatgaaggtcttctgaaaac

SEQ ID NO: 109541 - DNA, 20 bp, Artificial Sequence
  Description of Artificial Sequence: Synthetic oligonucleotide
  Target: ATXN1; (+) strand; PAM type: NRG; PAM sequence: CAG
gaaaacaagaaaacactatt

SEQ ID NO: 109542 - DNA, 20 bp, Artificial Sequence
  Description of Artificial Sequence: Synthetic oligonucleotide
  Target: ATXN1; (+) strand; PAM type: NRG; PAM sequence: TAG
gatgaaaactattatattta

SEQ ID NO: 109543 - DNA, 20 bp, Artificial Sequence
  Description of Artificial Sequence: Synthetic oligonucleotide
  Target: ATXN1; (+) strand; PAM type: NRG; PAM sequence: AAG
tactatttttttttaaaaaa

SEQ ID NO: 109544 - DNA, 20 bp, Artificial Sequence
  Description of Artificial Sequence: Synthetic oligonucleotide
  Target: ATXN1; (+) strand; PAM type: NRG; PAM sequence: AAG
tatttttttttaaaaaaaag

SEQ ID NO: 109545 - DNA, 20 bp, Artificial Sequence
  Description of Artificial Sequence: Synthetic oligonucleotide
  Target: ATXN1; (+) strand; PAM type: NRG; PAM sequence: CAG
ttgaattacctataatgcaa

SEQ ID NO: 109546 - DNA, 20 bp, Artificial Sequence
  Description of Artificial Sequence: Synthetic oligonucleotide
  Target: ATXN1; (+) strand; PAM type: NRG; PAM sequence: CAG
aattacctataatgcaacag

SEQ ID NO: 109547 - DNA, 20 bp, Artificial Sequence
  Description of Artificial Sequence: Synthetic oligonucleotide
  Target: ATXN1; (+) strand; PAM type: NRG; PAM sequence: CAG
aaaattgtgcacaattcaat

SEQ ID NO: 109548 - DNA, 20 bp, Artificial Sequence
  Description of Artificial Sequence: Synthetic oligonucleotide
  Target: ATXN1; (+) strand; PAM type: NRG; PAM sequence: GAG
aattgtgcacaattcaatca

SEQ ID NO: 109549 - DNA, 20 bp, Artificial Sequence
  Description of Artificial Sequence: Synthetic oligonucleotide
  Target: ATXN1; (+) strand; PAM type: NRG; PAM sequence: AGG
attgtgcacaattcaatcag

SEQ ID NO: 109550 - DNA, 20 bp, Artificial Sequence
  Description of Artificial Sequence: Synthetic oligonucleotide
  Target: ATXN1; (+) strand; PAM type: NRG; PAM sequence: TGG
caatcagaggttctcaaaca

SEQ ID NO: 109551 - DNA, 20 bp, Artificial Sequence
  Description of Artificial Sequence: Synthetic oligonucleotide
  Target: ATXN1; (+) strand; PAM type: NRG; PAM sequence: CAG
tctcaaacatggctgcccat

SEQ ID NO: 109552 - DNA, 20 bp, Artificial Sequence
  Description of Artificial Sequence: Synthetic oligonucleotide
  Target: ATXN1; (+) strand; PAM type: NRG; PAM sequence: TAG
agaatcaccattgtgccttt

SEQ ID NO: 109553 - DNA, 20 bp, Artificial Sequence
  Description of Artificial Sequence: Synthetic oligonucleotide
  Target: ATXN1; (+) strand; PAM type: NRG; PAM sequence: AGG
gaatcaccattgtgcctttt

SEQ ID NO: 109554 - DNA, 20 bp, Artificial Sequence
  Description of Artificial Sequence: Synthetic oligonucleotide
  Target: ATXN1; (+) strand; PAM type: NRG; PAM sequence: CAG
attgtgccttttaggaaaca

SEQ ID NO: 109555 - DNA, 20 bp, Artificial Sequence
  Description of Artificial Sequence: Synthetic oligonucleotide
  Target: ATXN1; (+) strand; PAM type: NRG; PAM sequence: CAG
ttttaggaaacacagattct

SEQ ID NO: 109556 - DNA, 20 bp, Artificial Sequence
  Description of Artificial Sequence: Synthetic oligonucleotide
  Target: ATXN1; (+) strand; PAM type: NRG; PAM sequence: CAG
cacagattctcagacatttg

SEQ ID NO: 109557 - DNA, 20 bp, Artificial Sequence
  Description of Artificial Sequence: Synthetic oligonucleotide
  Target: ATXN1; (+) strand; PAM type: NRG; PAM sequence: TGG
cagacatttgcagtctctaa

SEQ ID NO: 109558 - DNA, 20 bp, Artificial Sequence
  Description of Artificial Sequence: Synthetic oligonucleotide
  Target: ATXN1; (+) strand; PAM type: NRG; PAM sequence: TGG
tttgcagtctctaatggccc

SEQ ID NO: 109559 - DNA, 20 bp, Artificial Sequence
  Description of Artificial Sequence: Synthetic oligonucleotide
  Target: ATXN1; (+) strand; PAM type: NRG; PAM sequence: TGG
tctaatggccctggattttc

SEQ ID NO: 109560 - DNA, 20 bp, Artificial Sequence
  Description of Artificial Sequence: Synthetic oligonucleotide
  Target: ATXN1; (+) strand; PAM type: NRG; PAM sequence: GGG
ctaatggccctggattttct

SEQ ID NO: 109561 - DNA, 20 bp, Artificial Sequence
  Description of Artificial Sequence: Synthetic oligonucleotide
  Target: ATXN1; (+) strand; PAM type: NRG; PAM sequence: CAG
tggccctggattttctgggc

SEQ ID NO: 109562 - DNA, 20 bp, Artificial Sequence
  Description of Artificial Sequence: Synthetic oligonucleotide
  Target: ATXN1; (+) strand; PAM type: NRG; PAM sequence: CAG
ggattttctgggccagtgca

SEQ ID NO: 109563 - DNA, 20 bp, Artificial Sequence
  Description of Artificial Sequence: Synthetic oligonucleotide
  Target: ATXN1; (+) strand; PAM type: NRG; PAM sequence: AGG
gattttctgggccagtgcac

SEQ ID NO: 109564 - DNA, 20 bp, Artificial Sequence
  Description of Artificial Sequence: Synthetic oligonucleotide
  Target: ATXN1; (+) strand; PAM type: NRG; PAM sequence: TGG
ctgggccagtgcacaggtaa

SEQ ID NO: 109565 - DNA, 20 bp, Artificial Sequence
  Description of Artificial Sequence: Synthetic oligonucleotide
  Target: ATXN1; (+) strand; PAM type: NRG; PAM sequence: AAG
tttttaaaaacatttccccc

SEQ ID NO: 109566 - DNA, 20 bp, Artificial Sequence
  Description of Artificial Sequence: Synthetic oligonucleotide
  Target: ATXN1; (+) strand; PAM type: NRG; PAM sequence: AGG
ttttaaaaacatttccccca

SEQ ID NO: 109567 - DNA, 20 bp, Artificial Sequence
  Description of Artificial Sequence: Synthetic oligonucleotide
  Target: ATXN1; (+) strand; PAM type: NRG; PAM sequence: GGG
tttaaaaacatttcccccaa

SEQ ID NO: 109568 - DNA, 20 bp, Artificial Sequence
  Description of Artificial Sequence: Synthetic oligonucleotide
  Target: ATXN1; (+) strand; PAM type: NRG; PAM sequence: CAG
ttcccccaagggattctgat

SEQ ID NO: 109569 - DNA, 20 bp, Artificial Sequence
  Description of Artificial Sequence: Synthetic oligonucleotide
  Target: ATXN1; (+) strand; PAM type: NRG; PAM sequence: TAG
cccaagggattctgatcagt

SEQ ID NO: 109570 - DNA, 20 bp, Artificial Sequence
  Description of Artificial Sequence: Synthetic oligonucleotide
  Target: ATXN1; (+) strand; PAM type: NRG; PAM sequence: AGG
ccaagggattctgatcagtt

SEQ ID NO: 109571 - DNA, 20 bp, Artificial Sequence
  Description of Artificial Sequence: Synthetic oligonucleotide
  Target: ATXN1; (+) strand; PAM type: NRG; PAM sequence: TGG
ggattctgatcagttaggtt

SEQ ID NO: 109572 - DNA, 20 bp, Artificial Sequence
  Description of Artificial Sequence: Synthetic oligonucleotide
  Target: ATXN1; (+) strand; PAM type: NRG; PAM sequence: GGG
gattctgatcagttaggttt

SEQ ID NO: 109573 - DNA, 20 bp, Artificial Sequence
  Description of Artificial Sequence: Synthetic oligonucleotide
  Target: ATXN1; (+) strand; PAM type: NRG; PAM sequence: CGG
aataacatgtttctctgtga

SEQ ID NO: 109574 - DNA, 20 bp, Artificial Sequence
  Description of Artificial Sequence: Synthetic oligonucleotide
  Target: ATXN1; (+) strand; PAM type: NRG; PAM sequence: GAG
taacatgtttctctgtgacg

SEQ ID NO: 109575 - DNA, 20 bp, Artificial Sequence
  Description of Artificial Sequence: Synthetic oligonucleotide
  Target: ATXN1; (+) strand; PAM type: NRG; PAM sequence: AGG
aacatgtttctctgtgacgg

SEQ ID NO: 109576 - DNA, 20 bp, Artificial Sequence
  Description of Artificial Sequence: Synthetic oligonucleotide
  Target: ATXN1; (+) strand; PAM type: NRG; PAM sequence: AAG
ctctgtgacggaggaaattt

SEQ ID NO: 109577 - DNA, 20 bp, Artificial Sequence
  Description of Artificial Sequence: Synthetic oligonucleotide
  Target: ATXN1; (+) strand; PAM type: NRG; PAM sequence: CAG
ttgttatctgtttttttctt

SEQ ID NO: 109578 - DNA, 20 bp, Artificial Sequence
  Description of Artificial Sequence: Synthetic oligonucleotide
  Target: ATXN1; (+) strand; PAM type: NRG; PAM sequence: GAG
gttatctgtttttttcttca

SEQ ID NO: 109579 - DNA, 20 bp, Artificial Sequence
  Description of Artificial Sequence: Synthetic oligonucleotide
  Target: ATXN1; (+) strand; PAM type: NRG; PAM sequence: AGG
ttatctgtttttttcttcag

SEQ ID NO: 109580 - DNA, 20 bp, Artificial Sequence
  Description of Artificial Sequence: Synthetic oligonucleotide
  Target: ATXN1; (+) strand; PAM type: NRG; PAM sequence: CAG
tttttttcttcagaggatat

SEQ ID NO: 109581 - DNA, 20 bp, Artificial Sequence
  Description of Artificial Sequence: Synthetic oligonucleotide
  Target: ATXN1; (+) strand; PAM type: NRG; PAM sequence: AAG
tcttcagaggatatcagttt

SEQ ID NO: 109582 - DNA, 20 bp, Artificial Sequence
  Description of Artificial Sequence: Synthetic oligonucleotide
  Target: ATXN1; (+) strand; PAM type: NRG; PAM sequence: TGG
gaggatatcagtttaagtgt

SEQ ID NO: 109583 - DNA, 20 bp, Artificial Sequence
  Description of Artificial Sequence: Synthetic oligonucleotide
  Target: ATXN1; (+) strand; PAM type: NRG; PAM sequence: AAG
gtttttaaactgtaactctg

SEQ ID NO: 109584 - DNA, 20 bp, Artificial Sequence
  Description of Artificial Sequence: Synthetic oligonucleotide
  Target: ATXN1; (+) strand; PAM type: NRG; PAM sequence: AGG
tttttaaactgtaactctga

SEQ ID NO: 109585 - DNA, 20 bp, Artificial Sequence
  Description of Artificial Sequence: Synthetic oligonucleotide
  Target: ATXN1; (+) strand; PAM type: NRG; PAM sequence: TGG
taactctgaaggcaaacaac

SEQ ID NO: 109586 - DNA, 20 bp, Artificial Sequence
  Description of Artificial Sequence: Synthetic oligonucleotide
  Target: ATXN1; (+) strand; PAM type: NRG; PAM sequence: AAG
tctgaaggcaaacaactggc

SEQ ID NO: 109587 - DNA, 20 bp, Artificial Sequence
  Description of Artificial Sequence: Synthetic oligonucleotide
  Target: ATXN1; (+) strand; PAM type: NRG; PAM sequence: GAG
tgaaggcaaacaactggcaa

SEQ ID NO: 109588 - DNA, 20 bp, Artificial Sequence
  Description of Artificial Sequence: Synthetic oligonucleotide
  Target: ATXN1; (+) strand; PAM type: NRG; PAM sequence: GAG
aaggcaaacaactggcaaga

SEQ ID NO: 109589 - DNA, 20 bp, Artificial Sequence
  Description of Artificial Sequence: Synthetic oligonucleotide
  Target: ATXN1; (+) strand; PAM type: NRG; PAM sequence: GAG
ggcaaacaactggcaagaga

SEQ ID NO: 109590 - DNA, 20 bp, Artificial Sequence
  Description of Artificial Sequence: Synthetic oligonucleotide
  Target: ATXN1; (+) strand; PAM type: NRG; PAM sequence: CAG
aactggcaagagagagtttt

SEQ ID NO: 109591 - DNA, 20 bp, Artificial Sequence
  Description of Artificial Sequence: Synthetic oligonucleotide
  Target: ATXN1; (+) strand; PAM type: NRG; PAM sequence: AGG
actggcaagagagagttttc

SEQ ID NO: 109592 - DNA, 20 bp, Artificial Sequence
  Description of Artificial Sequence: Synthetic oligonucleotide
  Target: ATXN1; (+) strand; PAM type: NRG; PAM sequence: AAG
ggcaagagagagttttcagg

SEQ ID NO: 109593 - DNA, 20 bp, Artificial Sequence
  Description of Artificial Sequence: Synthetic oligonucleotide
  Target: ATXN1; (+) strand; PAM type: NRG; PAM sequence: TGG
agagttttcaggaagaatgc

SEQ ID NO: 109594 - DNA, 20 bp, Artificial Sequence
  Description of Artificial Sequence: Synthetic oligonucleotide
  Target: ATXN1; (+) strand; PAM type: NRG; PAM sequence: TGG
ttcaggaagaatgctggctc

SEQ ID NO: 109595 - DNA, 20 bp, Artificial Sequence
  Description of Artificial Sequence: Synthetic oligonucleotide
  Target: ATXN1; (+) strand; PAM type: NRG; PAM sequence: AAG
aggaagaatgctggctctgg

SEQ ID NO: 109596 - DNA, 20 bp, Artificial Sequence
  Description of Artificial Sequence: Synthetic oligonucleotide
  Target: ATXN1; (+) strand; PAM type: NRG; PAM sequence: AGG
ggaagaatgctggctctgga

SEQ ID NO: 109597 - DNA, 20 bp, Artificial Sequence
  Description of Artificial Sequence: Synthetic oligonucleotide
  Target: ATXN1; (+) strand; PAM type: NRG; PAM sequence: CAG
agaatgctggctctggaagg

SEQ ID NO: 109598 - DNA, 20 bp, Artificial Sequence
  Description of Artificial Sequence: Synthetic oligonucleotide
  Target: ATXN1; (+) strand; PAM type: NRG; PAM sequence: CGG
atgctggctctggaaggcag

SEQ ID NO: 109599 - DNA, 20 bp, Artificial Sequence
  Description of Artificial Sequence: Synthetic oligonucleotide
  Target: ATXN1; (+) strand; PAM type: NRG; PAM sequence: AAG
ctggctctggaaggcagcgg

SEQ ID NO: 109600 - DNA, 20 bp, Artificial Sequence
  Description of Artificial Sequence: Synthetic oligonucleotide
  Target: ATXN1; (+) strand; PAM type: NRG; PAM sequence: AGG
tggctctggaaggcagcgga

SEQ ID NO: 109601 - DNA, 20 bp, Artificial Sequence
  Description of Artificial Sequence: Synthetic oligonucleotide
  Target: ATXN1; (+) strand; PAM type: NRG; PAM sequence: TGG
tggaaggcagcggaaggttc

SEQ ID NO: 109602 - DNA, 20 bp, Artificial Sequence
  Description of Artificial Sequence: Synthetic oligonucleotide
  Target: ATXN1; (+) strand; PAM type: NRG; PAM sequence: AAG
ggcagcggaaggttctggaa

SEQ ID NO: 109603 - DNA, 20 bp, Artificial Sequence
  Description of Artificial Sequence: Synthetic oligonucleotide
  Target: ATXN1; (+) strand; PAM type: NRG; PAM sequence: TAG
aagcaatgtgtcctatgaac

SEQ ID NO: 109604 - DNA, 20 bp, Artificial Sequence
  Description of Artificial Sequence: Synthetic oligonucleotide
  Target: ATXN1; (+) strand; PAM type: NRG; PAM sequence: AAG
gaactagacttttcacctgt

SEQ ID NO: 109605 - DNA, 20 bp, Artificial Sequence
  Description of Artificial Sequence: Synthetic oligonucleotide
  Target: ATXN1; (+) strand; PAM type: NRG; PAM sequence: TGG
agacttttcacctgtaagca

SEQ ID NO: 109606 - DNA, 20 bp, Artificial Sequence
  Description of Artificial Sequence: Synthetic oligonucleotide
  Target: ATXN1; (+) strand; PAM type: NRG; PAM sequence: CAG
cttttcacctgtaagcatgg

SEQ ID NO: 109607 - DNA, 20 bp, Artificial Sequence
  Description of Artificial Sequence: Synthetic oligonucleotide
  Target: ATXN1; (+) strand; PAM type: NRG; PAM sequence: AGG
ttttcacctgtaagcatggc

SEQ ID NO: 109608 - DNA, 20 bp, Artificial Sequence
  Description of Artificial Sequence: Synthetic oligonucleotide
  Target: ATXN1; (+) strand; PAM type: NRG; PAM sequence: AAG
tcacctgtaagcatggcagg

SEQ ID NO: 109609 - DNA, 20 bp, Artificial Sequence
  Description of Artificial Sequence: Synthetic oligonucleotide
  Target: ATXN1; (+) strand; PAM type: NRG; PAM sequence: GAG
acctgtaagcatggcaggaa

SEQ ID NO: 109610 - DNA, 20 bp, Artificial Sequence
  Description of Artificial Sequence: Synthetic oligonucleotide
  Target: ATXN1; (+) strand; PAM type: NRG; PAM sequence: AGG
cctgtaagcatggcaggaag

SEQ ID NO: 109611 - DNA, 20 bp, Artificial Sequence
  Description of Artificial Sequence: Synthetic oligonucleotide
  Target: ATXN1; (+) strand; PAM type: NRG; PAM sequence: AAG
atggcaggaagaggctgtgc

SEQ ID NO: 109612 - DNA, 20 bp, Artificial Sequence
  Description of Artificial Sequence: Synthetic oligonucleotide
  Target: ATXN1; (+) strand; PAM type: NRG; PAM sequence: AGG
tggcaggaagaggctgtgca

SEQ ID NO: 109613 - DNA, 20 bp, Artificial Sequence
  Description of Artificial Sequence: Synthetic oligonucleotide
  Target: ATXN1; (+) strand; PAM type: NRG; PAM sequence: TGG
caggaagaggctgtgcaagg

SEQ ID NO: 109614 - DNA, 20 bp, Artificial Sequence
  Description of Artificial Sequence: Synthetic oligonucleotide
  Target: ATXN1; (+) strand; PAM type: NRG; PAM sequence: TGG
gaagaggctgtgcaaggtgg

SEQ ID NO: 109615 - DNA, 20 bp, Artificial Sequence
  Description of Artificial Sequence: Synthetic oligonucleotide
  Target: ATXN1; (+) strand; PAM type: NRG; PAM sequence: CAG
tgcaaggtggtggatgacta

SEQ ID NO: 109616 - DNA, 20 bp, Artificial Sequence
  Description of Artificial Sequence: Synthetic oligonucleotide
  Target: ATXN1; (+) strand; PAM type: NRG; PAM sequence: AGG
gcaaggtggtggatgactac

SEQ ID NO: 109617 - DNA, 20 bp, Artificial Sequence
  Description of Artificial Sequence: Synthetic oligonucleotide
  Target: ATXN1; (+) strand; PAM type: NRG; PAM sequence: GGG
caaggtggtggatgactaca

SEQ ID NO: 109618 - DNA, 20 bp, Artificial Sequence
  Description of Artificial Sequence: Synthetic oligonucleotide
  Target: ATXN1; (+) strand; PAM type: NRG; PAM sequence: TGG
atgactacagggctttgttg

SEQ ID NO: 109619 - DNA, 20 bp, Artificial Sequence
  Description of Artificial Sequence: Synthetic oligonucleotide
  Target: ATXN1; (+) strand; PAM type: NRG; PAM sequence: CAG
cagggctttgttgtggactc

SEQ ID NO: 109620 - DNA, 20 bp, Artificial Sequence
  Description of Artificial Sequence: Synthetic oligonucleotide
  Target: ATXN1; (+) strand; PAM type: NRG; PAM sequence: AGG
agggctttgttgtggactcc

SEQ ID NO: 109621 - DNA, 20 bp, Artificial Sequence
  Description of Artificial Sequence: Synthetic oligonucleotide
  Target: ATXN1; (+) strand; PAM type: NRG; PAM sequence: CAG
tccaggcctctaatcccttt

SEQ ID NO: 109622 - DNA, 20 bp, Artificial Sequence
  Description of Artificial Sequence: Synthetic oligonucleotide
  Target: ATXN1; (+) strand; PAM type: NRG; PAM sequence: AAG
tttttatttctctgccctca

SEQ ID NO: 109623 - DNA, 20 bp, Artificial Sequence
  Description of Artificial Sequence: Synthetic oligonucleotide
  Target: ATXN1; (+) strand; PAM type: NRG; PAM sequence: CAG
atttctctgccctcaaagcc

SEQ ID NO: 109624 - DNA, 20 bp, Artificial Sequence
  Description of Artificial Sequence: Synthetic oligonucleotide
  Target: ATXN1; (+) strand; PAM type: NRG; PAM sequence: CAG
tctctgccctcaaagcccag

SEQ ID NO: 109625 - DNA, 20 bp, Artificial Sequence
  Description of Artificial Sequence: Synthetic oligonucleotide
  Target: ATXN1; (+) strand; PAM type: NRG; PAM sequence: TGG
gccctcaaagcccagcagcc

SEQ ID NO: 109626 - DNA, 20 bp, Artificial Sequence
  Description of Artificial Sequence: Synthetic oligonucleotide
  Target: ATXN1; (+) strand; PAM type: NRG; PAM sequence: GAG
cctcaaagcccagcagcctg

SEQ ID NO: 109627 - DNA, 20 bp, Artificial Sequence
  Description of Artificial Sequence: Synthetic oligonucleotide
  Target: ATXN1; (+) strand; PAM type: NRG; PAM sequence: AGG
ctcaaagcccagcagcctgg

SEQ ID NO: 109628 - DNA, 20 bp, Artificial Sequence
  Description of Artificial Sequence: Synthetic oligonucleotide
  Target: ATXN1; (+) strand; PAM type: NRG; PAM sequence: GGG
tcaaagcccagcagcctgga

SEQ ID NO: 109629 - DNA, 20 bp, Artificial Sequence
  Description of Artificial Sequence: Synthetic oligonucleotide
  Target: ATXN1; (+) strand; PAM type: NRG; PAM sequence: GGG
caaagcccagcagcctggag

SEQ ID NO: 109630 - DNA, 20 bp, Artificial Sequence
  Description of Artificial Sequence: Synthetic oligonucleotide
  Target: ATXN1; (+) strand; PAM type: NRG; PAM sequence: GAG
aagcccagcagcctggaggg

SEQ ID NO: 109631 - DNA, 20 bp, Artificial Sequence
  Description of Artificial Sequence: Synthetic oligonucleotide
  Target: ATXN1; (+) strand; PAM type: NRG; PAM sequence: AAG
cccagcagcctggaggggag

SEQ ID NO: 109632 - DNA, 20 bp, Artificial Sequence
  Description of Artificial Sequence: Synthetic oligonucleotide
  Target: ATXN1; (+) strand; PAM type: NRG; PAM sequence: AGG
ccagcagcctggaggggaga

SEQ ID NO: 109633 - DNA, 20 bp, Artificial Sequence
  Description of Artificial Sequence: Synthetic oligonucleotide
  Target: ATXN1; (+) strand; PAM type: NRG; PAM sequence: CAG
gcagcctggaggggagaagg

SEQ ID NO: 109634 - DNA, 20 bp, Artificial Sequence
  Description of Artificial Sequence: Synthetic oligonucleotide
  Target: ATXN1; (+) strand; PAM type: NRG; PAM sequence: CAG
gaaggcagtgcccttgactg

SEQ ID NO: 109635 - DNA, 20 bp, Artificial Sequence
  Description of Artificial Sequence: Synthetic oligonucleotide
  Target: ATXN1; (+) strand; PAM type: NRG; PAM sequence: TGG
tgcagcctgatgtttcctcc

SEQ ID NO: 109636 - DNA, 20 bp, Artificial Sequence
  Description of Artificial Sequence: Synthetic oligonucleotide
  Target: ATXN1; (+) strand; PAM type: NRG; PAM sequence: TGG
tgatgtttcctcctggcttc

SEQ ID NO: 109637 - DNA, 20 bp, Artificial Sequence
  Description of Artificial Sequence: Synthetic oligonucleotide
  Target: ATXN1; (+) strand; PAM type: NRG; PAM sequence: TGG
tgtttcctcctggcttctgg

SEQ ID NO: 109638 - DNA, 20 bp, Artificial Sequence
  Description of Artificial Sequence: Synthetic oligonucleotide
  Target: ATXN1; (+) strand; PAM type: NRG; PAM sequence: CGG
tcctggcttctggtggccta

SEQ ID NO: 109639 - DNA, 20 bp, Artificial Sequence
  Description of Artificial Sequence: Synthetic oligonucleotide
  Target: ATXN1; (+) strand; PAM type: NRG; PAM sequence: TAG
gcctacggtctcctttactg

SEQ ID NO: 109640 - DNA, 20 bp, Artificial Sequence
  Description of Artificial Sequence: Synthetic oligonucleotide
  Target: ATXN1; (+) strand; PAM type: NRG; PAM sequence: AGG
cctacggtctcctttactgt

SEQ ID NO: 109641 - DNA, 20 bp, Artificial Sequence
  Description of Artificial Sequence: Synthetic oligonucleotide
  Target: ATXN1; (+) strand; PAM type: NRG; PAM sequence: TGG
tctcctttactgtaggtttc

SEQ ID NO: 109642 - DNA, 20 bp, Artificial Sequence
  Description of Artificial Sequence: Synthetic oligonucleotide
  Target: ATXN1; (+) strand; PAM type: NRG; PAM sequence: GAG
tcctttactgtaggtttctg

SEQ ID NO: 109643 - DNA, 20 bp, Artificial Sequence
  Description of Artificial Sequence: Synthetic oligonucleotide
  Target: ATXN1; (+) strand; PAM type: NRG; PAM sequence: CAG
aggtttctggagcaaaaatc

SEQ ID NO: 109644 - DNA, 20 bp, Artificial Sequence
  Description of Artificial Sequence: Synthetic oligonucleotide
  Target: ATXN1; (+) strand; PAM type: NRG; PAM sequence: CAG
tttctggagcaaaaatccag

SEQ ID NO: 109645 - DNA, 20 bp, Artificial Sequence
  Description of Artificial Sequence: Synthetic oligonucleotide
  Target: ATXN1; (+) strand; PAM type: NRG; PAM sequence: CAG
tggagcaaaaatccagcagt

SEQ ID NO: 109646 - DNA, 20 bp, Artificial Sequence
  Description of Artificial Sequence: Synthetic oligonucleotide
  Target: ATXN1; (+) strand; PAM type: NRG; PAM sequence: AGG
ggagcaaaaatccagcagtc

SEQ ID NO: 109647 - DNA, 20 bp, Artificial Sequence
  Description of Artificial Sequence: Synthetic oligonucleotide
  Target: ATXN1; (+) strand; PAM type: NRG; PAM sequence: CAG
aaatccagcagtcaggttac

SEQ ID NO: 109648 - DNA, 20 bp, Artificial Sequence
  Description of Artificial Sequence: Synthetic oligonucleotide
  Target: ATXN1; (+) strand; PAM type: NRG; PAM sequence: AGG
aatccagcagtcaggttacc

SEQ ID NO: 109649 - DNA, 20 bp, Artificial Sequence
  Description of Artificial Sequence: Synthetic oligonucleotide
  Target: ATXN1; (+) strand; PAM type: NRG; PAM sequence: CAG
agcagtcaggttaccaggat

SEQ ID NO: 109650 - DNA, 20 bp, Artificial Sequence
  Description of Artificial Sequence: Synthetic oligonucleotide
  Target: ATXN1; (+) strand; PAM type: NRG; PAM sequence: TAG
agtgacaactatgcaataat

SEQ ID NO: 109651 - DNA, 20 bp, Artificial Sequence
  Description of Artificial Sequence: Synthetic oligonucleotide
  Target: ATXN1; (+) strand; PAM type: NRG; PAM sequence: AGG
gtgacaactatgcaataatt

SEQ ID NO: 109652 - DNA, 20 bp, Artificial Sequence
  Description of Artificial Sequence: Synthetic oligonucleotide
  Target: ATXN1; (+) strand; PAM type: NRG; PAM sequence: GGG
tgacaactatgcaataatta

SEQ ID NO: 109653 - DNA, 20 bp, Artificial Sequence
  Description of Artificial Sequence: Synthetic oligonucleotide
  Target: ATXN1; (+) strand; PAM type: NRG; PAM sequence: GGG
gacaactatgcaataattag

SEQ ID NO: 109654 - DNA, 20 bp, Artificial Sequence
  Description of Artificial Sequence: Synthetic oligonucleotide
  Target: ATXN1; (+) strand; PAM type: NRG; PAM sequence: CAG
aactatgcaataattagggg

SEQ ID NO: 109655 - DNA, 20 bp, Artificial Sequence
  Description of Artificial Sequence: Synthetic oligonucleotide
  Target: ATXN1; (+) strand; PAM type: NRG; PAM sequence: AGG
actatgcaataattaggggc

SEQ ID NO: 109656 - DNA, 20 bp, Artificial Sequence
  Description of Artificial Sequence: Synthetic oligonucleotide
  Target: ATXN1; (+) strand; PAM type: NRG; PAM sequence: CAG
caataattaggggcaggcac

SEQ ID NO: 109657 - DNA, 20 bp, Artificial Sequence
  Description of Artificial Sequence: Synthetic oligonucleotide
  Target: ATXN1; (+) strand; PAM type: NRG; PAM sequence: AGG
aataattaggggcaggcacc

SEQ ID NO: 109658 - DNA, 20 bp, Artificial Sequence
  Description of Artificial Sequence: Synthetic oligonucleotide
  Target: ATXN1; (+) strand; PAM type: NRG; PAM sequence: GAG
taattaggggcaggcaccag

SEQ ID NO: 109659 - DNA, 20 bp, Artificial Sequence
  Description of Artificial Sequence: Synthetic oligonucleotide
  Target: ATXN1; (+) strand; PAM type: NRG; PAM sequence: AGG
aattaggggcaggcaccagg

SEQ ID NO: 109660 - DNA, 20 bp, Artificial Sequence
  Description of Artificial Sequence: Synthetic oligonucleotide
  Target: ATXN1; (+) strand; PAM type: NRG; PAM sequence: CAG
taggggcaggcaccaggagg

SEQ ID NO: 109661 - DNA, 20 bp, Artificial Sequence
  Description of Artificial Sequence: Synthetic oligonucleotide
  Target: ATXN1; (+) strand; PAM type: NRG; PAM sequence: GAG
ggggcaggcaccaggaggca

SEQ ID NO: 109662 - DNA, 20 bp, Artificial Sequence
  Description of Artificial Sequence: Synthetic oligonucleotide
  Target: ATXN1; (+) strand; PAM type: NRG; PAM sequence: CAG
ggcaccaggaggcagagaaa

SEQ ID NO: 109663 - DNA, 20 bp, Artificial Sequence
  Description of Artificial Sequence: Synthetic oligonucleotide
  Target: ATXN1; (+) strand; PAM type: NRG; PAM sequence: GAG
caccaggaggcagagaaaca

SEQ ID NO: 109664 - DNA, 20 bp, Artificial Sequence
  Description of Artificial Sequence: Synthetic oligonucleotide
  Target: ATXN1; (+) strand; PAM type: NRG; PAM sequence: TGG
aggaggcagagaaacagagc

SEQ ID NO: 109665 - DNA, 20 bp, Artificial Sequence
  Description of Artificial Sequence: Synthetic oligonucleotide
  Target: ATXN1; (+) strand; PAM type: NRG; PAM sequence: GGG
ggaggcagagaaacagagct

SEQ ID NO: 109666 - DNA, 20 bp, Artificial Sequence
  Description of Artificial Sequence: Synthetic oligonucleotide
  Target: ATXN1; (+) strand; PAM type: NRG; PAM sequence: TGG
ggcagagaaacagagctggg

SEQ ID NO: 109667 - DNA, 20 bp, Artificial Sequence
  Description of Artificial Sequence: Synthetic oligonucleotide
  Target: ATXN1; (+) strand; PAM type: NRG; PAM sequence: CAG
agagaaacagagctgggtgg

SEQ ID NO: 109668 - DNA, 20 bp, Artificial Sequence
  Description of Artificial Sequence: Synthetic oligonucleotide
  Target: ATXN1; (+) strand; PAM type: NRG; PAM sequence: AAG
agaaactctatgatacccca

SEQ ID NO: 109669 - DNA, 20 bp, Artificial Sequence
  Description of Artificial Sequence: Synthetic oligonucleotide
  Target: ATXN1; (+) strand; PAM type: NRG; PAM sequence: AGG
gaaactctatgataccccaa

SEQ ID NO: 109670 - DNA, 20 bp, Artificial Sequence
  Description of Artificial Sequence: Synthetic oligonucleotide
  Target: ATXN1; (+) strand; PAM type: NRG; PAM sequence: CAG
aaggaaacatcaactcttct

SEQ ID NO: 109671 - DNA, 20 bp, Artificial Sequence
  Description of Artificial Sequence: Synthetic oligonucleotide
  Target: ATXN1; (+) strand; PAM type: NRG; PAM sequence: GAG
ggaaacatcaactcttctca

SEQ ID NO: 109672 - DNA, 20 bp, Artificial Sequence
  Description of Artificial Sequence: Synthetic oligonucleotide
  Target: ATXN1; (+) strand; PAM type: NRG; PAM sequence: AGG
gaaacatcaactcttctcag

SEQ ID NO: 109673 - DNA, 20 bp, Artificial Sequence
  Description of Artificial Sequence: Synthetic oligonucleotide
  Target: ATXN1; (+) strand; PAM type: NRG; PAM sequence: TGG
acatcaactcttctcagagg

SEQ ID NO: 109674 - DNA, 20 bp, Artificial Sequence
  Description of Artificial Sequence: Synthetic oligonucleotide
  Target: ATXN1; (+) strand; PAM type: NRG; PAM sequence: AAG
aactcttctcagaggtggtc

SEQ ID NO: 109675 - DNA, 20 bp, Artificial Sequence
  Description of Artificial Sequence: Synthetic oligonucleotide
  Target: ATXN1; (+) strand; PAM type: NRG; PAM sequence: CAG
agaggtggtcaagaacatgc

SEQ ID NO: 109676 - DNA, 20 bp, Artificial Sequence
  Description of Artificial Sequence: Synthetic oligonucleotide
  Target: ATXN1; (+) strand; PAM type: NRG; PAM sequence: AAG
ggtggtcaagaacatgccag

SEQ ID NO: 109677 - DNA, 20 bp, Artificial Sequence
  Description of Artificial Sequence: Synthetic oligonucleotide
  Target: ATXN1; (+) strand; PAM type: NRG; PAM sequence: TGG
tgccagaagctttgcctgcc

SEQ ID NO: 109678 - DNA, 20 bp, Artificial Sequence
  Description of Artificial Sequence: Synthetic oligonucleotide
  Target: ATXN1; (+) strand; PAM type: NRG; PAM sequence: TGG
agaagctttgcctgcctggt

SEQ ID NO: 109679 - DNA, 20 bp, Artificial Sequence
  Description of Artificial Sequence: Synthetic oligonucleotide
  Target: ATXN1; (+) strand; PAM type: NRG; PAM sequence: CAG
agctttgcctgcctggttgg

SEQ ID NO: 109680 - DNA, 20 bp, Artificial Sequence
  Description of Artificial Sequence: Synthetic oligonucleotide
  Target: ATXN1; (+) strand; PAM type: NRG; PAM sequence: CAG
tttgcctgcctggttggcag

SEQ ID NO: 109681 - DNA, 20 bp, Artificial Sequence
  Description of Artificial Sequence: Synthetic oligonucleotide
  Target: ATXN1; (+) strand; PAM type: NRG; PAM sequence: TGG
tgcctggttggcagcagaaa

SEQ ID NO: 109682 - DNA, 20 bp, Artificial Sequence
  Description of Artificial Sequence: Synthetic oligonucleotide
  Target: ATXN1; (+) strand; PAM type: NRG; PAM sequence: TAG
gttggcagcagaaatggcac

SEQ ID NO: 109683 - DNA, 20 bp, Artificial Sequence
  Description of Artificial Sequence: Synthetic oligonucleotide
  Target: ATXN1; (+) strand; PAM type: NRG; PAM sequence: CAG
gcagcagaaatggcactagc

SEQ ID NO: 109684 - DNA, 20 bp, Artificial Sequence
  Description of Artificial Sequence: Synthetic oligonucleotide
  Target: ATXN1; (+) strand; PAM type: NRG; PAM sequence: CAG
taaccttgctgccttcttta

SEQ ID NO: 109685 - DNA, 20 bp, Artificial Sequence
  Description of Artificial Sequence: Synthetic oligonucleotide
  Target: ATXN1; (+) strand; PAM type: NRG; PAM sequence: TGG
cttgctgccttctttacaga

SEQ ID NO: 109686 - DNA, 20 bp, Artificial Sequence
  Description of Artificial Sequence: Synthetic oligonucleotide
  Target: ATXN1; (+) strand; PAM type: NRG; PAM sequence: CAG
tctttacagatggctgctgt

SEQ ID NO: 109687 - DNA, 20 bp, Artificial Sequence
  Description of Artificial Sequence: Synthetic oligonucleotide
  Target: ATXN1; (+) strand; PAM type: NRG; PAM sequence: AGG
ctttacagatggctgctgtc

SEQ ID NO: 109688 - DNA, 20 bp, Artificial Sequence
  Description of Artificial Sequence: Synthetic oligonucleotide
  Target: ATXN1; (+) strand; PAM type: NRG; PAM sequence: TGG
tgctgtcaggctgtttaatt

SEQ ID NO: 109689 - DNA, 20 bp, Artificial Sequence
  Description of Artificial Sequence: Synthetic oligonucleotide
  Target: ATXN1; (+) strand; PAM type: NRG; PAM sequence: GAG
ctgtcaggctgtttaatttg

SEQ ID NO: 109690 - DNA, 20 bp, Artificial Sequence
  Description of Artificial Sequence: Synthetic oligonucleotide
  Target: ATXN1; (+) strand; PAM type: NRG; PAM sequence: AGG
tgtcaggctgtttaatttgg

SEQ ID NO: 109691 - DNA, 20 bp, Artificial Sequence
  Description of Artificial Sequence: Synthetic oligonucleotide
  Target: ATXN1; (+) strand; PAM type: NRG; PAM sequence: CAG
ggaggaaattccaatgtcat

SEQ ID NO: 109692 - DNA, 20 bp, Artificial Sequence
  Description of Artificial Sequence: Synthetic oligonucleotide
  Target: ATXN1; (+) strand; PAM type: NRG; PAM sequence: CAG
ggaaattccaatgtcatcag

SEQ ID NO: 109693 - DNA, 20 bp, Artificial Sequence
  Description of Artificial Sequence: Synthetic oligonucleotide
  Target: ATXN1; (+) strand; PAM type: NRG; PAM sequence: GAG
aaattccaatgtcatcagca

SEQ ID NO: 109694 - DNA, 20 bp, Artificial Sequence
  Description of Artificial Sequence: Synthetic oligonucleotide
  Target: ATXN1; (+) strand; PAM type: NRG; PAM sequence: TGG
caatgtcatcagcagagaca

SEQ ID NO: 109695 - DNA, 20 bp, Artificial Sequence
  Description of Artificial Sequence: Synthetic oligonucleotide
  Target: ATXN1; (+) strand; PAM type: NRG; PAM sequence: TGG
catcagcagagacatggcat

SEQ ID NO: 109696 - DNA, 20 bp, Artificial Sequence
  Description of Artificial Sequence: Synthetic oligonucleotide
  Target: ATXN1; (+) strand; PAM type: NRG; PAM sequence: GGG
atcagcagagacatggcatt

SEQ ID NO: 109697 - DNA, 20 bp, Artificial Sequence
  Description of Artificial Sequence: Synthetic oligonucleotide
  Target: ATXN1; (+) strand; PAM type: NRG; PAM sequence: GGG
tcagcagagacatggcattg

SEQ ID NO: 109698 - DNA, 20 bp, Artificial Sequence
  Description of Artificial Sequence: Synthetic oligonucleotide
  Target: ATXN1; (+) strand; PAM type: NRG; PAM sequence: GAG
agcagagacatggcattggg

SEQ ID NO: 109699 - DNA, 20 bp, Artificial Sequence
  Description of Artificial Sequence: Synthetic oligonucleotide
  Target: ATXN1; (+) strand; PAM type: NRG; PAM sequence: AGG
gcagagacatggcattgggg

SEQ ID NO: 109700 - DNA, 20 bp, Artificial Sequence
  Description of Artificial Sequence: Synthetic oligonucleotide
  Target: ATXN1; (+) strand; PAM type: NRG; PAM sequence: GGG
cagagacatggcattgggga

SEQ ID NO: 109701 - DNA, 20 bp, Artificial Sequence
  Description of Artificial Sequence: Synthetic oligonucleotide
  Target: ATXN1; (+) strand; PAM type: NRG; PAM sequence: AAG
tggcattggggagggctgcc

SEQ ID NO: 109702 - DNA, 20 bp, Artificial Sequence
  Description of Artificial Sequence: Synthetic oligonucleotide
  Target: ATXN1; (+) strand; PAM type: NRG; PAM sequence: AAG
ggggagggctgccaagcaca

SEQ ID NO: 109703 - DNA, 20 bp, Artificial Sequence
  Description of Artificial Sequence: Synthetic oligonucleotide
  Target: ATXN1; (+) strand; PAM type: NRG; PAM sequence: CAG
agggctgccaagcacaaaga

SEQ ID NO: 109704 - DNA, 20 bp, Artificial Sequence
  Description of Artificial Sequence: Synthetic oligonucleotide
  Target: ATXN1; (+) strand; PAM type: NRG; PAM sequence: TGG
ccaagcacaaagacagaact

SEQ ID NO: 109705 - DNA, 20 bp, Artificial Sequence
  Description of Artificial Sequence: Synthetic oligonucleotide
  Target: ATXN1; (+) strand; PAM type: NRG; PAM sequence: CAG
aagacagaacttggcttccc

SEQ ID NO: 109706 - DNA, 20 bp, Artificial Sequence
  Description of Artificial Sequence: Synthetic oligonucleotide
  Target: ATXN1; (+) strand; PAM type: NRG; PAM sequence: TGG
gcttccccagctgataccca

SEQ ID NO: 109707 - DNA, 20 bp, Artificial Sequence
  Description of Artificial Sequence: Synthetic oligonucleotide
  Target: ATXN1; (+) strand; PAM type: NRG; PAM sequence: CAG
ccagctgatacccatggata

SEQ ID NO: 109708 - DNA, 20 bp, Artificial Sequence
  Description of Artificial Sequence: Synthetic oligonucleotide
  Target: ATXN1; (+) strand; PAM type: NRG; PAM sequence: CAG
gatacccatggatacagaaa

SEQ ID NO: 109709 - DNA, 20 bp, Artificial Sequence
  Description of Artificial Sequence: Synthetic oligonucleotide
  Target: ATXN1; (+) strand; PAM type: NRG; PAM sequence: AGG
atacccatggatacagaaac

SEQ ID NO: 109710 - DNA, 20 bp, Artificial Sequence
  Description of Artificial Sequence: Synthetic oligonucleotide
  Target: ATXN1; (+) strand; PAM type: NRG; PAM sequence: TAG
ccatggatacagaaacaggc

SEQ ID NO: 109711 - DNA, 20 bp, Artificial Sequence
  Description of Artificial Sequence: Synthetic oligonucleotide
  Target: ATXN1; (+) strand; PAM type: NRG; PAM sequence: TAG
ggctagtcttaacaatcttt

SEQ ID NO: 109712 - DNA, 20 bp, Artificial Sequence
  Description of Artificial Sequence: Synthetic oligonucleotide
  Target: ATXN1; (+) strand; PAM type: NRG; PAM sequence: TAG
caatcttttagacctgacct

SEQ ID NO: 109713 - DNA, 20 bp, Artificial Sequence
  Description of Artificial Sequence: Synthetic oligonucleotide
  Target: ATXN1; (+) strand; PAM type: NRG; PAM sequence: TAG
tcttttagacctgaccttag

SEQ ID NO: 109714 - DNA, 20 bp, Artificial Sequence
  Description of Artificial Sequence: Synthetic oligonucleotide
  Target: ATXN1; (+) strand; PAM type: NRG; PAM sequence: TGG
acctgaccttagtagcaaac

SEQ ID NO: 109715 - DNA, 20 bp, Artificial Sequence
  Description of Artificial Sequence: Synthetic oligonucleotide
  Target: ATXN1; (+) strand; PAM type: NRG; PAM sequence: CAG
gtagcaaactggataactgc

SEQ ID NO: 109716 - DNA, 20 bp, Artificial Sequence
  Description of Artificial Sequence: Synthetic oligonucleotide
  Target: ATXN1; (+) strand; PAM type: NRG; PAM sequence: AAG
tggataactgccagtcataa

SEQ ID NO: 109717 - DNA, 20 bp, Artificial Sequence
  Description of Artificial Sequence: Synthetic oligonucleotide
  Target: ATXN1; (+) strand; PAM type: NRG; PAM sequence: AAG
cagtcataaaagtgtttcta

SEQ ID NO: 109718 - DNA, 20 bp, Artificial Sequence
  Description of Artificial Sequence: Synthetic oligonucleotide
  Target: ATXN1; (+) strand; PAM type: NRG; PAM sequence: TGG
tcataaaagtgtttctaaag

SEQ ID NO: 109719 - DNA, 20 bp, Artificial Sequence
  Description of Artificial Sequence: Synthetic oligonucleotide
  Target: ATXN1; (+) strand; PAM type: NRG; PAM sequence: TAG
ctgattttctcccctcctgt

SEQ ID NO: 109720 - DNA, 20 bp, Artificial Sequence
  Description of Artificial Sequence: Synthetic oligonucleotide
  Target: ATXN1; (+) strand; PAM type: NRG; PAM sequence: AGG
tgattttctcccctcctgtt

SEQ ID NO: 109721 - DNA, 20 bp, Artificial Sequence
  Description of Artificial Sequence: Synthetic oligonucleotide
  Target: ATXN1; (+) strand; PAM type: NRG; PAM sequence: TGG
ctcccctcctgttaggatcc

SEQ ID NO: 109722 - DNA, 20 bp, Artificial Sequence
  Description of Artificial Sequence: Synthetic oligonucleotide
  Target: ATXN1; (+) strand; PAM type: NRG; PAM sequence: TGG
cttgtaatgctatttatcaa

SEQ ID NO: 109723 - DNA, 20 bp, Artificial Sequence
  Description of Artificial Sequence: Synthetic oligonucleotide
  Target: ATXN1; (+) strand; PAM type: NRG; PAM sequence: CAG
attttgtgcttactgatgtg

SEQ ID NO: 109724 - DNA, 20 bp, Artificial Sequence
  Description of Artificial Sequence: Synthetic oligonucleotide
  Target: ATXN1; (+) strand; PAM type: NRG; PAM sequence: GAG
acccattctttttttttttt

SEQ ID NO: 109725 - DNA, 20 bp, Artificial Sequence
  Description of Artificial Sequence: Synthetic oligonucleotide
  Target: ATXN1; (+) strand; PAM type: NRG; PAM sequence: TGG
attcttttttttttttgaga

SEQ ID NO: 109726 - DNA, 20 bp, Artificial Sequence
  Description of Artificial Sequence: Synthetic oligonucleotide
  Target: ATXN1; (+) strand; PAM type: NRG; PAM sequence: GAG
tcttttttttttttgagatg

SEQ ID NO: 109727 - DNA, 20 bp, Artificial Sequence
  Description of Artificial Sequence: Synthetic oligonucleotide
  Target: ATXN1; (+) strand; PAM type: NRG; PAM sequence: TAG
tgagatggagttttgctcta

SEQ ID NO: 109728 - DNA, 20 bp, Artificial Sequence
  Description of Artificial Sequence: Synthetic oligonucleotide
  Target: ATXN1; (+) strand; PAM type: NRG; PAM sequence: CAG
tggagttttgctctatagcc

SEQ ID NO: 109729 - DNA, 20 bp, Artificial Sequence
  Description of Artificial Sequence: Synthetic oligonucleotide
  Target: ATXN1; (+) strand; PAM type: NRG; PAM sequence: AGG
ggagttttgctctatagccc

SEQ ID NO: 109730 - DNA, 20 bp, Artificial Sequence
  Description of Artificial Sequence: Synthetic oligonucleotide
  Target: ATXN1; (+) strand; PAM type: NRG; PAM sequence: TGG
ttttgctctatagcccaggt

SEQ ID NO: 109731 - DNA, 20 bp, Artificial Sequence
  Description of Artificial Sequence: Synthetic oligonucleotide
  Target: ATXN1; (+) strand; PAM type: NRG; PAM sequence: GAG
ttgctctatagcccaggttg

SEQ ID NO: 109732 - DNA, 20 bp, Artificial Sequence
  Description of Artificial Sequence: Synthetic oligonucleotide
  Target: ATXN1; (+) strand; PAM type: NRG; PAM sequence: AAG
ctatagcccaggttggagtg

SEQ ID NO: 109733 - DNA, 20 bp, Artificial Sequence
  Description of Artificial Sequence: Synthetic oligonucleotide
  Target: ATXN1; (+) strand; PAM type: NRG; PAM sequence: CGG
tagcccaggttggagtgaag

SEQ ID NO: 109734 - DNA, 20 bp, Artificial Sequence
  Description of Artificial Sequence: Synthetic oligonucleotide
  Target: ATXN1; (+) strand; PAM type: NRG; PAM sequence: TGG
ggagtgaagcggtgtaatct

SEQ ID NO: 109735 - DNA, 20 bp, Artificial Sequence
  Description of Artificial Sequence: Synthetic oligonucleotide
  Target: ATXN1; (+) strand; PAM type: NRG; PAM sequence: TAG
tccctgcaacctccgccttc

SEQ ID NO: 109736 - DNA, 20 bp, Artificial Sequence
  Description of Artificial Sequence: Synthetic oligonucleotide
  Target: ATXN1; (+) strand; PAM type: NRG; PAM sequence: AGG
ccctgcaacctccgccttct

SEQ ID NO: 109737 - DNA, 20 bp, Artificial Sequence
  Description of Artificial Sequence: Synthetic oligonucleotide
  Target: ATXN1; (+) strand; PAM type: NRG; PAM sequence: AAG
aacctccgccttctaggttc

SEQ ID NO: 109738 - DNA, 20 bp, Artificial Sequence
  Description of Artificial Sequence: Synthetic oligonucleotide
  Target: ATXN1; (+) strand; PAM type: NRG; PAM sequence: CAG
ttcaagcgattctcctgcct

SEQ ID NO: 109739 - DNA, 20 bp, Artificial Sequence
  Description of Artificial Sequence: Synthetic oligonucleotide
  Target: ATXN1; (+) strand; PAM type: NRG; PAM sequence: GAG
ttctcctgcctcagcctcct

SEQ ID NO: 109740 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcctgag

SEQ ID NO: 109741 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcctgagtagc

SEQ ID NO: 109742 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcctgagtagct

SEQ ID NO: 109743 - DNA, 20 bp, Artificial Sequence
  Description of Artificial Sequence: Synthetic oligonucleotide
  Target: ATXN1; (+) strand; PAM type: NRG; PAM sequence: CAG
ctcctgagtagctgggatta

SEQ ID NO: 109744 - DNA, 20 bp, Artificial Sequence
  Description of Artificial Sequence: Synthetic oligonucleotide
  Target: ATXN1; (+) strand; PAM type: NRG; PAM sequence: AGG
tcctgagtagctgggattac

SEQ ID NO: 109745 - DNA, 20 bp, Artificial Sequence
  Description of Artificial Sequence: Synthetic oligonucleotide
  Target: ATXN1; (+) strand; PAM type: NRG; PAM sequence: TGG
caggcgcccgccaccacacc

SEQ ID NO: 109746 - DNA, 20 bp, Artificial Sequence
  Description of Artificial Sequence: Synthetic oligonucleotide
  Target: ATXN1; (+) strand; PAM type: NRG; PAM sequence: TAG
ctggctaatttttgtatttt

SEQ ID NO: 109747 - DNA, 20 bp, Artificial Sequence
  Description of Artificial Sequence: Synthetic oligonucleotide
  Target: ATXN1; (+) strand; PAM type: NRG; PAM sequence: TAG
gctaatttttgtatttttag

SEQ ID NO: 109748 - DNA, 20 bp, Artificial Sequence
  Description of Artificial Sequence: Synthetic oligonucleotide
  Target: ATXN1; (+) strand; PAM type: NRG; PAM sequence: GAG
taatttttgtatttttagta

SEQ ID NO: 109749 - DNA, 20 bp, Artificial Sequence
  Description of Artificial Sequence: Synthetic oligonucleotide
  Target: ATXN1; (+) strand; PAM type: NRG; PAM sequence: CAG
ttttgtatttttagtagaga

SEQ ID NO: 109750 - DNA, 20 bp, Artificial Sequence
  Description of Artificial Sequence: Synthetic oligonucleotide
  Target: ATXN1; (+) strand; PAM type: NRG; PAM sequence: AGG
tttgtatttttagtagagac

SEQ ID NO: 109751 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagaca

SEQ ID NO: 109752 - DNA, 20 bp, Artificial Sequence
  Description of Artificial Sequence: Synthetic oligonucleotide
  Target: ATXN1; (+) strand; PAM type: NRG; PAM sequence: TAG
gagacagggtttcatcatgt

SEQ ID NO: 109753 - DNA, 20 bp, Artificial Sequence
  Description of Artificial Sequence: Synthetic oligonucleotide
  Target: ATXN1; (+) strand; PAM type: NRG; PAM sequence: AGG
agacagggtttcatcatgtt

SEQ ID NO: 109754 - DNA, 20 bp, Artificial Sequence
  Description of Artificial Sequence: Synthetic oligonucleotide
  Target: ATXN1; (+) strand; PAM type: NRG; PAM sequence: CAG
cagggtttcatcatgttagg

SEQ ID NO: 109755 - DNA, 20 bp, Artificial Sequence
  Description of Artificial Sequence: Synthetic oligonucleotide
  Target: ATXN1; (+) strand; PAM type: NRG; PAM sequence: AGG
agggtttcatcatgttaggc

SEQ ID NO: 109756 - DNA, 20 bp, Artificial Sequence
  Description of Artificial Sequence: Synthetic oligonucleotide
  Target: ATXN1; (+) strand; PAM type: NRG; PAM sequence: TGG
tttcatcatgttaggcaggc

SEQ ID NO: 109757 - DNA, 20 bp, Artificial Sequence
  Description of Artificial Sequence: Synthetic oligonucleotide
  Target: ATXN1; (+) strand; PAM type: NRG; PAM sequence: CAG
tggtctcgaactcctgacct

SEQ ID NO: 109758 - DNA, 20 bp, Artificial Sequence
  Description of Artificial Sequence: Synthetic oligonucleotide
  Target: ATXN1; (+) strand; PAM type: NRG; PAM sequence: AGG
ggtctcgaactcctgacctc

SEQ ID NO: 109759 - DNA, 20 bp, Artificial Sequence
  Description of Artificial Sequence: Synthetic oligonucleotide
  Target: ATXN1; (+) strand; PAM type: NRG; PAM sequence: TGG
ctcaggtgatccacccgctt

SEQ ID NO: 109760 - DNA, 20 bp, Artificial Sequence
  Description of Artificial Sequence: Synthetic oligonucleotide
  Target: ATXN1; (+) strand; PAM type: NRG; PAM sequence: AAG
ccacccgctttggcctccca

SEQ ID NO: 109761 - DNA, 20 bp, Artificial Sequence
  Description of Artificial Sequence: Synthetic oligonucleotide
  Target: ATXN1; (+) strand; PAM type: NRG; PAM sequence: TAG
gctttggcctcccaaagtgc

SEQ ID NO: 109762 - DNA, 20 bp, Artificial Sequence
  Description of Artificial Sequence: Synthetic oligonucleotide
  Target: ATXN1; (+) strand; PAM type: NRG; PAM sequence: AGG
ctttggcctcccaaagtgct

SEQ ID NO: 109763 - DNA, 20 bp, Artificial Sequence
  Description of Artificial Sequence: Synthetic oligonucleotide
  Target: ATXN1; (+) strand; PAM type: NRG; PAM sequence: TAG
gcctcccaaagtgctaggac

SEQ ID NO: 109764 - DNA, 20 bp, Artificial Sequence
  Description of Artificial Sequence: Synthetic oligonucleotide
  Target: ATXN1; (+) strand; PAM type: NRG; PAM sequence: GAG
ctcccaaagtgctaggacta

SEQ ID NO: 109765 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctaggactag

SEQ ID NO: 109766 - DNA, 20 bp, Artificial Sequence
  Description of Artificial Sequence: Synthetic oligonucleotide
  Target: ATXN1; (+) strand; PAM type: NRG; PAM sequence: GAG
agtgctaggactagaggcat

SEQ ID NO: 109767 - DNA, 20 bp, Artificial Sequence
  Description of Artificial Sequence: Synthetic oligonucleotide
  Target: ATXN1; (+) strand; PAM type: NRG; PAM sequence: AAG
ttctttatctctaaactcac

SEQ ID NO: 109768 - DNA, 20 bp, Artificial Sequence
  Description of Artificial Sequence: Synthetic oligonucleotide
  Target: ATXN1; (+) strand; PAM type: NRG; PAM sequence: CAG
ttatctctaaactcacaaga

SEQ ID NO: 109769 - DNA, 20 bp, Artificial Sequence
  Description of Artificial Sequence: Synthetic oligonucleotide
  Target: ATXN1; (+) strand; PAM type: NRG; PAM sequence: TGG
tctctaaactcacaagacag

SEQ ID NO: 109770 - DNA, 20 bp, Artificial Sequence
  Description of Artificial Sequence: Synthetic oligonucleotide
  Target: ATXN1; (+) strand; PAM type: NRG; PAM sequence: AAG
tcacaagacagtggttctca

SEQ ID NO: 109771 - DNA, 20 bp, Artificial Sequence
  Description of Artificial Sequence: Synthetic oligonucleotide
  Target: ATXN1; (+) strand; PAM type: NRG; PAM sequence: GAG
aagacagtggttctcaaagt

SEQ ID NO: 109772 - DNA, 20 bp, Artificial Sequence
  Description of Artificial Sequence: Synthetic oligonucleotide
  Target: ATXN1; (+) strand; PAM type: NRG; PAM sequence: CAG
ggttctcaaagtgagtcacc

SEQ ID NO: 109773 - DNA, 20 bp, Artificial Sequence
  Description of Artificial Sequence: Synthetic oligonucleotide
  Target: ATXN1; (+) strand; PAM type: NRG; PAM sequence: AGG
gttctcaaagtgagtcaccc

SEQ ID NO: 109774 - DNA, 20 bp, Artificial Sequence
  Description of Artificial Sequence: Synthetic oligonucleotide
  Target: ATXN1; (+) strand; PAM type: NRG; PAM sequence: GGG
ttctcaaagtgagtcaccca

SEQ ID NO: 109775 - DNA, 20 bp, Artificial Sequence
  Description of Artificial Sequence: Synthetic oligonucleotide
  Target: ATXN1; (+) strand; PAM type: NRG; PAM sequence: AAG
caaagtgagtcacccaggga

SEQ ID NO: 109776 - DNA, 20 bp, Artificial Sequence
  Description of Artificial Sequence: Synthetic oligonucleotide
  Target: ATXN1; (+) strand; PAM type: NRG; PAM sequence: CGG
agtgagtcacccagggaaag

SEQ ID NO: 109777 - DNA, 20 bp, Artificial Sequence
  Description of Artificial Sequence: Synthetic oligonucleotide
  Target: ATXN1; (+) strand; PAM type: NRG; PAM sequence: TGG
ttgttacaaatgcaaattct

SEQ ID NO: 109778 - DNA, 20 bp, Artificial Sequence
  Description of Artificial Sequence: Synthetic oligonucleotide
  Target: ATXN1; (+) strand; PAM type: NRG; PAM sequence: GGG
tgttacaaatgcaaattctt

SEQ ID NO: 109779 - DNA, 20 bp, Artificial Sequence
  Description of Artificial Sequence: Synthetic oligonucleotide
  Target: ATXN1; (+) strand; PAM type: NRG; PAM sequence: CAG
atgcaaattcttgggctttc

SEQ ID NO: 109780 - DNA, 20 bp, Artificial Sequence
  Description of Artificial Sequence: Synthetic oligonucleotide
  Target: ATXN1; (+) strand; PAM type: NRG; PAM sequence: AAG
ccagcaatctgtgtttgaac

SEQ ID NO: 109781 - DNA, 20 bp, Artificial Sequence
  Description of Artificial Sequence: Synthetic oligonucleotide
  Target: ATXN1; (+) strand; PAM type: NRG; PAM sequence: CAG
ctgtgtttgaacaagtcctc

SEQ ID NO: 109782 - DNA, 20 bp, Artificial Sequence
  Description of Artificial Sequence: Synthetic oligonucleotide
  Target: ATXN1; (+) strand; PAM type: NRG; PAM sequence: AGG
tgtgtttgaacaagtcctcc

SEQ ID NO: 109783 - DNA, 20 bp, Artificial Sequence
  Description of Artificial Sequence: Synthetic oligonucleotide
  Target: ATXN1; (+) strand; PAM type: NRG; PAM sequence: CAG
cccatgcacttgaaatttga

SEQ ID NO: 109784 - DNA, 20 bp, Artificial Sequence
  Description of Artificial Sequence: Synthetic oligonucleotide
  Target: ATXN1; (+) strand; PAM type: NRG; PAM sequence: AAG
aatttgacagtaactctcat

SEQ ID NO: 109785 - DNA, 20 bp, Artificial Sequence
  Description of Artificial Sequence: Synthetic oligonucleotide
  Target: ATXN1; (+) strand; PAM type: NRG; PAM sequence: GAG
tttgacagtaactctcataa

SEQ ID NO: 109786 - DNA, 20 bp, Artificial Sequence
  Description of Artificial Sequence: Synthetic oligonucleotide
  Target: ATXN1; (+) strand; PAM type: NRG; PAM sequence: AGG
ttgacagtaactctcataag

SEQ ID NO: 109787 - DNA, 20 bp, Artificial Sequence
  Description of Artificial Sequence: Synthetic oligonucleotide
  Target: ATXN1; (+) strand; PAM type: NRG; PAM sequence: TGG
aactctcataagaggtcaca

SEQ ID NO: 109788 - DNA, 20 bp, Artificial Sequence
  Description of Artificial Sequence: Synthetic oligonucleotide
  Target: ATXN1; (+) strand; PAM type: NRG; PAM sequence: AAG
aatgtaaacacaccaaaatg

SEQ ID NO: 109789 - DNA, 20 bp, Artificial Sequence
  Description of Artificial Sequence: Synthetic oligonucleotide
  Target: ATXN1; (+) strand; PAM type: NRG; PAM sequence: AAG
taaacacaccaaaatgaagt

SEQ ID NO: 109790 - DNA, 20 bp, Artificial Sequence
  Description of Artificial Sequence: Synthetic oligonucleotide
  Target: ATXN1; (+) strand; PAM type: NRG; PAM sequence: AAG
agtaagaaccattttctttt

SEQ ID NO: 109791 - DNA, 20 bp, Artificial Sequence
  Description of Artificial Sequence: Synthetic oligonucleotide
  Target: ATXN1; (+) strand; PAM type: NRG; PAM sequence: AAG
aagaaccattttcttttaag

SEQ ID NO: 109792 - DNA, 20 bp, Artificial Sequence
  Description of Artificial Sequence: Synthetic oligonucleotide
  Target: ATXN1; (+) strand; PAM type: NRG; PAM sequence: AAG
attttcttttaagaagtttc

SEQ ID NO: 109793 - DNA, 20 bp, Artificial Sequence
  Description of Artificial Sequence: Synthetic oligonucleotide
  Target: ATXN1; (+) strand; PAM type: NRG; PAM sequence: CAG
ttaagaagtttcaagacctt

SEQ ID NO: 109794 - DNA, 20 bp, Artificial Sequence
  Description of Artificial Sequence: Synthetic oligonucleotide
  Target: ATXN1; (+) strand; PAM type: NRG; PAM sequence: GAG
gaccttcagacattttattc

SEQ ID NO: 109795 - DNA, 20 bp, Artificial Sequence
  Description of Artificial Sequence: Synthetic oligonucleotide
  Target: ATXN1; (+) strand; PAM type: NRG; PAM sequence: AAG
ttttattcgagtaaattcat

SEQ ID NO: 109796 - DNA, 20 bp, Artificial Sequence
  Description of Artificial Sequence: Synthetic oligonucleotide
  Target: ATXN1; (+) strand; PAM type: NRG; PAM sequence: AAG
taaattcataagcaaaacac

SEQ ID NO: 109797 - DNA, 20 bp, Artificial Sequence
  Description of Artificial Sequence: Synthetic oligonucleotide
  Target: ATXN1; (+) strand; PAM type: NRG; PAM sequence: CAG
cttaataaatatgattttct

SEQ ID NO: 109798 - DNA, 20 bp, Artificial Sequence
  Description of Artificial Sequence: Synthetic oligonucleotide
  Target: ATXN1; (+) strand; PAM type: NRG; PAM sequence: CAG
gattttctcagacccactaa

SEQ ID NO: 109799 - DNA, 20 bp, Artificial Sequence
  Description of Artificial Sequence: Synthetic oligonucleotide
  Target: ATXN1; (+) strand; PAM type: NRG; PAM sequence: TAG
catgtttcacccacacaaaa

SEQ ID NO: 109800 - DNA, 20 bp, Artificial Sequence
  Description of Artificial Sequence: Synthetic oligonucleotide
  Target: ATXN1; (+) strand; PAM type: NRG; PAM sequence: CAG
gtatgacttacgaatgatca

SEQ ID NO: 109801 - DNA, 20 bp, Artificial Sequence
  Description of Artificial Sequence: Synthetic oligonucleotide
  Target: ATXN1; (+) strand; PAM type: NRG; PAM sequence: GAG
atgacttacgaatgatcaca

SEQ ID NO: 109802 - DNA, 20 bp, Artificial Sequence
  Description of Artificial Sequence: Synthetic oligonucleotide
  Target: ATXN1; (+) strand; PAM type: NRG; PAM sequence: AAG
acttacgaatgatcacagag

SEQ ID NO: 109803 - DNA, 20 bp, Artificial Sequence
  Description of Artificial Sequence: Synthetic oligonucleotide
  Target: ATXN1; (+) strand; PAM type: NRG; PAM sequence: CAG
atgatcacagagaagaatca

SEQ ID NO: 109804 - DNA, 20 bp, Artificial Sequence
  Description of Artificial Sequence: Synthetic oligonucleotide
  Target: ATXN1; (+) strand; PAM type: NRG; PAM sequence: TGG
atcacagagaagaatcacag

SEQ ID NO: 109805 - DNA, 20 bp, Artificial Sequence
  Description of Artificial Sequence: Synthetic oligonucleotide
  Target: ATXN1; (+) strand; PAM type: NRG; PAM sequence: TAG
ttgtatatatttattttttt

SEQ ID NO: 109806 - DNA, 20 bp, Artificial Sequence
  Description of Artificial Sequence: Synthetic oligonucleotide
  Target: ATXN1; (+) strand; PAM type: NRG; PAM sequence: GAG
gtatatatttatttttttta

SEQ ID NO: 109807 - DNA, 20 bp, Artificial Sequence
  Description of Artificial Sequence: Synthetic oligonucleotide
  Target: ATXN1; (+) strand; PAM type: NRG; PAM sequence: CAG
atatttattttttttagaga

SEQ ID NO: 109808 - DNA, 20 bp, Artificial Sequence
  Description of Artificial Sequence: Synthetic oligonucleotide
  Target: ATXN1; (+) strand; PAM type: NRG; PAM sequence: AGG
tatttattttttttagagac

SEQ ID NO: 109809 - DNA, 20 bp, Artificial Sequence
  Description of Artificial Sequence: Synthetic oligonucleotide
  Target: ATXN1; (+) strand; PAM type: NRG; PAM sequence: GGG
atttattttttttagagaca

SEQ ID NO: 109810 - DNA, 20 bp, Artificial Sequence
  Description of Artificial Sequence: Synthetic oligonucleotide
  Target: ATXN1; (+) strand; PAM type: NRG; PAM sequence: TGG
ttttagagacagggtctttc

SEQ ID NO: 109811 - DNA, 20 bp, Artificial Sequence
  Description of Artificial Sequence: Synthetic oligonucleotide
  Target: ATXN1; (+) strand; PAM type: NRG; PAM sequence: GGG
tttagagacagggtctttct

SEQ ID NO: 109812 - DNA, 20 bp, Artificial Sequence
  Description of Artificial Sequence: Synthetic oligonucleotide
  Target: ATXN1; (+) strand; PAM type: NRG; PAM sequence: TAG
gtctttctgggttacatcca

SEQ ID NO: 109813 - DNA, 20 bp, Artificial Sequence
  Description of Artificial Sequence: Synthetic oligonucleotide
  Target: ATXN1; (+) strand; PAM type: NRG; PAM sequence: CAG
gttacatccatagctcactg

SEQ ID NO: 109814 - DNA, 20 bp, Artificial Sequence
  Description of Artificial Sequence: Synthetic oligonucleotide
  Target: ATXN1; (+) strand; PAM type: NRG; PAM sequence: TGG
tcactgcagcctcaaactcc

SEQ ID NO: 109815 - DNA, 20 bp, Artificial Sequence
  Description of Artificial Sequence: Synthetic oligonucleotide
  Target: ATXN1; (+) strand; PAM type: NRG; PAM sequence: GGG
cactgcagcctcaaactcct

SEQ ID NO: 109816 - DNA, 20 bp, Artificial Sequence
  Description of Artificial Sequence: Synthetic oligonucleotide
  Target: ATXN1; (+) strand; PAM type: NRG; PAM sequence: AAG
agcctcaaactcctgggctc

SEQ ID NO: 109817 - DNA, 20 bp, Artificial Sequence
  Description of Artificial Sequence: Synthetic oligonucleotide
  Target: ATXN1; (+) strand; PAM type: NRG; PAM sequence: CAG
ctcaagcaatcctcccacat

SEQ ID NO: 109818 - DNA, 20 bp, Artificial Sequence
  Description of Artificial Sequence: Synthetic oligonucleotide
  Target: ATXN1; (+) strand; PAM type: NRG; PAM sequence: GAG
tcctcccacatcagcctcct

SEQ ID NO: 109819 - DNA, 20 bp, Artificial Sequence
  Description of Artificial Sequence: Synthetic oligonucleotide
  Target: ATXN1; (+) strand; PAM type: NRG; PAM sequence: TAG
tcccacatcagcctcctgag

SEQ ID NO: 109820 - DNA, 20 bp, Artificial Sequence
  Description of Artificial Sequence: Synthetic oligonucleotide
  Target: ATXN1; (+) strand; PAM type: NRG; PAM sequence: AAG
catcagcctcctgagtagct

SEQ ID NO: 109821 - DNA, 20 bp, Artificial Sequence
  Description of Artificial Sequence: Synthetic oligonucleotide
  Target: ATXN1; (+) strand; PAM type: NRG; PAM sequence: CAG
ctcctgagtagctaagacta

SEQ ID NO: 109822 - DNA, 20 bp, Artificial Sequence
  Description of Artificial Sequence: Synthetic oligonucleotide
  Target: ATXN1; (+) strand; PAM type: NRG; PAM sequence: GAG
cctgagtagctaagactaca

SEQ ID NO: 109823 - DNA, 20 bp, Artificial Sequence
  Description of Artificial Sequence: Synthetic oligonucleotide
  Target: ATXN1; (+) strand; PAM type: NRG; PAM sequence: CGG
cagagatgtacaaccatacc

SEQ ID NO: 109824 - DNA, 20 bp, Artificial Sequence
  Description of Artificial Sequence: Synthetic oligonucleotide
  Target: ATXN1; (+) strand; PAM type: NRG; PAM sequence: TAG
ctaatttttaaatttttttg

SEQ ID NO: 109825 - DNA, 20 bp, Artificial Sequence
  Description of Artificial Sequence: Synthetic oligonucleotide
  Target: ATXN1; (+) strand; PAM type: NRG; PAM sequence: GAG
aatttttaaatttttttgta

SEQ ID NO: 109826 - DNA, 20 bp, Artificial Sequence
  Description of Artificial Sequence: Synthetic oligonucleotide
  Target: ATXN1; (+) strand; PAM type: NRG; PAM sequence: GAG
tttttaaatttttttgtaga

SEQ ID NO: 109827 - DNA, 20 bp, Artificial Sequence
  Description of Artificial Sequence: Synthetic oligonucleotide
  Target: ATXN1; (+) strand; PAM type: NRG; PAM sequence: AGG
ttttaaatttttttgtagag

SEQ ID NO: 109828 - DNA, 20 bp, Artificial Sequence
  Description of Artificial Sequence: Synthetic oligonucleotide
  Target: ATXN1; (+) strand; PAM type: NRG; PAM sequence: GAG
ttaaatttttttgtagagag

SEQ ID NO: 109829 - DNA, 20 bp, Artificial Sequence
  Description of Artificial Sequence: Synthetic oligonucleotide
  Target: ATXN1; (+) strand; PAM type: NRG; PAM sequence: CAG
aggagttttgcttttttgcc

SEQ ID NO: 109830 - DNA, 20 bp, Artificial Sequence
  Description of Artificial Sequence: Synthetic oligonucleotide
  Target: ATXN1; (+) strand; PAM type: NRG; PAM sequence: AGG
ggagttttgcttttttgccc

SEQ ID NO: 109831 - DNA, 20 bp, Artificial Sequence
  Description of Artificial Sequence: Synthetic oligonucleotide
  Target: ATXN1; (+) strand; PAM type: NRG; PAM sequence: CGG
ttttgcttttttgcccaggc

SEQ ID NO: 109832 - DNA, 20 bp, Artificial Sequence
  Description of Artificial Sequence: Synthetic oligonucleotide
  Target: ATXN1; (+) strand; PAM type: NRG; PAM sequence: AAG
ggtcttgaattcctgacctc

SEQ ID NO: 109833 - DNA, 20 bp, Artificial Sequence
  Description of Artificial Sequence: Synthetic oligonucleotide
  Target: ATXN1; (+) strand; PAM type: NRG; PAM sequence: TGG
ctcaagtgatcttcctacct

SEQ ID NO: 109834 - DNA, 20 bp, Artificial Sequence
  Description of Artificial Sequence: Synthetic oligonucleotide
  Target: ATXN1; (+) strand; PAM type: NRG; PAM sequence: AAG
cttcctaccttggccttcca

SEQ ID NO: 109835 - DNA, 20 bp, Artificial Sequence
  Description of Artificial Sequence: Synthetic oligonucleotide
  Target: ATXN1; (+) strand; PAM type: NRG; PAM sequence: TGG
accttggccttccaaagtgt

SEQ ID NO: 109836 - DNA, 20 bp, Artificial Sequence
  Description of Artificial Sequence: Synthetic oligonucleotide
  Target: ATXN1; (+) strand; PAM type: NRG; PAM sequence: TAG
cttccaaagtgttggaattg

SEQ ID NO: 109837 - DNA, 20 bp, Artificial Sequence
  Description of Artificial Sequence: Synthetic oligonucleotide
  Target: ATXN1; (+) strand; PAM type: NRG; PAM sequence: AGG
ttccaaagtgttggaattgt

SEQ ID NO: 109838 - DNA, 20 bp, Artificial Sequence
  Description of Artificial Sequence: Synthetic oligonucleotide
  Target: ATXN1; (+) strand; PAM type: NRG; PAM sequence: TGG
gtaggtgtgaaccatcatga

SEQ ID NO: 109839 - DNA, 20 bp, Artificial Sequence
  Description of Artificial Sequence: Synthetic oligonucleotide
  Target: ATXN1; (+) strand; PAM type: NRG; PAM sequence: TAG
tgaaccatcatgatggttca

SEQ ID NO: 109840 - DNA, 20 bp, Artificial Sequence
  Description of Artificial Sequence: Synthetic oligonucleotide
  Target: ATXN1; (+) strand; PAM type: NRG; PAM sequence: GAG
ccatcatgatggttcatagt

SEQ ID NO: 109841 - DNA, 20 bp, Artificial Sequence
  Description of Artificial Sequence: Synthetic oligonucleotide
  Target: ATXN1; (+) strand; PAM type: NRG; PAM sequence: TAG
atggttcatagtgagttgtt

SEQ ID NO: 109842 - DNA, 20 bp, Artificial Sequence
  Description of Artificial Sequence: Synthetic oligonucleotide
  Target: ATXN1; (+) strand; PAM type: NRG; PAM sequence: CAG
ccaaattcatgacatatgac

SEQ ID NO: 109843 - DNA, 20 bp, Artificial Sequence
  Description of Artificial Sequence: Synthetic oligonucleotide
  Target: ATXN1; (+) strand; PAM type: NRG; PAM sequence: CAG
cagtgtgtctgaatacatac

SEQ ID NO: 109844 - DNA, 20 bp, Artificial Sequence
  Description of Artificial Sequence: Synthetic oligonucleotide
  Target: ATXN1; (+) strand; PAM type: NRG; PAM sequence: TGG
tgaatacataccagtgttta

SEQ ID NO: 109845 - DNA, 20 bp, Artificial Sequence
  Description of Artificial Sequence: Synthetic oligonucleotide
  Target: ATXN1; (+) strand; PAM type: NRG; PAM sequence: AAG
gtttatggcactgacgtttt

SEQ ID NO: 109846 - DNA, 20 bp, Artificial Sequence
  Description of Artificial Sequence: Synthetic oligonucleotide
  Target: ATXN1; (+) strand; PAM type: NRG; PAM sequence: CGG
ctgacgttttaagtcctgtt

SEQ ID NO: 109847 - DNA, 20 bp, Artificial Sequence
  Description of Artificial Sequence: Synthetic oligonucleotide
  Target: ATXN1; (+) strand; PAM type: NRG; PAM sequence: TAG
gaaacacaaaatgcactact

SEQ ID NO: 109848 - DNA, 20 bp, Artificial Sequence
  Description of Artificial Sequence: Synthetic oligonucleotide
  Target: ATXN1; (+) strand; PAM type: NRG; PAM sequence: TAG
taattttaaaatatgctttt

SEQ ID NO: 109849 - DNA, 20 bp, Artificial Sequence
  Description of Artificial Sequence: Synthetic oligonucleotide
  Target: ATXN1; (+) strand; PAM type: NRG; PAM sequence: AGG
aattttaaaatatgcttttt

SEQ ID NO: 109850 - DNA, 20 bp, Artificial Sequence
  Description of Artificial Sequence: Synthetic oligonucleotide
  Target: ATXN1; (+) strand; PAM type: NRG; PAM sequence: CAG
ttaaaatatgctttttaggc

SEQ ID NO: 109851 - DNA, 20 bp, Artificial Sequence
  Description of Artificial Sequence: Synthetic oligonucleotide
  Target: ATXN1; (+) strand; PAM type: NRG; PAM sequence: CAG
tatgctttttaggccagacg

SEQ ID NO: 109852 - DNA, 20 bp, Artificial Sequence
  Description of Artificial Sequence: Synthetic oligonucleotide
  Target: ATXN1; (+) strand; PAM type: NRG; PAM sequence: TGG
gctttttaggccagacgcag

SEQ ID NO: 109853 - DNA, 20 bp, Artificial Sequence
  Description of Artificial Sequence: Synthetic oligonucleotide
  Target: ATXN1; (+) strand; PAM type: NRG; PAM sequence: CAG
gtggctcacacctgtaatcc

SEQ ID NO: 109854 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatcccagcactt

SEQ ID NO: 109855 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccagcacttt

SEQ ID NO: 109856 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 109857 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 109858 - DNA, 20 bp, Artificial Sequence
  Description of Artificial Sequence: Synthetic oligonucleotide
  Target: ATXN1; (+) strand; PAM type: NRG; PAM sequence: AAG
tcccagcactttgggaggcc

SEQ ID NO: 109859 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggcca

SEQ ID NO: 109860 - DNA, 20 bp, Artificial Sequence
  Description of Artificial Sequence: Synthetic oligonucleotide
  Target: ATXN1; (+) strand; PAM type: NRG; PAM sequence: TGG
agcactttgggaggccaagg

SEQ ID NO: 109861 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccaaggt

SEQ ID NO: 109862 - DNA, 20 bp, Artificial Sequence
  Description of Artificial Sequence: Synthetic oligonucleotide
  Target: ATXN1; (+) strand; PAM type: NRG; PAM sequence: GAG
actttgggaggccaaggtgg

SEQ ID NO: 109863 - DNA, 20 bp, Artificial Sequence
  Description of Artificial Sequence: Synthetic oligonucleotide
  Target: ATXN1; (+) strand; PAM type: NRG; PAM sequence: AGG
ctttgggaggccaaggtggg

SEQ ID NO: 109864 - DNA, 20 bp, Artificial Sequence
  Description of Artificial Sequence: Synthetic oligonucleotide
  Target: ATXN1; (+) strand; PAM type: NRG; PAM sequence: GAG
ggccaaggtgggaggatcac

SEQ ID NO: 109865 - DNA, 20 bp, Artificial Sequence
  Description of Artificial Sequence: Synthetic oligonucleotide
  Target: ATXN1; (+) strand; PAM type: NRG; PAM sequence: AGG
gccaaggtgggaggatcacg

SEQ ID NO: 109866 - DNA, 20 bp, Artificial Sequence
  Description of Artificial Sequence: Synthetic oligonucleotide
  Target: ATXN1; (+) strand; PAM type: NRG; PAM sequence: CAG
aggtgggaggatcacgaggt

SEQ ID NO: 109867 - DNA, 20 bp, Artificial Sequence
  Description of Artificial Sequence: Synthetic oligonucleotide
  Target: ATXN1; (+) strand; PAM type: NRG; PAM sequence: AGG
ggtgggaggatcacgaggtc

SEQ ID NO: 109868 - DNA, 20 bp, Artificial Sequence
  Description of Artificial Sequence: Synthetic oligonucleotide
  Target: ATXN1; (+) strand; PAM type: NRG; PAM sequence: GAG
tgggaggatcacgaggtcag

SEQ ID NO: 109869 - DNA, 20 bp, Artificial Sequence
  Description of Artificial Sequence: Synthetic oligonucleotide
  Target: ATXN1; (+) strand; PAM type: NRG; PAM sequence: AAG
gatcacgaggtcaggagttc

SEQ ID NO: 109870 - DNA, 20 bp, Artificial Sequence
  Description of Artificial Sequence: Synthetic oligonucleotide
  Target: ATXN1; (+) strand; PAM type: NRG; PAM sequence: CAG
cgaggtcaggagttcaagac

SEQ ID NO: 109871 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcaagaccagtc

SEQ ID NO: 109872 - DNA, 20 bp, Artificial Sequence
  Description of Artificial Sequence: Synthetic oligonucleotide
  Target: ATXN1; (+) strand; PAM type: NRG; PAM sequence: CAG
caagaccagtctggccaaca

SEQ ID NO: 109873 - DNA, 20 bp, Artificial Sequence
  Description of Artificial Sequence: Synthetic oligonucleotide
  Target: ATXN1; (+) strand; PAM type: NRG; PAM sequence: AAG
atcttgtctgtattacaata

SEQ ID NO: 109874 - DNA, 20 bp, Artificial Sequence
  Description of Artificial Sequence: Synthetic oligonucleotide
  Target: ATXN1; (+) strand; PAM type: NRG; PAM sequence: TGG
agtgtaataccttttcaaca

SEQ ID NO: 109875 - DNA, 20 bp, Artificial Sequence
  Description of Artificial Sequence: Synthetic oligonucleotide
  Target: ATXN1; (+) strand; PAM type: NRG; PAM sequence: GGG
gtgtaataccttttcaacat

SEQ ID NO: 109876 - DNA, 20 bp, Artificial Sequence
  Description of Artificial Sequence: Synthetic oligonucleotide
  Target: ATXN1; (+) strand; PAM type: NRG; PAM sequence: TGG
ttcaacatgggattctaaca

SEQ ID NO: 109877 - DNA, 20 bp, Artificial Sequence
  Description of Artificial Sequence: Synthetic oligonucleotide
  Target: ATXN1; (+) strand; PAM type: NRG; PAM sequence: TAG
taattcgtgcctccctcccc

SEQ ID NO: 109878 - DNA, 20 bp, Artificial Sequence
  Description of Artificial Sequence: Synthetic oligonucleotide
  Target: ATXN1; (+) strand; PAM type: NRG; PAM sequence: TGG
ccctagttttaacctatgct

SEQ ID NO: 109879 - DNA, 20 bp, Artificial Sequence
  Description of Artificial Sequence: Synthetic oligonucleotide
  Target: ATXN1; (+) strand; PAM type: NRG; PAM sequence: TGG
tatgcttggtccaaatatca

SEQ ID NO: 109880 - DNA, 20 bp, Artificial Sequence
  Description of Artificial Sequence: Synthetic oligonucleotide
  Target: ATXN1; (+) strand; PAM type: NRG; PAM sequence: GGG
atgcttggtccaaatatcat

SEQ ID NO: 109881 - DNA, 20 bp, Artificial Sequence
  Description of Artificial Sequence: Synthetic oligonucleotide
  Target: ATXN1; (+) strand; PAM type: NRG; PAM sequence: TGG
atcatgggtctatgtttctg

SEQ ID NO: 109882 - DNA, 20 bp, Artificial Sequence
  Description of Artificial Sequence: Synthetic oligonucleotide
  Target: ATXN1; (+) strand; PAM type: NRG; PAM sequence: AAG
ggtctatgtttctgtggtct

SEQ ID NO: 109883 - DNA, 20 bp, Artificial Sequence
  Description of Artificial Sequence: Synthetic oligonucleotide
  Target: ATXN1; (+) strand; PAM type: NRG; PAM sequence: AAG
gtggtctaagacacttcttt

SEQ ID NO: 109884 - DNA, 20 bp, Artificial Sequence
  Description of Artificial Sequence: Synthetic oligonucleotide
  Target: ATXN1; (+) strand; PAM type: NRG; PAM sequence: AAG
ctaagacacttctttaagat

SEQ ID NO: 109885 - DNA, 20 bp, Artificial Sequence
  Description of Artificial Sequence: Synthetic oligonucleotide
  Target: ATXN1; (+) strand; PAM type: NRG; PAM sequence: TAG
cccgatgcctaacacacatc

SEQ ID NO: 109886 - DNA, 20 bp, Artificial Sequence
  Description of Artificial Sequence: Synthetic oligonucleotide
  Target: ATXN1; (+) strand; PAM type: NRG; PAM sequence: AGG
ccgatgcctaacacacatct

SEQ ID NO: 109887 - DNA, 20 bp, Artificial Sequence
  Description of Artificial Sequence: Synthetic oligonucleotide
  Target: ATXN1; (+) strand; PAM type: NRG; PAM sequence: GAG
gatgcctaacacacatctag

SEQ ID NO: 109888 - DNA, 20 bp, Artificial Sequence
  Description of Artificial Sequence: Synthetic oligonucleotide
  Target: ATXN1; (+) strand; PAM type: NRG; PAM sequence: AAG
cctaacacacatctaggagt

SEQ ID NO: 109889 - DNA, 20 bp, Artificial Sequence
  Description of Artificial Sequence: Synthetic oligonucleotide
  Target: ATXN1; (+) strand; PAM type: NRG; PAM sequence: TGG
agttaacaattctgaaatac

SEQ ID NO: 109890 - DNA, 20 bp, Artificial Sequence
  Description of Artificial Sequence: Synthetic oligonucleotide
  Target: ATXN1; (+) strand; PAM type: NRG; PAM sequence: TGG
ttctgaaatactggtttctt

SEQ ID NO: 109891 - DNA, 20 bp, Artificial Sequence
  Description of Artificial Sequence: Synthetic oligonucleotide
  Target: ATXN1; (+) strand; PAM type: NRG; PAM sequence: TAG
atactggtttctttggcttt

SEQ ID NO: 109892 - DNA, 20 bp, Artificial Sequence
  Description of Artificial Sequence: Synthetic oligonucleotide
  Target: ATXN1; (+) strand; PAM type: NRG; PAM sequence: TGG
tttagacctgttgattgttt

SEQ ID NO: 109893 - DNA, 20 bp, Artificial Sequence
  Description of Artificial Sequence: Synthetic oligonucleotide
  Target: ATXN1; (+) strand; PAM type: NRG; PAM sequence: AAG
tgttgattgttttggttata

SEQ ID NO: 109894 - DNA, 20 bp, Artificial Sequence
  Description of Artificial Sequence: Synthetic oligonucleotide
  Target: ATXN1; (+) strand; PAM type: NRG; PAM sequence: AGG
gttgattgttttggttataa

SEQ ID NO: 109895 - DNA, 20 bp, Artificial Sequence
  Description of Artificial Sequence: Synthetic oligonucleotide
  Target: ATXN1; (+) strand; PAM type: NRG; PAM sequence: TAG
tttccttctgtgttcctaac

SEQ ID NO: 109896 - DNA, 20 bp, Artificial Sequence
  Description of Artificial Sequence: Synthetic oligonucleotide
  Target: ATXN1; (+) strand; PAM type: NRG; PAM sequence: AGG
ttccttctgtgttcctaact

SEQ ID NO: 109897 - DNA, 20 bp, Artificial Sequence
  Description of Artificial Sequence: Synthetic oligonucleotide
  Target: ATXN1; (+) strand; PAM type: NRG; PAM sequence: GAG
gtgttcctaactaggcctct

SEQ ID NO: 109898 - DNA, 20 bp, Artificial Sequence
  Description of Artificial Sequence: Synthetic oligonucleotide
  Target: ATXN1; (+) strand; PAM type: NRG; PAM sequence: TGG
gagtctccactgtcaaaatg

SEQ ID NO: 109899 - DNA, 20 bp, Artificial Sequence
  Description of Artificial Sequence: Synthetic oligonucleotide
  Target: ATXN1; (+) strand; PAM type: NRG; PAM sequence: CAG
actgtcaaaatgtggctgat

SEQ ID NO: 109900 - DNA, 20 bp, Artificial Sequence
  Description of Artificial Sequence: Synthetic oligonucleotide
  Target: ATXN1; (+) strand; PAM type: NRG; PAM sequence: TAG
aaatgtggctgatcagactt

SEQ ID NO: 109901 - DNA, 20 bp, Artificial Sequence
  Description of Artificial Sequence: Synthetic oligonucleotide
  Target: ATXN1; (+) strand; PAM type: NRG; PAM sequence: AGG
aatgtggctgatcagacttt

SEQ ID NO: 109902 - DNA, 20 bp, Artificial Sequence
  Description of Artificial Sequence: Synthetic oligonucleotide
  Target: ATXN1; (+) strand; PAM type: NRG; PAM sequence: TGG
ctcacctcaacctgtgatta

SEQ ID NO: 109903 - DNA, 20 bp, Artificial Sequence
  Description of Artificial Sequence: Synthetic oligonucleotide
  Target: ATXN1; (+) strand; PAM type: NRG; PAM sequence: AAG
acctcaacctgtgattatgg

SEQ ID NO: 109904 - DNA, 20 bp, Artificial Sequence
  Description of Artificial Sequence: Synthetic oligonucleotide
  Target: ATXN1; (+) strand; PAM type: NRG; PAM sequence: AGG
cctcaacctgtgattatgga

SEQ ID NO: 109905 - DNA, 20 bp, Artificial Sequence
  Description of Artificial Sequence: Synthetic oligonucleotide
  Target: ATXN1; (+) strand; PAM type: NRG; PAM sequence: AAG
caacctgtgattatggaagg

SEQ ID NO: 109906 - DNA, 20 bp, Artificial Sequence
  Description of Artificial Sequence: Synthetic oligonucleotide
  Target: ATXN1; (+) strand; PAM type: NRG; PAM sequence: CAG
tgtgattatggaaggaagta

SEQ ID NO: 109907 - DNA, 20 bp, Artificial Sequence
  Description of Artificial Sequence: Synthetic oligonucleotide
  Target: ATXN1; (+) strand; PAM type: NRG; PAM sequence: AGG
gtgattatggaaggaagtac

SEQ ID NO: 109908 - DNA, 20 bp, Artificial Sequence
  Description of Artificial Sequence: Synthetic oligonucleotide
  Target: ATXN1; (+) strand; PAM type: NRG; PAM sequence: CGG
gacatcttaacactccttcc

SEQ ID NO: 109909 - DNA, 20 bp, Artificial Sequence
  Description of Artificial Sequence: Synthetic oligonucleotide
  Target: ATXN1; (+) strand; PAM type: NRG; PAM sequence: GAG
cggtcacgtgcatcatgaat

SEQ ID NO: 109910 - DNA, 20 bp, Artificial Sequence
  Description of Artificial Sequence: Synthetic oligonucleotide
  Target: ATXN1; (+) strand; PAM type: NRG; PAM sequence: CGG
ttcaatcttttgttctccac

SEQ ID NO: 109911 - DNA, 20 bp, Artificial Sequence
  Description of Artificial Sequence: Synthetic oligonucleotide
  Target: ATXN1; (+) strand; PAM type: NRG; PAM sequence: AAG
ccattttttcccgaaccctt

SEQ ID NO: 109912 - DNA, 20 bp, Artificial Sequence
  Description of Artificial Sequence: Synthetic oligonucleotide
  Target: ATXN1; (+) strand; PAM type: NRG; PAM sequence: AGG
cattttttcccgaaccctta

SEQ ID NO: 109913 - DNA, 20 bp, Artificial Sequence
  Description of Artificial Sequence: Synthetic oligonucleotide
  Target: ATXN1; (+) strand; PAM type: NRG; PAM sequence: TAG
ttttcccgaacccttaagga

SEQ ID NO: 109914 - DNA, 20 bp, Artificial Sequence
  Description of Artificial Sequence: Synthetic oligonucleotide
  Target: ATXN1; (+) strand; PAM type: NRG; PAM sequence: TAG
cccgaacccttaaggataga

SEQ ID NO: 109915 - DNA, 20 bp, Artificial Sequence
  Description of Artificial Sequence: Synthetic oligonucleotide
  Target: ATXN1; (+) strand; PAM type: NRG; PAM sequence: CAG
aacccttaaggatagatagc

SEQ ID NO: 109916 - DNA, 20 bp, Artificial Sequence
  Description of Artificial Sequence: Synthetic oligonucleotide
  Target: ATXN1; (+) strand; PAM type: NRG; PAM sequence: TGG
taaataaataaatctcttct

SEQ ID NO: 109917 - DNA, 20 bp, Artificial Sequence
  Description of Artificial Sequence: Synthetic oligonucleotide
  Target: ATXN1; (+) strand; PAM type: NRG; PAM sequence: GGG
aaataaataaatctcttctt

SEQ ID NO: 109918 - DNA, 20 bp, Artificial Sequence
  Description of Artificial Sequence: Synthetic oligonucleotide
  Target: ATXN1; (+) strand; PAM type: NRG; PAM sequence: TAG
ctcttcttgggaatattttc

SEQ ID NO: 109919 - DNA, 20 bp, Artificial Sequence
  Description of Artificial Sequence: Synthetic oligonucleotide
  Target: ATXN1; (+) strand; PAM type: NRG; PAM sequence: TGG
ctgataatttcttatattta

SEQ ID NO: 109920 - DNA, 20 bp, Artificial Sequence
  Description of Artificial Sequence: Synthetic oligonucleotide
  Target: ATXN1; (+) strand; PAM type: NRG; PAM sequence: GGG
tgataatttcttatatttat

SEQ ID NO: 109921 - DNA, 20 bp, Artificial Sequence
  Description of Artificial Sequence: Synthetic oligonucleotide
  Target: ATXN1; (+) strand; PAM type: NRG; PAM sequence: TAG
aatttcttatatttatgggc

SEQ ID NO: 109922 - DNA, 20 bp, Artificial Sequence
  Description of Artificial Sequence: Synthetic oligonucleotide
  Target: ATXN1; (+) strand; PAM type: NRG; PAM sequence: GAG
tttcttatatttatgggcta

SEQ ID NO: 109923 - DNA, 20 bp, Artificial Sequence
  Description of Artificial Sequence: Synthetic oligonucleotide
  Target: ATXN1; (+) strand; PAM type: NRG; PAM sequence: CGG
attgtgtaatgatcaattca

SEQ ID NO: 109924 - DNA, 20 bp, Artificial Sequence
  Description of Artificial Sequence: Synthetic oligonucleotide
  Target: ATXN1; (+) strand; PAM type: NRG; PAM sequence: TAG
aatgatcaattcacggtaat

SEQ ID NO: 109925 - DNA, 20 bp, Artificial Sequence
  Description of Artificial Sequence: Synthetic oligonucleotide
  Target: ATXN1; (+) strand; PAM type: NRG; PAM sequence: CAG
ttttcacttcaaacctttat

SEQ ID NO: 109926 - DNA, 20 bp, Artificial Sequence
  Description of Artificial Sequence: Synthetic oligonucleotide
  Target: ATXN1; (+) strand; PAM type: NRG; PAM sequence: GAG
ctttatcagttctttgttat

SEQ ID NO: 109927 - DNA, 20 bp, Artificial Sequence
  Description of Artificial Sequence: Synthetic oligonucleotide
  Target: ATXN1; (+) strand; PAM type: NRG; PAM sequence: TAG
acattcaaattcctcttgtc

SEQ ID NO: 109928 - DNA, 20 bp, Artificial Sequence
  Description of Artificial Sequence: Synthetic oligonucleotide
  Target: ATXN1; (+) strand; PAM type: NRG; PAM sequence: CAG
tcctcttgtctagttttctg

SEQ ID NO: 109929 - DNA, 20 bp, Artificial Sequence
  Description of Artificial Sequence: Synthetic oligonucleotide
  Target: ATXN1; (+) strand; PAM type: NRG; PAM sequence: AAG
gttttctgcagtcttctctt

SEQ ID NO: 109930 - DNA, 20 bp, Artificial Sequence
  Description of Artificial Sequence: Synthetic oligonucleotide
  Target: ATXN1; (+) strand; PAM type: NRG; PAM sequence: AGG
ttttctgcagtcttctctta

SEQ ID NO: 109931 - DNA, 20 bp, Artificial Sequence
  Description of Artificial Sequence: Synthetic oligonucleotide
  Target: ATXN1; (+) strand; PAM type: NRG; PAM sequence: AAG
cagtcttctcttaaggacca

SEQ ID NO: 109932 - DNA, 20 bp, Artificial Sequence
  Description of Artificial Sequence: Synthetic oligonucleotide
  Target: ATXN1; (+) strand; PAM type: NRG; PAM sequence: AAG
tcttctcttaaggaccaaag

SEQ ID NO: 109933 - DNA, 20 bp, Artificial Sequence
  Description of Artificial Sequence: Synthetic oligonucleotide
  Target: ATXN1; (+) strand; PAM type: NRG; PAM sequence: AAG
aggaccaaagaagaaaataa

SEQ ID NO: 109934 - DNA, 20 bp, Artificial Sequence
  Description of Artificial Sequence: Synthetic oligonucleotide
  Target: ATXN1; (+) strand; PAM type: NRG; PAM sequence: CAG
ataaaagaccctataaaatt

SEQ ID NO: 109935 - DNA, 20 bp, Artificial Sequence
  Description of Artificial Sequence: Synthetic oligonucleotide
  Target: ATXN1; (+) strand; PAM type: NRG; PAM sequence: AAG
tataaaattcagctctgttt

SEQ ID NO: 109936 - DNA, 20 bp, Artificial Sequence
  Description of Artificial Sequence: Synthetic oligonucleotide
  Target: ATXN1; (+) strand; PAM type: NRG; PAM sequence: AAG
ctgtttaagtcctatctttt

SEQ ID NO: 109937 - DNA, 20 bp, Artificial Sequence
  Description of Artificial Sequence: Synthetic oligonucleotide
  Target: ATXN1; (+) strand; PAM type: NRG; PAM sequence: AAG
ctatcttttaagtaactaaa

SEQ ID NO: 109938 - DNA, 20 bp, Artificial Sequence
  Description of Artificial Sequence: Synthetic oligonucleotide
  Target: ATXN1; (+) strand; PAM type: NRG; PAM sequence: TAG
gtaactaaaaagttgaatac

SEQ ID NO: 109939 - DNA, 20 bp, Artificial Sequence
  Description of Artificial Sequence: Synthetic oligonucleotide
  Target: ATXN1; (+) strand; PAM type: NRG; PAM sequence: TAG
tgaatactagctccaataac

SEQ ID NO: 109940 - DNA, 20 bp, Artificial Sequence
  Description of Artificial Sequence: Synthetic oligonucleotide
  Target: ATXN1; (+) strand; PAM type: NRG; PAM sequence: TAG
tttttcaatactaattttct

SEQ ID NO: 109941 - DNA, 20 bp, Artificial Sequence
  Description of Artificial Sequence: Synthetic oligonucleotide
  Target: ATXN1; (+) strand; PAM type: NRG; PAM sequence: AAG
aatactaattttcttagcca

SEQ ID NO: 109942 - DNA, 20 bp, Artificial Sequence
  Description of Artificial Sequence: Synthetic oligonucleotide
  Target: ATXN1; (+) strand; PAM type: NRG; PAM sequence: GAG
tactaattttcttagccaaa

SEQ ID NO: 109943 - DNA, 20 bp, Artificial Sequence
  Description of Artificial Sequence: Synthetic oligonucleotide
  Target: ATXN1; (+) strand; PAM type: NRG; PAM sequence: CAG
ttcttagccaaagagatatg

SEQ ID NO: 109944 - DNA, 20 bp, Artificial Sequence
  Description of Artificial Sequence: Synthetic oligonucleotide
  Target: ATXN1; (+) strand; PAM type: NRG; PAM sequence: TAG
ttagccaaagagatatgcag

SEQ ID NO: 109945 - DNA, 20 bp, Artificial Sequence
  Description of Artificial Sequence: Synthetic oligonucleotide
  Target: ATXN1; (+) strand; PAM type: NRG; PAM sequence: GAG
agccaaagagatatgcagta

SEQ ID NO: 109946 - DNA, 20 bp, Artificial Sequence
  Description of Artificial Sequence: Synthetic oligonucleotide
  Target: ATXN1; (+) strand; PAM type: NRG; PAM sequence: GAG
agatatgcagtagagaatgt

SEQ ID NO: 109947 - DNA, 20 bp, Artificial Sequence
  Description of Artificial Sequence: Synthetic oligonucleotide
  Target: ATXN1; (+) strand; PAM type: NRG; PAM sequence: AAG
gcagtagagaatgtgagacc

SEQ ID NO: 109948 - DNA, 20 bp, Artificial Sequence
  Description of Artificial Sequence: Synthetic oligonucleotide
  Target: ATXN1; (+) strand; PAM type: NRG; PAM sequence: GAG
agtagagaatgtgagaccaa

SEQ ID NO: 109949 - DNA, 20 bp, Artificial Sequence
  Description of Artificial Sequence: Synthetic oligonucleotide
  Target: ATXN1; (+) strand; PAM type: NRG; PAM sequence: TAG
agagaatgtgagaccaagag

SEQ ID NO: 109950 - DNA, 20 bp, Artificial Sequence
  Description of Artificial Sequence: Synthetic oligonucleotide
  Target: ATXN1; (+) strand; PAM type: NRG; PAM sequence: CAG
aatgtgagaccaagagtaga

SEQ ID NO: 109951 - DNA, 20 bp, Artificial Sequence
  Description of Artificial Sequence: Synthetic oligonucleotide
  Target: ATXN1; (+) strand; PAM type: NRG; PAM sequence: CAG
tgagaccaagagtagacagc

SEQ ID NO: 109952 - DNA, 20 bp, Artificial Sequence
  Description of Artificial Sequence: Synthetic oligonucleotide
  Target: ATXN1; (+) strand; PAM type: NRG; PAM sequence: AAG
aagagtagacagccagtcca

SEQ ID NO: 109953 - DNA, 20 bp, Artificial Sequence
  Description of Artificial Sequence: Synthetic oligonucleotide
  Target: ATXN1; (+) strand; PAM type: NRG; PAM sequence: CAG
gacagccagtccaaagtcca

SEQ ID NO: 109954 - DNA, 20 bp, Artificial Sequence
  Description of Artificial Sequence: Synthetic oligonucleotide
  Target: ATXN1; (+) strand; PAM type: NRG; PAM sequence: TGG
tatgactgcattttccacgc

SEQ ID NO: 109955 - DNA, 20 bp, Artificial Sequence
  Description of Artificial Sequence: Synthetic oligonucleotide
  Target: ATXN1; (+) strand; PAM type: NRG; PAM sequence: CAG
cattttccacgctggctttc

SEQ ID NO: 109956 - DNA, 20 bp, Artificial Sequence
  Description of Artificial Sequence: Synthetic oligonucleotide
  Target: ATXN1; (+) strand; PAM type: NRG; PAM sequence: AGG
attttccacgctggctttcc

SEQ ID NO: 109957 - DNA, 20 bp, Artificial Sequence
  Description of Artificial Sequence: Synthetic oligonucleotide
  Target: ATXN1; (+) strand; PAM type: NRG; PAM sequence: TGG
tccacgctggctttccagga

SEQ ID NO: 109958 - DNA, 20 bp, Artificial Sequence
  Description of Artificial Sequence: Synthetic oligonucleotide
  Target: ATXN1; (+) strand; PAM type: NRG; PAM sequence: TGG
gtcctgaacttgctaattca

SEQ ID NO: 109959 - DNA, 20 bp, Artificial Sequence
  Description of Artificial Sequence: Synthetic oligonucleotide
  Target: ATXN1; (+) strand; PAM type: NRG; PAM sequence: CAG
tataactttgtactgtaaca

SEQ ID NO: 109960 - DNA, 20 bp, Artificial Sequence
  Description of Artificial Sequence: Synthetic oligonucleotide
  Target: ATXN1; (+) strand; PAM type: NRG; PAM sequence: AAG
ctttgtactgtaacacagcc

SEQ ID NO: 109961 - DNA, 20 bp, Artificial Sequence
  Description of Artificial Sequence: Synthetic oligonucleotide
  Target: ATXN1; (+) strand; PAM type: NRG; PAM sequence: AGG
tttgtactgtaacacagcca

SEQ ID NO: 109962 - DNA, 20 bp, Artificial Sequence
  Description of Artificial Sequence: Synthetic oligonucleotide
  Target: ATXN1; (+) strand; PAM type: NRG; PAM sequence: GAG
tgtactgtaacacagccaag

SEQ ID NO: 109963 - DNA, 20 bp, Artificial Sequence
  Description of Artificial Sequence: Synthetic oligonucleotide
  Target: ATXN1; (+) strand; PAM type: NRG; PAM sequence: CAG
gtaacacagccaaggagaaa

SEQ ID NO: 109964 - DNA, 20 bp, Artificial Sequence
  Description of Artificial Sequence: Synthetic oligonucleotide
  Target: ATXN1; (+) strand; PAM type: NRG; PAM sequence: TAG
acacagccaaggagaaacag

SEQ ID NO: 109965 - DNA, 20 bp, Artificial Sequence
  Description of Artificial Sequence: Synthetic oligonucleotide
  Target: ATXN1; (+) strand; PAM type: NRG; PAM sequence: TGG
aaggagaaacagtagcatgt

SEQ ID NO: 109966 - DNA, 20 bp, Artificial Sequence
  Description of Artificial Sequence: Synthetic oligonucleotide
  Target: ATXN1; (+) strand; PAM type: NRG; PAM sequence: GAG
ggagaaacagtagcatgttg

SEQ ID NO: 109967 - DNA, 20 bp, Artificial Sequence
  Description of Artificial Sequence: Synthetic oligonucleotide
  Target: ATXN1; (+) strand; PAM type: NRG; PAM sequence: CAG
aaacagtagcatgttggagc

SEQ ID NO: 109968 - DNA, 20 bp, Artificial Sequence
  Description of Artificial Sequence: Synthetic oligonucleotide
  Target: ATXN1; (+) strand; PAM type: NRG; PAM sequence: AGG
aacagtagcatgttggagcc

SEQ ID NO: 109969 - DNA, 20 bp, Artificial Sequence
  Description of Artificial Sequence: Synthetic oligonucleotide
  Target: ATXN1; (+) strand; PAM type: NRG; PAM sequence: GAG
catgttggagccaggtctgt

SEQ ID NO: 109970 - DNA, 20 bp, Artificial Sequence
  Description of Artificial Sequence: Synthetic oligonucleotide
  Target: ATXN1; (+) strand; PAM type: NRG; PAM sequence: GAG
tgttggagccaggtctgtga

SEQ ID NO: 109971 - DNA, 20 bp, Artificial Sequence
  Description of Artificial Sequence: Synthetic oligonucleotide
  Target: ATXN1; (+) strand; PAM type: NRG; PAM sequence: CAG
gccaggtctgtgagagctaa

SEQ ID NO: 109972 - DNA, 20 bp, Artificial Sequence
  Description of Artificial Sequence: Synthetic oligonucleotide
  Target: ATXN1; (+) strand; PAM type: NRG; PAM sequence: AAG
gtctgtgagagctaacagtt

SEQ ID NO: 109973 - DNA, 20 bp, Artificial Sequence
  Description of Artificial Sequence: Synthetic oligonucleotide
  Target: ATXN1; (+) strand; PAM type: NRG; PAM sequence: CAG
gagctaacagttaagcttga

SEQ ID NO: 109974 - DNA, 20 bp, Artificial Sequence
  Description of Artificial Sequence: Synthetic oligonucleotide
  Target: ATXN1; (+) strand; PAM type: NRG; PAM sequence: AAG
aacagttaagcttgacagcc

SEQ ID NO: 109975 - DNA, 20 bp, Artificial Sequence
  Description of Artificial Sequence: Synthetic oligonucleotide
  Target: ATXN1; (+) strand; PAM type: NRG; PAM sequence: TAG
tgacagccaagcgttcaaca

SEQ ID NO: 109976 - DNA, 20 bp, Artificial Sequence
  Description of Artificial Sequence: Synthetic oligonucleotide
  Target: ATXN1; (+) strand; PAM type: NRG; PAM sequence: TGG
aattaacttatataaactta

SEQ ID NO: 109977 - DNA, 20 bp, Artificial Sequence
  Description of Artificial Sequence: Synthetic oligonucleotide
  Target: ATXN1; (+) strand; PAM type: NRG; PAM sequence: GAG
aaattatattaaaaactcct

SEQ ID NO: 109978 - DNA, 20 bp, Artificial Sequence
  Description of Artificial Sequence: Synthetic oligonucleotide
  Target: ATXN1; (+) strand; PAM type: NRG; PAM sequence: AGG
aattatattaaaaactcctg

SEQ ID NO: 109979 - DNA, 20 bp, Artificial Sequence
  Description of Artificial Sequence: Synthetic oligonucleotide
  Target: ATXN1; (+) strand; PAM type: NRG; PAM sequence: GAG
atattaaaaactcctgaggc

SEQ ID NO: 109980 - DNA, 20 bp, Artificial Sequence
  Description of Artificial Sequence: Synthetic oligonucleotide
  Target: ATXN1; (+) strand; PAM type: NRG; PAM sequence: AGG
tattaaaaactcctgaggcg

SEQ ID NO: 109981 - DNA, 20 bp, Artificial Sequence
  Description of Artificial Sequence: Synthetic oligonucleotide
  Target: ATXN1; (+) strand; PAM type: NRG; PAM sequence: CGG
taaaaactcctgaggcgagg

SEQ ID NO: 109982 - DNA, 20 bp, Artificial Sequence
  Description of Artificial Sequence: Synthetic oligonucleotide
  Target: ATXN1; (+) strand; PAM type: NRG; PAM sequence: GAG
tgaggcgaggcggatcaccc

SEQ ID NO: 109983 - DNA, 20 bp, Artificial Sequence
  Description of Artificial Sequence: Synthetic oligonucleotide
  Target: ATXN1; (+) strand; PAM type: NRG; PAM sequence: CGG
cgaggcggatcacccgagat

SEQ ID NO: 109984 - DNA, 20 bp, Artificial Sequence
  Description of Artificial Sequence: Synthetic oligonucleotide
  Target: ATXN1; (+) strand; PAM type: NRG; PAM sequence: GGG
gaggcggatcacccgagatc

SEQ ID NO: 109985 - DNA, 20 bp, Artificial Sequence
  Description of Artificial Sequence: Synthetic oligonucleotide
  Target: ATXN1; (+) strand; PAM type: NRG; PAM sequence: GGG
aggcggatcacccgagatcg

SEQ ID NO: 109986 - DNA, 20 bp, Artificial Sequence
  Description of Artificial Sequence: Synthetic oligonucleotide
  Target: ATXN1; (+) strand; PAM type: NRG; PAM sequence: GAG
gcggatcacccgagatcggg

SEQ ID NO: 109987 - DNA, 20 bp, Artificial Sequence
  Description of Artificial Sequence: Synthetic oligonucleotide
  Target: ATXN1; (+) strand; PAM type: NRG; PAM sequence: GAG
cacccgagatcggggagttc

SEQ ID NO: 109988 - DNA, 20 bp, Artificial Sequence
  Description of Artificial Sequence: Synthetic oligonucleotide
  Target: ATXN1; (+) strand; PAM type: NRG; PAM sequence: CAG
gagatcggggagttcgagac

SEQ ID NO: 109989 - DNA, 20 bp, Artificial Sequence
  Description of Artificial Sequence: Synthetic oligonucleotide
  Target: ATXN1; (+) strand; PAM type: NRG; PAM sequence: CGG
tcggggagttcgagaccagt

SEQ ID NO: 109990 - DNA, 20 bp, Artificial Sequence
  Description of Artificial Sequence: Synthetic oligonucleotide
  Target: ATXN1; (+) strand; PAM type: NRG; PAM sequence: TGG
cgagaccagtcggaccaaca

SEQ ID NO: 109991 - DNA, 20 bp, Artificial Sequence
  Description of Artificial Sequence: Synthetic oligonucleotide
  Target: ATXN1; (+) strand; PAM type: NRG; PAM sequence: GAG
agaccagtcggaccaacatg

SEQ ID NO: 109992 - DNA, 20 bp, Artificial Sequence
  Description of Artificial Sequence: Synthetic oligonucleotide
  Target: ATXN1; (+) strand; PAM type: NRG; PAM sequence: TAG
ctctactaaaaatacaaaat

SEQ ID NO: 109993 - DNA, 20 bp, Artificial Sequence
  Description of Artificial Sequence: Synthetic oligonucleotide
  Target: ATXN1; (+) strand; PAM type: NRG; PAM sequence: TGG
actaaaaatacaaaattagc

SEQ ID NO: 109994 - DNA, 20 bp, Artificial Sequence
  Description of Artificial Sequence: Synthetic oligonucleotide
  Target: ATXN1; (+) strand; PAM type: NRG; PAM sequence: GGG
ctaaaaatacaaaattagct

SEQ ID NO: 109995 - DNA, 20 bp, Artificial Sequence
  Description of Artificial Sequence: Synthetic oligonucleotide
  Target: ATXN1; (+) strand; PAM type: NRG; PAM sequence: TGG
aatacaaaattagctgggca

SEQ ID NO: 109996 - DNA, 20 bp, Artificial Sequence
  Description of Artificial Sequence: Synthetic oligonucleotide
  Target: ATXN1; (+) strand; PAM type: NRG; PAM sequence: TGG
acaaaattagctgggcatgg

SEQ ID NO: 109997 - DNA, 20 bp, Artificial Sequence
  Description of Artificial Sequence: Synthetic oligonucleotide
  Target: ATXN1; (+) strand; PAM type: NRG; PAM sequence: CAG
atgcctgtaatcacactact

SEQ ID NO: 109998 - DNA, 20 bp, Artificial Sequence
  Description of Artificial Sequence: Synthetic oligonucleotide
  Target: ATXN1; (+) strand; PAM type: NRG; PAM sequence: AGG
tgcctgtaatcacactactc

SEQ ID NO: 109999 - DNA, 20 bp, Artificial Sequence
  Description of Artificial Sequence: Synthetic oligonucleotide
  Target: ATXN1; (+) strand; PAM type: NRG; PAM sequence: GAG
cctgtaatcacactactcag

SEQ ID NO: 110000 - DNA, 20 bp, Artificial Sequence
  Description of Artificial Sequence: Synthetic oligonucleotide
  Target: ATXN1; (+) strand; PAM type: NRG; PAM sequence: AGG
ctgtaatcacactactcagg

SEQ ID NO: 110001 - DNA, 20 bp, Artificial Sequence
  Description of Artificial Sequence: Synthetic oligonucleotide
  Target: ATXN1; (+) strand; PAM type: NRG; PAM sequence: GAG
atcacactactcaggaggct

SEQ ID NO: 110002 - DNA, 20 bp, Artificial Sequence
  Description of Artificial Sequence: Synthetic oligonucleotide
  Target: ATXN1; (+) strand; PAM type: NRG; PAM sequence: AGG
tcacactactcaggaggctg

SEQ ID NO: 110003 - DNA, 20 bp, Artificial Sequence
  Description of Artificial Sequence: Synthetic oligonucleotide
  Target: ATXN1; (+) strand; PAM type: NRG; PAM sequence: CAG
cactactcaggaggctgagg

SEQ ID NO: 110004 - DNA, 20 bp, Artificial Sequence
  Description of Artificial Sequence: Synthetic oligonucleotide
  Target: ATXN1; (+) strand; PAM type: NRG; PAM sequence: AGG
actactcaggaggctgaggc

SEQ ID NO: 110005 - DNA, 20 bp, Artificial Sequence
  Description of Artificial Sequence: Synthetic oligonucleotide
  Target: ATXN1; (+) strand; PAM type: NRG; PAM sequence: GAG
tactcaggaggctgaggcag

SEQ ID NO: 110006 - DNA, 20 bp, Artificial Sequence
  Description of Artificial Sequence: Synthetic oligonucleotide
  Target: ATXN1; (+) strand; PAM type: NRG; PAM sequence: CGG
gcaggagaatcacttgaacc

SEQ ID NO: 110007 - DNA, 20 bp, Artificial Sequence
  Description of Artificial Sequence: Synthetic oligonucleotide
  Target: ATXN1; (+) strand; PAM type: NRG; PAM sequence: GGG
caggagaatcacttgaaccc

SEQ ID NO: 110008 - DNA, 20 bp, Artificial Sequence
  Description of Artificial Sequence: Synthetic oligonucleotide
  Target: ATXN1; (+) strand; PAM type: NRG; PAM sequence: GAG
ggagaatcacttgaacccgg

SEQ ID NO: 110009 - DNA, 20 bp, Artificial Sequence
  Description of Artificial Sequence: Synthetic oligonucleotide
  Target: ATXN1; (+) strand; PAM type: NRG; PAM sequence: AGG
gagaatcacttgaacccggg

SEQ ID NO: 110010 - DNA, 20 bp, Artificial Sequence
  Description of Artificial Sequence: Synthetic oligonucleotide
  Target: ATXN1; (+) strand; PAM type: NRG; PAM sequence: TGG
aatcacttgaacccgggagg

SEQ ID NO: 110011 - DNA, 20 bp, Artificial Sequence
  Description of Artificial Sequence: Synthetic oligonucleotide
  Target: ATXN1; (+) strand; PAM type: NRG; PAM sequence: GAG
tcacttgaacccgggaggtg

SEQ ID NO: 110012 - DNA, 20 bp, Artificial Sequence
  Description of Artificial Sequence: Synthetic oligonucleotide
  Target: ATXN1; (+) strand; PAM type: NRG; PAM sequence: AGG
cacttgaacccgggaggtgg

SEQ ID NO: 110013 - DNA, 20 bp, Artificial Sequence
  Description of Artificial Sequence: Synthetic oligonucleotide
  Target: ATXN1; (+) strand; PAM type: NRG; PAM sequence: CGG
aacccgggaggtggaggttg

SEQ ID NO: 110014 - DNA, 20 bp, Artificial Sequence
  Description of Artificial Sequence: Synthetic oligonucleotide
  Target: ATXN1; (+) strand; PAM type: NRG; PAM sequence: GAG
cgggaggtggaggttgcggt

SEQ ID NO: 110015 - DNA, 20 bp, Artificial Sequence
  Description of Artificial Sequence: Synthetic oligonucleotide
  Target: ATXN1; (+) strand; PAM type: NRG; PAM sequence: AAG
ggtggaggttgcggtgagcc

SEQ ID NO: 110016 - DNA, 20 bp, Artificial Sequence
  Description of Artificial Sequence: Synthetic oligonucleotide
  Target: ATXN1; (+) strand; PAM type: NRG; PAM sequence: CAG
aagattgcgccattgcattc

SEQ ID NO: 110017 - DNA, 20 bp, Artificial Sequence
  Description of Artificial Sequence: Synthetic oligonucleotide
  Target: ATXN1; (+) strand; PAM type: NRG; PAM sequence: TGG
tgcgccattgcattccagcc

SEQ ID NO: 110018 - DNA, 20 bp, Artificial Sequence
  Description of Artificial Sequence: Synthetic oligonucleotide
  Target: ATXN1; (+) strand; PAM type: NRG; PAM sequence: AAG
tgcattccagcctggccaac

SEQ ID NO: 110019 - DNA, 20 bp, Artificial Sequence
  Description of Artificial Sequence: Synthetic oligonucleotide
  Target: ATXN1; (+) strand; PAM type: NRG; PAM sequence: GAG
cattccagcctggccaacaa

SEQ ID NO: 110020 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaaaaaaaaac

SEQ ID NO: 110021 - DNA, 20 bp, Artificial Sequence
  Description of Artificial Sequence: Synthetic oligonucleotide
  Target: ATXN1; (+) strand; PAM type: NRG; PAM sequence: GAG
ttactattatctgtatgact

SEQ ID NO: 110022 - DNA, 20 bp, Artificial Sequence
  Description of Artificial Sequence: Synthetic oligonucleotide
  Target: ATXN1; (+) strand; PAM type: NRG; PAM sequence: AGG
tactattatctgtatgactg

SEQ ID NO: 110023 - DNA, 20 bp, Artificial Sequence
  Description of Artificial Sequence: Synthetic oligonucleotide
  Target: ATXN1; (+) strand; PAM type: NRG; PAM sequence: TAG
gttaattacatctacttgta

SEQ ID NO: 110024 - DNA, 20 bp, Artificial Sequence
  Description of Artificial Sequence: Synthetic oligonucleotide
  Target: ATXN1; (+) strand; PAM type: NRG; PAM sequence: TGG
aattacatctacttgtatag

SEQ ID NO: 110025 - DNA, 20 bp, Artificial Sequence
  Description of Artificial Sequence: Synthetic oligonucleotide
  Target: ATXN1; (+) strand; PAM type: NRG; PAM sequence: AAG
ctacttgtatagtggatata

SEQ ID NO: 110026 - DNA, 20 bp, Artificial Sequence
  Description of Artificial Sequence: Synthetic oligonucleotide
  Target: ATXN1; (+) strand; PAM type: NRG; PAM sequence: TGG
atgcaccacataacaacatt

SEQ ID NO: 110027 - DNA, 20 bp, Artificial Sequence
  Description of Artificial Sequence: Synthetic oligonucleotide
  Target: ATXN1; (+) strand; PAM type: NRG; PAM sequence: GGG
tgcaccacataacaacattt

SEQ ID NO: 110028 - DNA, 20 bp, Artificial Sequence
  Description of Artificial Sequence: Synthetic oligonucleotide
  Target: ATXN1; (+) strand; PAM type: NRG; PAM sequence: CAG
ccacataacaacatttgggt

SEQ ID NO: 110029 - DNA, 20 bp, Artificial Sequence
  Description of Artificial Sequence: Synthetic oligonucleotide
  Target: ATXN1; (+) strand; PAM type: NRG; PAM sequence: CGG
aacaacatttgggtcagccg

SEQ ID NO: 110030 - DNA, 20 bp, Artificial Sequence
  Description of Artificial Sequence: Synthetic oligonucleotide
  Target: ATXN1; (+) strand; PAM type: NRG; PAM sequence: CAG
gccgcggattgcatatgtga

SEQ ID NO: 110031 - DNA, 20 bp, Artificial Sequence
  Description of Artificial Sequence: Synthetic oligonucleotide
  Target: ATXN1; (+) strand; PAM type: NRG; PAM sequence: CGG
gcggattgcatatgtgacag

SEQ ID NO: 110032 - DNA, 20 bp, Artificial Sequence
  Description of Artificial Sequence: Synthetic oligonucleotide
  Target: ATXN1; (+) strand; PAM type: NRG; PAM sequence: AAG
atatgtgacagcggtcacat

SEQ ID NO: 110033 - DNA, 20 bp, Artificial Sequence
  Description of Artificial Sequence: Synthetic oligonucleotide
  Target: ATXN1; (+) strand; PAM type: NRG; PAM sequence: TGG
gcggtcacataagattataa

SEQ ID NO: 110034 - DNA, 20 bp, Artificial Sequence
  Description of Artificial Sequence: Synthetic oligonucleotide
  Target: ATXN1; (+) strand; PAM type: NRG; PAM sequence: GAG
ggtcacataagattataatg

SEQ ID NO: 110035 - DNA, 20 bp, Artificial Sequence
  Description of Artificial Sequence: Synthetic oligonucleotide
  Target: ATXN1; (+) strand; PAM type: NRG; PAM sequence: TAG
tctactgcctactgatgctg

SEQ ID NO: 110036 - DNA, 20 bp, Artificial Sequence
  Description of Artificial Sequence: Synthetic oligonucleotide
  Target: ATXN1; (+) strand; PAM type: NRG; PAM sequence: TAG
gctgtagctgtccaatgtaa

SEQ ID NO: 110037 - DNA, 20 bp, Artificial Sequence
  Description of Artificial Sequence: Synthetic oligonucleotide
  Target: ATXN1; (+) strand; PAM type: NRG; PAM sequence: TGG
atacattactcatatgtttg

SEQ ID NO: 110038 - DNA, 20 bp, Artificial Sequence
  Description of Artificial Sequence: Synthetic oligonucleotide
  Target: ATXN1; (+) strand; PAM type: NRG; PAM sequence: TGG
tcatatgtttgtggtgatgc

SEQ ID NO: 110039 - DNA, 20 bp, Artificial Sequence
  Description of Artificial Sequence: Synthetic oligonucleotide
  Target: ATXN1; (+) strand; PAM type: NRG; PAM sequence: CAG
tggtatatataaacgtcctg

SEQ ID NO: 110040 - DNA, 20 bp, Artificial Sequence
  Description of Artificial Sequence: Synthetic oligonucleotide
  Target: ATXN1; (+) strand; PAM type: NRG; PAM sequence: CAG
atataaacgtcctgcagtgc

SEQ ID NO: 110041 - DNA, 20 bp, Artificial Sequence
  Description of Artificial Sequence: Synthetic oligonucleotide
  Target: ATXN1; (+) strand; PAM type: NRG; PAM sequence: AAG
ctgcagtgccagtcctataa

SEQ ID NO: 110042 - DNA, 20 bp, Artificial Sequence
  Description of Artificial Sequence: Synthetic oligonucleotide
  Target: ATXN1; (+) strand; PAM type: NRG; PAM sequence: TAG
gtgccagtcctataaaagta

SEQ ID NO: 110043 - DNA, 20 bp, Artificial Sequence
  Description of Artificial Sequence: Synthetic oligonucleotide
  Target: ATXN1; (+) strand; PAM type: NRG; PAM sequence: CAG
atagcacatgcaattacgca

SEQ ID NO: 110044 - DNA, 20 bp, Artificial Sequence
  Description of Artificial Sequence: Synthetic oligonucleotide
  Target: ATXN1; (+) strand; PAM type: NRG; PAM sequence: TAG
caattacgcacagtacataa

SEQ ID NO: 110045 - DNA, 20 bp, Artificial Sequence
  Description of Artificial Sequence: Synthetic oligonucleotide
  Target: ATXN1; (+) strand; PAM type: NRG; PAM sequence: TAG
gcacagtacataatagttga

SEQ ID NO: 110046 - DNA, 20 bp, Artificial Sequence
  Description of Artificial Sequence: Synthetic oligonucleotide
  Target: ATXN1; (+) strand; PAM type: NRG; PAM sequence: TGG
aaaataaatgactatgttac

SEQ ID NO: 110047 - DNA, 20 bp, Artificial Sequence
  Description of Artificial Sequence: Synthetic oligonucleotide
  Target: ATXN1; (+) strand; PAM type: NRG; PAM sequence: GAG
tatactttttattgttattt

SEQ ID NO: 110048 - DNA, 20 bp, Artificial Sequence
  Description of Artificial Sequence: Synthetic oligonucleotide
  Target: ATXN1; (+) strand; PAM type: NRG; PAM sequence: GAG
tactttttattgttatttga

SEQ ID NO: 110049 - DNA, 20 bp, Artificial Sequence
  Description of Artificial Sequence: Synthetic oligonucleotide
  Target: ATXN1; (+) strand; PAM type: NRG; PAM sequence: TGG
tttttattgttatttgagag

SEQ ID NO: 110050 - DNA, 20 bp, Artificial Sequence
  Description of Artificial Sequence: Synthetic oligonucleotide
  Target: ATXN1; (+) strand; PAM type: NRG; PAM sequence: AAG
agtggactctttctacctat

SEQ ID NO: 110051 - DNA, 20 bp, Artificial Sequence
  Description of Artificial Sequence: Synthetic oligonucleotide
  Target: ATXN1; (+) strand; PAM type: NRG; PAM sequence: TAG
tacctataagaaattaactg

SEQ ID NO: 110052 - DNA, 20 bp, Artificial Sequence
  Description of Artificial Sequence: Synthetic oligonucleotide
  Target: ATXN1; (+) strand; PAM type: NRG; PAM sequence: AGG
acctataagaaattaactgt

SEQ ID NO: 110053 - DNA, 20 bp, Artificial Sequence
  Description of Artificial Sequence: Synthetic oligonucleotide
  Target: ATXN1; (+) strand; PAM type: NRG; PAM sequence: CGG
ataagaaattaactgtaggc

SEQ ID NO: 110054 - DNA, 20 bp, Artificial Sequence
  Description of Artificial Sequence: Synthetic oligonucleotide
  Target: ATXN1; (+) strand; PAM type: NRG; PAM sequence: GGG
taagaaattaactgtaggcc

SEQ ID NO: 110055 - DNA, 20 bp, Artificial Sequence
  Description of Artificial Sequence: Synthetic oligonucleotide
  Target: ATXN1; (+) strand; PAM type: NRG; PAM sequence: CAG
aattaactgtaggccgggcg

SEQ ID NO: 110056 - DNA, 20 bp, Artificial Sequence
  Description of Artificial Sequence: Synthetic oligonucleotide
  Target: ATXN1; (+) strand; PAM type: NRG; PAM sequence: TGG
taactgtaggccgggcgcag

SEQ ID NO: 110057 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgtaatcc

SEQ ID NO: 110058 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagcactt

SEQ ID NO: 110059 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 110060 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 110061 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 110062 - DNA, 20 bp, Artificial Sequence
  Description of Artificial Sequence: Synthetic oligonucleotide
  Target: ATXN1; (+) strand; PAM type: NRG; PAM sequence: AAG
tcccagcactttgggaggcc

SEQ ID NO: 110063 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggcca

SEQ ID NO: 110064 - DNA, 20 bp, Artificial Sequence
  Description of Artificial Sequence: Synthetic oligonucleotide
  Target: ATXN1; (+) strand; PAM type: NRG; PAM sequence: TGG
agcactttgggaggccaagg

SEQ ID NO: 110065 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccaaggt

SEQ ID NO: 110066 - DNA, 20 bp, Artificial Sequence
  Description of Artificial Sequence: Synthetic oligonucleotide
  Target: ATXN1; (+) strand; PAM type: NRG; PAM sequence: CAG
ctttgggaggccaaggtggg

SEQ ID NO: 110067 - DNA, 20 bp, Artificial Sequence
  Description of Artificial Sequence: Synthetic oligonucleotide
  Target: ATXN1; (+) strand; PAM type: NRG; PAM sequence: GAG
ggccaaggtgggcagatcac

SEQ ID NO: 110068 - DNA, 20 bp, Artificial Sequence
  Description of Artificial Sequence: Synthetic oligonucleotide
  Target: ATXN1; (+) strand; PAM type: NRG; PAM sequence: AGG
gccaaggtgggcagatcacg

SEQ ID NO: 110069 - DNA, 20 bp, Artificial Sequence
  Description of Artificial Sequence: Synthetic oligonucleotide
  Target: ATXN1; (+) strand; PAM type: NRG; PAM sequence: CAG
aggtgggcagatcacgaggt

SEQ ID NO: 110070 - DNA, 20 bp, Artificial Sequence
  Description of Artificial Sequence: Synthetic oligonucleotide
  Target: ATXN1; (+) strand; PAM type: NRG; PAM sequence: AGG
ggtgggcagatcacgaggtc

SEQ ID NO: 110071 - DNA, 20 bp, Artificial Sequence
  Description of Artificial Sequence: Synthetic oligonucleotide
  Target: ATXN1; (+) strand; PAM type: NRG; PAM sequence: GAG
tgggcagatcacgaggtcag

SEQ ID NO: 110072 - DNA, 20 bp, Artificial Sequence
  Description of Artificial Sequence: Synthetic oligonucleotide
  Target: ATXN1; (+) strand; PAM type: NRG; PAM sequence: GAG
gatcacgaggtcaggagatc

SEQ ID NO: 110073 - DNA, 20 bp, Artificial Sequence
  Description of Artificial Sequence: Synthetic oligonucleotide
  Target: ATXN1; (+) strand; PAM type: NRG; PAM sequence: TGG
tcaggagatcgagaccatcc

SEQ ID NO: 110074 - DNA, 20 bp, Artificial Sequence
  Description of Artificial Sequence: Synthetic oligonucleotide
  Target: ATXN1; (+) strand; PAM type: NRG; PAM sequence: TGG
cgagaccatcctggccaaca

SEQ ID NO: 110075 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 110076 - DNA, 20 bp, Artificial Sequence
  Description of Artificial Sequence: Synthetic oligonucleotide
  Target: ATXN1; (+) strand; PAM type: NRG; PAM sequence: TGG
ctaaaaatacaaaaattagc

SEQ ID NO: 110077 - DNA, 20 bp, Artificial Sequence
  Description of Artificial Sequence: Synthetic oligonucleotide
  Target: ATXN1; (+) strand; PAM type: NRG; PAM sequence: GGG
taaaaatacaaaaattagct

SEQ ID NO: 110078 - DNA, 20 bp, Artificial Sequence
  Description of Artificial Sequence: Synthetic oligonucleotide
  Target: ATXN1; (+) strand; PAM type: NRG; PAM sequence: TAG
atacaaaaattagctgggca

SEQ ID NO: 110079 - DNA, 20 bp, Artificial Sequence
  Description of Artificial Sequence: Synthetic oligonucleotide
  Target: ATXN1; (+) strand; PAM type: NRG; PAM sequence: TGG
caaaaattagctgggcatag

SEQ ID NO: 110080 - DNA, 20 bp, Artificial Sequence
  Description of Artificial Sequence: Synthetic oligonucleotide
  Target: ATXN1; (+) strand; PAM type: NRG; PAM sequence: CAG
gtggcacgtgcctgtaatct

SEQ ID NO: 110081 - DNA, 20 bp, Artificial Sequence
  Description of Artificial Sequence: Synthetic oligonucleotide
  Target: ATXN1; (+) strand; PAM type: NRG; PAM sequence: CGG
tgcctgtaatctcagctctt

SEQ ID NO: 110082 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatctcagctcttc

SEQ ID NO: 110083 - DNA, 20 bp, Artificial Sequence
  Description of Artificial Sequence: Synthetic oligonucleotide
  Target: ATXN1; (+) strand; PAM type: NRG; PAM sequence: TGG
tgtaatctcagctcttcggg

SEQ ID NO: 110084 - DNA, 20 bp, Artificial Sequence
  Description of Artificial Sequence: Synthetic oligonucleotide
  Target: ATXN1; (+) strand; PAM type: NRG; PAM sequence: GAG
tctcagctcttcgggtggct

SEQ ID NO: 110085 - DNA, 20 bp, Artificial Sequence
  Description of Artificial Sequence: Synthetic oligonucleotide
  Target: ATXN1; (+) strand; PAM type: NRG; PAM sequence: AGG
ctcagctcttcgggtggctg

SEQ ID NO: 110086 - DNA, 20 bp, Artificial Sequence
  Description of Artificial Sequence: Synthetic oligonucleotide
  Target: ATXN1; (+) strand; PAM type: NRG; PAM sequence: CAG
agctcttcgggtggctgagg

SEQ ID NO: 110087 - DNA, 20 bp, Artificial Sequence
  Description of Artificial Sequence: Synthetic oligonucleotide
  Target: ATXN1; (+) strand; PAM type: NRG; PAM sequence: AAG
tcttcgggtggctgaggcag

SEQ ID NO: 110088 - DNA, 20 bp, Artificial Sequence
  Description of Artificial Sequence: Synthetic oligonucleotide
  Target: ATXN1; (+) strand; PAM type: NRG; PAM sequence: CAG
ggcagaagaatcacttgaac

SEQ ID NO: 110089 - DNA, 20 bp, Artificial Sequence
  Description of Artificial Sequence: Synthetic oligonucleotide
  Target: ATXN1; (+) strand; PAM type: NRG; PAM sequence: AGG
gcagaagaatcacttgaacc

SEQ ID NO: 110090 - DNA, 20 bp, Artificial Sequence
  Description of Artificial Sequence: Synthetic oligonucleotide
  Target: ATXN1; (+) strand; PAM type: NRG; PAM sequence: GGG
cagaagaatcacttgaacca

SEQ ID NO: 110091 - DNA, 20 bp, Artificial Sequence
  Description of Artificial Sequence: Synthetic oligonucleotide
  Target: ATXN1; (+) strand; PAM type: NRG; PAM sequence: GAG
gaagaatcacttgaaccagg

SEQ ID NO: 110092 - DNA, 20 bp, Artificial Sequence
  Description of Artificial Sequence: Synthetic oligonucleotide
  Target: ATXN1; (+) strand; PAM type: NRG; PAM sequence: CGG
aatcacttgaaccagggagt

SEQ ID NO: 110093 - DNA, 20 bp, Artificial Sequence
  Description of Artificial Sequence: Synthetic oligonucleotide
  Target: ATXN1; (+) strand; PAM type: NRG; PAM sequence: GAG
tcacttgaaccagggagtcg

SEQ ID NO: 110094 - DNA, 20 bp, Artificial Sequence
  Description of Artificial Sequence: Synthetic oligonucleotide
  Target: ATXN1; (+) strand; PAM type: NRG; PAM sequence: AGG
cacttgaaccagggagtcgg

SEQ ID NO: 110095 - DNA, 20 bp, Artificial Sequence
  Description of Artificial Sequence: Synthetic oligonucleotide
  Target: ATXN1; (+) strand; PAM type: NRG; PAM sequence: CAG
aaccagggagtcggaggttg

SEQ ID NO: 110096 - DNA, 20 bp, Artificial Sequence
  Description of Artificial Sequence: Synthetic oligonucleotide
  Target: ATXN1; (+) strand; PAM type: NRG; PAM sequence: GAG
agggagtcggaggttgcagt

SEQ ID NO: 110097 - DNA, 20 bp, Artificial Sequence
  Description of Artificial Sequence: Synthetic oligonucleotide
  Target: ATXN1; (+) strand; PAM type: NRG; PAM sequence: GAG
gtcggaggttgcagtgagct

SEQ ID NO: 110098 - DNA, 20 bp, Artificial Sequence
  Description of Artificial Sequence: Synthetic oligonucleotide
  Target: ATXN1; (+) strand; PAM type: NRG; PAM sequence: CAG
gagattgtgccactgcactc

SEQ ID NO: 110099 - DNA, 20 bp, Artificial Sequence
  Description of Artificial Sequence: Synthetic oligonucleotide
  Target: ATXN1; (+) strand; PAM type: NRG; PAM sequence: TGG
tgtgccactgcactccagcc

SEQ ID NO: 110100 - DNA, 20 bp, Artificial Sequence
  Description of Artificial Sequence: Synthetic oligonucleotide
  Target: ATXN1; (+) strand; PAM type: NRG; PAM sequence: CAG
actgcactccagcctggtga

SEQ ID NO: 110101 - DNA, 20 bp, Artificial Sequence
  Description of Artificial Sequence: Synthetic oligonucleotide
  Target: ATXN1; (+) strand; PAM type: NRG; PAM sequence: GAG
tgcactccagcctggtgaca

SEQ ID NO: 110102 - DNA, 20 bp, Artificial Sequence
  Description of Artificial Sequence: Synthetic oligonucleotide
  Target: ATXN1; (+) strand; PAM type: NRG; PAM sequence: GAG
ctccagcctggtgacagagc

SEQ ID NO: 110103 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaaaaaaaaaa

SEQ ID NO: 110104 - DNA, 20 bp, Artificial Sequence
  Description of Artificial Sequence: Synthetic oligonucleotide
  Target: ATXN1; (+) strand; PAM type: NRG; PAM sequence: CAG
aaaagccaattaactgtaaa

SEQ ID NO: 110105 - DNA, 20 bp, Artificial Sequence
  Description of Artificial Sequence: Synthetic oligonucleotide
  Target: ATXN1; (+) strand; PAM type: NRG; PAM sequence: CAG
caattaactgtaaacagcct

SEQ ID NO: 110106 - DNA, 20 bp, Artificial Sequence
  Description of Artificial Sequence: Synthetic oligonucleotide
  Target: ATXN1; (+) strand; PAM type: NRG; PAM sequence: AGG
aattaactgtaaacagcctc

SEQ ID NO: 110107 - DNA, 20 bp, Artificial Sequence
  Description of Artificial Sequence: Synthetic oligonucleotide
  Target: ATXN1; (+) strand; PAM type: NRG; PAM sequence: CAG
taactgtaaacagcctcagg

SEQ ID NO: 110108 - DNA, 20 bp, Artificial Sequence
  Description of Artificial Sequence: Synthetic oligonucleotide
  Target: ATXN1; (+) strand; PAM type: NRG; PAM sequence: AGG
aactgtaaacagcctcaggc

SEQ ID NO: 110109 - DNA, 20 bp, Artificial Sequence
  Description of Artificial Sequence: Synthetic oligonucleotide
  Target: ATXN1; (+) strand; PAM type: NRG; PAM sequence: TGG
cagcctcaggcaggtccctc

SEQ ID NO: 110110 - DNA, 20 bp, Artificial Sequence
  Description of Artificial Sequence: Synthetic oligonucleotide
  Target: ATXN1; (+) strand; PAM type: NRG; PAM sequence: GAG
gcctcaggcaggtccctctg

SEQ ID NO: 110111 - DNA, 20 bp, Artificial Sequence
  Description of Artificial Sequence: Synthetic oligonucleotide
  Target: ATXN1; (+) strand; PAM type: NRG; PAM sequence: AGG
cctcaggcaggtccctctgg

SEQ ID NO: 110112 - DNA, 20 bp, Artificial Sequence
  Description of Artificial Sequence: Synthetic oligonucleotide
  Target: ATXN1; (+) strand; PAM type: NRG; PAM sequence: AAG
aggtccctctggaggtgttc

SEQ ID NO: 110113 - DNA, 20 bp, Artificial Sequence
  Description of Artificial Sequence: Synthetic oligonucleotide
  Target: ATXN1; (+) strand; PAM type: NRG; PAM sequence: AAG
tccctctggaggtgttcaag

SEQ ID NO: 110114 - DNA, 20 bp, Artificial Sequence
  Description of Artificial Sequence: Synthetic oligonucleotide
  Target: ATXN1; (+) strand; PAM type: NRG; PAM sequence: AAG
ctctggaggtgttcaagaag

SEQ ID NO: 110115 - DNA, 20 bp, Artificial Sequence
  Description of Artificial Sequence: Synthetic oligonucleotide
  Target: ATXN1; (+) strand; PAM type: NRG; PAM sequence: AGG
tctggaggtgttcaagaaga

SEQ ID NO: 110116 - DNA, 20 bp, Artificial Sequence
  Description of Artificial Sequence: Synthetic oligonucleotide
  Target: ATXN1; (+) strand; PAM type: NRG; PAM sequence: CAG
agaaggcattgttatcatcg

SEQ ID NO: 110117 - DNA, 20 bp, Artificial Sequence
  Description of Artificial Sequence: Synthetic oligonucleotide
  Target: ATXN1; (+) strand; PAM type: NRG; PAM sequence: TGG
attgttatcatcgcagatga

SEQ ID NO: 110118 - DNA, 20 bp, Artificial Sequence
  Description of Artificial Sequence: Synthetic oligonucleotide
  Target: ATXN1; (+) strand; PAM type: NRG; PAM sequence: TGG
gcagatgatggctccattca

SEQ ID NO: 110119 - DNA, 20 bp, Artificial Sequence
  Description of Artificial Sequence: Synthetic oligonucleotide
  Target: ATXN1; (+) strand; PAM type: NRG; PAM sequence: AAG
cattcatggtattgcctctg

SEQ ID NO: 110120 - DNA, 20 bp, Artificial Sequence
  Description of Artificial Sequence: Synthetic oligonucleotide
  Target: ATXN1; (+) strand; PAM type: NRG; PAM sequence: CAG
tattgcctctgaagacctta

SEQ ID NO: 110121 - DNA, 20 bp, Artificial Sequence
  Description of Artificial Sequence: Synthetic oligonucleotide
  Target: ATXN1; (+) strand; PAM type: NRG; PAM sequence: TGG
gcctctgaagaccttacaga

SEQ ID NO: 110122 - DNA, 20 bp, Artificial Sequence
  Description of Artificial Sequence: Synthetic oligonucleotide
  Target: ATXN1; (+) strand; PAM type: NRG; PAM sequence: AAG
tgaagaccttacagatggaa

SEQ ID NO: 110123 - DNA, 20 bp, Artificial Sequence
  Description of Artificial Sequence: Synthetic oligonucleotide
  Target: ATXN1; (+) strand; PAM type: NRG; PAM sequence: AAG
accttacagatggaaaagat

SEQ ID NO: 110124 - DNA, 20 bp, Artificial Sequence
  Description of Artificial Sequence: Synthetic oligonucleotide
  Target: ATXN1; (+) strand; PAM type: NRG; PAM sequence: AGG
ccttacagatggaaaagata

SEQ ID NO: 110125 - DNA, 20 bp, Artificial Sequence
  Description of Artificial Sequence: Synthetic oligonucleotide
  Target: ATXN1; (+) strand; PAM type: NRG; PAM sequence: GAG
ttacagatggaaaagataag

SEQ ID NO: 110126 - DNA, 20 bp, Artificial Sequence
  Description of Artificial Sequence: Synthetic oligonucleotide
  Target: ATXN1; (+) strand; PAM type: NRG; PAM sequence: AGG
tacagatggaaaagataagg

SEQ ID NO: 110127 - DNA, 20 bp, Artificial Sequence
  Description of Artificial Sequence: Synthetic oligonucleotide
  Target: ATXN1; (+) strand; PAM type: NRG; PAM sequence: TAG
agatggaaaagataaggagg

SEQ ID NO: 110128 - DNA, 20 bp, Artificial Sequence
  Description of Artificial Sequence: Synthetic oligonucleotide
  Target: ATXN1; (+) strand; PAM type: NRG; PAM sequence: AAG
tggaaaagataaggaggtag

SEQ ID NO: 110129 - DNA, 20 bp, Artificial Sequence
  Description of Artificial Sequence: Synthetic oligonucleotide
  Target: ATXN1; (+) strand; PAM type: NRG; PAM sequence: CAG
aaagataaggaggtagaaga

SEQ ID NO: 110130 - DNA, 20 bp, Artificial Sequence
  Description of Artificial Sequence: Synthetic oligonucleotide
  Target: ATXN1; (+) strand; PAM type: NRG; PAM sequence: TGG
ctgaccatcatgaccctgtg

SEQ ID NO: 110131 - DNA, 20 bp, Artificial Sequence
  Description of Artificial Sequence: Synthetic oligonucleotide
  Target: ATXN1; (+) strand; PAM type: NRG; PAM sequence: GGG
tgaccatcatgaccctgtgt

SEQ ID NO: 110132 - DNA, 20 bp, Artificial Sequence
  Description of Artificial Sequence: Synthetic oligonucleotide
  Target: ATXN1; (+) strand; PAM type: NRG; PAM sequence: GGG
gaccatcatgaccctgtgtg

SEQ ID NO: 110133 - DNA, 20 bp, Artificial Sequence
  Description of Artificial Sequence: Synthetic oligonucleotide
  Target: ATXN1; (+) strand; PAM type: NRG; PAM sequence: TAG
atcatgaccctgtgtggggc

SEQ ID NO: 110134 - DNA, 20 bp, Artificial Sequence
  Description of Artificial Sequence: Synthetic oligonucleotide
  Target: ATXN1; (+) strand; PAM type: NRG; PAM sequence: AGG
tcatgaccctgtgtggggct

SEQ ID NO: 110135 - DNA, 20 bp, Artificial Sequence
  Description of Artificial Sequence: Synthetic oligonucleotide
  Target: ATXN1; (+) strand; PAM type: NRG; PAM sequence: TAG
taatgtatgtgtttgtgtct

SEQ ID NO: 110136 - DNA, 20 bp, Artificial Sequence
  Description of Artificial Sequence: Synthetic oligonucleotide
  Target: ATXN1; (+) strand; PAM type: NRG; PAM sequence: CAG
gtttgtgtcttagtttttaa

SEQ ID NO: 110137 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaactttttttaat

SEQ ID NO: 110138 - DNA, 20 bp, Artificial Sequence
  Description of Artificial Sequence: Synthetic oligonucleotide
  Target: ATXN1; (+) strand; PAM type: NRG; PAM sequence: AAG
aaactttttttaataagaaa

SEQ ID NO: 110139 - DNA, 20 bp, Artificial Sequence
  Description of Artificial Sequence: Synthetic oligonucleotide
  Target: ATXN1; (+) strand; PAM type: NRG; PAM sequence: TGG
ataagaaaaagcttataaac

SEQ ID NO: 110140 - DNA, 20 bp, Artificial Sequence
  Description of Artificial Sequence: Synthetic oligonucleotide
  Target: ATXN1; (+) strand; PAM type: NRG; PAM sequence: TGG
aaaagcttataaactggatg

SEQ ID NO: 110141 - DNA, 20 bp, Artificial Sequence
  Description of Artificial Sequence: Synthetic oligonucleotide
  Target: ATXN1; (+) strand; PAM type: NRG; PAM sequence: TGG
agcttataaactggatgtgg

SEQ ID NO: 110142 - DNA, 20 bp, Artificial Sequence
  Description of Artificial Sequence: Synthetic oligonucleotide
  Target: ATXN1; (+) strand; PAM type: NRG; PAM sequence: CAG
gtggtgtacacctgtaatcc

SEQ ID NO: 110143 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatcccagcattt

SEQ ID NO: 110144 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccagcatttt

SEQ ID NO: 110145 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcattttgg

SEQ ID NO: 110146 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcattttggg

SEQ ID NO: 110147 - DNA, 20 bp, Artificial Sequence
  Description of Artificial Sequence: Synthetic oligonucleotide
  Target: ATXN1; (+) strand; PAM type: NRG; PAM sequence: GAG
tcccagcattttgggaggct

SEQ ID NO: 110148 - DNA, 20 bp, Artificial Sequence
  Description of Artificial Sequence: Synthetic oligonucleotide
  Target: ATXN1; (+) strand; PAM type: NRG; PAM sequence: AGG
cccagcattttgggaggctg

SEQ ID NO: 110149 - DNA, 20 bp, Artificial Sequence
  Description of Artificial Sequence: Synthetic oligonucleotide
  Target: ATXN1; (+) strand; PAM type: NRG; PAM sequence: CAG
agcattttgggaggctgagg

SEQ ID NO: 110150 - DNA, 20 bp, Artificial Sequence
  Description of Artificial Sequence: Synthetic oligonucleotide
  Target: ATXN1; (+) strand; PAM type: NRG; PAM sequence: AGG
gcattttgggaggctgaggc

SEQ ID NO: 110151 - DNA, 20 bp, Artificial Sequence
  Description of Artificial Sequence: Synthetic oligonucleotide
  Target: ATXN1; (+) strand; PAM type: NRG; PAM sequence: GAG
attttgggaggctgaggcag

SEQ ID NO: 110152 - DNA, 20 bp, Artificial Sequence
  Description of Artificial Sequence: Synthetic oligonucleotide
  Target: ATXN1; (+) strand; PAM type: NRG; PAM sequence: AGG
ttttgggaggctgaggcagg

SEQ ID NO: 110153 - DNA, 20 bp, Artificial Sequence
  Description of Artificial Sequence: Synthetic oligonucleotide
  Target: ATXN1; (+) strand; PAM type: NRG; PAM sequence: TGG
gggaggctgaggcaggagga

SEQ ID NO: 110154 - DNA, 20 bp, Artificial Sequence
  Description of Artificial Sequence: Synthetic oligonucleotide
  Target: ATXN1; (+) strand; PAM type: NRG; PAM sequence: GAG
ctgaggcaggaggatggctt

SEQ ID NO: 110155 - DNA, 20 bp, Artificial Sequence
  Description of Artificial Sequence: Synthetic oligonucleotide
  Target: ATXN1; (+) strand; PAM type: NRG; PAM sequence: CGG
gcaggaggatggcttgagcc

SEQ ID NO: 110156 - DNA, 20 bp, Artificial Sequence
  Description of Artificial Sequence: Synthetic oligonucleotide
  Target: ATXN1; (+) strand; PAM type: NRG; PAM sequence: GGG
caggaggatggcttgagccc

SEQ ID NO: 110157 - DNA, 20 bp, Artificial Sequence
  Description of Artificial Sequence: Synthetic oligonucleotide
  Target: ATXN1; (+) strand; PAM type: NRG; PAM sequence: CAG
tgagcccgggtgcgcgaaac

SEQ ID NO: 110158 - DNA, 20 bp, Artificial Sequence
  Description of Artificial Sequence: Synthetic oligonucleotide
  Target: ATXN1; (+) strand; PAM type: NRG; PAM sequence: TGG
ccgggtgcgcgaaaccagcc

SEQ ID NO: 110159 - DNA, 20 bp, Artificial Sequence
  Description of Artificial Sequence: Synthetic oligonucleotide
  Target: ATXN1; (+) strand; PAM type: NRG; PAM sequence: GGG
cgggtgcgcgaaaccagcct

SEQ ID NO: 110160 - DNA, 20 bp, Artificial Sequence
  Description of Artificial Sequence: Synthetic oligonucleotide
  Target: ATXN1; (+) strand; PAM type: NRG; PAM sequence: TAG
cgaaaccagcctgggcaaca

SEQ ID NO: 110161 - DNA, 20 bp, Artificial Sequence
  Description of Artificial Sequence: Synthetic oligonucleotide
  Target: ATXN1; (+) strand; PAM type: NRG; PAM sequence: GAG
accagcctgggcaacatagt

SEQ ID NO: 110162 - DNA, 20 bp, Artificial Sequence
  Description of Artificial Sequence: Synthetic oligonucleotide
  Target: ATXN1; (+) strand; PAM type: NRG; PAM sequence: TAG
ctgggcaacatagtgagact

SEQ ID NO: 110163 - DNA, 20 bp, Artificial Sequence
  Description of Artificial Sequence: Synthetic oligonucleotide
  Target: ATXN1; (+) strand; PAM type: NRG; PAM sequence: AAG
gacttagtttctacaaaaac

SEQ ID NO: 110164 - DNA, 20 bp, Artificial Sequence
  Description of Artificial Sequence: Synthetic oligonucleotide
  Target: ATXN1; (+) strand; PAM type: NRG; PAM sequence: TAG
tttctacaaaaacaagctta

SEQ ID NO: 110165 - DNA, 20 bp, Artificial Sequence
  Description of Artificial Sequence: Synthetic oligonucleotide
  Target: ATXN1; (+) strand; PAM type: NRG; PAM sequence: AAG
aaaaacaagcttatagaata

SEQ ID NO: 110166 - DNA, 20 bp, Artificial Sequence
  Description of Artificial Sequence: Synthetic oligonucleotide
  Target: ATXN1; (+) strand; PAM type: NRG; PAM sequence: AAG
gcttatagaataaagatata

SEQ ID NO: 110167 - DNA, 20 bp, Artificial Sequence
  Description of Artificial Sequence: Synthetic oligonucleotide
  Target: ATXN1; (+) strand; PAM type: NRG; PAM sequence: AAG
atagaataaagatataaaga

SEQ ID NO: 110168 - DNA, 20 bp, Artificial Sequence
  Description of Artificial Sequence: Synthetic oligonucleotide
  Target: ATXN1; (+) strand; PAM type: NRG; PAM sequence: CAG
agaaagaaaatattcttgta

SEQ ID NO: 110169 - DNA, 20 bp, Artificial Sequence
  Description of Artificial Sequence: Synthetic oligonucleotide
  Target: ATXN1; (+) strand; PAM type: NRG; PAM sequence: GAG
atgtgtttgtattttaaact

SEQ ID NO: 110170 - DNA, 20 bp, Artificial Sequence
  Description of Artificial Sequence: Synthetic oligonucleotide
  Target: ATXN1; (+) strand; PAM type: NRG; PAM sequence: AAG
taaactgagtgctattatga

SEQ ID NO: 110171 - DNA, 20 bp, Artificial Sequence
  Description of Artificial Sequence: Synthetic oligonucleotide
  Target: ATXN1; (+) strand; PAM type: NRG; PAM sequence: AAG
ctattatgaaagttatcaaa

SEQ ID NO: 110172 - DNA, 20 bp, Artificial Sequence
  Description of Artificial Sequence: Synthetic oligonucleotide
  Target: ATXN1; (+) strand; PAM type: NRG; PAM sequence: AAG
aaaagtttttaaaaattaaa

SEQ ID NO: 110173 - DNA, 20 bp, Artificial Sequence
  Description of Artificial Sequence: Synthetic oligonucleotide
  Target: ATXN1; (+) strand; PAM type: NRG; PAM sequence: AAG
taaaaattaaaaagtttata

SEQ ID NO: 110174 - DNA, 20 bp, Artificial Sequence
  Description of Artificial Sequence: Synthetic oligonucleotide
  Target: ATXN1; (+) strand; PAM type: NRG; PAM sequence: AAG
aaaaagtttataaagtaaaa

SEQ ID NO: 110175 - DNA, 20 bp, Artificial Sequence
  Description of Artificial Sequence: Synthetic oligonucleotide
  Target: ATXN1; (+) strand; PAM type: NRG; PAM sequence: AAG
agtttataaagtaaaaaagt

SEQ ID NO: 110176 - DNA, 20 bp, Artificial Sequence
  Description of Artificial Sequence: Synthetic oligonucleotide
  Target: ATXN1; (+) strand; PAM type: NRG; PAM sequence: GAG
ataaagtaaaaaagtaagct

SEQ ID NO: 110177 - DNA, 20 bp, Artificial Sequence
  Description of Artificial Sequence: Synthetic oligonucleotide
  Target: ATXN1; (+) strand; PAM type: NRG; PAM sequence: TGG
gtaaaaaagtaagctgagcg

SEQ ID NO: 110178 - DNA, 20 bp, Artificial Sequence
  Description of Artificial Sequence: Synthetic oligonucleotide
  Target: ATXN1; (+) strand; PAM type: NRG; PAM sequence: AAG
gcgtggttaatttattatca

SEQ ID NO: 110179 - DNA, 20 bp, Artificial Sequence
  Description of Artificial Sequence: Synthetic oligonucleotide
  Target: ATXN1; (+) strand; PAM type: NRG; PAM sequence: AAG
ggttaatttattatcaaaga

SEQ ID NO: 110180 - DNA, 20 bp, Artificial Sequence
  Description of Artificial Sequence: Synthetic oligonucleotide
  Target: ATXN1; (+) strand; PAM type: NRG; PAM sequence: TAG
aacaatttaaaaaacaaact

SEQ ID NO: 110181 - DNA, 20 bp, Artificial Sequence
  Description of Artificial Sequence: Synthetic oligonucleotide
  Target: ATXN1; (+) strand; PAM type: NRG; PAM sequence: TAG
tttaaaaaacaaacttagtg

SEQ ID NO: 110182 - DNA, 20 bp, Artificial Sequence
  Description of Artificial Sequence: Synthetic oligonucleotide
  Target: ATXN1; (+) strand; PAM type: NRG; PAM sequence: AAG
aaacaaacttagtgtagcct

SEQ ID NO: 110183 - DNA, 20 bp, Artificial Sequence
  Description of Artificial Sequence: Synthetic oligonucleotide
  Target: ATXN1; (+) strand; PAM type: NRG; PAM sequence: CAG
cttagtgtagcctaagtgta

SEQ ID NO: 110184 - DNA, 20 bp, Artificial Sequence
  Description of Artificial Sequence: Synthetic oligonucleotide
  Target: ATXN1; (+) strand; PAM type: NRG; PAM sequence: AAG
ctaagtgtacagtccttata

SEQ ID NO: 110185 - DNA, 20 bp, Artificial Sequence
  Description of Artificial Sequence: Synthetic oligonucleotide
  Target: ATXN1; (+) strand; PAM type: NRG; PAM sequence: CAG
tacagtccttataaagtcta

SEQ ID NO: 110186 - DNA, 20 bp, Artificial Sequence
  Description of Artificial Sequence: Synthetic oligonucleotide
  Target: ATXN1; (+) strand; PAM type: NRG; PAM sequence: TGG
agtccttataaagtctacag

SEQ ID NO: 110187 - DNA, 20 bp, Artificial Sequence
  Description of Artificial Sequence: Synthetic oligonucleotide
  Target: ATXN1; (+) strand; PAM type: NRG; PAM sequence: GGG
gtccttataaagtctacagt

SEQ ID NO: 110188 - DNA, 20 bp, Artificial Sequence
  Description of Artificial Sequence: Synthetic oligonucleotide
  Target: ATXN1; (+) strand; PAM type: NRG; PAM sequence: GGG
tccttataaagtctacagtg

SEQ ID NO: 110189 - DNA, 20 bp, Artificial Sequence
  Description of Artificial Sequence: Synthetic oligonucleotide
  Target: ATXN1; (+) strand; PAM type: NRG; PAM sequence: CAG
ataaagtctacagtggggta

SEQ ID NO: 110190 - DNA, 20 bp, Artificial Sequence
  Description of Artificial Sequence: Synthetic oligonucleotide
  Target: ATXN1; (+) strand; PAM type: NRG; PAM sequence: CAG
tacagtggggtacagtgata

SEQ ID NO: 110191 - DNA, 20 bp, Artificial Sequence
  Description of Artificial Sequence: Synthetic oligonucleotide
  Target: ATXN1; (+) strand; PAM type: NRG; PAM sequence: TAG
acagtgatacagtgatgtcc

SEQ ID NO: 110192 - DNA, 20 bp, Artificial Sequence
  Description of Artificial Sequence: Synthetic oligonucleotide
  Target: ATXN1; (+) strand; PAM type: NRG; PAM sequence: AGG
cagtgatacagtgatgtcct

SEQ ID NO: 110193 - DNA, 20 bp, Artificial Sequence
  Description of Artificial Sequence: Synthetic oligonucleotide
  Target: ATXN1; (+) strand; PAM type: NRG; PAM sequence: CAG
cacccactcactgactcacc

SEQ ID NO: 110194 - DNA, 20 bp, Artificial Sequence
  Description of Artificial Sequence: Synthetic oligonucleotide
  Target: ATXN1; (+) strand; PAM type: NRG; PAM sequence: GAG
cccactcactgactcaccca

SEQ ID NO: 110195 - DNA, 20 bp, Artificial Sequence
  Description of Artificial Sequence: Synthetic oligonucleotide
  Target: ATXN1; (+) strand; PAM type: NRG; PAM sequence: CAG
gactcacccagagcaacttc

SEQ ID NO: 110196 - DNA, 20 bp, Artificial Sequence
  Description of Artificial Sequence: Synthetic oligonucleotide
  Target: ATXN1; (+) strand; PAM type: NRG; PAM sequence: AAG
agagcaacttccagtcctgc

SEQ ID NO: 110197 - DNA, 20 bp, Artificial Sequence
  Description of Artificial Sequence: Synthetic oligonucleotide
  Target: ATXN1; (+) strand; PAM type: NRG; PAM sequence: TGG
agtcctgcaagctccattca

SEQ ID NO: 110198 - DNA, 20 bp, Artificial Sequence
  Description of Artificial Sequence: Synthetic oligonucleotide
  Target: ATXN1; (+) strand; PAM type: NRG; PAM sequence: AAG
ctgcaagctccattcatggt

SEQ ID NO: 110199 - DNA, 20 bp, Artificial Sequence
  Description of Artificial Sequence: Synthetic oligonucleotide
  Target: ATXN1; (+) strand; PAM type: NRG; PAM sequence: TAG
ttcatggtaagtgccctata

SEQ ID NO: 110200 - DNA, 20 bp, Artificial Sequence
  Description of Artificial Sequence: Synthetic oligonucleotide
  Target: ATXN1; (+) strand; PAM type: NRG; PAM sequence: AGG
tcatggtaagtgccctatat

SEQ ID NO: 110201 - DNA, 20 bp, Artificial Sequence
  Description of Artificial Sequence: Synthetic oligonucleotide
  Target: ATXN1; (+) strand; PAM type: NRG; PAM sequence: TAG
tactgtacctattctatgtc

SEQ ID NO: 110202 - DNA, 20 bp, Artificial Sequence
  Description of Artificial Sequence: Synthetic oligonucleotide
  Target: ATXN1; (+) strand; PAM type: NRG; PAM sequence: TAG
agatgcacaaaaactatgtt

SEQ ID NO: 110203 - DNA, 20 bp, Artificial Sequence
  Description of Artificial Sequence: Synthetic oligonucleotide
  Target: ATXN1; (+) strand; PAM type: NRG; PAM sequence: AGG
gatgcacaaaaactatgttt

SEQ ID NO: 110204 - DNA, 20 bp, Artificial Sequence
  Description of Artificial Sequence: Synthetic oligonucleotide
  Target: ATXN1; (+) strand; PAM type: NRG; PAM sequence: AAG
gtttaggaacattgtgttac

SEQ ID NO: 110205 - DNA, 20 bp, Artificial Sequence
  Description of Artificial Sequence: Synthetic oligonucleotide
  Target: ATXN1; (+) strand; PAM type: NRG; PAM sequence: CAG
cattgtgttacaagtgccta

SEQ ID NO: 110206 - DNA, 20 bp, Artificial Sequence
  Description of Artificial Sequence: Synthetic oligonucleotide
  Target: ATXN1; (+) strand; PAM type: NRG; PAM sequence: CAG
ttacaagtgcctacagtatt

SEQ ID NO: 110207 - DNA, 20 bp, Artificial Sequence
  Description of Artificial Sequence: Synthetic oligonucleotide
  Target: ATXN1; (+) strand; PAM type: NRG; PAM sequence: CAG
agtgcctacagtattcagta

SEQ ID NO: 110208 - DNA, 20 bp, Artificial Sequence
  Description of Artificial Sequence: Synthetic oligonucleotide
  Target: ATXN1; (+) strand; PAM type: NRG; PAM sequence: AAG
cctacagtattcagtacagt

SEQ ID NO: 110209 - DNA, 20 bp, Artificial Sequence
  Description of Artificial Sequence: Synthetic oligonucleotide
  Target: ATXN1; (+) strand; PAM type: NRG; PAM sequence: AGG
ctacagtattcagtacagta

SEQ ID NO: 110210 - DNA, 20 bp, Artificial Sequence
  Description of Artificial Sequence: Synthetic oligonucleotide
  Target: ATXN1; (+) strand; PAM type: NRG; PAM sequence: GAG
attcagtacagtaaggtgct

SEQ ID NO: 110211 - DNA, 20 bp, Artificial Sequence
  Description of Artificial Sequence: Synthetic oligonucleotide
  Target: ATXN1; (+) strand; PAM type: NRG; PAM sequence: TAG
cagtaaggtgctgagtgctg

SEQ ID NO: 110212 - DNA, 20 bp, Artificial Sequence
  Description of Artificial Sequence: Synthetic oligonucleotide
  Target: ATXN1; (+) strand; PAM type: NRG; PAM sequence: AGG
agtaaggtgctgagtgctgt

SEQ ID NO: 110213 - DNA, 20 bp, Artificial Sequence
  Description of Artificial Sequence: Synthetic oligonucleotide
  Target: ATXN1; (+) strand; PAM type: NRG; PAM sequence: AAG
gcaatcgtaaccctatgtcc

SEQ ID NO: 110214 - DNA, 20 bp, Artificial Sequence
  Description of Artificial Sequence: Synthetic oligonucleotide
  Target: ATXN1; (+) strand; PAM type: NRG; PAM sequence: TAG
ctatgtccaagtttgtatcc

SEQ ID NO: 110215 - DNA, 20 bp, Artificial Sequence
  Description of Artificial Sequence: Synthetic oligonucleotide
  Target: ATXN1; (+) strand; PAM type: NRG; PAM sequence: AGG
tatgtccaagtttgtatcct

SEQ ID NO: 110216 - DNA, 20 bp, Artificial Sequence
  Description of Artificial Sequence: Synthetic oligonucleotide
  Target: ATXN1; (+) strand; PAM type: NRG; PAM sequence: GAG
tgtccaagtttgtatcctag

SEQ ID NO: 110217 - DNA, 20 bp, Artificial Sequence
  Description of Artificial Sequence: Synthetic oligonucleotide
  Target: ATXN1; (+) strand; PAM type: NRG; PAM sequence: CAG
agtttgtatcctaggagcaa

SEQ ID NO: 110218 - DNA, 20 bp, Artificial Sequence
  Description of Artificial Sequence: Synthetic oligonucleotide
  Target: ATXN1; (+) strand; PAM type: NRG; PAM sequence: AGG
gtttgtatcctaggagcaac

SEQ ID NO: 110219 - DNA, 20 bp, Artificial Sequence
  Description of Artificial Sequence: Synthetic oligonucleotide
  Target: ATXN1; (+) strand; PAM type: NRG; PAM sequence: TAG
gagcaacaggctgcattata

SEQ ID NO: 110220 - DNA, 20 bp, Artificial Sequence
  Description of Artificial Sequence: Synthetic oligonucleotide
  Target: ATXN1; (+) strand; PAM type: NRG; PAM sequence: TAG
acaggctgcattatatagct

SEQ ID NO: 110221 - DNA, 20 bp, Artificial Sequence
  Description of Artificial Sequence: Synthetic oligonucleotide
  Target: ATXN1; (+) strand; PAM type: NRG; PAM sequence: TAG
cattatatagcttagatgtg

SEQ ID NO: 110222 - DNA, 20 bp, Artificial Sequence
  Description of Artificial Sequence: Synthetic oligonucleotide
  Target: ATXN1; (+) strand; PAM type: NRG; PAM sequence: CAG
tatatagcttagatgtgtag

SEQ ID NO: 110223 - DNA, 20 bp, Artificial Sequence
  Description of Artificial Sequence: Synthetic oligonucleotide
  Target: ATXN1; (+) strand; PAM type: NRG; PAM sequence: AGG
atatagcttagatgtgtagc

SEQ ID NO: 110224 - DNA, 20 bp, Artificial Sequence
  Description of Artificial Sequence: Synthetic oligonucleotide
  Target: ATXN1; (+) strand; PAM type: NRG; PAM sequence: TAG
gtgtagcaggctgtaccatc

SEQ ID NO: 110225 - DNA, 20 bp, Artificial Sequence
  Description of Artificial Sequence: Synthetic oligonucleotide
  Target: ATXN1; (+) strand; PAM type: NRG; PAM sequence: AGG
tgtagcaggctgtaccatct

SEQ ID NO: 110226 - DNA, 20 bp, Artificial Sequence
  Description of Artificial Sequence: Synthetic oligonucleotide
  Target: ATXN1; (+) strand; PAM type: NRG; PAM sequence: TGG
caggctgtaccatctaggct

SEQ ID NO: 110227 - DNA, 20 bp, Artificial Sequence
  Description of Artificial Sequence: Synthetic oligonucleotide
  Target: ATXN1; (+) strand; PAM type: NRG; PAM sequence: GGG
aggctgtaccatctaggctt

SEQ ID NO: 110228 - DNA, 20 bp, Artificial Sequence
  Description of Artificial Sequence: Synthetic oligonucleotide
  Target: ATXN1; (+) strand; PAM type: NRG; PAM sequence: CAG
aacacactttatgatatttg

SEQ ID NO: 110229 - DNA, 20 bp, Artificial Sequence
  Description of Artificial Sequence: Synthetic oligonucleotide
  Target: ATXN1; (+) strand; PAM type: NRG; PAM sequence: AAG
acactttatgatatttgcag

SEQ ID NO: 110230 - DNA, 20 bp, Artificial Sequence
  Description of Artificial Sequence: Synthetic oligonucleotide
  Target: ATXN1; (+) strand; PAM type: NRG; PAM sequence: AGG
cactttatgatatttgcaga

SEQ ID NO: 110231 - DNA, 20 bp, Artificial Sequence
  Description of Artificial Sequence: Synthetic oligonucleotide
  Target: ATXN1; (+) strand; PAM type: NRG; PAM sequence: AAG
tatttgcagaaggacgatgt

SEQ ID NO: 110232 - DNA, 20 bp, Artificial Sequence
  Description of Artificial Sequence: Synthetic oligonucleotide
  Target: ATXN1; (+) strand; PAM type: NRG; PAM sequence: AGG
atttgcagaaggacgatgta

SEQ ID NO: 110233 - DNA, 20 bp, Artificial Sequence
  Description of Artificial Sequence: Synthetic oligonucleotide
  Target: ATXN1; (+) strand; PAM type: NRG; PAM sequence: CAG
cgatgtaaggatgcatttct

SEQ ID NO: 110234 - DNA, 20 bp, Artificial Sequence
  Description of Artificial Sequence: Synthetic oligonucleotide
  Target: ATXN1; (+) strand; PAM type: NRG; PAM sequence: AAG
cagaatgcattcccattatt

SEQ ID NO: 110235 - DNA, 20 bp, Artificial Sequence
  Description of Artificial Sequence: Synthetic oligonucleotide
  Target: ATXN1; (+) strand; PAM type: NRG; PAM sequence: TGG
tgatgcacgactgtcctata

SEQ ID NO: 110236 - DNA, 20 bp, Artificial Sequence
  Description of Artificial Sequence: Synthetic oligonucleotide
  Target: ATXN1; (+) strand; PAM type: NRG; PAM sequence: TGG
tgcacgactgtcctatatgg

SEQ ID NO: 110237 - DNA, 20 bp, Artificial Sequence
  Description of Artificial Sequence: Synthetic oligonucleotide
  Target: ATXN1; (+) strand; PAM type: NRG; PAM sequence: TGG
tgcatctctttacaatctca

SEQ ID NO: 110238 - DNA, 20 bp, Artificial Sequence
  Description of Artificial Sequence: Synthetic oligonucleotide
  Target: ATXN1; (+) strand; PAM type: NRG; PAM sequence: TGG
tctctttacaatctcatggt

SEQ ID NO: 110239 - DNA, 20 bp, Artificial Sequence
  Description of Artificial Sequence: Synthetic oligonucleotide
  Target: ATXN1; (+) strand; PAM type: NRG; PAM sequence: TGG
catggttggtaatgtcacat

SEQ ID NO: 110240 - DNA, 20 bp, Artificial Sequence
  Description of Artificial Sequence: Synthetic oligonucleotide
  Target: ATXN1; (+) strand; PAM type: NRG; PAM sequence: TAG
ggttggtaatgtcacattgg

SEQ ID NO: 110241 - DNA, 20 bp, Artificial Sequence
  Description of Artificial Sequence: Synthetic oligonucleotide
  Target: ATXN1; (+) strand; PAM type: NRG; PAM sequence: TAG
tcacattggtagtttgaaat

SEQ ID NO: 110242 - DNA, 20 bp, Artificial Sequence
  Description of Artificial Sequence: Synthetic oligonucleotide
  Target: ATXN1; (+) strand; PAM type: NRG; PAM sequence: CAG
tggtagtttgaaattagtca

SEQ ID NO: 110243 - DNA, 20 bp, Artificial Sequence
  Description of Artificial Sequence: Synthetic oligonucleotide
  Target: ATXN1; (+) strand; PAM type: NRG; PAM sequence: GAG
agtttgaaattagtcacagt

SEQ ID NO: 110244 - DNA, 20 bp, Artificial Sequence
  Description of Artificial Sequence: Synthetic oligonucleotide
  Target: ATXN1; (+) strand; PAM type: NRG; PAM sequence: GAG
tttgaaattagtcacagtga

SEQ ID NO: 110245 - DNA, 20 bp, Artificial Sequence
  Description of Artificial Sequence: Synthetic oligonucleotide
  Target: ATXN1; (+) strand; PAM type: NRG; PAM sequence: CAG
cagtgagagtatttatatta

SEQ ID NO: 110246 - DNA, 20 bp, Artificial Sequence
  Description of Artificial Sequence: Synthetic oligonucleotide
  Target: ATXN1; (+) strand; PAM type: NRG; PAM sequence: CAG
agtatttatattacagaaat

SEQ ID NO: 110247 - DNA, 20 bp, Artificial Sequence
  Description of Artificial Sequence: Synthetic oligonucleotide
  Target: ATXN1; (+) strand; PAM type: NRG; PAM sequence: GAG
tcaaacgtcctgttattccc

SEQ ID NO: 110248 - DNA, 20 bp, Artificial Sequence
  Description of Artificial Sequence: Synthetic oligonucleotide
  Target: ATXN1; (+) strand; PAM type: NRG; PAM sequence: CAG
acgtcctgttattcccgagc

SEQ ID NO: 110249 - DNA, 20 bp, Artificial Sequence
  Description of Artificial Sequence: Synthetic oligonucleotide
  Target: ATXN1; (+) strand; PAM type: NRG; PAM sequence: TAG
tcctgttattcccgagccag

SEQ ID NO: 110250 - DNA, 20 bp, Artificial Sequence
  Description of Artificial Sequence: Synthetic oligonucleotide
  Target: ATXN1; (+) strand; PAM type: NRG; PAM sequence: GAG
tttttgttttttgttttttt

SEQ ID NO: 110251 - DNA, 20 bp, Artificial Sequence
  Description of Artificial Sequence: Synthetic oligonucleotide
  Target: ATXN1; (+) strand; PAM type: NRG; PAM sequence: AAG
ttttttgtttttttgagatg

SEQ ID NO: 110252 - DNA, 20 bp, Artificial Sequence
  Description of Artificial Sequence: Synthetic oligonucleotide
  Target: ATXN1; (+) strand; PAM type: NRG; PAM sequence: CAG
tgaagtctcgttctgtcatc

SEQ ID NO: 110253 - DNA, 20 bp, Artificial Sequence
  Description of Artificial Sequence: Synthetic oligonucleotide
  Target: ATXN1; (+) strand; PAM type: NRG; PAM sequence: AGG
gaagtctcgttctgtcatcc

SEQ ID NO: 110254 - DNA, 20 bp, Artificial Sequence
  Description of Artificial Sequence: Synthetic oligonucleotide
  Target: ATXN1; (+) strand; PAM type: NRG; PAM sequence: TGG
tctcgttctgtcatccaggc

SEQ ID NO: 110255 - DNA, 20 bp, Artificial Sequence
  Description of Artificial Sequence: Synthetic oligonucleotide
  Target: ATXN1; (+) strand; PAM type: NRG; PAM sequence: GAG
tcgttctgtcatccaggctg

SEQ ID NO: 110256 - DNA, 20 bp, Artificial Sequence
  Description of Artificial Sequence: Synthetic oligonucleotide
  Target: ATXN1; (+) strand; PAM type: NRG; PAM sequence: TGG
tcatccaggctggagtgcaa

SEQ ID NO: 110257 - DNA, 20 bp, Artificial Sequence
  Description of Artificial Sequence: Synthetic oligonucleotide
  Target: ATXN1; (+) strand; PAM type: NRG; PAM sequence: TGG
ggagtgcaatggcacgatct

SEQ ID NO: 110258 - DNA, 20 bp, Artificial Sequence
  Description of Artificial Sequence: Synthetic oligonucleotide
  Target: ATXN1; (+) strand; PAM type: NRG; PAM sequence: AAG
tcactgcaacctccacctcc

SEQ ID NO: 110259 - DNA, 20 bp, Artificial Sequence
  Description of Artificial Sequence: Synthetic oligonucleotide
  Target: ATXN1; (+) strand; PAM type: NRG; PAM sequence: CAG
tccaagtgattctcctgctt

SEQ ID NO: 110260 - DNA, 20 bp, Artificial Sequence
  Description of Artificial Sequence: Synthetic oligonucleotide
  Target: ATXN1; (+) strand; PAM type: NRG; PAM sequence: GAG
ttctcctgcttcagcctccc

SEQ ID NO: 110261 - DNA, 20 bp, Artificial Sequence
  Description of Artificial Sequence: Synthetic oligonucleotide
  Target: ATXN1; (+) strand; PAM type: NRG; PAM sequence: TAG
tcctgcttcagcctcccgag

SEQ ID NO: 110262 - DNA, 20 bp, Artificial Sequence
  Description of Artificial Sequence: Synthetic oligonucleotide
  Target: ATXN1; (+) strand; PAM type: NRG; PAM sequence: TGG
gcttcagcctcccgagtagc

SEQ ID NO: 110263 - DNA, 20 bp, Artificial Sequence
  Description of Artificial Sequence: Synthetic oligonucleotide
  Target: ATXN1; (+) strand; PAM type: NRG; PAM sequence: CAG
ctcccgagtagctggaatta

SEQ ID NO: 110264 - DNA, 20 bp, Artificial Sequence
  Description of Artificial Sequence: Synthetic oligonucleotide
  Target: ATXN1; (+) strand; PAM type: NRG; PAM sequence: AGG
tcccgagtagctggaattac

SEQ ID NO: 110265 - DNA, 20 bp, Artificial Sequence
  Description of Artificial Sequence: Synthetic oligonucleotide
  Target: ATXN1; (+) strand; PAM type: NRG; PAM sequence: CGG
caggtgcccaccaccatgcc

SEQ ID NO: 110266 - DNA, 20 bp, Artificial Sequence
  Description of Artificial Sequence: Synthetic oligonucleotide
  Target: ATXN1; (+) strand; PAM type: NRG; PAM sequence: TAG
tgcccaccaccatgcccggc

SEQ ID NO: 110267 - DNA, 20 bp, Artificial Sequence
  Description of Artificial Sequence: Synthetic oligonucleotide
  Target: ATXN1; (+) strand; PAM type: NRG; PAM sequence: TAG
ccggctagtatttatatttt

SEQ ID NO: 110268 - DNA, 20 bp, Artificial Sequence
  Description of Artificial Sequence: Synthetic oligonucleotide
  Target: ATXN1; (+) strand; PAM type: NRG; PAM sequence: TAG
gctagtatttatatttttag

SEQ ID NO: 110269 - DNA, 20 bp, Artificial Sequence
  Description of Artificial Sequence: Synthetic oligonucleotide
  Target: ATXN1; (+) strand; PAM type: NRG; PAM sequence: GAG
tagtatttatatttttagta

SEQ ID NO: 110270 - DNA, 20 bp, Artificial Sequence
  Description of Artificial Sequence: Synthetic oligonucleotide
  Target: ATXN1; (+) strand; PAM type: NRG; PAM sequence: TGG
atttatatttttagtagaga

SEQ ID NO: 110271 - DNA, 20 bp, Artificial Sequence
  Description of Artificial Sequence: Synthetic oligonucleotide
  Target: ATXN1; (+) strand; PAM type: NRG; PAM sequence: GGG
tttatatttttagtagagat

SEQ ID NO: 110272 - DNA, 20 bp, Artificial Sequence
  Description of Artificial Sequence: Synthetic oligonucleotide
  Target: ATXN1; (+) strand; PAM type: NRG; PAM sequence: GGG
ttatatttttagtagagatg

SEQ ID NO: 110273 - DNA, 20 bp, Artificial Sequence
  Description of Artificial Sequence: Synthetic oligonucleotide
  Target: ATXN1; (+) strand; PAM type: NRG; PAM sequence: TGG
gagatggggtttcactatgt

SEQ ID NO: 110274 - DNA, 20 bp, Artificial Sequence
  Description of Artificial Sequence: Synthetic oligonucleotide
  Target: ATXN1; (+) strand; PAM type: NRG; PAM sequence: CAG
tggggtttcactatgttggc

SEQ ID NO: 110275 - DNA, 20 bp, Artificial Sequence
  Description of Artificial Sequence: Synthetic oligonucleotide
  Target: ATXN1; (+) strand; PAM type: NRG; PAM sequence: AGG
ggggtttcactatgttggcc

SEQ ID NO: 110276 - DNA, 20 bp, Artificial Sequence
  Description of Artificial Sequence: Synthetic oligonucleotide
  Target: ATXN1; (+) strand; PAM type: NRG; PAM sequence: TGG
tttcactatgttggccaggc

SEQ ID NO: 110277 - DNA, 20 bp, Artificial Sequence
  Description of Artificial Sequence: Synthetic oligonucleotide
  Target: ATXN1; (+) strand; PAM type: NRG; PAM sequence: CAG
tggtctcaaactcctgacct

SEQ ID NO: 110278 - DNA, 20 bp, Artificial Sequence
  Description of Artificial Sequence: Synthetic oligonucleotide
  Target: ATXN1; (+) strand; PAM type: NRG; PAM sequence: AGG
ggtctcaaactcctgacctc

SEQ ID NO: 110279 - DNA, 20 bp, Artificial Sequence
  Description of Artificial Sequence: Synthetic oligonucleotide
  Target: ATXN1; (+) strand; PAM type: NRG; PAM sequence: CAG
ctcaggtgatctgcctgcct

SEQ ID NO: 110280 - DNA, 20 bp, Artificial Sequence
  Description of Artificial Sequence: Synthetic oligonucleotide
  Target: ATXN1; (+) strand; PAM type: NRG; PAM sequence: AAG
ctgcctgcctcagcctctca

SEQ ID NO: 110281 - DNA, 20 bp, Artificial Sequence
  Description of Artificial Sequence: Synthetic oligonucleotide
  Target: ATXN1; (+) strand; PAM type: NRG; PAM sequence: CGG
tctcaaagtgccactgtgcc

SEQ ID NO: 110282 - DNA, 20 bp, Artificial Sequence
  Description of Artificial Sequence: Synthetic oligonucleotide
  Target: ATXN1; (+) strand; PAM type: NRG; PAM sequence: CAG
gtgccactgtgcccggccgc

SEQ ID NO: 110283 - DNA, 20 bp, Artificial Sequence
  Description of Artificial Sequence: Synthetic oligonucleotide
  Target: ATXN1; (+) strand; PAM type: NRG; PAM sequence: TAG
ccactgtgcccggccgccag

SEQ ID NO: 110284 - DNA, 20 bp, Artificial Sequence
  Description of Artificial Sequence: Synthetic oligonucleotide
  Target: ATXN1; (+) strand; PAM type: NRG; PAM sequence: TAG
ctgtgcccggccgccagtag

SEQ ID NO: 110285 - DNA, 20 bp, Artificial Sequence
  Description of Artificial Sequence: Synthetic oligonucleotide
  Target: ATXN1; (+) strand; PAM type: NRG; PAM sequence: CAG
agtagtagctaaacttttat

SEQ ID NO: 110286 - DNA, 20 bp, Artificial Sequence
  Description of Artificial Sequence: Synthetic oligonucleotide
  Target: ATXN1; (+) strand; PAM type: NRG; PAM sequence: TGG
aacttttatcagcacactgc

SEQ ID NO: 110287 - DNA, 20 bp, Artificial Sequence
  Description of Artificial Sequence: Synthetic oligonucleotide
  Target: ATXN1; (+) strand; PAM type: NRG; PAM sequence: AAG
atccattccaactttttctt

SEQ ID NO: 110288 - DNA, 20 bp, Artificial Sequence
  Description of Artificial Sequence: Synthetic oligonucleotide
  Target: ATXN1; (+) strand; PAM type: NRG; PAM sequence: TAG
caactttttcttaagtgaaa

SEQ ID NO: 110289 - DNA, 20 bp, Artificial Sequence
  Description of Artificial Sequence: Synthetic oligonucleotide
  Target: ATXN1; (+) strand; PAM type: NRG; PAM sequence: TAG
tttcttaagtgaaatagaac

SEQ ID NO: 110290 - DNA, 20 bp, Artificial Sequence
  Description of Artificial Sequence: Synthetic oligonucleotide
  Target: ATXN1; (+) strand; PAM type: NRG; PAM sequence: AGG
ttcttaagtgaaatagaact

SEQ ID NO: 110291 - DNA, 20 bp, Artificial Sequence
  Description of Artificial Sequence: Synthetic oligonucleotide
  Target: ATXN1; (+) strand; PAM type: NRG; PAM sequence: GGG
tcttaagtgaaatagaacta

SEQ ID NO: 110292 - DNA, 20 bp, Artificial Sequence
  Description of Artificial Sequence: Synthetic oligonucleotide
  Target: ATXN1; (+) strand; PAM type: NRG; PAM sequence: GGG
cttaagtgaaatagaactag

SEQ ID NO: 110293 - DNA, 20 bp, Artificial Sequence
  Description of Artificial Sequence: Synthetic oligonucleotide
  Target: ATXN1; (+) strand; PAM type: NRG; PAM sequence: GAG
taagtgaaatagaactaggg

SEQ ID NO: 110294 - DNA, 20 bp, Artificial Sequence
  Description of Artificial Sequence: Synthetic oligonucleotide
  Target: ATXN1; (+) strand; PAM type: NRG; PAM sequence: CAG
gaaatagaactaggggagaa

SEQ ID NO: 110295 - DNA, 20 bp, Artificial Sequence
  Description of Artificial Sequence: Synthetic oligonucleotide
  Target: ATXN1; (+) strand; PAM type: NRG; PAM sequence: TAG
atagaactaggggagaacag

SEQ ID NO: 110296 - DNA, 20 bp, Artificial Sequence
  Description of Artificial Sequence: Synthetic oligonucleotide
  Target: ATXN1; (+) strand; PAM type: NRG; PAM sequence: AGG
tagaactaggggagaacagt

SEQ ID NO: 110297 - DNA, 20 bp, Artificial Sequence
  Description of Artificial Sequence: Synthetic oligonucleotide
  Target: ATXN1; (+) strand; PAM type: NRG; PAM sequence: TAG
ctaggggagaacagtaggaa

SEQ ID NO: 110298 - DNA, 20 bp, Artificial Sequence
  Description of Artificial Sequence: Synthetic oligonucleotide
  Target: ATXN1; (+) strand; PAM type: NRG; PAM sequence: CAG
actttccatgattacatgtg

SEQ ID NO: 110299 - DNA, 20 bp, Artificial Sequence
  Description of Artificial Sequence: Synthetic oligonucleotide
  Target: ATXN1; (+) strand; PAM type: NRG; PAM sequence: AGG
ctttccatgattacatgtgc

SEQ ID NO: 110300 - DNA, 20 bp, Artificial Sequence
  Description of Artificial Sequence: Synthetic oligonucleotide
  Target: ATXN1; (+) strand; PAM type: NRG; PAM sequence: AAG
atgtgcaggtacataccacc

SEQ ID NO: 110301 - DNA, 20 bp, Artificial Sequence
  Description of Artificial Sequence: Synthetic oligonucleotide
  Target: ATXN1; (+) strand; PAM type: NRG; PAM sequence: CAG
gccaccaaatcattgctgtc

SEQ ID NO: 110302 - DNA, 20 bp, Artificial Sequence
  Description of Artificial Sequence: Synthetic oligonucleotide
  Target: ATXN1; (+) strand; PAM type: NRG; PAM sequence: GAG
caccaaatcattgctgtcca

SEQ ID NO: 110303 - DNA, 20 bp, Artificial Sequence
  Description of Artificial Sequence: Synthetic oligonucleotide
  Target: ATXN1; (+) strand; PAM type: NRG; PAM sequence: CAG
tgtttatctgctactgaaat

SEQ ID NO: 110304 - DNA, 20 bp, Artificial Sequence
  Description of Artificial Sequence: Synthetic oligonucleotide
  Target: ATXN1; (+) strand; PAM type: NRG; PAM sequence: CAG
ctactgaaatcagtctgact

SEQ ID NO: 110305 - DNA, 20 bp, Artificial Sequence
  Description of Artificial Sequence: Synthetic oligonucleotide
  Target: ATXN1; (+) strand; PAM type: NRG; PAM sequence: TGG
aaatgtaattgtatgtgtgt

SEQ ID NO: 110306 - DNA, 20 bp, Artificial Sequence
  Description of Artificial Sequence: Synthetic oligonucleotide
  Target: ATXN1; (+) strand; PAM type: NRG; PAM sequence: AAG
gtaattgtatgtgtgttggc

SEQ ID NO: 110307 - DNA, 20 bp, Artificial Sequence
  Description of Artificial Sequence: Synthetic oligonucleotide
  Target: ATXN1; (+) strand; PAM type: NRG; PAM sequence: AAG
gtgttggcaagaactcacac

SEQ ID NO: 110308 - DNA, 20 bp, Artificial Sequence
  Description of Artificial Sequence: Synthetic oligonucleotide
  Target: ATXN1; (+) strand; PAM type: NRG; PAM sequence: AAG
cacacaagaatactatcttc

SEQ ID NO: 110309 - DNA, 20 bp, Artificial Sequence
  Description of Artificial Sequence: Synthetic oligonucleotide
  Target: ATXN1; (+) strand; PAM type: NRG; PAM sequence: TGG
ttcaagaacaaaaacgccac

SEQ ID NO: 110310 - DNA, 20 bp, Artificial Sequence
  Description of Artificial Sequence: Synthetic oligonucleotide
  Target: ATXN1; (+) strand; PAM type: NRG; PAM sequence: CGG
atttgtatcatccttcacca

SEQ ID NO: 110311 - DNA, 20 bp, Artificial Sequence
  Description of Artificial Sequence: Synthetic oligonucleotide
  Target: ATXN1; (+) strand; PAM type: NRG; PAM sequence: CAG
atcatccttcaccacggcca

SEQ ID NO: 110312 - DNA, 20 bp, Artificial Sequence
  Description of Artificial Sequence: Synthetic oligonucleotide
  Target: ATXN1; (+) strand; PAM type: NRG; PAM sequence: CGG
accacggccacagaatttga

SEQ ID NO: 110313 - DNA, 20 bp, Artificial Sequence
  Description of Artificial Sequence: Synthetic oligonucleotide
  Target: ATXN1; (+) strand; PAM type: NRG; PAM sequence: GAG
ctcgcaaccattgctatgtt

SEQ ID NO: 110314 - DNA, 20 bp, Artificial Sequence
  Description of Artificial Sequence: Synthetic oligonucleotide
  Target: ATXN1; (+) strand; PAM type: NRG; PAM sequence: CAG
gtttcattgtccctgtttga

SEQ ID NO: 110315 - DNA, 20 bp, Artificial Sequence
  Description of Artificial Sequence: Synthetic oligonucleotide
  Target: ATXN1; (+) strand; PAM type: NRG; PAM sequence: AGG
tttcattgtccctgtttgac

SEQ ID NO: 110316 - DNA, 20 bp, Artificial Sequence
  Description of Artificial Sequence: Synthetic oligonucleotide
  Target: ATXN1; (+) strand; PAM type: NRG; PAM sequence: GAG
attgtccctgtttgacaggt

SEQ ID NO: 110317 - DNA, 20 bp, Artificial Sequence
  Description of Artificial Sequence: Synthetic oligonucleotide
  Target: ATXN1; (+) strand; PAM type: NRG; PAM sequence: TAG
ccctgtttgacaggtgagat

SEQ ID NO: 110318 - DNA, 20 bp, Artificial Sequence
  Description of Artificial Sequence: Synthetic oligonucleotide
  Target: ATXN1; (+) strand; PAM type: NRG; PAM sequence: AGG
cctgtttgacaggtgagatt

SEQ ID NO: 110319 - DNA, 20 bp, Artificial Sequence
  Description of Artificial Sequence: Synthetic oligonucleotide
  Target: ATXN1; (+) strand; PAM type: NRG; PAM sequence: AAG
tgagattaggtgatctgtcc

SEQ ID NO: 110320 - DNA, 20 bp, Artificial Sequence
  Description of Artificial Sequence: Synthetic oligonucleotide
  Target: ATXN1; (+) strand; PAM type: NRG; PAM sequence: AGG
gagattaggtgatctgtcca

SEQ ID NO: 110321 - DNA, 20 bp, Artificial Sequence
  Description of Artificial Sequence: Synthetic oligonucleotide
  Target: ATXN1; (+) strand; PAM type: NRG; PAM sequence: TAG
tctgtccaaggccacatatc

SEQ ID NO: 110322 - DNA, 20 bp, Artificial Sequence
  Description of Artificial Sequence: Synthetic oligonucleotide
  Target: ATXN1; (+) strand; PAM type: NRG; PAM sequence: AAG
tccaaggccacatatctagt

SEQ ID NO: 110323 - DNA, 20 bp, Artificial Sequence
  Description of Artificial Sequence: Synthetic oligonucleotide
  Target: ATXN1; (+) strand; PAM type: NRG; PAM sequence: TAG
cacatatctagtaagttgca

SEQ ID NO: 110324 - DNA, 20 bp, Artificial Sequence
  Description of Artificial Sequence: Synthetic oligonucleotide
  Target: ATXN1; (+) strand; PAM type: NRG; PAM sequence: CAG
tatctagtaagttgcataga

SEQ ID NO: 110325 - DNA, 20 bp, Artificial Sequence
  Description of Artificial Sequence: Synthetic oligonucleotide
  Target: ATXN1; (+) strand; PAM type: NRG; PAM sequence: AGG
atctagtaagttgcatagac

SEQ ID NO: 110326 - DNA, 20 bp, Artificial Sequence
  Description of Artificial Sequence: Synthetic oligonucleotide
  Target: ATXN1; (+) strand; PAM type: NRG; PAM sequence: CAG
gcatagacaggactcaaatc

SEQ ID NO: 110327 - DNA, 20 bp, Artificial Sequence
  Description of Artificial Sequence: Synthetic oligonucleotide
  Target: ATXN1; (+) strand; PAM type: NRG; PAM sequence: TAG
aatccaaatcttgtattctt

SEQ ID NO: 110328 - DNA, 20 bp, Artificial Sequence
  Description of Artificial Sequence: Synthetic oligonucleotide
  Target: ATXN1; (+) strand; PAM type: NRG; PAM sequence: CAG
gtattctttagactttacca

SEQ ID NO: 110329 - DNA, 20 bp, Artificial Sequence
  Description of Artificial Sequence: Synthetic oligonucleotide
  Target: ATXN1; (+) strand; PAM type: NRG; PAM sequence: AGG
tattctttagactttaccac

SEQ ID NO: 110330 - DNA, 20 bp, Artificial Sequence
  Description of Artificial Sequence: Synthetic oligonucleotide
  Target: ATXN1; (+) strand; PAM type: NRG; PAM sequence: TGG
atgccaatctgtcatgaaaa

SEQ ID NO: 110331 - DNA, 20 bp, Artificial Sequence
  Description of Artificial Sequence: Synthetic oligonucleotide
  Target: ATXN1; (+) strand; PAM type: NRG; PAM sequence: GGG
tgccaatctgtcatgaaaat

SEQ ID NO: 110332 - DNA, 20 bp, Artificial Sequence
  Description of Artificial Sequence: Synthetic oligonucleotide
  Target: ATXN1; (+) strand; PAM type: NRG; PAM sequence: AAG
aaatgggacttttttttcaa

SEQ ID NO: 110333 - DNA, 20 bp, Artificial Sequence
  Description of Artificial Sequence: Synthetic oligonucleotide
  Target: ATXN1; (+) strand; PAM type: NRG; PAM sequence: AGG
aatgggacttttttttcaaa

SEQ ID NO: 110334 - DNA, 20 bp, Artificial Sequence
  Description of Artificial Sequence: Synthetic oligonucleotide
  Target: ATXN1; (+) strand; PAM type: NRG; PAM sequence: TGG
tttttcaaaaggtcaacatc

SEQ ID NO: 110335 - DNA, 20 bp, Artificial Sequence
  Description of Artificial Sequence: Synthetic oligonucleotide
  Target: ATXN1; (+) strand; PAM type: NRG; PAM sequence: GGG
ttttcaaaaggtcaacatct

SEQ ID NO: 110336 - DNA, 20 bp, Artificial Sequence
  Description of Artificial Sequence: Synthetic oligonucleotide
  Target: ATXN1; (+) strand; PAM type: NRG; PAM sequence: TAG
gctcacttctctccttcctt

SEQ ID NO: 110337 - DNA, 20 bp, Artificial Sequence
  Description of Artificial Sequence: Synthetic oligonucleotide
  Target: ATXN1; (+) strand; PAM type: NRG; PAM sequence: TAG
acttctctccttcctttagt

SEQ ID NO: 110338 - DNA, 20 bp, Artificial Sequence
  Description of Artificial Sequence: Synthetic oligonucleotide
  Target: ATXN1; (+) strand; PAM type: NRG; PAM sequence: CAG
ccttcctttagttagcaacg

SEQ ID NO: 110339 - DNA, 20 bp, Artificial Sequence
  Description of Artificial Sequence: Synthetic oligonucleotide
  Target: ATXN1; (+) strand; PAM type: NRG; PAM sequence: GAG
ttagcaacgcagccaacttt

SEQ ID NO: 110340 - DNA, 20 bp, Artificial Sequence
  Description of Artificial Sequence: Synthetic oligonucleotide
  Target: ATXN1; (+) strand; PAM type: NRG; PAM sequence: AGG
tagcaacgcagccaactttg

SEQ ID NO: 110341 - DNA, 20 bp, Artificial Sequence
  Description of Artificial Sequence: Synthetic oligonucleotide
  Target: ATXN1; (+) strand; PAM type: NRG; PAM sequence: AAG
aaatacgaactccaccatct

SEQ ID NO: 110342 - DNA, 20 bp, Artificial Sequence
  Description of Artificial Sequence: Synthetic oligonucleotide
  Target: ATXN1; (+) strand; PAM type: NRG; PAM sequence: AAG
ctaagctcccttcctgccca

SEQ ID NO: 110343 - DNA, 20 bp, Artificial Sequence
  Description of Artificial Sequence: Synthetic oligonucleotide
  Target: ATXN1; (+) strand; PAM type: NRG; PAM sequence: AGG
taagctcccttcctgcccaa

SEQ ID NO: 110344 - DNA, 20 bp, Artificial Sequence
  Description of Artificial Sequence: Synthetic oligonucleotide
  Target: ATXN1; (+) strand; PAM type: NRG; PAM sequence: CAG
gctcccttcctgcccaaagg

SEQ ID NO: 110345 - DNA, 20 bp, Artificial Sequence
  Description of Artificial Sequence: Synthetic oligonucleotide
  Target: ATXN1; (+) strand; PAM type: NRG; PAM sequence: TAG
tccccactgctgcaacgtct

SEQ ID NO: 110346 - DNA, 20 bp, Artificial Sequence
  Description of Artificial Sequence: Synthetic oligonucleotide
  Target: ATXN1; (+) strand; PAM type: NRG; PAM sequence: AAG
cacttccacctgaattccta

SEQ ID NO: 110347 - DNA, 20 bp, Artificial Sequence
  Description of Artificial Sequence: Synthetic oligonucleotide
  Target: ATXN1; (+) strand; PAM type: NRG; PAM sequence: TAG
ctgaattcctaaagatgtcc

SEQ ID NO: 110348 - DNA, 20 bp, Artificial Sequence
  Description of Artificial Sequence: Synthetic oligonucleotide
  Target: ATXN1; (+) strand; PAM type: NRG; PAM sequence: AGG
tgaattcctaaagatgtcct

SEQ ID NO: 110349 - DNA, 20 bp, Artificial Sequence
  Description of Artificial Sequence: Synthetic oligonucleotide
  Target: ATXN1; (+) strand; PAM type: NRG; PAM sequence: CAG
attcctaaagatgtcctagg

SEQ ID NO: 110350 - DNA, 20 bp, Artificial Sequence
  Description of Artificial Sequence: Synthetic oligonucleotide
  Target: ATXN1; (+) strand; PAM type: NRG; PAM sequence: AGG
ttcctaaagatgtcctaggc

SEQ ID NO: 110351 - DNA, 20 bp, Artificial Sequence
  Description of Artificial Sequence: Synthetic oligonucleotide
  Target: ATXN1; (+) strand; PAM type: NRG; PAM sequence: TGG
ctaaagatgtcctaggcagg

SEQ ID NO: 110352 - DNA, 20 bp, Artificial Sequence
  Description of Artificial Sequence: Synthetic oligonucleotide
  Target: ATXN1; (+) strand; PAM type: NRG; PAM sequence: GGG
taaagatgtcctaggcaggt

SEQ ID NO: 110353 - DNA, 20 bp, Artificial Sequence
  Description of Artificial Sequence: Synthetic oligonucleotide
  Target: ATXN1; (+) strand; PAM type: NRG; PAM sequence: TAG
cctaggcaggtgggcatcat

SEQ ID NO: 110354 - DNA, 20 bp, Artificial Sequence
  Description of Artificial Sequence: Synthetic oligonucleotide
  Target: ATXN1; (+) strand; PAM type: NRG; PAM sequence: AGG
ctaggcaggtgggcatcatt

SEQ ID NO: 110355 - DNA, 20 bp, Artificial Sequence
  Description of Artificial Sequence: Synthetic oligonucleotide
  Target: ATXN1; (+) strand; PAM type: NRG; PAM sequence: AAG
ggcaggtgggcatcattagg

SEQ ID NO: 110356 - DNA, 20 bp, Artificial Sequence
  Description of Artificial Sequence: Synthetic oligonucleotide
  Target: ATXN1; (+) strand; PAM type: NRG; PAM sequence: AAG
gtgttttatactttgtgtct

SEQ ID NO: 110357 - DNA, 20 bp, Artificial Sequence
  Description of Artificial Sequence: Synthetic oligonucleotide
  Target: ATXN1; (+) strand; PAM type: NRG; PAM sequence: AAG
gtctaagttattcaaaccca

SEQ ID NO: 110358 - DNA, 20 bp, Artificial Sequence
  Description of Artificial Sequence: Synthetic oligonucleotide
  Target: ATXN1; (+) strand; PAM type: NRG; PAM sequence: GAG
ctaagttattcaaacccaaa

SEQ ID NO: 110359 - DNA, 20 bp, Artificial Sequence
  Description of Artificial Sequence: Synthetic oligonucleotide
  Target: ATXN1; (+) strand; PAM type: NRG; PAM sequence: AAG
agttattcaaacccaaagag

SEQ ID NO: 110360 - DNA, 20 bp, Artificial Sequence
  Description of Artificial Sequence: Synthetic oligonucleotide
  Target: ATXN1; (+) strand; PAM type: NRG; PAM sequence: AAG
tcaaacccaaagagaagcct

SEQ ID NO: 110361 - DNA, 20 bp, Artificial Sequence
  Description of Artificial Sequence: Synthetic oligonucleotide
  Target: ATXN1; (+) strand; PAM type: NRG; PAM sequence: AGG
caaacccaaagagaagccta

SEQ ID NO: 110362 - DNA, 20 bp, Artificial Sequence
  Description of Artificial Sequence: Synthetic oligonucleotide
  Target: ATXN1; (+) strand; PAM type: NRG; PAM sequence: TAG
gcatctaatttaaattcaaa

SEQ ID NO: 110363 - DNA, 20 bp, Artificial Sequence
  Description of Artificial Sequence: Synthetic oligonucleotide
  Target: ATXN1; (+) strand; PAM type: NRG; PAM sequence: AAG
tctaatttaaattcaaatag

SEQ ID NO: 110364 - DNA, 20 bp, Artificial Sequence
  Description of Artificial Sequence: Synthetic oligonucleotide
  Target: ATXN1; (+) strand; PAM type: NRG; PAM sequence: AAG
aatagaagtaatcgtgaata

SEQ ID NO: 110365 - DNA, 20 bp, Artificial Sequence
  Description of Artificial Sequence: Synthetic oligonucleotide
  Target: ATXN1; (+) strand; PAM type: NRG; PAM sequence: AAG
taatcgtgaataaagaatcc

SEQ ID NO: 110366 - DNA, 20 bp, Artificial Sequence
  Description of Artificial Sequence: Synthetic oligonucleotide
  Target: ATXN1; (+) strand; PAM type: NRG; PAM sequence: TGG
atccaagttcttgcacttaa

SEQ ID NO: 110367 - DNA, 20 bp, Artificial Sequence
  Description of Artificial Sequence: Synthetic oligonucleotide
  Target: ATXN1; (+) strand; PAM type: NRG; PAM sequence: TAG
aatatatatgtatatgtgta

SEQ ID NO: 110368 - DNA, 20 bp, Artificial Sequence
  Description of Artificial Sequence: Synthetic oligonucleotide
  Target: ATXN1; (+) strand; PAM type: NRG; PAM sequence: GAG
tatatatgtatatgtgtata

SEQ ID NO: 110369 - DNA, 20 bp, Artificial Sequence
  Description of Artificial Sequence: Synthetic oligonucleotide
  Target: ATXN1; (+) strand; PAM type: NRG; PAM sequence: GAG
tacacacacacacatttcat

SEQ ID NO: 110370 - DNA, 20 bp, Artificial Sequence
  Description of Artificial Sequence: Synthetic oligonucleotide
  Target: ATXN1; (+) strand; PAM type: NRG; PAM sequence: AGG
acacacacacacatttcatg

SEQ ID NO: 110371 - DNA, 20 bp, Artificial Sequence
  Description of Artificial Sequence: Synthetic oligonucleotide
  Target: ATXN1; (+) strand; PAM type: NRG; PAM sequence: GGG
cacacacacacatttcatga

SEQ ID NO: 110372 - DNA, 20 bp, Artificial Sequence
  Description of Artificial Sequence: Synthetic oligonucleotide
  Target: ATXN1; (+) strand; PAM type: NRG; PAM sequence: GGG
acacacacacatttcatgag

SEQ ID NO: 110373 - DNA, 20 bp, Artificial Sequence
  Description of Artificial Sequence: Synthetic oligonucleotide
  Target: ATXN1; (+) strand; PAM type: NRG; PAM sequence: GGG
cacacacacatttcatgagg

SEQ ID NO: 110374 - DNA, 20 bp, Artificial Sequence
  Description of Artificial Sequence: Synthetic oligonucleotide
  Target: ATXN1; (+) strand; PAM type: NRG; PAM sequence: GAG
cacaaatacgtgtgttttgt

SEQ ID NO: 110375 - DNA, 20 bp, Artificial Sequence
  Description of Artificial Sequence: Synthetic oligonucleotide
  Target: ATXN1; (+) strand; PAM type: NRG; PAM sequence: TAG
tgagtgtgtatgtgtgtgtc

SEQ ID NO: 110376 - DNA, 20 bp, Artificial Sequence
  Description of Artificial Sequence: Synthetic oligonucleotide
  Target: ATXN1; (+) strand; PAM type: NRG; PAM sequence: CAG
agtttgtttttcgcctcctc

SEQ ID NO: 110377 - DNA, 20 bp, Artificial Sequence
  Description of Artificial Sequence: Synthetic oligonucleotide
  Target: ATXN1; (+) strand; PAM type: NRG; PAM sequence: AGG
gtttgtttttcgcctcctcc

SEQ ID NO: 110378 - DNA, 20 bp, Artificial Sequence
  Description of Artificial Sequence: Synthetic oligonucleotide
  Target: ATXN1; (+) strand; PAM type: NRG; PAM sequence: GAG
ttgtttttcgcctcctccag

SEQ ID NO: 110379 - DNA, 20 bp, Artificial Sequence
  Description of Artificial Sequence: Synthetic oligonucleotide
  Target: ATXN1; (+) strand; PAM type: NRG; PAM sequence: CAG
cgcctcctccaggagttata

SEQ ID NO: 110380 - DNA, 20 bp, Artificial Sequence
  Description of Artificial Sequence: Synthetic oligonucleotide
  Target: ATXN1; (+) strand; PAM type: NRG; PAM sequence: AAG
ccaggagttatacagcaaaa

SEQ ID NO: 110381 - DNA, 20 bp, Artificial Sequence
  Description of Artificial Sequence: Synthetic oligonucleotide
  Target: ATXN1; (+) strand; PAM type: NRG; PAM sequence: AAG
ggagttatacagcaaaaaag

SEQ ID NO: 110382 - DNA, 20 bp, Artificial Sequence
  Description of Artificial Sequence: Synthetic oligonucleotide
  Target: ATXN1; (+) strand; PAM type: NRG; PAM sequence: CAG
aaaaaatccctgccttttat

SEQ ID NO: 110383 - DNA, 20 bp, Artificial Sequence
  Description of Artificial Sequence: Synthetic oligonucleotide
  Target: ATXN1; (+) strand; PAM type: NRG; PAM sequence: TGG
atgattttatgactaaatcc

SEQ ID NO: 110384 - DNA, 20 bp, Artificial Sequence
  Description of Artificial Sequence: Synthetic oligonucleotide
  Target: ATXN1; (+) strand; PAM type: NRG; PAM sequence: GGG
tgattttatgactaaatcct

SEQ ID NO: 110385 - DNA, 20 bp, Artificial Sequence
  Description of Artificial Sequence: Synthetic oligonucleotide
  Target: ATXN1; (+) strand; PAM type: NRG; PAM sequence: AAG
taaatcctgggaaaaatgtg

SEQ ID NO: 110386 - DNA, 20 bp, Artificial Sequence
  Description of Artificial Sequence: Synthetic oligonucleotide
  Target: ATXN1; (+) strand; PAM type: NRG; PAM sequence: TGG
ggaaaaatgtgaagaatgct

SEQ ID NO: 110387 - DNA, 20 bp, Artificial Sequence
  Description of Artificial Sequence: Synthetic oligonucleotide
  Target: ATXN1; (+) strand; PAM type: NRG; PAM sequence: TAG
aaatgtgaagaatgcttggc

SEQ ID NO: 110388 - DNA, 20 bp, Artificial Sequence
  Description of Artificial Sequence: Synthetic oligonucleotide
  Target: ATXN1; (+) strand; PAM type: NRG; PAM sequence: TGG
gtgaagaatgcttggctaga

SEQ ID NO: 110389 - DNA, 20 bp, Artificial Sequence
  Description of Artificial Sequence: Synthetic oligonucleotide
  Target: ATXN1; (+) strand; PAM type: NRG; PAM sequence: AAG
agaatgcttggctagatggc

SEQ ID NO: 110390 - DNA, 20 bp, Artificial Sequence
  Description of Artificial Sequence: Synthetic oligonucleotide
  Target: ATXN1; (+) strand; PAM type: NRG; PAM sequence: CAG
ggctagatggcaagcttttc

SEQ ID NO: 110391 - DNA, 20 bp, Artificial Sequence
  Description of Artificial Sequence: Synthetic oligonucleotide
  Target: ATXN1; (+) strand; PAM type: NRG; PAM sequence: TAG
acaacactgcttatgaattg

SEQ ID NO: 110392 - DNA, 20 bp, Artificial Sequence
  Description of Artificial Sequence: Synthetic oligonucleotide
  Target: ATXN1; (+) strand; PAM type: NRG; PAM sequence: TGG
tgcttatgaattgtagcact

SEQ ID NO: 110393 - DNA, 20 bp, Artificial Sequence
  Description of Artificial Sequence: Synthetic oligonucleotide
  Target: ATXN1; (+) strand; PAM type: NRG; PAM sequence: GAG
cttatgaattgtagcacttg

SEQ ID NO: 110394 - DNA, 20 bp, Artificial Sequence
  Description of Artificial Sequence: Synthetic oligonucleotide
  Target: ATXN1; (+) strand; PAM type: NRG; PAM sequence: AAG
atgaattgtagcacttggag

SEQ ID NO: 110395 - DNA, 20 bp, Artificial Sequence
  Description of Artificial Sequence: Synthetic oligonucleotide
  Target: ATXN1; (+) strand; PAM type: NRG; PAM sequence: TAG
catgatgtacatttttgctc

SEQ ID NO: 110396 - DNA, 20 bp, Artificial Sequence
  Description of Artificial Sequence: Synthetic oligonucleotide
  Target: ATXN1; (+) strand; PAM type: NRG; PAM sequence: GAG
gtacatttttgctctagctt

SEQ ID NO: 110397 - DNA, 20 bp, Artificial Sequence
  Description of Artificial Sequence: Synthetic oligonucleotide
  Target: ATXN1; (+) strand; PAM type: NRG; PAM sequence: TGG
gcttgagactaaatcctgtt

SEQ ID NO: 110398 - DNA, 20 bp, Artificial Sequence
  Description of Artificial Sequence: Synthetic oligonucleotide
  Target: ATXN1; (+) strand; PAM type: NRG; PAM sequence: GAG
ttgagactaaatcctgtttg

SEQ ID NO: 110399 - DNA, 20 bp, Artificial Sequence
  Description of Artificial Sequence: Synthetic oligonucleotide
  Target: ATXN1; (+) strand; PAM type: NRG; PAM sequence: AGG
tgagactaaatcctgtttgg

SEQ ID NO: 110400 - DNA, 20 bp, Artificial Sequence
  Description of Artificial Sequence: Synthetic oligonucleotide
  Target: ATXN1; (+) strand; PAM type: NRG; PAM sequence: TAG
gactaaatcctgtttggagg

SEQ ID NO: 110401 - DNA, 20 bp, Artificial Sequence
  Description of Artificial Sequence: Synthetic oligonucleotide
  Target: ATXN1; (+) strand; PAM type: NRG; PAM sequence: AGG
actaaatcctgtttggaggt

SEQ ID NO: 110402 - DNA, 20 bp, Artificial Sequence
  Description of Artificial Sequence: Synthetic oligonucleotide
  Target: ATXN1; (+) strand; PAM type: NRG; PAM sequence: TGG
gtttggaggtaggttttctt

SEQ ID NO: 110403 - DNA, 20 bp, Artificial Sequence
  Description of Artificial Sequence: Synthetic oligonucleotide
  Target: ATXN1; (+) strand; PAM type: NRG; PAM sequence: CAG
ggtaggttttctttggcttt

SEQ ID NO: 110404 - DNA, 20 bp, Artificial Sequence
  Description of Artificial Sequence: Synthetic oligonucleotide
  Target: ATXN1; (+) strand; PAM type: NRG; PAM sequence: AAG
ttttctttggctttcagaaa

SEQ ID NO: 110405 - DNA, 20 bp, Artificial Sequence
  Description of Artificial Sequence: Synthetic oligonucleotide
  Target: ATXN1; (+) strand; PAM type: NRG; PAM sequence: TGG
gttgaaccgattgtacaaca

SEQ ID NO: 110406 - DNA, 20 bp, Artificial Sequence
  Description of Artificial Sequence: Synthetic oligonucleotide
  Target: ATXN1; (+) strand; PAM type: NRG; PAM sequence: GGG
ttgaaccgattgtacaacat

SEQ ID NO: 110407 - DNA, 20 bp, Artificial Sequence
  Description of Artificial Sequence: Synthetic oligonucleotide
  Target: ATXN1; (+) strand; PAM type: NRG; PAM sequence: TGG
gattgtacaacatgggtctt

SEQ ID NO: 110408 - DNA, 20 bp, Artificial Sequence
  Description of Artificial Sequence: Synthetic oligonucleotide
  Target: ATXN1; (+) strand; PAM type: NRG; PAM sequence: GGG
attgtacaacatgggtcttt

SEQ ID NO: 110409 - DNA, 20 bp, Artificial Sequence
  Description of Artificial Sequence: Synthetic oligonucleotide
  Target: ATXN1; (+) strand; PAM type: NRG; PAM sequence: TGG
ggtctttgggccctccaacg

SEQ ID NO: 110410 - DNA, 20 bp, Artificial Sequence
  Description of Artificial Sequence: Synthetic oligonucleotide
  Target: ATXN1; (+) strand; PAM type: NRG; PAM sequence: GAG
ctccaacgtggactcaccat

SEQ ID NO: 110411 - DNA, 20 bp, Artificial Sequence
  Description of Artificial Sequence: Synthetic oligonucleotide
  Target: ATXN1; (+) strand; PAM type: NRG; PAM sequence: GAG
ccaacgtggactcaccatga

SEQ ID NO: 110412 - DNA, 20 bp, Artificial Sequence
  Description of Artificial Sequence: Synthetic oligonucleotide
  Target: ATXN1; (+) strand; PAM type: NRG; PAM sequence: AGG
caacgtggactcaccatgag

SEQ ID NO: 110413 - DNA, 20 bp, Artificial Sequence
  Description of Artificial Sequence: Synthetic oligonucleotide
  Target: ATXN1; (+) strand; PAM type: NRG; PAM sequence: CAG
atgcctccgtctcacgactc

SEQ ID NO: 110414 - DNA, 20 bp, Artificial Sequence
  Description of Artificial Sequence: Synthetic oligonucleotide
  Target: ATXN1; (+) strand; PAM type: NRG; PAM sequence: CAG
ctccgtctcacgactccagc

SEQ ID NO: 110415 - DNA, 20 bp, Artificial Sequence
  Description of Artificial Sequence: Synthetic oligonucleotide
  Target: ATXN1; (+) strand; PAM type: NRG; PAM sequence: AGG
tccgtctcacgactccagcc

SEQ ID NO: 110416 - DNA, 20 bp, Artificial Sequence
  Description of Artificial Sequence: Synthetic oligonucleotide
  Target: ATXN1; (+) strand; PAM type: NRG; PAM sequence: GGG
ccgtctcacgactccagcca

SEQ ID NO: 110417 - DNA, 20 bp, Artificial Sequence
  Description of Artificial Sequence: Synthetic oligonucleotide
  Target: ATXN1; (+) strand; PAM type: NRG; PAM sequence: CAG
ccagccagggttaaaacctt

SEQ ID NO: 110418 - DNA, 20 bp, Artificial Sequence
  Description of Artificial Sequence: Synthetic oligonucleotide
  Target: ATXN1; (+) strand; PAM type: NRG; PAM sequence: AAG
agatgttttctcaacacatt

SEQ ID NO: 110419 - DNA, 20 bp, Artificial Sequence
  Description of Artificial Sequence: Synthetic oligonucleotide
  Target: ATXN1; (+) strand; PAM type: NRG; PAM sequence: CAG
tgttttctcaacacattaag

SEQ ID NO: 110420 - DNA, 20 bp, Artificial Sequence
  Description of Artificial Sequence: Synthetic oligonucleotide
  Target: ATXN1; (+) strand; PAM type: NRG; PAM sequence: AAG
aagcagaactaaccatcaca

SEQ ID NO: 110421 - DNA, 20 bp, Artificial Sequence
  Description of Artificial Sequence: Synthetic oligonucleotide
  Target: ATXN1; (+) strand; PAM type: NRG; PAM sequence: AGG
agcagaactaaccatcacaa

SEQ ID NO: 110422 - DNA, 20 bp, Artificial Sequence
  Description of Artificial Sequence: Synthetic oligonucleotide
  Target: ATXN1; (+) strand; PAM type: NRG; PAM sequence: CAG
aaacccatctgtccccttgt

SEQ ID NO: 110423 - DNA, 20 bp, Artificial Sequence
  Description of Artificial Sequence: Synthetic oligonucleotide
  Target: ATXN1; (+) strand; PAM type: NRG; PAM sequence: AGG
aacccatctgtccccttgtc

SEQ ID NO: 110424 - DNA, 20 bp, Artificial Sequence
  Description of Artificial Sequence: Synthetic oligonucleotide
  Target: ATXN1; (+) strand; PAM type: NRG; PAM sequence: GAG
gtccccttgtcaggattttt

SEQ ID NO: 110425 - DNA, 20 bp, Artificial Sequence
  Description of Artificial Sequence: Synthetic oligonucleotide
  Target: ATXN1; (+) strand; PAM type: NRG; PAM sequence: TGG
aggatttttgagattgtcaa

SEQ ID NO: 110426 - DNA, 20 bp, Artificial Sequence
  Description of Artificial Sequence: Synthetic oligonucleotide
  Target: ATXN1; (+) strand; PAM type: NRG; PAM sequence: TGG
ttgtcaatggactgaccttg

SEQ ID NO: 110427 - DNA, 20 bp, Artificial Sequence
  Description of Artificial Sequence: Synthetic oligonucleotide
  Target: ATXN1; (+) strand; PAM type: NRG; PAM sequence: TGG
caatggactgaccttgtggc

SEQ ID NO: 110428 - DNA, 20 bp, Artificial Sequence
  Description of Artificial Sequence: Synthetic oligonucleotide
  Target: ATXN1; (+) strand; PAM type: NRG; PAM sequence: TGG
cttgtggctggaaaacattt

SEQ ID NO: 110429 - DNA, 20 bp, Artificial Sequence
  Description of Artificial Sequence: Synthetic oligonucleotide
  Target: ATXN1; (+) strand; PAM type: NRG; PAM sequence: GAG
tgtggctggaaaacattttg

SEQ ID NO: 110430 - DNA, 20 bp, Artificial Sequence
  Description of Artificial Sequence: Synthetic oligonucleotide
  Target: ATXN1; (+) strand; PAM type: NRG; PAM sequence: AGG
gtggctggaaaacattttgg

SEQ ID NO: 110431 - DNA, 20 bp, Artificial Sequence
  Description of Artificial Sequence: Synthetic oligonucleotide
  Target: ATXN1; (+) strand; PAM type: NRG; PAM sequence: AAG
ttttggaggccgtgtaacaa

SEQ ID NO: 110432 - DNA, 20 bp, Artificial Sequence
  Description of Artificial Sequence: Synthetic oligonucleotide
  Target: ATXN1; (+) strand; PAM type: NRG; PAM sequence: TGG
cgtgtaacaaaagttaaatg

SEQ ID NO: 110433 - DNA, 20 bp, Artificial Sequence
  Description of Artificial Sequence: Synthetic oligonucleotide
  Target: ATXN1; (+) strand; PAM type: NRG; PAM sequence: CAG
gtaacaaaagttaaatgtgg

SEQ ID NO: 110434 - DNA, 20 bp, Artificial Sequence
  Description of Artificial Sequence: Synthetic oligonucleotide
  Target: ATXN1; (+) strand; PAM type: NRG; PAM sequence: CAG
taaatgtggcagtgaatgca

SEQ ID NO: 110435 - DNA, 20 bp, Artificial Sequence
  Description of Artificial Sequence: Synthetic oligonucleotide
  Target: ATXN1; (+) strand; PAM type: NRG; PAM sequence: GAG
aatgtggcagtgaatgcaca

SEQ ID NO: 110436 - DNA, 20 bp, Artificial Sequence
  Description of Artificial Sequence: Synthetic oligonucleotide
  Target: ATXN1; (+) strand; PAM type: NRG; PAM sequence: TAG
tgaatgcacagagaaattct

SEQ ID NO: 110437 - DNA, 20 bp, Artificial Sequence
  Description of Artificial Sequence: Synthetic oligonucleotide
  Target: ATXN1; (+) strand; PAM type: NRG; PAM sequence: GAG
aatgcacagagaaattctta

SEQ ID NO: 110438 - DNA, 20 bp, Artificial Sequence
  Description of Artificial Sequence: Synthetic oligonucleotide
  Target: ATXN1; (+) strand; PAM type: NRG; PAM sequence: AGG
atgcacagagaaattcttag

SEQ ID NO: 110439 - DNA, 20 bp, Artificial Sequence
  Description of Artificial Sequence: Synthetic oligonucleotide
  Target: ATXN1; (+) strand; PAM type: NRG; PAM sequence: TAG
gagaaattcttagaggtcac

SEQ ID NO: 110440 - DNA, 20 bp, Artificial Sequence
  Description of Artificial Sequence: Synthetic oligonucleotide
  Target: ATXN1; (+) strand; PAM type: NRG; PAM sequence: TGG
aattactaacaccattaccc

SEQ ID NO: 110441 - DNA, 20 bp, Artificial Sequence
  Description of Artificial Sequence: Synthetic oligonucleotide
  Target: ATXN1; (+) strand; PAM type: NRG; PAM sequence: AAG
actaacaccattaccctggc

SEQ ID NO: 110442 - DNA, 20 bp, Artificial Sequence
  Description of Artificial Sequence: Synthetic oligonucleotide
  Target: ATXN1; (+) strand; PAM type: NRG; PAM sequence: GAG
taacaccattaccctggcaa

SEQ ID NO: 110443 - DNA, 20 bp, Artificial Sequence
  Description of Artificial Sequence: Synthetic oligonucleotide
  Target: ATXN1; (+) strand; PAM type: NRG; PAM sequence: TGG
attaccctggcaagagatga

SEQ ID NO: 110444 - DNA, 20 bp, Artificial Sequence
  Description of Artificial Sequence: Synthetic oligonucleotide
  Target: ATXN1; (+) strand; PAM type: NRG; PAM sequence: GAG
taccctggcaagagatgatg

SEQ ID NO: 110445 - DNA, 20 bp, Artificial Sequence
  Description of Artificial Sequence: Synthetic oligonucleotide
  Target: ATXN1; (+) strand; PAM type: NRG; PAM sequence: CAG
atggagtttccattttatct

SEQ ID NO: 110446 - DNA, 20 bp, Artificial Sequence
  Description of Artificial Sequence: Synthetic oligonucleotide
  Target: ATXN1; (+) strand; PAM type: NRG; PAM sequence: GAG
ggagtttccattttatctca

SEQ ID NO: 110447 - DNA, 20 bp, Artificial Sequence
  Description of Artificial Sequence: Synthetic oligonucleotide
  Target: ATXN1; (+) strand; PAM type: NRG; PAM sequence: AGG
gagtttccattttatctcag

SEQ ID NO: 110448 - DNA, 20 bp, Artificial Sequence
  Description of Artificial Sequence: Synthetic oligonucleotide
  Target: ATXN1; (+) strand; PAM type: NRG; PAM sequence: TGG
tccattttatctcagaggtt

SEQ ID NO: 110449 - DNA, 20 bp, Artificial Sequence
  Description of Artificial Sequence: Synthetic oligonucleotide
  Target: ATXN1; (+) strand; PAM type: NRG; PAM sequence: TGG
attttatctcagaggtttgg

SEQ ID NO: 110450 - DNA, 20 bp, Artificial Sequence
  Description of Artificial Sequence: Synthetic oligonucleotide
  Target: ATXN1; (+) strand; PAM type: NRG; PAM sequence: GGG
ttttatctcagaggtttggt

SEQ ID NO: 110451 - DNA, 20 bp, Artificial Sequence
  Description of Artificial Sequence: Synthetic oligonucleotide
  Target: ATXN1; (+) strand; PAM type: NRG; PAM sequence: TGG
tcagaggtttggtgggtgta

SEQ ID NO: 110452 - DNA, 20 bp, Artificial Sequence
  Description of Artificial Sequence: Synthetic oligonucleotide
  Target: ATXN1; (+) strand; PAM type: NRG; PAM sequence: TAG
gtgatgacttaaaatgacgt

SEQ ID NO: 110453 - DNA, 20 bp, Artificial Sequence
  Description of Artificial Sequence: Synthetic oligonucleotide
  Target: ATXN1; (+) strand; PAM type: NRG; PAM sequence: AGG
tgatgacttaaaatgacgtt

SEQ ID NO: 110454 - DNA, 20 bp, Artificial Sequence
  Description of Artificial Sequence: Synthetic oligonucleotide
  Target: ATXN1; (+) strand; PAM type: NRG; PAM sequence: TAG
taaaatgacgttaggctacg

SEQ ID NO: 110455 - DNA, 20 bp, Artificial Sequence
  Description of Artificial Sequence: Synthetic oligonucleotide
  Target: ATXN1; (+) strand; PAM type: NRG; PAM sequence: TGG
ctacgtagccaacactttct

SEQ ID NO: 110456 - DNA, 20 bp, Artificial Sequence
  Description of Artificial Sequence: Synthetic oligonucleotide
  Target: ATXN1; (+) strand; PAM type: NRG; PAM sequence: AAG
gtagccaacactttcttgga

SEQ ID NO: 110457 - DNA, 20 bp, Artificial Sequence
  Description of Artificial Sequence: Synthetic oligonucleotide
  Target: ATXN1; (+) strand; PAM type: NRG; PAM sequence: AGG
tagccaacactttcttggaa

SEQ ID NO: 110458 - DNA, 20 bp, Artificial Sequence
  Description of Artificial Sequence: Synthetic oligonucleotide
  Target: ATXN1; (+) strand; PAM type: NRG; PAM sequence: CAG
tgctgttctattaaaactgt

SEQ ID NO: 110459 - DNA, 20 bp, Artificial Sequence
  Description of Artificial Sequence: Synthetic oligonucleotide
  Target: ATXN1; (+) strand; PAM type: NRG; PAM sequence: TAG
ctattaaaactgtcagcaaa

SEQ ID NO: 110460 - DNA, 20 bp, Artificial Sequence
  Description of Artificial Sequence: Synthetic oligonucleotide
  Target: ATXN1; (+) strand; PAM type: NRG; PAM sequence: AGG
tattaaaactgtcagcaaat

SEQ ID NO: 110461 - DNA, 20 bp, Artificial Sequence
  Description of Artificial Sequence: Synthetic oligonucleotide
  Target: ATXN1; (+) strand; PAM type: NRG; PAM sequence: GGG
attaaaactgtcagcaaata

SEQ ID NO: 110462 - DNA, 20 bp, Artificial Sequence
  Description of Artificial Sequence: Synthetic oligonucleotide
  Target: ATXN1; (+) strand; PAM type: NRG; PAM sequence: AAG
aactgtcagcaaatagggcc

SEQ ID NO: 110463 - DNA, 20 bp, Artificial Sequence
  Description of Artificial Sequence: Synthetic oligonucleotide
  Target: ATXN1; (+) strand; PAM type: NRG; PAM sequence: AGG
actgtcagcaaatagggcca

SEQ ID NO: 110464 - DNA, 20 bp, Artificial Sequence
  Description of Artificial Sequence: Synthetic oligonucleotide
  Target: ATXN1; (+) strand; PAM type: NRG; PAM sequence: TGG
aatagggccaaggcgctcac

SEQ ID NO: 110465 - DNA, 20 bp, Artificial Sequence
  Description of Artificial Sequence: Synthetic oligonucleotide
  Target: ATXN1; (+) strand; PAM type: NRG; PAM sequence: GAG
ggcgctcactggtctatgcc

SEQ ID NO: 110466 - DNA, 20 bp, Artificial Sequence
  Description of Artificial Sequence: Synthetic oligonucleotide
  Target: ATXN1; (+) strand; PAM type: NRG; PAM sequence: AGG
gcgctcactggtctatgccg

SEQ ID NO: 110467 - DNA, 20 bp, Artificial Sequence
  Description of Artificial Sequence: Synthetic oligonucleotide
  Target: ATXN1; (+) strand; PAM type: NRG; PAM sequence: AAG
tctatgccgaggacacctta

SEQ ID NO: 110468 - DNA, 20 bp, Artificial Sequence
  Description of Artificial Sequence: Synthetic oligonucleotide
  Target: ATXN1; (+) strand; PAM type: NRG; PAM sequence: CAG
cgaggacaccttaaagtaat

SEQ ID NO: 110469 - DNA, 20 bp, Artificial Sequence
  Description of Artificial Sequence: Synthetic oligonucleotide
  Target: ATXN1; (+) strand; PAM type: NRG; PAM sequence: AGG
gaggacaccttaaagtaatc

SEQ ID NO: 110470 - DNA, 20 bp, Artificial Sequence
  Description of Artificial Sequence: Synthetic oligonucleotide
  Target: ATXN1; (+) strand; PAM type: NRG; PAM sequence: AAG
agtaatcaggccgtcaaata

SEQ ID NO: 110471 - DNA, 20 bp, Artificial Sequence
  Description of Artificial Sequence: Synthetic oligonucleotide
  Target: ATXN1; (+) strand; PAM type: NRG; PAM sequence: AGG
gtaatcaggccgtcaaataa

SEQ ID NO: 110472 - DNA, 20 bp, Artificial Sequence
  Description of Artificial Sequence: Synthetic oligonucleotide
  Target: ATXN1; (+) strand; PAM type: NRG; PAM sequence: AAG
acactttctcaacatttcta

SEQ ID NO: 110473 - DNA, 20 bp, Artificial Sequence
  Description of Artificial Sequence: Synthetic oligonucleotide
  Target: ATXN1; (+) strand; PAM type: NRG; PAM sequence: CAG
tttctcaacatttctaaaga

SEQ ID NO: 110474 - DNA, 20 bp, Artificial Sequence
  Description of Artificial Sequence: Synthetic oligonucleotide
  Target: ATXN1; (+) strand; PAM type: NRG; PAM sequence: TAG
aacatttctaaagacagaaa

SEQ ID NO: 110475 - DNA, 20 bp, Artificial Sequence
  Description of Artificial Sequence: Synthetic oligonucleotide
  Target: ATXN1; (+) strand; PAM type: NRG; PAM sequence: AAG
ctaaagacagaaatagcgaa

SEQ ID NO: 110476 - DNA, 20 bp, Artificial Sequence
  Description of Artificial Sequence: Synthetic oligonucleotide
  Target: ATXN1; (+) strand; PAM type: NRG; PAM sequence: GAG
aaagacagaaatagcgaaaa

SEQ ID NO: 110477 - DNA, 20 bp, Artificial Sequence
  Description of Artificial Sequence: Synthetic oligonucleotide
  Target: ATXN1; (+) strand; PAM type: NRG; PAM sequence: AAG
cgaaaagagtgttgcgttcc

SEQ ID NO: 110478 - DNA, 20 bp, Artificial Sequence
  Description of Artificial Sequence: Synthetic oligonucleotide
  Target: ATXN1; (+) strand; PAM type: NRG; PAM sequence: CAG
gtgttgcgttccaagcatat

SEQ ID NO: 110479 - DNA, 20 bp, Artificial Sequence
  Description of Artificial Sequence: Synthetic oligonucleotide
  Target: ATXN1; (+) strand; PAM type: NRG; PAM sequence: AAG
gttccaagcatatcagactt

SEQ ID NO: 110480 - DNA, 20 bp, Artificial Sequence
  Description of Artificial Sequence: Synthetic oligonucleotide
  Target: ATXN1; (+) strand; PAM type: NRG; PAM sequence: TGG
cttaagtcatttctgcctca

SEQ ID NO: 110481 - DNA, 20 bp, Artificial Sequence
  Description of Artificial Sequence: Synthetic oligonucleotide
  Target: ATXN1; (+) strand; PAM type: NRG; PAM sequence: TAG
tcatttctgcctcatggttc

SEQ ID NO: 110482 - DNA, 20 bp, Artificial Sequence
  Description of Artificial Sequence: Synthetic oligonucleotide
  Target: ATXN1; (+) strand; PAM type: NRG; PAM sequence: AAG
tttctgcctcatggttctag

SEQ ID NO: 110483 - DNA, 20 bp, Artificial Sequence
  Description of Artificial Sequence: Synthetic oligonucleotide
  Target: ATXN1; (+) strand; PAM type: NRG; PAM sequence: AAG
gcctcatggttctagaagac

SEQ ID NO: 110484 - DNA, 20 bp, Artificial Sequence
  Description of Artificial Sequence: Synthetic oligonucleotide
  Target: ATXN1; (+) strand; PAM type: NRG; PAM sequence: GAG
ctcatggttctagaagacaa

SEQ ID NO: 110485 - DNA, 20 bp, Artificial Sequence
  Description of Artificial Sequence: Synthetic oligonucleotide
  Target: ATXN1; (+) strand; PAM type: NRG; PAM sequence: AGG
tcatggttctagaagacaag

SEQ ID NO: 110486 - DNA, 20 bp, Artificial Sequence
  Description of Artificial Sequence: Synthetic oligonucleotide
  Target: ATXN1; (+) strand; PAM type: NRG; PAM sequence: TGG
tggttctagaagacaagagg

SEQ ID NO: 110487 - DNA, 20 bp, Artificial Sequence
  Description of Artificial Sequence: Synthetic oligonucleotide
  Target: ATXN1; (+) strand; PAM type: NRG; PAM sequence: GAG
gttctagaagacaagaggtg

SEQ ID NO: 110488 - DNA, 20 bp, Artificial Sequence
  Description of Artificial Sequence: Synthetic oligonucleotide
  Target: ATXN1; (+) strand; PAM type: NRG; PAM sequence: AGG
ttctagaagacaagaggtgg

SEQ ID NO: 110489 - DNA, 20 bp, Artificial Sequence
  Description of Artificial Sequence: Synthetic oligonucleotide
  Target: ATXN1; (+) strand; PAM type: NRG; PAM sequence: TGG
tagaagacaagaggtggagg

SEQ ID NO: 110490 - DNA, 20 bp, Artificial Sequence
  Description of Artificial Sequence: Synthetic oligonucleotide
  Target: ATXN1; (+) strand; PAM type: NRG; PAM sequence: CAG
aagacaagaggtggaggtgg

SEQ ID NO: 110491 - DNA, 20 bp, Artificial Sequence
  Description of Artificial Sequence: Synthetic oligonucleotide
  Target: ATXN1; (+) strand; PAM type: NRG; PAM sequence: AAG
caagaggtggaggtggcagc

SEQ ID NO: 110492 - DNA, 20 bp, Artificial Sequence
  Description of Artificial Sequence: Synthetic oligonucleotide
  Target: ATXN1; (+) strand; PAM type: NRG; PAM sequence: CGG
gaggtggaggtggcagcaag

SEQ ID NO: 110493 - DNA, 20 bp, Artificial Sequence
  Description of Artificial Sequence: Synthetic oligonucleotide
  Target: ATXN1; (+) strand; PAM type: NRG; PAM sequence: GGG
aggtggaggtggcagcaagc

SEQ ID NO: 110494 - DNA, 20 bp, Artificial Sequence
  Description of Artificial Sequence: Synthetic oligonucleotide
  Target: ATXN1; (+) strand; PAM type: NRG; PAM sequence: GGG
ggtggaggtggcagcaagcg

SEQ ID NO: 110495 - DNA, 20 bp, Artificial Sequence
  Description of Artificial Sequence: Synthetic oligonucleotide
  Target: ATXN1; (+) strand; PAM type: NRG; PAM sequence: GAG
tggaggtggcagcaagcggg

SEQ ID NO: 110496 - DNA, 20 bp, Artificial Sequence
  Description of Artificial Sequence: Synthetic oligonucleotide
  Target: ATXN1; (+) strand; PAM type: NRG; PAM sequence: AGG
ggaggtggcagcaagcgggg

SEQ ID NO: 110497 - DNA, 20 bp, Artificial Sequence
  Description of Artificial Sequence: Synthetic oligonucleotide
  Target: ATXN1; (+) strand; PAM type: NRG; PAM sequence: GGG
gaggtggcagcaagcgggga

SEQ ID NO: 110498 - DNA, 20 bp, Artificial Sequence
  Description of Artificial Sequence: Synthetic oligonucleotide
  Target: ATXN1; (+) strand; PAM type: NRG; PAM sequence: AAG
gtggcagcaagcggggaggg

SEQ ID NO: 110499 - DNA, 20 bp, Artificial Sequence
  Description of Artificial Sequence: Synthetic oligonucleotide
  Target: ATXN1; (+) strand; PAM type: NRG; PAM sequence: TGG
taattctccttctaaccctc

SEQ ID NO: 110500 - DNA, 20 bp, Artificial Sequence
  Description of Artificial Sequence: Synthetic oligonucleotide
  Target: ATXN1; (+) strand; PAM type: NRG; PAM sequence: CGG
ctaaccctctggctctcaac

SEQ ID NO: 110501 - DNA, 20 bp, Artificial Sequence
  Description of Artificial Sequence: Synthetic oligonucleotide
  Target: ATXN1; (+) strand; PAM type: NRG; PAM sequence: AAG
accctctggctctcaaccgg

SEQ ID NO: 110502 - DNA, 20 bp, Artificial Sequence
  Description of Artificial Sequence: Synthetic oligonucleotide
  Target: ATXN1; (+) strand; PAM type: NRG; PAM sequence: AAG
cggaagcaattttgctctgc

SEQ ID NO: 110503 - DNA, 20 bp, Artificial Sequence
  Description of Artificial Sequence: Synthetic oligonucleotide
  Target: ATXN1; (+) strand; PAM type: NRG; PAM sequence: AGG
ggaagcaattttgctctgca

SEQ ID NO: 110504 - DNA, 20 bp, Artificial Sequence
  Description of Artificial Sequence: Synthetic oligonucleotide
  Target: ATXN1; (+) strand; PAM type: NRG; PAM sequence: GGG
gaagcaattttgctctgcaa

SEQ ID NO: 110505 - DNA, 20 bp, Artificial Sequence
  Description of Artificial Sequence: Synthetic oligonucleotide
  Target: ATXN1; (+) strand; PAM type: NRG; PAM sequence: TGG
tttgctctgcaagggacacc

SEQ ID NO: 110506 - DNA, 20 bp, Artificial Sequence
  Description of Artificial Sequence: Synthetic oligonucleotide
  Target: ATXN1; (+) strand; PAM type: NRG; PAM sequence: AAG
gctctgcaagggacacctgg

SEQ ID NO: 110507 - DNA, 20 bp, Artificial Sequence
  Description of Artificial Sequence: Synthetic oligonucleotide
  Target: ATXN1; (+) strand; PAM type: NRG; PAM sequence: GAG
agggacacctggaagtgtct

SEQ ID NO: 110508 - DNA, 20 bp, Artificial Sequence
  Description of Artificial Sequence: Synthetic oligonucleotide
  Target: ATXN1; (+) strand; PAM type: NRG; PAM sequence: AGG
gggacacctggaagtgtctg

SEQ ID NO: 110509 - DNA, 20 bp, Artificial Sequence
  Description of Artificial Sequence: Synthetic oligonucleotide
  Target: ATXN1; (+) strand; PAM type: NRG; PAM sequence: CGG
tttttgattgtcacaactgc

SEQ ID NO: 110510 - DNA, 20 bp, Artificial Sequence
  Description of Artificial Sequence: Synthetic oligonucleotide
  Target: ATXN1; (+) strand; PAM type: NRG; PAM sequence: GGG
ttttgattgtcacaactgcc

SEQ ID NO: 110511 - DNA, 20 bp, Artificial Sequence
  Description of Artificial Sequence: Synthetic oligonucleotide
  Target: ATXN1; (+) strand; PAM type: NRG; PAM sequence: CAG
tcacaactgccgggtgctac

SEQ ID NO: 110512 - DNA, 20 bp, Artificial Sequence
  Description of Artificial Sequence: Synthetic oligonucleotide
  Target: ATXN1; (+) strand; PAM type: NRG; PAM sequence: CAG
tgccgggtgctaccagcatc

SEQ ID NO: 110513 - DNA, 20 bp, Artificial Sequence
  Description of Artificial Sequence: Synthetic oligonucleotide
  Target: ATXN1; (+) strand; PAM type: NRG; PAM sequence: TAG
tgctaccagcatccagcgca

SEQ ID NO: 110514 - DNA, 20 bp, Artificial Sequence
  Description of Artificial Sequence: Synthetic oligonucleotide
  Target: ATXN1; (+) strand; PAM type: NRG; PAM sequence: GAG
ctaccagcatccagcgcata

SEQ ID NO: 110515 - DNA, 20 bp, Artificial Sequence
  Description of Artificial Sequence: Synthetic oligonucleotide
  Target: ATXN1; (+) strand; PAM type: NRG; PAM sequence: AGG
taccagcatccagcgcatag

SEQ ID NO: 110516 - DNA, 20 bp, Artificial Sequence
  Description of Artificial Sequence: Synthetic oligonucleotide
  Target: ATXN1; (+) strand; PAM type: NRG; PAM sequence: CAG
agcatccagcgcatagaggc

SEQ ID NO: 110517 - DNA, 20 bp, Artificial Sequence
  Description of Artificial Sequence: Synthetic oligonucleotide
  Target: ATXN1; (+) strand; PAM type: NRG; PAM sequence: AGG
gcatccagcgcatagaggcc

SEQ ID NO: 110518 - DNA, 20 bp, Artificial Sequence
  Description of Artificial Sequence: Synthetic oligonucleotide
  Target: ATXN1; (+) strand; PAM type: NRG; PAM sequence: CGG
gctaaatttctcccaatgca

SEQ ID NO: 110519 - DNA, 20 bp, Artificial Sequence
  Description of Artificial Sequence: Synthetic oligonucleotide
  Target: ATXN1; (+) strand; PAM type: NRG; PAM sequence: GGG
ctaaatttctcccaatgcac

SEQ ID NO: 110520 - DNA, 20 bp, Artificial Sequence
  Description of Artificial Sequence: Synthetic oligonucleotide
  Target: ATXN1; (+) strand; PAM type: NRG; PAM sequence: TAG
catctccctgcttccccaaa

SEQ ID NO: 110521 - DNA, 20 bp, Artificial Sequence
  Description of Artificial Sequence: Synthetic oligonucleotide
  Target: ATXN1; (+) strand; PAM type: NRG; PAM sequence: AGG
atctccctgcttccccaaat

SEQ ID NO: 110522 - DNA, 20 bp, Artificial Sequence
  Description of Artificial Sequence: Synthetic oligonucleotide
  Target: ATXN1; (+) strand; PAM type: NRG; PAM sequence: TGG
cttccccaaataggatgatc

SEQ ID NO: 110523 - DNA, 20 bp, Artificial Sequence
  Description of Artificial Sequence: Synthetic oligonucleotide
  Target: ATXN1; (+) strand; PAM type: NRG; PAM sequence: GGG
ttccccaaataggatgatct

SEQ ID NO: 110524 - DNA, 20 bp, Artificial Sequence
  Description of Artificial Sequence: Synthetic oligonucleotide
  Target: ATXN1; (+) strand; PAM type: NRG; PAM sequence: CAG
atctgggccccaaatgtcaa

SEQ ID NO: 110525 - DNA, 20 bp, Artificial Sequence
  Description of Artificial Sequence: Synthetic oligonucleotide
  Target: ATXN1; (+) strand; PAM type: NRG; PAM sequence: GAG
caaatgtcaacagtgctgtt

SEQ ID NO: 110526 - DNA, 20 bp, Artificial Sequence
  Description of Artificial Sequence: Synthetic oligonucleotide
  Target: ATXN1; (+) strand; PAM type: NRG; PAM sequence: AAG
tgttgagattccctgctcta

SEQ ID NO: 110527 - DNA, 20 bp, Artificial Sequence
  Description of Artificial Sequence: Synthetic oligonucleotide
  Target: ATXN1; (+) strand; PAM type: NRG; PAM sequence: AGG
gttgagattccctgctctaa

SEQ ID NO: 110528 - DNA, 20 bp, Artificial Sequence
  Description of Artificial Sequence: Synthetic oligonucleotide
  Target: ATXN1; (+) strand; PAM type: NRG; PAM sequence: GGG
ttgagattccctgctctaaa

SEQ ID NO: 110529 - DNA, 20 bp, Artificial Sequence
  Description of Artificial Sequence: Synthetic oligonucleotide
  Target: ATXN1; (+) strand; PAM type: NRG; PAM sequence: AAG
agattccctgctctaaaggg

SEQ ID NO: 110530 - DNA, 20 bp, Artificial Sequence
  Description of Artificial Sequence: Synthetic oligonucleotide
  Target: ATXN1; (+) strand; PAM type: NRG; PAM sequence: CAG
ttccctgctctaaagggaag

SEQ ID NO: 110531 - DNA, 20 bp, Artificial Sequence
  Description of Artificial Sequence: Synthetic oligonucleotide
  Target: ATXN1; (+) strand; PAM type: NRG; PAM sequence: AAG
tgctctaaagggaagcagaa

SEQ ID NO: 110532 - DNA, 20 bp, Artificial Sequence
  Description of Artificial Sequence: Synthetic oligonucleotide
  Target: ATXN1; (+) strand; PAM type: NRG; PAM sequence: CAG
taaagggaagcagaaaagat

SEQ ID NO: 110533 - DNA, 20 bp, Artificial Sequence
  Description of Artificial Sequence: Synthetic oligonucleotide
  Target: ATXN1; (+) strand; PAM type: NRG; PAM sequence: CAG
gaagcagaaaagatcagctg

SEQ ID NO: 110534 - DNA, 20 bp, Artificial Sequence
  Description of Artificial Sequence: Synthetic oligonucleotide
  Target: ATXN1; (+) strand; PAM type: NRG; PAM sequence: CAG
cagaaaagatcagctgcagc

SEQ ID NO: 110535 - DNA, 20 bp, Artificial Sequence
  Description of Artificial Sequence: Synthetic oligonucleotide
  Target: ATXN1; (+) strand; PAM type: NRG; PAM sequence: GAG
gaaaagatcagctgcagcca

SEQ ID NO: 110536 - DNA, 20 bp, Artificial Sequence
  Description of Artificial Sequence: Synthetic oligonucleotide
  Target: ATXN1; (+) strand; PAM type: NRG; PAM sequence: TGG
ttgaccttctaactgttgcc

SEQ ID NO: 110537 - DNA, 20 bp, Artificial Sequence
  Description of Artificial Sequence: Synthetic oligonucleotide
  Target: ATXN1; (+) strand; PAM type: NRG; PAM sequence: GGG
tgaccttctaactgttgcct

SEQ ID NO: 110538 - DNA, 20 bp, Artificial Sequence
  Description of Artificial Sequence: Synthetic oligonucleotide
  Target: ATXN1; (+) strand; PAM type: NRG; PAM sequence: TGG
ctaactgttgcctgggctcc

SEQ ID NO: 110539 - DNA, 20 bp, Artificial Sequence
  Description of Artificial Sequence: Synthetic oligonucleotide
  Target: ATXN1; (+) strand; PAM type: NRG; PAM sequence: GAG
aactgttgcctgggctcctg

SEQ ID NO: 110540 - DNA, 20 bp, Artificial Sequence
  Description of Artificial Sequence: Synthetic oligonucleotide
  Target: ATXN1; (+) strand; PAM type: NRG; PAM sequence: AGG
actgttgcctgggctcctgg

SEQ ID NO: 110541 - DNA, 20 bp, Artificial Sequence
  Description of Artificial Sequence: Synthetic oligonucleotide
  Target: ATXN1; (+) strand; PAM type: NRG; PAM sequence: AAG
ctcctggaggacatcctctg

SEQ ID NO: 110542 - DNA, 20 bp, Artificial Sequence
  Description of Artificial Sequence: Synthetic oligonucleotide
  Target: ATXN1; (+) strand; PAM type: NRG; PAM sequence: TAG
tgtttccttgacctaaacgc

SEQ ID NO: 110543 - DNA, 20 bp, Artificial Sequence
  Description of Artificial Sequence: Synthetic oligonucleotide
  Target: ATXN1; (+) strand; PAM type: NRG; PAM sequence: TGG
cctaaacgctagcctcacca

SEQ ID NO: 110544 - DNA, 20 bp, Artificial Sequence
  Description of Artificial Sequence: Synthetic oligonucleotide
  Target: ATXN1; (+) strand; PAM type: NRG; PAM sequence: CAG
gctagcctcaccatggccca

SEQ ID NO: 110545 - DNA, 20 bp, Artificial Sequence
  Description of Artificial Sequence: Synthetic oligonucleotide
  Target: ATXN1; (+) strand; PAM type: NRG; PAM sequence: CAG
cctcaccatggcccacagcc

SEQ ID NO: 110546 - DNA, 20 bp, Artificial Sequence
  Description of Artificial Sequence: Synthetic oligonucleotide
  Target: ATXN1; (+) strand; PAM type: NRG; PAM sequence: CAG
caccatggcccacagcccag

SEQ ID NO: 110547 - DNA, 20 bp, Artificial Sequence
  Description of Artificial Sequence: Synthetic oligonucleotide
  Target: ATXN1; (+) strand; PAM type: NRG; PAM sequence: CAG
ggcccacagcccagcagcat

SEQ ID NO: 110548 - DNA, 20 bp, Artificial Sequence
  Description of Artificial Sequence: Synthetic oligonucleotide
  Target: ATXN1; (+) strand; PAM type: NRG; PAM sequence: TAG
cccagcagcatcagcatcac

SEQ ID NO: 110549 - DNA, 20 bp, Artificial Sequence
  Description of Artificial Sequence: Synthetic oligonucleotide
  Target: ATXN1; (+) strand; PAM type: NRG; PAM sequence: AGG
ccagcagcatcagcatcact

SEQ ID NO: 110550 - DNA, 20 bp, Artificial Sequence
  Description of Artificial Sequence: Synthetic oligonucleotide
  Target: ATXN1; (+) strand; PAM type: NRG; PAM sequence: GGG
cagcagcatcagcatcacta

SEQ ID NO: 110551 - DNA, 20 bp, Artificial Sequence
  Description of Artificial Sequence: Synthetic oligonucleotide
  Target: ATXN1; (+) strand; PAM type: NRG; PAM sequence: GAG
gcagcatcagcatcactagg

SEQ ID NO: 110552 - DNA, 20 bp, Artificial Sequence
  Description of Artificial Sequence: Synthetic oligonucleotide
  Target: ATXN1; (+) strand; PAM type: NRG; PAM sequence: TGG
cagcatcactagggagcatg

SEQ ID NO: 110553 - DNA, 20 bp, Artificial Sequence
  Description of Artificial Sequence: Synthetic oligonucleotide
  Target: ATXN1; (+) strand; PAM type: NRG; PAM sequence: GGG
agcatcactagggagcatgt

SEQ ID NO: 110554 - DNA, 20 bp, Artificial Sequence
  Description of Artificial Sequence: Synthetic oligonucleotide
  Target: ATXN1; (+) strand; PAM type: NRG; PAM sequence: CAG
tagggagcatgtgggaaatg

SEQ ID NO: 110555 - DNA, 20 bp, Artificial Sequence
  Description of Artificial Sequence: Synthetic oligonucleotide
  Target: ATXN1; (+) strand; PAM type: NRG; PAM sequence: CAG
atgtgggaaatgcagaatct

SEQ ID NO: 110556 - DNA, 20 bp, Artificial Sequence
  Description of Artificial Sequence: Synthetic oligonucleotide
  Target: ATXN1; (+) strand; PAM type: NRG; PAM sequence: AGG
tgtgggaaatgcagaatctc

SEQ ID NO: 110557 - DNA, 20 bp, Artificial Sequence
  Description of Artificial Sequence: Synthetic oligonucleotide
  Target: ATXN1; (+) strand; PAM type: NRG; PAM sequence: CAG
gcagaatctcaggtcccacc

SEQ ID NO: 110558 - DNA, 20 bp, Artificial Sequence
  Description of Artificial Sequence: Synthetic oligonucleotide
  Target: ATXN1; (+) strand; PAM type: NRG; PAM sequence: CAG
tcaggtcccacccagactga

SEQ ID NO: 110559 - DNA, 20 bp, Artificial Sequence
  Description of Artificial Sequence: Synthetic oligonucleotide
  Target: ATXN1; (+) strand; PAM type: NRG; PAM sequence: CAG
cccacccagactgacagaac

SEQ ID NO: 110560 - DNA, 20 bp, Artificial Sequence
  Description of Artificial Sequence: Synthetic oligonucleotide
  Target: ATXN1; (+) strand; PAM type: NRG; PAM sequence: TAG
accagaatgtgcatttccac

SEQ ID NO: 110561 - DNA, 20 bp, Artificial Sequence
  Description of Artificial Sequence: Synthetic oligonucleotide
  Target: ATXN1; (+) strand; PAM type: NRG; PAM sequence: TGG
gtgcatttccactagaacgc

SEQ ID NO: 110562 - DNA, 20 bp, Artificial Sequence
  Description of Artificial Sequence: Synthetic oligonucleotide
  Target: ATXN1; (+) strand; PAM type: NRG; PAM sequence: GGG
tgcatttccactagaacgct

SEQ ID NO: 110563 - DNA, 20 bp, Artificial Sequence
  Description of Artificial Sequence: Synthetic oligonucleotide
  Target: ATXN1; (+) strand; PAM type: NRG; PAM sequence: GGG
gcatttccactagaacgctg

SEQ ID NO: 110564 - DNA, 20 bp, Artificial Sequence
  Description of Artificial Sequence: Synthetic oligonucleotide
  Target: ATXN1; (+) strand; PAM type: NRG; PAM sequence: GGG
catttccactagaacgctgg

SEQ ID NO: 110565 - DNA, 20 bp, Artificial Sequence
  Description of Artificial Sequence: Synthetic oligonucleotide
  Target: ATXN1; (+) strand; PAM type: NRG; PAM sequence: TAG
ctagaacgctgggggcttcc

SEQ ID NO: 110566 - DNA, 20 bp, Artificial Sequence
  Description of Artificial Sequence: Synthetic oligonucleotide
  Target: ATXN1; (+) strand; PAM type: NRG; PAM sequence: CAG
tcctagacacttgaaacttt

SEQ ID NO: 110567 - DNA, 20 bp, Artificial Sequence
  Description of Artificial Sequence: Synthetic oligonucleotide
  Target: ATXN1; (+) strand; PAM type: NRG; PAM sequence: AAG
tagacacttgaaactttcag

SEQ ID NO: 110568 - DNA, 20 bp, Artificial Sequence
  Description of Artificial Sequence: Synthetic oligonucleotide
  Target: ATXN1; (+) strand; PAM type: NRG; PAM sequence: CAG
cttgaaactttcagaagcac

SEQ ID NO: 110569 - DNA, 20 bp, Artificial Sequence
  Description of Artificial Sequence: Synthetic oligonucleotide
  Target: ATXN1; (+) strand; PAM type: NRG; PAM sequence: CAG
aaactttcagaagcaccaga

SEQ ID NO: 110570 - DNA, 20 bp, Artificial Sequence
  Description of Artificial Sequence: Synthetic oligonucleotide
  Target: ATXN1; (+) strand; PAM type: NRG; PAM sequence: TAG
agacctctctcacctatcct

SEQ ID NO: 110571 - DNA, 20 bp, Artificial Sequence
  Description of Artificial Sequence: Synthetic oligonucleotide
  Target: ATXN1; (+) strand; PAM type: NRG; PAM sequence: AGG
gacctctctcacctatcctt

SEQ ID NO: 110572 - DNA, 20 bp, Artificial Sequence
  Description of Artificial Sequence: Synthetic oligonucleotide
  Target: ATXN1; (+) strand; PAM type: NRG; PAM sequence: CAG
tgtctgtccttctattcact

SEQ ID NO: 110573 - DNA, 20 bp, Artificial Sequence
  Description of Artificial Sequence: Synthetic oligonucleotide
  Target: ATXN1; (+) strand; PAM type: NRG; PAM sequence: CAG
cactctgccctctgaataca

SEQ ID NO: 110574 - DNA, 20 bp, Artificial Sequence
  Description of Artificial Sequence: Synthetic oligonucleotide
  Target: ATXN1; (+) strand; PAM type: NRG; PAM sequence: TAG
cctctgaatacacagtaatc

SEQ ID NO: 110575 - DNA, 20 bp, Artificial Sequence
  Description of Artificial Sequence: Synthetic oligonucleotide
  Target: ATXN1; (+) strand; PAM type: NRG; PAM sequence: AAG
atacacagtaatctagtaaa

SEQ ID NO: 110576 - DNA, 20 bp, Artificial Sequence
  Description of Artificial Sequence: Synthetic oligonucleotide
  Target: ATXN1; (+) strand; PAM type: NRG; PAM sequence: TAG
cacagtaatctagtaaaaag

SEQ ID NO: 110577 - DNA, 20 bp, Artificial Sequence
  Description of Artificial Sequence: Synthetic oligonucleotide
  Target: ATXN1; (+) strand; PAM type: NRG; PAM sequence: CAG
aagtagctctcttcttgctt

SEQ ID NO: 110578 - DNA, 20 bp, Artificial Sequence
  Description of Artificial Sequence: Synthetic oligonucleotide
  Target: ATXN1; (+) strand; PAM type: NRG; PAM sequence: CAG
ttcttgcttcagcctttcct

SEQ ID NO: 110579 - DNA, 20 bp, Artificial Sequence
  Description of Artificial Sequence: Synthetic oligonucleotide
  Target: ATXN1; (+) strand; PAM type: NRG; PAM sequence: CAG
tcagaacattctctccaacc

SEQ ID NO: 110580 - DNA, 20 bp, Artificial Sequence
  Description of Artificial Sequence: Synthetic oligonucleotide
  Target: ATXN1; (+) strand; PAM type: NRG; PAM sequence: TGG
tccaacccagactgtaacct

SEQ ID NO: 110581 - DNA, 20 bp, Artificial Sequence
  Description of Artificial Sequence: Synthetic oligonucleotide
  Target: ATXN1; (+) strand; PAM type: NRG; PAM sequence: CAG
actgtaaccttggctccctg

SEQ ID NO: 110582 - DNA, 20 bp, Artificial Sequence
  Description of Artificial Sequence: Synthetic oligonucleotide
  Target: ATXN1; (+) strand; PAM type: NRG; PAM sequence: CAG
taaccttggctccctgcaga

SEQ ID NO: 110583 - DNA, 20 bp, Artificial Sequence
  Description of Artificial Sequence: Synthetic oligonucleotide
  Target: ATXN1; (+) strand; PAM type: NRG; PAM sequence: CAG
agacagccctgtttctccta

SEQ ID NO: 110584 - DNA, 20 bp, Artificial Sequence
  Description of Artificial Sequence: Synthetic oligonucleotide
  Target: ATXN1; (+) strand; PAM type: NRG; PAM sequence: GAG
tgtttctcctacagccctct

SEQ ID NO: 110585 - DNA, 20 bp, Artificial Sequence
  Description of Artificial Sequence: Synthetic oligonucleotide
  Target: ATXN1; (+) strand; PAM type: NRG; PAM sequence: AGG
gtttctcctacagccctctg

SEQ ID NO: 110586 - DNA, 20 bp, Artificial Sequence
  Description of Artificial Sequence: Synthetic oligonucleotide
  Target: ATXN1; (+) strand; PAM type: NRG; PAM sequence: TGG
tctcctacagccctctgagg

SEQ ID NO: 110587 - DNA, 20 bp, Artificial Sequence
  Description of Artificial Sequence: Synthetic oligonucleotide
  Target: ATXN1; (+) strand; PAM type: NRG; PAM sequence: GAG
tcctacagccctctgaggtg

SEQ ID NO: 110588 - DNA, 20 bp, Artificial Sequence
  Description of Artificial Sequence: Synthetic oligonucleotide
  Target: ATXN1; (+) strand; PAM type: NRG; PAM sequence: GAG
ctacagccctctgaggtgga

SEQ ID NO: 110589 - DNA, 20 bp, Artificial Sequence
  Description of Artificial Sequence: Synthetic oligonucleotide
  Target: ATXN1; (+) strand; PAM type: NRG; PAM sequence: GAG
acagccctctgaggtggaga

SEQ ID NO: 110590 - DNA, 20 bp, Artificial Sequence
  Description of Artificial Sequence: Synthetic oligonucleotide
  Target: ATXN1; (+) strand; PAM type: NRG; PAM sequence: AAG
tggagagagctcaacctccc

SEQ ID NO: 110591 - DNA, 20 bp, Artificial Sequence
  Description of Artificial Sequence: Synthetic oligonucleotide
  Target: ATXN1; (+) strand; PAM type: NRG; PAM sequence: CAG
caacctcccaagcccctgtt

SEQ ID NO: 110592 - DNA, 20 bp, Artificial Sequence
  Description of Artificial Sequence: Synthetic oligonucleotide
  Target: ATXN1; (+) strand; PAM type: NRG; PAM sequence: AGG
aacctcccaagcccctgttc

SEQ ID NO: 110593 - DNA, 20 bp, Artificial Sequence
  Description of Artificial Sequence: Synthetic oligonucleotide
  Target: ATXN1; (+) strand; PAM type: NRG; PAM sequence: GGG
acctcccaagcccctgttca

SEQ ID NO: 110594 - DNA, 20 bp, Artificial Sequence
  Description of Artificial Sequence: Synthetic oligonucleotide
  Target: ATXN1; (+) strand; PAM type: NRG; PAM sequence: TGG
agcccctgttcagggctccg

SEQ ID NO: 110595 - DNA, 20 bp, Artificial Sequence
  Description of Artificial Sequence: Synthetic oligonucleotide
  Target: ATXN1; (+) strand; PAM type: NRG; PAM sequence: TGG
ttccttctcttctgaccacg

SEQ ID NO: 110596 - DNA, 20 bp, Artificial Sequence
  Description of Artificial Sequence: Synthetic oligonucleotide
  Target: ATXN1; (+) strand; PAM type: NRG; PAM sequence: TGG
ctcttctgaccacgtggcca

SEQ ID NO: 110597 - DNA, 20 bp, Artificial Sequence
  Description of Artificial Sequence: Synthetic oligonucleotide
  Target: ATXN1; (+) strand; PAM type: NRG; PAM sequence: CAG
tctgaccacgtggccatggc

SEQ ID NO: 110598 - DNA, 20 bp, Artificial Sequence
  Description of Artificial Sequence: Synthetic oligonucleotide
  Target: ATXN1; (+) strand; PAM type: NRG; PAM sequence: TGG
gtggccatggccagaccaca

SEQ ID NO: 110599 - DNA, 20 bp, Artificial Sequence
  Description of Artificial Sequence: Synthetic oligonucleotide
  Target: ATXN1; (+) strand; PAM type: NRG; PAM sequence: TGG
tggccagaccacatggccat

SEQ ID NO: 110600 - DNA, 20 bp, Artificial Sequence
  Description of Artificial Sequence: Synthetic oligonucleotide
  Target: ATXN1; (+) strand; PAM type: NRG; PAM sequence: AAG
tggcttccatttattgttgc

SEQ ID NO: 110601 - DNA, 20 bp, Artificial Sequence
  Description of Artificial Sequence: Synthetic oligonucleotide
  Target: ATXN1; (+) strand; PAM type: NRG; PAM sequence: AGG
ggcttccatttattgttgca

SEQ ID NO: 110602 - DNA, 20 bp, Artificial Sequence
  Description of Artificial Sequence: Synthetic oligonucleotide
  Target: ATXN1; (+) strand; PAM type: NRG; PAM sequence: AAG
catttattgttgcaaggtac

SEQ ID NO: 110603 - DNA, 20 bp, Artificial Sequence
  Description of Artificial Sequence: Synthetic oligonucleotide
  Target: ATXN1; (+) strand; PAM type: NRG; PAM sequence: AAG
gttgcaaggtacaagttttc

SEQ ID NO: 110604 - DNA, 20 bp, Artificial Sequence
  Description of Artificial Sequence: Synthetic oligonucleotide
  Target: ATXN1; (+) strand; PAM type: NRG; PAM sequence: CAG
caaggtacaagttttcaagc

SEQ ID NO: 110605 - DNA, 20 bp, Artificial Sequence
  Description of Artificial Sequence: Synthetic oligonucleotide
  Target: ATXN1; (+) strand; PAM type: NRG; PAM sequence: TAG
acaagttttcaagccagttc

SEQ ID NO: 110606 - DNA, 20 bp, Artificial Sequence
  Description of Artificial Sequence: Synthetic oligonucleotide
  Target: ATXN1; (+) strand; PAM type: NRG; PAM sequence: AGG
caagttttcaagccagttct

SEQ ID NO: 110607 - DNA, 20 bp, Artificial Sequence
  Description of Artificial Sequence: Synthetic oligonucleotide
  Target: ATXN1; (+) strand; PAM type: NRG; PAM sequence: TGG
tcaagccagttctaggtacc

SEQ ID NO: 110608 - DNA, 20 bp, Artificial Sequence
  Description of Artificial Sequence: Synthetic oligonucleotide
  Target: ATXN1; (+) strand; PAM type: NRG; PAM sequence: TGG
agttctaggtacctggatca

SEQ ID NO: 110609 - DNA, 20 bp, Artificial Sequence
  Description of Artificial Sequence: Synthetic oligonucleotide
  Target: ATXN1; (+) strand; PAM type: NRG; PAM sequence: TGG
atttgccctcaacccaactg

SEQ ID NO: 110610 - DNA, 20 bp, Artificial Sequence
  Description of Artificial Sequence: Synthetic oligonucleotide
  Target: ATXN1; (+) strand; PAM type: NRG; PAM sequence: CAG
aacccaactgtggaattctc

SEQ ID NO: 110611 - DNA, 20 bp, Artificial Sequence
  Description of Artificial Sequence: Synthetic oligonucleotide
  Target: ATXN1; (+) strand; PAM type: NRG; PAM sequence: TGG
ggaattctccagtgactatg

SEQ ID NO: 110612 - DNA, 20 bp, Artificial Sequence
  Description of Artificial Sequence: Synthetic oligonucleotide
  Target: ATXN1; (+) strand; PAM type: NRG; PAM sequence: AAG
atgtggatgacatcttacac

SEQ ID NO: 110613 - DNA, 20 bp, Artificial Sequence
  Description of Artificial Sequence: Synthetic oligonucleotide
  Target: ATXN1; (+) strand; PAM type: NRG; PAM sequence: TGG
acatcttacacaagaattcc

SEQ ID NO: 110614 - DNA, 20 bp, Artificial Sequence
  Description of Artificial Sequence: Synthetic oligonucleotide
  Target: ATXN1; (+) strand; PAM type: NRG; PAM sequence: CAG
tggttcctgaaccttttcta

SEQ ID NO: 110615 - DNA, 20 bp, Artificial Sequence
  Description of Artificial Sequence: Synthetic oligonucleotide
  Target: ATXN1; (+) strand; PAM type: NRG; PAM sequence: TGG
ttcctgaaccttttctacag

SEQ ID NO: 110616 - DNA, 20 bp, Artificial Sequence
  Description of Artificial Sequence: Synthetic oligonucleotide
  Target: ATXN1; (+) strand; PAM type: NRG; PAM sequence: CAG
gcaacaaccacattcccctt

SEQ ID NO: 110617 - DNA, 20 bp, Artificial Sequence
  Description of Artificial Sequence: Synthetic oligonucleotide
  Target: ATXN1; (+) strand; PAM type: NRG; PAM sequence: AAG
tcatatctgactgtgtgcta

SEQ ID NO: 110618 - DNA, 20 bp, Artificial Sequence
  Description of Artificial Sequence: Synthetic oligonucleotide
  Target: ATXN1; (+) strand; PAM type: NRG; PAM sequence: AAG
gactgtgtgctaaagatatt

SEQ ID NO: 110619 - DNA, 20 bp, Artificial Sequence
  Description of Artificial Sequence: Synthetic oligonucleotide
  Target: ATXN1; (+) strand; PAM type: NRG; PAM sequence: GAG
atattgtccttgttctcaat

SEQ ID NO: 110620 - DNA, 20 bp, Artificial Sequence
  Description of Artificial Sequence: Synthetic oligonucleotide
  Target: ATXN1; (+) strand; PAM type: NRG; PAM sequence: CAG
ccttgttctcaatgagctta

SEQ ID NO: 110621 - DNA, 20 bp, Artificial Sequence
  Description of Artificial Sequence: Synthetic oligonucleotide
  Target: ATXN1; (+) strand; PAM type: NRG; PAM sequence: AAG
tcaatgagcttacagtctaa

SEQ ID NO: 110622 - DNA, 20 bp, Artificial Sequence
  Description of Artificial Sequence: Synthetic oligonucleotide
  Target: ATXN1; (+) strand; PAM type: NRG; PAM sequence: GAG
aatgagcttacagtctaaaa

SEQ ID NO: 110623 - DNA, 20 bp, Artificial Sequence
  Description of Artificial Sequence: Synthetic oligonucleotide
  Target: ATXN1; (+) strand; PAM type: NRG; PAM sequence: AGG
atgagcttacagtctaaaag

SEQ ID NO: 110624 - DNA, 20 bp, Artificial Sequence
  Description of Artificial Sequence: Synthetic oligonucleotide
  Target: ATXN1; (+) strand; PAM type: NRG; PAM sequence: GGG
tgagcttacagtctaaaaga

SEQ ID NO: 110625 - DNA, 20 bp, Artificial Sequence
  Description of Artificial Sequence: Synthetic oligonucleotide
  Target: ATXN1; (+) strand; PAM type: NRG; PAM sequence: GAG
agcttacagtctaaaagagg

SEQ ID NO: 110626 - DNA, 20 bp, Artificial Sequence
  Description of Artificial Sequence: Synthetic oligonucleotide
  Target: ATXN1; (+) strand; PAM type: NRG; PAM sequence: AGG
gcttacagtctaaaagaggg

SEQ ID NO: 110627 - DNA, 20 bp, Artificial Sequence
  Description of Artificial Sequence: Synthetic oligonucleotide
  Target: ATXN1; (+) strand; PAM type: NRG; PAM sequence: GGG
cttacagtctaaaagaggga

SEQ ID NO: 110628 - DNA, 20 bp, Artificial Sequence
  Description of Artificial Sequence: Synthetic oligonucleotide
  Target: ATXN1; (+) strand; PAM type: NRG; PAM sequence: GAG
tacagtctaaaagagggagg

SEQ ID NO: 110629 - DNA, 20 bp, Artificial Sequence
  Description of Artificial Sequence: Synthetic oligonucleotide
  Target: ATXN1; (+) strand; PAM type: NRG; PAM sequence: AGG
acagtctaaaagagggaggg

SEQ ID NO: 110630 - DNA, 20 bp, Artificial Sequence
  Description of Artificial Sequence: Synthetic oligonucleotide
  Target: ATXN1; (+) strand; PAM type: NRG; PAM sequence: GGG
cagtctaaaagagggaggga

SEQ ID NO: 110631 - DNA, 20 bp, Artificial Sequence
  Description of Artificial Sequence: Synthetic oligonucleotide
  Target: ATXN1; (+) strand; PAM type: NRG; PAM sequence: GAG
gtctaaaagagggagggagg

SEQ ID NO: 110632 - DNA, 20 bp, Artificial Sequence
  Description of Artificial Sequence: Synthetic oligonucleotide
  Target: ATXN1; (+) strand; PAM type: NRG; PAM sequence: AAG
taaaagagggagggagggag

SEQ ID NO: 110633 - DNA, 20 bp, Artificial Sequence
  Description of Artificial Sequence: Synthetic oligonucleotide
  Target: ATXN1; (+) strand; PAM type: NRG; PAM sequence: TGG
ggagggagggagaagtattt

SEQ ID NO: 110634 - DNA, 20 bp, Artificial Sequence
  Description of Artificial Sequence: Synthetic oligonucleotide
  Target: ATXN1; (+) strand; PAM type: NRG; PAM sequence: TAG
agggagaagtattttggcac

SEQ ID NO: 110635 - DNA, 20 bp, Artificial Sequence
  Description of Artificial Sequence: Synthetic oligonucleotide
  Target: ATXN1; (+) strand; PAM type: NRG; PAM sequence: AAG
gagaagtattttggcactag

SEQ ID NO: 110636 - DNA, 20 bp, Artificial Sequence
  Description of Artificial Sequence: Synthetic oligonucleotide
  Target: ATXN1; (+) strand; PAM type: NRG; PAM sequence: AGG
agaagtattttggcactaga

SEQ ID NO: 110637 - DNA, 20 bp, Artificial Sequence
  Description of Artificial Sequence: Synthetic oligonucleotide
  Target: ATXN1; (+) strand; PAM type: NRG; PAM sequence: GAG
aagtattttggcactagaag

SEQ ID NO: 110638 - DNA, 20 bp, Artificial Sequence
  Description of Artificial Sequence: Synthetic oligonucleotide
  Target: ATXN1; (+) strand; PAM type: NRG; PAM sequence: CGG
tttggcactagaaggagctt

SEQ ID NO: 110639 - DNA, 20 bp, Artificial Sequence
  Description of Artificial Sequence: Synthetic oligonucleotide
  Target: ATXN1; (+) strand; PAM type: NRG; PAM sequence: GGG
ttggcactagaaggagcttc

SEQ ID NO: 110640 - DNA, 20 bp, Artificial Sequence
  Description of Artificial Sequence: Synthetic oligonucleotide
  Target: ATXN1; (+) strand; PAM type: NRG; PAM sequence: AAG
gaaggagcttcgggaattac

SEQ ID NO: 110641 - DNA, 20 bp, Artificial Sequence
  Description of Artificial Sequence: Synthetic oligonucleotide
  Target: ATXN1; (+) strand; PAM type: NRG; PAM sequence: CAG
gagcttcgggaattacaagc

SEQ ID NO: 110642 - DNA, 20 bp, Artificial Sequence
  Description of Artificial Sequence: Synthetic oligonucleotide
  Target: ATXN1; (+) strand; PAM type: NRG; PAM sequence: GAG
gcttcgggaattacaagcca

SEQ ID NO: 110643 - DNA, 20 bp, Artificial Sequence
  Description of Artificial Sequence: Synthetic oligonucleotide
  Target: ATXN1; (+) strand; PAM type: NRG; PAM sequence: AAG
gggaattacaagccagagaa

SEQ ID NO: 110644 - DNA, 20 bp, Artificial Sequence
  Description of Artificial Sequence: Synthetic oligonucleotide
  Target: ATXN1; (+) strand; PAM type: NRG; PAM sequence: AAG
acaagccagagaaaagctca

SEQ ID NO: 110645 - DNA, 20 bp, Artificial Sequence
  Description of Artificial Sequence: Synthetic oligonucleotide
  Target: ATXN1; (+) strand; PAM type: NRG; PAM sequence: AAG
agccagagaaaagctcaaag

SEQ ID NO: 110646 - DNA, 20 bp, Artificial Sequence
  Description of Artificial Sequence: Synthetic oligonucleotide
  Target: ATXN1; (+) strand; PAM type: NRG; PAM sequence: AGG
gccagagaaaagctcaaaga

SEQ ID NO: 110647 - DNA, 20 bp, Artificial Sequence
  Description of Artificial Sequence: Synthetic oligonucleotide
  Target: ATXN1; (+) strand; PAM type: NRG; PAM sequence: TGG
gaaaagctcaaagaaggtca

SEQ ID NO: 110648 - DNA, 20 bp, Artificial Sequence
  Description of Artificial Sequence: Synthetic oligonucleotide
  Target: ATXN1; (+) strand; PAM type: NRG; PAM sequence: TGG
gaaggtcatggtctactttt

SEQ ID NO: 110649 - DNA, 20 bp, Artificial Sequence
  Description of Artificial Sequence: Synthetic oligonucleotide
  Target: ATXN1; (+) strand; PAM type: NRG; PAM sequence: TGG
tactttttggccatttttat

SEQ ID NO: 110650 - DNA, 20 bp, Artificial Sequence
  Description of Artificial Sequence: Synthetic oligonucleotide
  Target: ATXN1; (+) strand; PAM type: NRG; PAM sequence: CAG
tattggctaacactccaacc

SEQ ID NO: 110651 - DNA, 20 bp, Artificial Sequence
  Description of Artificial Sequence: Synthetic oligonucleotide
  Target: ATXN1; (+) strand; PAM type: NRG; PAM sequence: TAG
tggctaacactccaacccag

SEQ ID NO: 110652 - DNA, 20 bp, Artificial Sequence
  Description of Artificial Sequence: Synthetic oligonucleotide
  Target: ATXN1; (+) strand; PAM type: NRG; PAM sequence: TGG
acccagtagttcccacatgc

SEQ ID NO: 110653 - DNA, 20 bp, Artificial Sequence
  Description of Artificial Sequence: Synthetic oligonucleotide
  Target: ATXN1; (+) strand; PAM type: NRG; PAM sequence: GAG
tagttcccacatgctggtct

SEQ ID NO: 110654 - DNA, 20 bp, Artificial Sequence
  Description of Artificial Sequence: Synthetic oligonucleotide
  Target: ATXN1; (+) strand; PAM type: NRG; PAM sequence: CAG
ccacatgctggtctgagaac

SEQ ID NO: 110655 - DNA, 20 bp, Artificial Sequence
  Description of Artificial Sequence: Synthetic oligonucleotide
  Target: ATXN1; (+) strand; PAM type: NRG; PAM sequence: AGG
cacatgctggtctgagaacc

SEQ ID NO: 110656 - DNA, 20 bp, Artificial Sequence
  Description of Artificial Sequence: Synthetic oligonucleotide
  Target: ATXN1; (+) strand; PAM type: NRG; PAM sequence: GGG
acatgctggtctgagaacca

SEQ ID NO: 110657 - DNA, 20 bp, Artificial Sequence
  Description of Artificial Sequence: Synthetic oligonucleotide
  Target: ATXN1; (+) strand; PAM type: NRG; PAM sequence: TGG
tgagaaccagggccaatccg

SEQ ID NO: 110658 - DNA, 20 bp, Artificial Sequence
  Description of Artificial Sequence: Synthetic oligonucleotide
  Target: ATXN1; (+) strand; PAM type: NRG; PAM sequence: AAG
agggccaatccgtggaaatg

SEQ ID NO: 110659 - DNA, 20 bp, Artificial Sequence
  Description of Artificial Sequence: Synthetic oligonucleotide
  Target: ATXN1; (+) strand; PAM type: NRG; PAM sequence: AAG
cgtggaaatgaagaaaaata

SEQ ID NO: 110660 - DNA, 20 bp, Artificial Sequence
  Description of Artificial Sequence: Synthetic oligonucleotide
  Target: ATXN1; (+) strand; PAM type: NRG; PAM sequence: TAG
gaagaaaaataaagacaaca

SEQ ID NO: 110661 - DNA, 20 bp, Artificial Sequence
  Description of Artificial Sequence: Synthetic oligonucleotide
  Target: ATXN1; (+) strand; PAM type: NRG; PAM sequence: TAG
gtaccataatattaaatttc

SEQ ID NO: 110662 - DNA, 20 bp, Artificial Sequence
  Description of Artificial Sequence: Synthetic oligonucleotide
  Target: ATXN1; (+) strand; PAM type: NRG; PAM sequence: AGG
taccataatattaaatttct

SEQ ID NO: 110663 - DNA, 20 bp, Artificial Sequence
  Description of Artificial Sequence: Synthetic oligonucleotide
  Target: ATXN1; (+) strand; PAM type: NRG; PAM sequence: TGG
atattatattattttcactt

SEQ ID NO: 110664 - DNA, 20 bp, Artificial Sequence
  Description of Artificial Sequence: Synthetic oligonucleotide
  Target: ATXN1; (+) strand; PAM type: NRG; PAM sequence: GGG
tattatattattttcacttt

SEQ ID NO: 110665 - DNA, 20 bp, Artificial Sequence
  Description of Artificial Sequence: Synthetic oligonucleotide
  Target: ATXN1; (+) strand; PAM type: NRG; PAM sequence: GGG
attatattattttcactttg

SEQ ID NO: 110666 - DNA, 20 bp, Artificial Sequence
  Description of Artificial Sequence: Synthetic oligonucleotide
  Target: ATXN1; (+) strand; PAM type: NRG; PAM sequence: AAG
aatatcccttcctttttaaa

SEQ ID NO: 110667 - DNA, 20 bp, Artificial Sequence
  Description of Artificial Sequence: Synthetic oligonucleotide
  Target: ATXN1; (+) strand; PAM type: NRG; PAM sequence: TAG
cccttcctttttaaaaagat

SEQ ID NO: 110668 - DNA, 20 bp, Artificial Sequence
  Description of Artificial Sequence: Synthetic oligonucleotide
  Target: ATXN1; (+) strand; PAM type: NRG; PAM sequence: AAG
agattagaaaacttatttta

SEQ ID NO: 110669 - DNA, 20 bp, Artificial Sequence
  Description of Artificial Sequence: Synthetic oligonucleotide
  Target: ATXN1; (+) strand; PAM type: NRG; PAM sequence: CAG
aaaacttattttaaagtgtc

SEQ ID NO: 110670 - DNA, 20 bp, Artificial Sequence
  Description of Artificial Sequence: Synthetic oligonucleotide
  Target: ATXN1; (+) strand; PAM type: NRG; PAM sequence: AAG
agtgtccttacattaaaata

SEQ ID NO: 110671 - DNA, 20 bp, Artificial Sequence
  Description of Artificial Sequence: Synthetic oligonucleotide
  Target: ATXN1; (+) strand; PAM type: NRG; PAM sequence: GAG
tgtccttacattaaaataaa

SEQ ID NO: 110672 - DNA, 20 bp, Artificial Sequence
  Description of Artificial Sequence: Synthetic oligonucleotide
  Target: ATXN1; (+) strand; PAM type: NRG; PAM sequence: TAG
aagagttgacccacatatgc

SEQ ID NO: 110673 - DNA, 20 bp, Artificial Sequence
  Description of Artificial Sequence: Synthetic oligonucleotide
  Target: ATXN1; (+) strand; PAM type: NRG; PAM sequence: TGG
taaaactcatccttgaaacc

SEQ ID NO: 110674 - DNA, 20 bp, Artificial Sequence
  Description of Artificial Sequence: Synthetic oligonucleotide
  Target: ATXN1; (+) strand; PAM type: NRG; PAM sequence: AAG
aactcatccttgaaacctgg

SEQ ID NO: 110675 - DNA, 20 bp, Artificial Sequence
  Description of Artificial Sequence: Synthetic oligonucleotide
  Target: ATXN1; (+) strand; PAM type: NRG; PAM sequence: TGG
tcatccttgaaacctggaag

SEQ ID NO: 110676 - DNA, 20 bp, Artificial Sequence
  Description of Artificial Sequence: Synthetic oligonucleotide
  Target: ATXN1; (+) strand; PAM type: NRG; PAM sequence: CAG
gaaacctggaagtggctttc

SEQ ID NO: 110677 - DNA, 20 bp, Artificial Sequence
  Description of Artificial Sequence: Synthetic oligonucleotide
  Target: ATXN1; (+) strand; PAM type: NRG; PAM sequence: AGG
aaacctggaagtggctttcc

SEQ ID NO: 110678 - DNA, 20 bp, Artificial Sequence
  Description of Artificial Sequence: Synthetic oligonucleotide
  Target: ATXN1; (+) strand; PAM type: NRG; PAM sequence: TGG
agtggctttccaggtctaca

SEQ ID NO: 110679 - DNA, 20 bp, Artificial Sequence
  Description of Artificial Sequence: Synthetic oligonucleotide
  Target: ATXN1; (+) strand; PAM type: NRG; PAM sequence: GGG
gtggctttccaggtctacat

SEQ ID NO: 110680 - DNA, 20 bp, Artificial Sequence
  Description of Artificial Sequence: Synthetic oligonucleotide
  Target: ATXN1; (+) strand; PAM type: NRG; PAM sequence: GAG
ggctttccaggtctacatgg

SEQ ID NO: 110681 - DNA, 20 bp, Artificial Sequence
  Description of Artificial Sequence: Synthetic oligonucleotide
  Target: ATXN1; (+) strand; PAM type: NRG; PAM sequence: AGG
gctttccaggtctacatggg

SEQ ID NO: 110682 - DNA, 20 bp, Artificial Sequence
  Description of Artificial Sequence: Synthetic oligonucleotide
  Target: ATXN1; (+) strand; PAM type: NRG; PAM sequence: GGG
ctttccaggtctacatggga

SEQ ID NO: 110683 - DNA, 20 bp, Artificial Sequence
  Description of Artificial Sequence: Synthetic oligonucleotide
  Target: ATXN1; (+) strand; PAM type: NRG; PAM sequence: GGG
tttccaggtctacatgggag

SEQ ID NO: 110684 - DNA, 20 bp, Artificial Sequence
  Description of Artificial Sequence: Synthetic oligonucleotide
  Target: ATXN1; (+) strand; PAM type: NRG; PAM sequence: TAG
ctacatgggaggggcttgct

SEQ ID NO: 110685 - DNA, 20 bp, Artificial Sequence
  Description of Artificial Sequence: Synthetic oligonucleotide
  Target: ATXN1; (+) strand; PAM type: NRG; PAM sequence: AGG
tacatgggaggggcttgctt

SEQ ID NO: 110686 - DNA, 20 bp, Artificial Sequence
  Description of Artificial Sequence: Synthetic oligonucleotide
  Target: ATXN1; (+) strand; PAM type: NRG; PAM sequence: CAG
tgggaggggcttgcttaggc

SEQ ID NO: 110687 - DNA, 20 bp, Artificial Sequence
  Description of Artificial Sequence: Synthetic oligonucleotide
  Target: ATXN1; (+) strand; PAM type: NRG; PAM sequence: AGG
gggaggggcttgcttaggcc

SEQ ID NO: 110688 - DNA, 20 bp, Artificial Sequence
  Description of Artificial Sequence: Synthetic oligonucleotide
  Target: ATXN1; (+) strand; PAM type: NRG; PAM sequence: GGG
ggaggggcttgcttaggcca

SEQ ID NO: 110689 - DNA, 20 bp, Artificial Sequence
  Description of Artificial Sequence: Synthetic oligonucleotide
  Target: ATXN1; (+) strand; PAM type: NRG; PAM sequence: CAG
gggcttgcttaggccaggga

SEQ ID NO: 110690 - DNA, 20 bp, Artificial Sequence
  Description of Artificial Sequence: Synthetic oligonucleotide
  Target: ATXN1; (+) strand; PAM type: NRG; PAM sequence: TGG
tgcttaggccagggacagtc

SEQ ID NO: 110691 - DNA, 20 bp, Artificial Sequence
  Description of Artificial Sequence: Synthetic oligonucleotide
  Target: ATXN1; (+) strand; PAM type: NRG; PAM sequence: TAG
ggccagggacagtctggttg

SEQ ID NO: 110692 - DNA, 20 bp, Artificial Sequence
  Description of Artificial Sequence: Synthetic oligonucleotide
  Target: ATXN1; (+) strand; PAM type: NRG; PAM sequence: GAG
agggacagtctggttgtagc

SEQ ID NO: 110693 - DNA, 20 bp, Artificial Sequence
  Description of Artificial Sequence: Synthetic oligonucleotide
  Target: ATXN1; (+) strand; PAM type: NRG; PAM sequence: AGG
gggacagtctggttgtagcg

SEQ ID NO: 110694 - DNA, 20 bp, Artificial Sequence
  Description of Artificial Sequence: Synthetic oligonucleotide
  Target: ATXN1; (+) strand; PAM type: NRG; PAM sequence: GGG
ggacagtctggttgtagcga

SEQ ID NO: 110695 - DNA, 20 bp, Artificial Sequence
  Description of Artificial Sequence: Synthetic oligonucleotide
  Target: ATXN1; (+) strand; PAM type: NRG; PAM sequence: TGG
agtctggttgtagcgagggt

SEQ ID NO: 110696 - DNA, 20 bp, Artificial Sequence
  Description of Artificial Sequence: Synthetic oligonucleotide
  Target: ATXN1; (+) strand; PAM type: NRG; PAM sequence: AAG
tggttgtagcgagggttggc

SEQ ID NO: 110697 - DNA, 20 bp, Artificial Sequence
  Description of Artificial Sequence: Synthetic oligonucleotide
  Target: ATXN1; (+) strand; PAM type: NRG; PAM sequence: AAG
ggttggcaagacttgctttg

SEQ ID NO: 110698 - DNA, 20 bp, Artificial Sequence
  Description of Artificial Sequence: Synthetic oligonucleotide
  Target: ATXN1; (+) strand; PAM type: NRG; PAM sequence: TGG
gcccgtctctttacacaaca

SEQ ID NO: 110699 - DNA, 20 bp, Artificial Sequence
  Description of Artificial Sequence: Synthetic oligonucleotide
  Target: ATXN1; (+) strand; PAM type: NRG; PAM sequence: GGG
cccgtctctttacacaacat

SEQ ID NO: 110700 - DNA, 20 bp, Artificial Sequence
  Description of Artificial Sequence: Synthetic oligonucleotide
  Target: ATXN1; (+) strand; PAM type: NRG; PAM sequence: AAG
gtctctttacacaacatggg

SEQ ID NO: 110701 - DNA, 20 bp, Artificial Sequence
  Description of Artificial Sequence: Synthetic oligonucleotide
  Target: ATXN1; (+) strand; PAM type: NRG; PAM sequence: AAG
tcattaattgttcttcataa

SEQ ID NO: 110702 - DNA, 20 bp, Artificial Sequence
  Description of Artificial Sequence: Synthetic oligonucleotide
  Target: ATXN1; (+) strand; PAM type: NRG; PAM sequence: AAG
cataaaagattcaatgtgcc

SEQ ID NO: 110703 - DNA, 20 bp, Artificial Sequence
  Description of Artificial Sequence: Synthetic oligonucleotide
  Target: ATXN1; (+) strand; PAM type: NRG; PAM sequence: AAG
aagattcaatgtgccaagtc

SEQ ID NO: 110704 - DNA, 20 bp, Artificial Sequence
  Description of Artificial Sequence: Synthetic oligonucleotide
  Target: ATXN1; (+) strand; PAM type: NRG; PAM sequence: TGG
tcaatgtgccaagtcaagcc

SEQ ID NO: 110705 - DNA, 20 bp, Artificial Sequence
  Description of Artificial Sequence: Synthetic oligonucleotide
  Target: ATXN1; (+) strand; PAM type: NRG; PAM sequence: GGG
caatgtgccaagtcaagcct

SEQ ID NO: 110706 - DNA, 20 bp, Artificial Sequence
  Description of Artificial Sequence: Synthetic oligonucleotide
  Target: ATXN1; (+) strand; PAM type: NRG; PAM sequence: GGG
aatgtgccaagtcaagcctg

SEQ ID NO: 110707 - DNA, 20 bp, Artificial Sequence
  Description of Artificial Sequence: Synthetic oligonucleotide
  Target: ATXN1; (+) strand; PAM type: NRG; PAM sequence: GGG
atgtgccaagtcaagcctgg

SEQ ID NO: 110708 - DNA, 20 bp, Artificial Sequence
  Description of Artificial Sequence: Synthetic oligonucleotide
  Target: ATXN1; (+) strand; PAM type: NRG; PAM sequence: CAG
ccaagtcaagcctgggggac

SEQ ID NO: 110709 - DNA, 20 bp, Artificial Sequence
  Description of Artificial Sequence: Synthetic oligonucleotide
  Target: ATXN1; (+) strand; PAM type: NRG; PAM sequence: AGG
caagtcaagcctgggggacc

SEQ ID NO: 110710 - DNA, 20 bp, Artificial Sequence
  Description of Artificial Sequence: Synthetic oligonucleotide
  Target: ATXN1; (+) strand; PAM type: NRG; PAM sequence: TGG
caggctcacacctgtaatcc

SEQ ID NO: 110711 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatcctggtgttt

SEQ ID NO: 110712 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcctggtgtttt

SEQ ID NO: 110713 - DNA, 20 bp, Artificial Sequence
  Description of Artificial Sequence: Synthetic oligonucleotide
  Target: ATXN1; (+) strand; PAM type: NRG; PAM sequence: AAG
tgtaatcctggtgttttggg

SEQ ID NO: 110714 - DNA, 20 bp, Artificial Sequence
  Description of Artificial Sequence: Synthetic oligonucleotide
  Target: ATXN1; (+) strand; PAM type: NRG; PAM sequence: GAG
tcctggtgttttgggaagct

SEQ ID NO: 110715 - DNA, 20 bp, Artificial Sequence
  Description of Artificial Sequence: Synthetic oligonucleotide
  Target: ATXN1; (+) strand; PAM type: NRG; PAM sequence: AGG
cctggtgttttgggaagctg

SEQ ID NO: 110716 - DNA, 20 bp, Artificial Sequence
  Description of Artificial Sequence: Synthetic oligonucleotide
  Target: ATXN1; (+) strand; PAM type: NRG; PAM sequence: CAG
ggtgttttgggaagctgagg

SEQ ID NO: 110717 - DNA, 20 bp, Artificial Sequence
  Description of Artificial Sequence: Synthetic oligonucleotide
  Target: ATXN1; (+) strand; PAM type: NRG; PAM sequence: AGG
gtgttttgggaagctgaggc

SEQ ID NO: 110718 - DNA, 20 bp, Artificial Sequence
  Description of Artificial Sequence: Synthetic oligonucleotide
  Target: ATXN1; (+) strand; PAM type: NRG; PAM sequence: GAG
gttttgggaagctgaggcag

SEQ ID NO: 110719 - DNA, 20 bp, Artificial Sequence
  Description of Artificial Sequence: Synthetic oligonucleotide
  Target: ATXN1; (+) strand; PAM type: NRG; PAM sequence: AGG
ttttgggaagctgaggcagg

SEQ ID NO: 110720 - DNA, 20 bp, Artificial Sequence
  Description of Artificial Sequence: Synthetic oligonucleotide
  Target: ATXN1; (+) strand; PAM type: NRG; PAM sequence: CAG
gcaggaggatcacttgacac

SEQ ID NO: 110721 - DNA, 20 bp, Artificial Sequence
  Description of Artificial Sequence: Synthetic oligonucleotide
  Target: ATXN1; (+) strand; PAM type: NRG; PAM sequence: AGG
caggaggatcacttgacacc

SEQ ID NO: 110722 - DNA, 20 bp, Artificial Sequence
  Description of Artificial Sequence: Synthetic oligonucleotide
  Target: ATXN1; (+) strand; PAM type: NRG; PAM sequence: GAG
ggaggatcacttgacaccag

SEQ ID NO: 110723 - DNA, 20 bp, Artificial Sequence
  Description of Artificial Sequence: Synthetic oligonucleotide
  Target: ATXN1; (+) strand; PAM type: NRG; PAM sequence: AGG
gaggatcacttgacaccagg

SEQ ID NO: 110724 - DNA, 20 bp, Artificial Sequence
  Description of Artificial Sequence: Synthetic oligonucleotide
  Target: ATXN1; (+) strand; PAM type: NRG; PAM sequence: AAG
tcacttgacaccaggaggtc

SEQ ID NO: 110725 - DNA, 20 bp, Artificial Sequence
  Description of Artificial Sequence: Synthetic oligonucleotide
  Target: ATXN1; (+) strand; PAM type: NRG; PAM sequence: CAG
tgacaccaggaggtcaagat

SEQ ID NO: 110726 - DNA, 20 bp, Artificial Sequence
  Description of Artificial Sequence: Synthetic oligonucleotide
  Target: ATXN1; (+) strand; PAM type: NRG; PAM sequence: CGG
accaggaggtcaagatcagc

SEQ ID NO: 110727 - DNA, 20 bp, Artificial Sequence
  Description of Artificial Sequence: Synthetic oligonucleotide
  Target: ATXN1; (+) strand; PAM type: NRG; PAM sequence: GAG
caggaggtcaagatcagccg

SEQ ID NO: 110728 - DNA, 20 bp, Artificial Sequence
  Description of Artificial Sequence: Synthetic oligonucleotide
  Target: ATXN1; (+) strand; PAM type: NRG; PAM sequence: AAG
tcaagatcagccggagaaac

SEQ ID NO: 110729 - DNA, 20 bp, Artificial Sequence
  Description of Artificial Sequence: Synthetic oligonucleotide
  Target: ATXN1; (+) strand; PAM type: NRG; PAM sequence: AGG
caagatcagccggagaaaca

SEQ ID NO: 110730 - DNA, 20 bp, Artificial Sequence
  Description of Artificial Sequence: Synthetic oligonucleotide
  Target: ATXN1; (+) strand; PAM type: NRG; PAM sequence: GAG
atcagccggagaaacaaggt

SEQ ID NO: 110731 - DNA, 20 bp, Artificial Sequence
  Description of Artificial Sequence: Synthetic oligonucleotide
  Target: ATXN1; (+) strand; PAM type: NRG; PAM sequence: TAG
atttaaaaatttaaaaaaaa

SEQ ID NO: 110732 - DNA, 20 bp, Artificial Sequence
  Description of Artificial Sequence: Synthetic oligonucleotide
  Target: ATXN1; (+) strand; PAM type: NRG; PAM sequence: TGG
aaaaatttaaaaaaaatagc

SEQ ID NO: 110733 - DNA, 20 bp, Artificial Sequence
  Description of Artificial Sequence: Synthetic oligonucleotide
  Target: ATXN1; (+) strand; PAM type: NRG; PAM sequence: GGG
aaaatttaaaaaaaatagct

SEQ ID NO: 110734 - DNA, 20 bp, Artificial Sequence
  Description of Artificial Sequence: Synthetic oligonucleotide
  Target: ATXN1; (+) strand; PAM type: NRG; PAM sequence: TGG
ttaaaaaaaatagctgggtg

SEQ ID NO: 110735 - DNA, 20 bp, Artificial Sequence
  Description of Artificial Sequence: Synthetic oligonucleotide
  Target: ATXN1; (+) strand; PAM type: NRG; PAM sequence: CAG
gggtgtggtacatgtgcctg

SEQ ID NO: 110736 - DNA, 20 bp, Artificial Sequence
  Description of Artificial Sequence: Synthetic oligonucleotide
  Target: ATXN1; (+) strand; PAM type: NRG; PAM sequence: CAG
ggtacatgtgcctgcagtcc

SEQ ID NO: 110737 - DNA, 20 bp, Artificial Sequence
  Description of Artificial Sequence: Synthetic oligonucleotide
  Target: ATXN1; (+) strand; PAM type: NRG; PAM sequence: CAG
tgcctgcagtcccagctact

SEQ ID NO: 110738 - DNA, 20 bp, Artificial Sequence
  Description of Artificial Sequence: Synthetic oligonucleotide
  Target: ATXN1; (+) strand; PAM type: NRG; PAM sequence: GAG
cctgcagtcccagctactca

SEQ ID NO: 110739 - DNA, 20 bp, Artificial Sequence
  Description of Artificial Sequence: Synthetic oligonucleotide
  Target: ATXN1; (+) strand; PAM type: NRG; PAM sequence: AGG
ctgcagtcccagctactcag

SEQ ID NO: 110740 - DNA, 20 bp, Artificial Sequence
  Description of Artificial Sequence: Synthetic oligonucleotide
  Target: ATXN1; (+) strand; PAM type: NRG; PAM sequence: GAG
gtcccagctactcagaggct

SEQ ID NO: 110741 - DNA, 20 bp, Artificial Sequence
  Description of Artificial Sequence: Synthetic oligonucleotide
  Target: ATXN1; (+) strand; PAM type: NRG; PAM sequence: AGG
tcccagctactcagaggctg

SEQ ID NO: 110742 - DNA, 20 bp, Artificial Sequence
  Description of Artificial Sequence: Synthetic oligonucleotide
  Target: ATXN1; (+) strand; PAM type: NRG; PAM sequence: GGG
cccagctactcagaggctga

SEQ ID NO: 110743 - DNA, 20 bp, Artificial Sequence
  Description of Artificial Sequence: Synthetic oligonucleotide
  Target: ATXN1; (+) strand; PAM type: NRG; PAM sequence: TGG
agctactcagaggctgaggg

SEQ ID NO: 110744 - DNA, 20 bp, Artificial Sequence
  Description of Artificial Sequence: Synthetic oligonucleotide
  Target: ATXN1; (+) strand; PAM type: NRG; PAM sequence: GAG
ctactcagaggctgagggtg

SEQ ID NO: 110745 - DNA, 20 bp, Artificial Sequence
  Description of Artificial Sequence: Synthetic oligonucleotide
  Target: ATXN1; (+) strand; PAM type: NRG; PAM sequence: GAG
ctgagggtggagaatcgctt

SEQ ID NO: 110746 - DNA, 20 bp, Artificial Sequence
  Description of Artificial Sequence: Synthetic oligonucleotide
  Target: ATXN1; (+) strand; PAM type: NRG; PAM sequence: GAG
gagggtggagaatcgcttga

SEQ ID NO: 110747 - DNA, 20 bp, Artificial Sequence
  Description of Artificial Sequence: Synthetic oligonucleotide
  Target: ATXN1; (+) strand; PAM type: NRG; PAM sequence: GAG
gggtggagaatcgcttgaga

SEQ ID NO: 110748 - DNA, 20 bp, Artificial Sequence
  Description of Artificial Sequence: Synthetic oligonucleotide
  Target: ATXN1; (+) strand; PAM type: NRG; PAM sequence: TGG
agaatcgcttgagagagctg

SEQ ID NO: 110749 - DNA, 20 bp, Artificial Sequence
  Description of Artificial Sequence: Synthetic oligonucleotide
  Target: ATXN1; (+) strand; PAM type: NRG; PAM sequence: TAG
tcgcttgagagagctgtggc

SEQ ID NO: 110750 - DNA, 20 bp, Artificial Sequence
  Description of Artificial Sequence: Synthetic oligonucleotide
  Target: ATXN1; (+) strand; PAM type: NRG; PAM sequence: AGG
cgcttgagagagctgtggct

SEQ ID NO: 110751 - DNA, 20 bp, Artificial Sequence
  Description of Artificial Sequence: Synthetic oligonucleotide
  Target: ATXN1; (+) strand; PAM type: NRG; PAM sequence: TAG
agagctgtggctaggacttt

SEQ ID NO: 110752 - DNA, 20 bp, Artificial Sequence
  Description of Artificial Sequence: Synthetic oligonucleotide
  Target: ATXN1; (+) strand; PAM type: NRG; PAM sequence: TGG
ctgtggctaggacttttagt

SEQ ID NO: 110753 - DNA, 20 bp, Artificial Sequence
  Description of Artificial Sequence: Synthetic oligonucleotide
  Target: ATXN1; (+) strand; PAM type: NRG; PAM sequence: GGG
tgtggctaggacttttagtt

SEQ ID NO: 110754 - DNA, 20 bp, Artificial Sequence
  Description of Artificial Sequence: Synthetic oligonucleotide
  Target: ATXN1; (+) strand; PAM type: NRG; PAM sequence: GGG
gtggctaggacttttagttg

SEQ ID NO: 110755 - DNA, 20 bp, Artificial Sequence
  Description of Artificial Sequence: Synthetic oligonucleotide
  Target: ATXN1; (+) strand; PAM type: NRG; PAM sequence: CAG
gctaggacttttagttgggg

SEQ ID NO: 110756 - DNA, 20 bp, Artificial Sequence
  Description of Artificial Sequence: Synthetic oligonucleotide
  Target: ATXN1; (+) strand; PAM type: NRG; PAM sequence: TGG
tttagttggggcagatgaaa

SEQ ID NO: 110757 - DNA, 20 bp, Artificial Sequence
  Description of Artificial Sequence: Synthetic oligonucleotide
  Target: ATXN1; (+) strand; PAM type: NRG; PAM sequence: AAG
tggggcagatgaaatggtct

SEQ ID NO: 110758 - DNA, 20 bp, Artificial Sequence
  Description of Artificial Sequence: Synthetic oligonucleotide
  Target: ATXN1; (+) strand; PAM type: NRG; PAM sequence: AGG
ggggcagatgaaatggtcta

SEQ ID NO: 110759 - DNA, 20 bp, Artificial Sequence
  Description of Artificial Sequence: Synthetic oligonucleotide
  Target: ATXN1; (+) strand; PAM type: NRG; PAM sequence: TAG
cagatgaaatggtctaaggt

SEQ ID NO: 110760 - DNA, 20 bp, Artificial Sequence
  Description of Artificial Sequence: Synthetic oligonucleotide
  Target: ATXN1; (+) strand; PAM type: NRG; PAM sequence: CAG
tgaaatggtctaaggttaga

SEQ ID NO: 110761 - DNA, 20 bp, Artificial Sequence
  Description of Artificial Sequence: Synthetic oligonucleotide
  Target: ATXN1; (+) strand; PAM type: NRG; PAM sequence: TGG
gacagcaacaaaaacaactt

SEQ ID NO: 110762 - DNA, 20 bp, Artificial Sequence
  Description of Artificial Sequence: Synthetic oligonucleotide
  Target: ATXN1; (+) strand; PAM type: NRG; PAM sequence: CAG
agcaacaaaaacaactttgg

SEQ ID NO: 110763 - DNA, 20 bp, Artificial Sequence
  Description of Artificial Sequence: Synthetic oligonucleotide
  Target: ATXN1; (+) strand; PAM type: NRG; PAM sequence: TGG
ttggcagattttgcctccat

SEQ ID NO: 110764 - DNA, 20 bp, Artificial Sequence
  Description of Artificial Sequence: Synthetic oligonucleotide
  Target: ATXN1; (+) strand; PAM type: NRG; PAM sequence: GGG
tggcagattttgcctccatt

SEQ ID NO: 110765 - DNA, 20 bp, Artificial Sequence
  Description of Artificial Sequence: Synthetic oligonucleotide
  Target: ATXN1; (+) strand; PAM type: NRG; PAM sequence: AAG
cagattttgcctccattggg

SEQ ID NO: 110766 - DNA, 20 bp, Artificial Sequence
  Description of Artificial Sequence: Synthetic oligonucleotide
  Target: ATXN1; (+) strand; PAM type: NRG; PAM sequence: GAG
gattttgcctccattgggaa

SEQ ID NO: 110767 - DNA, 20 bp, Artificial Sequence
  Description of Artificial Sequence: Synthetic oligonucleotide
  Target: ATXN1; (+) strand; PAM type: NRG; PAM sequence: TGG
tccattgggaagagtgctcc

SEQ ID NO: 110768 - DNA, 20 bp, Artificial Sequence
  Description of Artificial Sequence: Synthetic oligonucleotide
  Target: ATXN1; (+) strand; PAM type: NRG; PAM sequence: TGG
attgggaagagtgctcctgg

SEQ ID NO: 110769 - DNA, 20 bp, Artificial Sequence
  Description of Artificial Sequence: Synthetic oligonucleotide
  Target: ATXN1; (+) strand; PAM type: NRG; PAM sequence: GAG
gctcctggtggacacacttt

SEQ ID NO: 110770 - DNA, 20 bp, Artificial Sequence
  Description of Artificial Sequence: Synthetic oligonucleotide
  Target: ATXN1; (+) strand; PAM type: NRG; PAM sequence: AAG
gacacactttgagtctcaaa

SEQ ID NO: 110771 - DNA, 20 bp, Artificial Sequence
  Description of Artificial Sequence: Synthetic oligonucleotide
  Target: ATXN1; (+) strand; PAM type: NRG; PAM sequence: AGG
acacactttgagtctcaaaa

SEQ ID NO: 110772 - DNA, 20 bp, Artificial Sequence
  Description of Artificial Sequence: Synthetic oligonucleotide
  Target: ATXN1; (+) strand; PAM type: NRG; PAM sequence: TAG
aggaaaataatgttgacttt

SEQ ID NO: 110773 - DNA, 20 bp, Artificial Sequence
  Description of Artificial Sequence: Synthetic oligonucleotide
  Target: ATXN1; (+) strand; PAM type: NRG; PAM sequence: CAG
aatgttgacttttagctctt

SEQ ID NO: 110774 - DNA, 20 bp, Artificial Sequence
  Description of Artificial Sequence: Synthetic oligonucleotide
  Target: ATXN1; (+) strand; PAM type: NRG; PAM sequence: CAG
acttttagctcttcagttct

SEQ ID NO: 110775 - DNA, 20 bp, Artificial Sequence
  Description of Artificial Sequence: Synthetic oligonucleotide
  Target: ATXN1; (+) strand; PAM type: NRG; PAM sequence: CAG
tttagctcttcagttctcag

SEQ ID NO: 110776 - DNA, 20 bp, Artificial Sequence
  Description of Artificial Sequence: Synthetic oligonucleotide
  Target: ATXN1; (+) strand; PAM type: NRG; PAM sequence: AAG
gttctcagcagttacaacaa

SEQ ID NO: 110777 - DNA, 20 bp, Artificial Sequence
  Description of Artificial Sequence: Synthetic oligonucleotide
  Target: ATXN1; (+) strand; PAM type: NRG; PAM sequence: GAG
gtactatgtttatatctcat

SEQ ID NO: 110778 - DNA, 20 bp, Artificial Sequence
  Description of Artificial Sequence: Synthetic oligonucleotide
  Target: ATXN1; (+) strand; PAM type: NRG; PAM sequence: TAG
aactgaatatttttcccctt

SEQ ID NO: 110779 - DNA, 20 bp, Artificial Sequence
  Description of Artificial Sequence: Synthetic oligonucleotide
  Target: ATXN1; (+) strand; PAM type: NRG; PAM sequence: AGG
actgaatatttttccccttt

SEQ ID NO: 110780 - DNA, 20 bp, Artificial Sequence
  Description of Artificial Sequence: Synthetic oligonucleotide
  Target: ATXN1; (+) strand; PAM type: NRG; PAM sequence: GGG
ctgaatatttttccccttta

SEQ ID NO: 110781 - DNA, 20 bp, Artificial Sequence
  Description of Artificial Sequence: Synthetic oligonucleotide
  Target: ATXN1; (+) strand; PAM type: NRG; PAM sequence: AAG
tatttttcccctttagggtc

SEQ ID NO: 110782 - DNA, 20 bp, Artificial Sequence
  Description of Artificial Sequence: Synthetic oligonucleotide
  Target: ATXN1; (+) strand; PAM type: NRG; PAM sequence: AGG
atttttcccctttagggtca

SEQ ID NO: 110783 - DNA, 20 bp, Artificial Sequence
  Description of Artificial Sequence: Synthetic oligonucleotide
  Target: ATXN1; (+) strand; PAM type: NRG; PAM sequence: GGG
tttttcccctttagggtcaa

SEQ ID NO: 110784 - DNA, 20 bp, Artificial Sequence
  Description of Artificial Sequence: Synthetic oligonucleotide
  Target: ATXN1; (+) strand; PAM type: NRG; PAM sequence: CAG
tagggtcaagggctctgtct

SEQ ID NO: 110785 - DNA, 20 bp, Artificial Sequence
  Description of Artificial Sequence: Synthetic oligonucleotide
  Target: ATXN1; (+) strand; PAM type: NRG; PAM sequence: AGG
agggtcaagggctctgtctc

SEQ ID NO: 110786 - DNA, 20 bp, Artificial Sequence
  Description of Artificial Sequence: Synthetic oligonucleotide
  Target: ATXN1; (+) strand; PAM type: NRG; PAM sequence: GGG
gggtcaagggctctgtctca

SEQ ID NO: 110787 - DNA, 20 bp, Artificial Sequence
  Description of Artificial Sequence: Synthetic oligonucleotide
  Target: ATXN1; (+) strand; PAM type: NRG; PAM sequence: CAG
atcacttgtttcttaaatct

SEQ ID NO: 110788 - DNA, 20 bp, Artificial Sequence
  Description of Artificial Sequence: Synthetic oligonucleotide
  Target: ATXN1; (+) strand; PAM type: NRG; PAM sequence: AGG
tcacttgtttcttaaatctc

SEQ ID NO: 110789 - DNA, 20 bp, Artificial Sequence
  Description of Artificial Sequence: Synthetic oligonucleotide
  Target: ATXN1; (+) strand; PAM type: NRG; PAM sequence: CAG
tgctacattttctcaaccac

SEQ ID NO: 110790 - DNA, 20 bp, Artificial Sequence
  Description of Artificial Sequence: Synthetic oligonucleotide
  Target: ATXN1; (+) strand; PAM type: NRG; PAM sequence: TAG
ttctcaaccaccagtcgtat

SEQ ID NO: 110791 - DNA, 20 bp, Artificial Sequence
  Description of Artificial Sequence: Synthetic oligonucleotide
  Target: ATXN1; (+) strand; PAM type: NRG; PAM sequence: AAG
ccatttttatgctgttgata

SEQ ID NO: 110792 - DNA, 20 bp, Artificial Sequence
  Description of Artificial Sequence: Synthetic oligonucleotide
  Target: ATXN1; (+) strand; PAM type: NRG; PAM sequence: GAG
ctgttgataaagacataccc

SEQ ID NO: 110793 - DNA, 20 bp, Artificial Sequence
  Description of Artificial Sequence: Synthetic oligonucleotide
  Target: ATXN1; (+) strand; PAM type: NRG; PAM sequence: GAG
ataaagacatacccgagact

SEQ ID NO: 110794 - DNA, 20 bp, Artificial Sequence
  Description of Artificial Sequence: Synthetic oligonucleotide
  Target: ATXN1; (+) strand; PAM type: NRG; PAM sequence: AAG
cgagactgagcaatttacaa

SEQ ID NO: 110795 - DNA, 20 bp, Artificial Sequence
  Description of Artificial Sequence: Synthetic oligonucleotide
  Target: ATXN1; (+) strand; PAM type: NRG; PAM sequence: AAG
actgagcaatttacaaaaga

SEQ ID NO: 110796 - DNA, 20 bp, Artificial Sequence
  Description of Artificial Sequence: Synthetic oligonucleotide
  Target: ATXN1; (+) strand; PAM type: NRG; PAM sequence: GAG
tgagcaatttacaaaagaaa

SEQ ID NO: 110797 - DNA, 20 bp, Artificial Sequence
  Description of Artificial Sequence: Synthetic oligonucleotide
  Target: ATXN1; (+) strand; PAM type: NRG; PAM sequence: AGG
gagcaatttacaaaagaaag

SEQ ID NO: 110798 - DNA, 20 bp, Artificial Sequence
  Description of Artificial Sequence: Synthetic oligonucleotide
  Target: ATXN1; (+) strand; PAM type: NRG; PAM sequence: TGG
acaaaagaaagaggtttaat

SEQ ID NO: 110799 - DNA, 20 bp, Artificial Sequence
  Description of Artificial Sequence: Synthetic oligonucleotide
  Target: ATXN1; (+) strand; PAM type: NRG; PAM sequence: CAG
aagaggtttaattggactta

SEQ ID NO: 110800 - DNA, 20 bp, Artificial Sequence
  Description of Artificial Sequence: Synthetic oligonucleotide
  Target: ATXN1; (+) strand; PAM type: NRG; PAM sequence: TGG
attggacttacagttccaca

SEQ ID NO: 110801 - DNA, 20 bp, Artificial Sequence
  Description of Artificial Sequence: Synthetic oligonucleotide
  Target: ATXN1; (+) strand; PAM type: NRG; PAM sequence: GAG
acttacagttccacatggct

SEQ ID NO: 110802 - DNA, 20 bp, Artificial Sequence
  Description of Artificial Sequence: Synthetic oligonucleotide
  Target: ATXN1; (+) strand; PAM type: NRG; PAM sequence: AGG
cttacagttccacatggctg

SEQ ID NO: 110803 - DNA, 20 bp, Artificial Sequence
  Description of Artificial Sequence: Synthetic oligonucleotide
  Target: ATXN1; (+) strand; PAM type: NRG; PAM sequence: AAG
acagttccacatggctgagg

SEQ ID NO: 110804 - DNA, 20 bp, Artificial Sequence
  Description of Artificial Sequence: Synthetic oligonucleotide
  Target: ATXN1; (+) strand; PAM type: NRG; PAM sequence: TGG
ctgaggaagcctctcaatca

SEQ ID NO: 110805 - DNA, 20 bp, Artificial Sequence
  Description of Artificial Sequence: Synthetic oligonucleotide
  Target: ATXN1; (+) strand; PAM type: NRG; PAM sequence: TGG
aggaagcctctcaatcatgg

SEQ ID NO: 110806 - DNA, 20 bp, Artificial Sequence
  Description of Artificial Sequence: Synthetic oligonucleotide
  Target: ATXN1; (+) strand; PAM type: NRG; PAM sequence: AAG
aagcctctcaatcatggtgg

SEQ ID NO: 110807 - DNA, 20 bp, Artificial Sequence
  Description of Artificial Sequence: Synthetic oligonucleotide
  Target: ATXN1; (+) strand; PAM type: NRG; PAM sequence: AGG
agcctctcaatcatggtgga

SEQ ID NO: 110808 - DNA, 20 bp, Artificial Sequence
  Description of Artificial Sequence: Synthetic oligonucleotide
  Target: ATXN1; (+) strand; PAM type: NRG; PAM sequence: AAG
tctcaatcatggtggaaggc

SEQ ID NO: 110809 - DNA, 20 bp, Artificial Sequence
  Description of Artificial Sequence: Synthetic oligonucleotide
  Target: ATXN1; (+) strand; PAM type: NRG; PAM sequence: AGG
ctcaatcatggtggaaggca

SEQ ID NO: 110810 - DNA, 20 bp, Artificial Sequence
  Description of Artificial Sequence: Synthetic oligonucleotide
  Target: ATXN1; (+) strand; PAM type: NRG; PAM sequence: GAG
caatcatggtggaaggcaag

SEQ ID NO: 110811 - DNA, 20 bp, Artificial Sequence
  Description of Artificial Sequence: Synthetic oligonucleotide
  Target: ATXN1; (+) strand; PAM type: NRG; PAM sequence: AGG
aatcatggtggaaggcaagg

SEQ ID NO: 110812 - DNA, 20 bp, Artificial Sequence
  Description of Artificial Sequence: Synthetic oligonucleotide
  Target: ATXN1; (+) strand; PAM type: NRG; PAM sequence: GAG
tcatggtggaaggcaaggag

SEQ ID NO: 110813 - DNA, 20 bp, Artificial Sequence
  Description of Artificial Sequence: Synthetic oligonucleotide
  Target: ATXN1; (+) strand; PAM type: NRG; PAM sequence: AAG
ggtggaaggcaaggaggagc

SEQ ID NO: 110814 - DNA, 20 bp, Artificial Sequence
  Description of Artificial Sequence: Synthetic oligonucleotide
  Target: ATXN1; (+) strand; PAM type: NRG; PAM sequence: TGG
ggagcaagtcacatcttaca

SEQ ID NO: 110815 - DNA, 20 bp, Artificial Sequence
  Description of Artificial Sequence: Synthetic oligonucleotide
  Target: ATXN1; (+) strand; PAM type: NRG; PAM sequence: TGG
caagtcacatcttacatgga

SEQ ID NO: 110816 - DNA, 20 bp, Artificial Sequence
  Description of Artificial Sequence: Synthetic oligonucleotide
  Target: ATXN1; (+) strand; PAM type: NRG; PAM sequence: TGG
gtcacatcttacatggatgg

SEQ ID NO: 110817 - DNA, 20 bp, Artificial Sequence
  Description of Artificial Sequence: Synthetic oligonucleotide
  Target: ATXN1; (+) strand; PAM type: NRG; PAM sequence: CAG
acatcttacatggatggtgg

SEQ ID NO: 110818 - DNA, 20 bp, Artificial Sequence
  Description of Artificial Sequence: Synthetic oligonucleotide
  Target: ATXN1; (+) strand; PAM type: NRG; PAM sequence: AGG
catcttacatggatggtggc

SEQ ID NO: 110819 - DNA, 20 bp, Artificial Sequence
  Description of Artificial Sequence: Synthetic oligonucleotide
  Target: ATXN1; (+) strand; PAM type: NRG; PAM sequence: GAG
gatggtggcaggcaaaaaat

SEQ ID NO: 110820 - DNA, 20 bp, Artificial Sequence
  Description of Artificial Sequence: Synthetic oligonucleotide
  Target: ATXN1; (+) strand; PAM type: NRG; PAM sequence: GAG
tggtggcaggcaaaaaatga

SEQ ID NO: 110821 - DNA, 20 bp, Artificial Sequence
  Description of Artificial Sequence: Synthetic oligonucleotide
  Target: ATXN1; (+) strand; PAM type: NRG; PAM sequence: GAG
gtggcaggcaaaaaatgaga

SEQ ID NO: 110822 - DNA, 20 bp, Artificial Sequence
  Description of Artificial Sequence: Synthetic oligonucleotide
  Target: ATXN1; (+) strand; PAM type: NRG; PAM sequence: GAG
ggcaggcaaaaaatgagaga

SEQ ID NO: 110823 - DNA, 20 bp, Artificial Sequence
  Description of Artificial Sequence: Synthetic oligonucleotide
  Target: ATXN1; (+) strand; PAM type: NRG; PAM sequence: CAG
aaaatgagagagagcttatg

SEQ ID NO: 110824 - DNA, 20 bp, Artificial Sequence
  Description of Artificial Sequence: Synthetic oligonucleotide
  Target: ATXN1; (+) strand; PAM type: NRG; PAM sequence: AGG
aaatgagagagagcttatgc

SEQ ID NO: 110825 - DNA, 20 bp, Artificial Sequence
  Description of Artificial Sequence: Synthetic oligonucleotide
  Target: ATXN1; (+) strand; PAM type: NRG; PAM sequence: GGG
aatgagagagagcttatgca

SEQ ID NO: 110826 - DNA, 20 bp, Artificial Sequence
  Description of Artificial Sequence: Synthetic oligonucleotide
  Target: ATXN1; (+) strand; PAM type: NRG; PAM sequence: GGG
atgagagagagcttatgcag

SEQ ID NO: 110827 - DNA, 20 bp, Artificial Sequence
  Description of Artificial Sequence: Synthetic oligonucleotide
  Target: ATXN1; (+) strand; PAM type: NRG; PAM sequence: CAG
atgcctctttttaaaaccat

SEQ ID NO: 110828 - DNA, 20 bp, Artificial Sequence
  Description of Artificial Sequence: Synthetic oligonucleotide
  Target: ATXN1; (+) strand; PAM type: NRG; PAM sequence: GAG
ttaaaaccatcagatctcgt

SEQ ID NO: 110829 - DNA, 20 bp, Artificial Sequence
  Description of Artificial Sequence: Synthetic oligonucleotide
  Target: ATXN1; (+) strand; PAM type: NRG; PAM sequence: GAG
tgagacttatccattaccac

SEQ ID NO: 110830 - DNA, 20 bp, Artificial Sequence
  Description of Artificial Sequence: Synthetic oligonucleotide
  Target: ATXN1; (+) strand; PAM type: NRG; PAM sequence: CAG
cttatccattaccacgagaa

SEQ ID NO: 110831 - DNA, 20 bp, Artificial Sequence
  Description of Artificial Sequence: Synthetic oligonucleotide
  Target: ATXN1; (+) strand; PAM type: NRG; PAM sequence: TGG
ccattaccacgagaacagca

SEQ ID NO: 110832 - DNA, 20 bp, Artificial Sequence
  Description of Artificial Sequence: Synthetic oligonucleotide
  Target: ATXN1; (+) strand; PAM type: NRG; PAM sequence: GGG
cattaccacgagaacagcat

SEQ ID NO: 110833 - DNA, 20 bp, Artificial Sequence
  Description of Artificial Sequence: Synthetic oligonucleotide
  Target: ATXN1; (+) strand; PAM type: NRG; PAM sequence: AAG
accacgagaacagcatggga

SEQ ID NO: 110834 - DNA, 20 bp, Artificial Sequence
  Description of Artificial Sequence: Synthetic oligonucleotide
  Target: ATXN1; (+) strand; PAM type: NRG; PAM sequence: CAG
catgattcaatacctcccac

SEQ ID NO: 110835 - DNA, 20 bp, Artificial Sequence
  Description of Artificial Sequence: Synthetic oligonucleotide
  Target: ATXN1; (+) strand; PAM type: NRG; PAM sequence: AGG
atgattcaatacctcccacc

SEQ ID NO: 110836 - DNA, 20 bp, Artificial Sequence
  Description of Artificial Sequence: Synthetic oligonucleotide
  Target: ATXN1; (+) strand; PAM type: NRG; PAM sequence: TGG
ccaggtccctcccacacaca

SEQ ID NO: 110837 - DNA, 20 bp, Artificial Sequence
  Description of Artificial Sequence: Synthetic oligonucleotide
  Target: ATXN1; (+) strand; PAM type: NRG; PAM sequence: GGG
caggtccctcccacacacat

SEQ ID NO: 110838 - DNA, 20 bp, Artificial Sequence
  Description of Artificial Sequence: Synthetic oligonucleotide
  Target: ATXN1; (+) strand; PAM type: NRG; PAM sequence: GAG
ggtccctcccacacacatgg

SEQ ID NO: 110839 - DNA, 20 bp, Artificial Sequence
  Description of Artificial Sequence: Synthetic oligonucleotide
  Target: ATXN1; (+) strand; PAM type: NRG; PAM sequence: AGG
gtccctcccacacacatggg

SEQ ID NO: 110840 - DNA, 20 bp, Artificial Sequence
  Description of Artificial Sequence: Synthetic oligonucleotide
  Target: ATXN1; (+) strand; PAM type: NRG; PAM sequence: AAG
tcccacacacatgggaggtc

SEQ ID NO: 110841 - DNA, 20 bp, Artificial Sequence
  Description of Artificial Sequence: Synthetic oligonucleotide
  Target: ATXN1; (+) strand; PAM type: NRG; PAM sequence: TGG
tgggaggtcaagatgaaatc

SEQ ID NO: 110842 - DNA, 20 bp, Artificial Sequence
  Description of Artificial Sequence: Synthetic oligonucleotide
  Target: ATXN1; (+) strand; PAM type: NRG; PAM sequence: GGG
gggaggtcaagatgaaatct

SEQ ID NO: 110843 - DNA, 20 bp, Artificial Sequence
  Description of Artificial Sequence: Synthetic oligonucleotide
  Target: ATXN1; (+) strand; PAM type: NRG; PAM sequence: CAG
aggtcaagatgaaatctggg

SEQ ID NO: 110844 - DNA, 20 bp, Artificial Sequence
  Description of Artificial Sequence: Synthetic oligonucleotide
  Target: ATXN1; (+) strand; PAM type: NRG; PAM sequence: AGG
ggtcaagatgaaatctgggc

SEQ ID NO: 110845 - DNA, 20 bp, Artificial Sequence
  Description of Artificial Sequence: Synthetic oligonucleotide
  Target: ATXN1; (+) strand; PAM type: NRG; PAM sequence: GGG
gtcaagatgaaatctgggca

SEQ ID NO: 110846 - DNA, 20 bp, Artificial Sequence
  Description of Artificial Sequence: Synthetic oligonucleotide
  Target: ATXN1; (+) strand; PAM type: NRG; PAM sequence: CAG
atgaaatctgggcagggaca

SEQ ID NO: 110847 - DNA, 20 bp, Artificial Sequence
  Description of Artificial Sequence: Synthetic oligonucleotide
  Target: ATXN1; (+) strand; PAM type: NRG; PAM sequence: CAG
acacagccaaaccatatcat

SEQ ID NO: 110848 - DNA, 20 bp, Artificial Sequence
  Description of Artificial Sequence: Synthetic oligonucleotide
  Target: ATXN1; (+) strand; PAM type: NRG; PAM sequence: TGG
atatcatcagttgatctata

SEQ ID NO: 110849 - DNA, 20 bp, Artificial Sequence
  Description of Artificial Sequence: Synthetic oligonucleotide
  Target: ATXN1; (+) strand; PAM type: NRG; PAM sequence: TGG
catcagttgatctatatggc

SEQ ID NO: 110850 - DNA, 20 bp, Artificial Sequence
  Description of Artificial Sequence: Synthetic oligonucleotide
  Target: ATXN1; (+) strand; PAM type: NRG; PAM sequence: AAG
tctatatggctggaaaaaac

SEQ ID NO: 110851 - DNA, 20 bp, Artificial Sequence
  Description of Artificial Sequence: Synthetic oligonucleotide
  Target: ATXN1; (+) strand; PAM type: NRG; PAM sequence: CAG
gacttctcgccaaccactga

SEQ ID NO: 110852 - DNA, 20 bp, Artificial Sequence
  Description of Artificial Sequence: Synthetic oligonucleotide
  Target: ATXN1; (+) strand; PAM type: NRG; PAM sequence: TAG
tttttttttttttttgcttc

SEQ ID NO: 110853 - DNA, 20 bp, Artificial Sequence
  Description of Artificial Sequence: Synthetic oligonucleotide
  Target: ATXN1; (+) strand; PAM type: NRG; PAM sequence: TGG
ttgcttctagttctaatgct

SEQ ID NO: 110854 - DNA, 20 bp, Artificial Sequence
  Description of Artificial Sequence: Synthetic oligonucleotide
  Target: ATXN1; (+) strand; PAM type: NRG; PAM sequence: TAG
tgcttggtcattaatttctc

SEQ ID NO: 110855 - DNA, 20 bp, Artificial Sequence
  Description of Artificial Sequence: Synthetic oligonucleotide
  Target: ATXN1; (+) strand; PAM type: NRG; PAM sequence: CAG
tcattaatttctctagaact

SEQ ID NO: 110856 - DNA, 20 bp, Artificial Sequence
  Description of Artificial Sequence: Synthetic oligonucleotide
  Target: ATXN1; (+) strand; PAM type: NRG; PAM sequence: CAG
cctttaatgttttcacaaaa

SEQ ID NO: 110857 - DNA, 20 bp, Artificial Sequence
  Description of Artificial Sequence: Synthetic oligonucleotide
  Target: ATXN1; (+) strand; PAM type: NRG; PAM sequence: AGG
ctttaatgttttcacaaaac

SEQ ID NO: 110858 - DNA, 20 bp, Artificial Sequence
  Description of Artificial Sequence: Synthetic oligonucleotide
  Target: ATXN1; (+) strand; PAM type: NRG; PAM sequence: GGG
tttaatgttttcacaaaaca

SEQ ID NO: 110859 - DNA, 20 bp, Artificial Sequence
  Description of Artificial Sequence: Synthetic oligonucleotide
  Target: ATXN1; (+) strand; PAM type: NRG; PAM sequence: TAG
caaaacagggacaatgtgca

SEQ ID NO: 110860 - DNA, 20 bp, Artificial Sequence
  Description of Artificial Sequence: Synthetic oligonucleotide
  Target: ATXN1; (+) strand; PAM type: NRG; PAM sequence: AGG
aaaacagggacaatgtgcat

SEQ ID NO: 110861 - DNA, 20 bp, Artificial Sequence
  Description of Artificial Sequence: Synthetic oligonucleotide
  Target: ATXN1; (+) strand; PAM type: NRG; PAM sequence: CAG
cagggacaatgtgcataggc

SEQ ID NO: 110862 - DNA, 20 bp, Artificial Sequence
  Description of Artificial Sequence: Synthetic oligonucleotide
  Target: ATXN1; (+) strand; PAM type: NRG; PAM sequence: GAG
gggacaatgtgcataggcca

SEQ ID NO: 110863 - DNA, 20 bp, Artificial Sequence
  Description of Artificial Sequence: Synthetic oligonucleotide
  Target: ATXN1; (+) strand; PAM type: NRG; PAM sequence: AGG
ggacaatgtgcataggccag

SEQ ID NO: 110864 - DNA, 20 bp, Artificial Sequence
  Description of Artificial Sequence: Synthetic oligonucleotide
  Target: ATXN1; (+) strand; PAM type: NRG; PAM sequence: TGG
gcataggccagaggatttta

SEQ ID NO: 110865 - DNA, 20 bp, Artificial Sequence
  Description of Artificial Sequence: Synthetic oligonucleotide
  Target: ATXN1; (+) strand; PAM type: NRG; PAM sequence: GAG
aattcgtttttaaaacttac

SEQ ID NO: 110866 - DNA, 20 bp, Artificial Sequence
  Description of Artificial Sequence: Synthetic oligonucleotide
  Target: ATXN1; (+) strand; PAM type: NRG; PAM sequence: TGG
tttaaaacttacgagacaac

SEQ ID NO: 110867 - DNA, 20 bp, Artificial Sequence
  Description of Artificial Sequence: Synthetic oligonucleotide
  Target: ATXN1; (+) strand; PAM type: NRG; PAM sequence: TAG
cttacgagacaactggctta

SEQ ID NO: 110868 - DNA, 20 bp, Artificial Sequence
  Description of Artificial Sequence: Synthetic oligonucleotide
  Target: ATXN1; (+) strand; PAM type: NRG; PAM sequence: CAG
actggcttatagcaattttc

SEQ ID NO: 110869 - DNA, 20 bp, Artificial Sequence
  Description of Artificial Sequence: Synthetic oligonucleotide
  Target: ATXN1; (+) strand; PAM type: NRG; PAM sequence: AAG
acaacacgaacacaacccac

SEQ ID NO: 110870 - DNA, 20 bp, Artificial Sequence
  Description of Artificial Sequence: Synthetic oligonucleotide
  Target: ATXN1; (+) strand; PAM type: NRG; PAM sequence: AAG
acgaacacaacccacaagcc

SEQ ID NO: 110871 - DNA, 20 bp, Artificial Sequence
  Description of Artificial Sequence: Synthetic oligonucleotide
  Target: ATXN1; (+) strand; PAM type: NRG; PAM sequence: CAG
aacccacaagccaagaacaa

SEQ ID NO: 110872 - DNA, 20 bp, Artificial Sequence
  Description of Artificial Sequence: Synthetic oligonucleotide
  Target: ATXN1; (+) strand; PAM type: NRG; PAM sequence: AAG
ccacaagccaagaacaacag

SEQ ID NO: 110873 - DNA, 20 bp, Artificial Sequence
  Description of Artificial Sequence: Synthetic oligonucleotide
  Target: ATXN1; (+) strand; PAM type: NRG; PAM sequence: GAG
acaagccaagaacaacagaa

SEQ ID NO: 110874 - DNA, 20 bp, Artificial Sequence
  Description of Artificial Sequence: Synthetic oligonucleotide
  Target: ATXN1; (+) strand; PAM type: NRG; PAM sequence: AGG
caagccaagaacaacagaag

SEQ ID NO: 110875 - DNA, 20 bp, Artificial Sequence
  Description of Artificial Sequence: Synthetic oligonucleotide
  Target: ATXN1; (+) strand; PAM type: NRG; PAM sequence: GAG
agccaagaacaacagaagag

SEQ ID NO: 110876 - DNA, 20 bp, Artificial Sequence
  Description of Artificial Sequence: Synthetic oligonucleotide
  Target: ATXN1; (+) strand; PAM type: NRG; PAM sequence: GAG
ccaagaacaacagaagagga

SEQ ID NO: 110877 - DNA, 20 bp, Artificial Sequence
  Description of Artificial Sequence: Synthetic oligonucleotide
  Target: ATXN1; (+) strand; PAM type: NRG; PAM sequence: CAG
gaacaacagaagaggagaga

SEQ ID NO: 110878 - DNA, 20 bp, Artificial Sequence
  Description of Artificial Sequence: Synthetic oligonucleotide
  Target: ATXN1; (+) strand; PAM type: NRG; PAM sequence: AAG
aacagaagaggagagacaga

SEQ ID NO: 110879 - DNA, 20 bp, Artificial Sequence
  Description of Artificial Sequence: Synthetic oligonucleotide
  Target: ATXN1; (+) strand; PAM type: NRG; PAM sequence: GAG
gaacataaaacattacttat

SEQ ID NO: 110880 - DNA, 20 bp, Artificial Sequence
  Description of Artificial Sequence: Synthetic oligonucleotide
  Target: ATXN1; (+) strand; PAM type: NRG; PAM sequence: TAG
atgagatctttcccactgct

SEQ ID NO: 110881 - DNA, 20 bp, Artificial Sequence
  Description of Artificial Sequence: Synthetic oligonucleotide
  Target: ATXN1; (+) strand; PAM type: NRG; PAM sequence: CAG
tctttcccactgcttagcac

SEQ ID NO: 110882 - DNA, 20 bp, Artificial Sequence
  Description of Artificial Sequence: Synthetic oligonucleotide
  Target: ATXN1; (+) strand; PAM type: NRG; PAM sequence: AAG
accagatctataatgcatgc

SEQ ID NO: 110883 - DNA, 20 bp, Artificial Sequence
  Description of Artificial Sequence: Synthetic oligonucleotide
  Target: ATXN1; (+) strand; PAM type: NRG; PAM sequence: AGG
ccagatctataatgcatgca

SEQ ID NO: 110884 - DNA, 20 bp, Artificial Sequence
  Description of Artificial Sequence: Synthetic oligonucleotide
  Target: ATXN1; (+) strand; PAM type: NRG; PAM sequence: TAG
tctataatgcatgcaaggct

SEQ ID NO: 110885 - DNA, 20 bp, Artificial Sequence
  Description of Artificial Sequence: Synthetic oligonucleotide
  Target: ATXN1; (+) strand; PAM type: NRG; PAM sequence: TGG
taatgcatgcaaggcttagc

SEQ ID NO: 110886 - DNA, 20 bp, Artificial Sequence
  Description of Artificial Sequence: Synthetic oligonucleotide
  Target: ATXN1; (+) strand; PAM type: NRG; PAM sequence: AAG
ttagctggaacaaatgatga

SEQ ID NO: 110887 - DNA, 20 bp, Artificial Sequence
  Description of Artificial Sequence: Synthetic oligonucleotide
  Target: ATXN1; (+) strand; PAM type: NRG; PAM sequence: AAG
tgaaagctgttcctcctttc

SEQ ID NO: 110888 - DNA, 20 bp, Artificial Sequence
  Description of Artificial Sequence: Synthetic oligonucleotide
  Target: ATXN1; (+) strand; PAM type: NRG; PAM sequence: AGG
gaaagctgttcctcctttca

SEQ ID NO: 110889 - DNA, 20 bp, Artificial Sequence
  Description of Artificial Sequence: Synthetic oligonucleotide
  Target: ATXN1; (+) strand; PAM type: NRG; PAM sequence: GGG
aaagctgttcctcctttcaa

SEQ ID NO: 110890 - DNA, 20 bp, Artificial Sequence
  Description of Artificial Sequence: Synthetic oligonucleotide
  Target: ATXN1; (+) strand; PAM type: NRG; PAM sequence: GAG
agctgttcctcctttcaagg

SEQ ID NO: 110891 - DNA, 20 bp, Artificial Sequence
  Description of Artificial Sequence: Synthetic oligonucleotide
  Target: ATXN1; (+) strand; PAM type: NRG; PAM sequence: AGG
gctgttcctcctttcaaggg

SEQ ID NO: 110892 - DNA, 20 bp, Artificial Sequence
  Description of Artificial Sequence: Synthetic oligonucleotide
  Target: ATXN1; (+) strand; PAM type: NRG; PAM sequence: TGG
tcaagggaggatcatttaca

SEQ ID NO: 110893 - DNA, 20 bp, Artificial Sequence
  Description of Artificial Sequence: Synthetic oligonucleotide
  Target: ATXN1; (+) strand; PAM type: NRG; PAM sequence: GGG
caagggaggatcatttacat

SEQ ID NO: 110894 - DNA, 20 bp, Artificial Sequence
  Description of Artificial Sequence: Synthetic oligonucleotide
  Target: ATXN1; (+) strand; PAM type: NRG; PAM sequence: CAG
gaggatcatttacatgggcc

SEQ ID NO: 110895 - DNA, 20 bp, Artificial Sequence
  Description of Artificial Sequence: Synthetic oligonucleotide
  Target: ATXN1; (+) strand; PAM type: NRG; PAM sequence: CAG
gttctcatttattcaacttc

SEQ ID NO: 110896 - DNA, 20 bp, Artificial Sequence
  Description of Artificial Sequence: Synthetic oligonucleotide
  Target: ATXN1; (+) strand; PAM type: NRG; PAM sequence: CAG
cagccctcactgacattaac

SEQ ID NO: 110897 - DNA, 20 bp, Artificial Sequence
  Description of Artificial Sequence: Synthetic oligonucleotide
  Target: ATXN1; (+) strand; PAM type: NRG; PAM sequence: AGG
agccctcactgacattaacc

SEQ ID NO: 110898 - DNA, 20 bp, Artificial Sequence
  Description of Artificial Sequence: Synthetic oligonucleotide
  Target: ATXN1; (+) strand; PAM type: NRG; PAM sequence: GAG
ccctcactgacattaaccag

SEQ ID NO: 110899 - DNA, 20 bp, Artificial Sequence
  Description of Artificial Sequence: Synthetic oligonucleotide
  Target: ATXN1; (+) strand; PAM type: NRG; PAM sequence: CAG
tcactgacattaaccaggag

SEQ ID NO: 110900 - DNA, 20 bp, Artificial Sequence
  Description of Artificial Sequence: Synthetic oligonucleotide
  Target: ATXN1; (+) strand; PAM type: NRG; PAM sequence: GAG
actgacattaaccaggagca

SEQ ID NO: 110901 - DNA, 20 bp, Artificial Sequence
  Description of Artificial Sequence: Synthetic oligonucleotide
  Target: ATXN1; (+) strand; PAM type: NRG; PAM sequence: TGG
aaccaggagcagagaacatc

SEQ ID NO: 110902 - DNA, 20 bp, Artificial Sequence
  Description of Artificial Sequence: Synthetic oligonucleotide
  Target: ATXN1; (+) strand; PAM type: NRG; PAM sequence: CAG
gagcagagaacatctggtgt

SEQ ID NO: 110903 - DNA, 20 bp, Artificial Sequence
  Description of Artificial Sequence: Synthetic oligonucleotide
  Target: ATXN1; (+) strand; PAM type: NRG; PAM sequence: CAG
gaaccaactcccgctgtgcc

SEQ ID NO: 110904 - DNA, 20 bp, Artificial Sequence
  Description of Artificial Sequence: Synthetic oligonucleotide
  Target: ATXN1; (+) strand; PAM type: NRG; PAM sequence: AGG
aaccaactcccgctgtgccc

SEQ ID NO: 110905 - DNA, 20 bp, Artificial Sequence
  Description of Artificial Sequence: Synthetic oligonucleotide
  Target: ATXN1; (+) strand; PAM type: NRG; PAM sequence: GGG
accaactcccgctgtgccca

SEQ ID NO: 110906 - DNA, 20 bp, Artificial Sequence
  Description of Artificial Sequence: Synthetic oligonucleotide
  Target: ATXN1; (+) strand; PAM type: NRG; PAM sequence: CAG
gggctgttgtctcactgttg

SEQ ID NO: 110907 - DNA, 20 bp, Artificial Sequence
  Description of Artificial Sequence: Synthetic oligonucleotide
  Target: ATXN1; (+) strand; PAM type: NRG; PAM sequence: AAG
gttgtctcactgttgcagaa

SEQ ID NO: 110908 - DNA, 20 bp, Artificial Sequence
  Description of Artificial Sequence: Synthetic oligonucleotide
  Target: ATXN1; (+) strand; PAM type: NRG; PAM sequence: AGG
ttgtctcactgttgcagaaa

SEQ ID NO: 110909 - DNA, 20 bp, Artificial Sequence
  Description of Artificial Sequence: Synthetic oligonucleotide
  Target: ATXN1; (+) strand; PAM type: NRG; PAM sequence: CAG
ctcactgttgcagaaaaggc

SEQ ID NO: 110910 - DNA, 20 bp, Artificial Sequence
  Description of Artificial Sequence: Synthetic oligonucleotide
  Target: ATXN1; (+) strand; PAM type: NRG; PAM sequence: GAG
cactgttgcagaaaaggcca

SEQ ID NO: 110911 - DNA, 20 bp, Artificial Sequence
  Description of Artificial Sequence: Synthetic oligonucleotide
  Target: ATXN1; (+) strand; PAM type: NRG; PAM sequence: AGG
actgttgcagaaaaggccag

SEQ ID NO: 110912 - DNA, 20 bp, Artificial Sequence
  Description of Artificial Sequence: Synthetic oligonucleotide
  Target: ATXN1; (+) strand; PAM type: NRG; PAM sequence: GGG
ctgttgcagaaaaggccaga

SEQ ID NO: 110913 - DNA, 20 bp, Artificial Sequence
  Description of Artificial Sequence: Synthetic oligonucleotide
  Target: ATXN1; (+) strand; PAM type: NRG; PAM sequence: AAG
tgcagaaaaggccagagggc

SEQ ID NO: 110914 - DNA, 20 bp, Artificial Sequence
  Description of Artificial Sequence: Synthetic oligonucleotide
  Target: ATXN1; (+) strand; PAM type: NRG; PAM sequence: AGG
gcagaaaaggccagagggca

SEQ ID NO: 110915 - DNA, 20 bp, Artificial Sequence
  Description of Artificial Sequence: Synthetic oligonucleotide
  Target: ATXN1; (+) strand; PAM type: NRG; PAM sequence: TGG
ggccagagggcaaggctgct

SEQ ID NO: 110916 - DNA, 20 bp, Artificial Sequence
  Description of Artificial Sequence: Synthetic oligonucleotide
  Target: ATXN1; (+) strand; PAM type: NRG; PAM sequence: AAG
agggcaaggctgcttggctg

SEQ ID NO: 110917 - DNA, 20 bp, Artificial Sequence
  Description of Artificial Sequence: Synthetic oligonucleotide
  Target: ATXN1; (+) strand; PAM type: NRG; PAM sequence: TGG
caaggctgcttggctgaaga

SEQ ID NO: 110918 - DNA, 20 bp, Artificial Sequence
  Description of Artificial Sequence: Synthetic oligonucleotide
  Target: ATXN1; (+) strand; PAM type: NRG; PAM sequence: GGG
aaggctgcttggctgaagat

SEQ ID NO: 110919 - DNA, 20 bp, Artificial Sequence
  Description of Artificial Sequence: Synthetic oligonucleotide
  Target: ATXN1; (+) strand; PAM type: NRG; PAM sequence: CAG
gcttggctgaagatgggcct

SEQ ID NO: 110920 - DNA, 20 bp, Artificial Sequence
  Description of Artificial Sequence: Synthetic oligonucleotide
  Target: ATXN1; (+) strand; PAM type: NRG; PAM sequence: GAG
ttggctgaagatgggcctca

SEQ ID NO: 110921 - DNA, 20 bp, Artificial Sequence
  Description of Artificial Sequence: Synthetic oligonucleotide
  Target: ATXN1; (+) strand; PAM type: NRG; PAM sequence: AGG
tggctgaagatgggcctcag

SEQ ID NO: 110922 - DNA, 20 bp, Artificial Sequence
  Description of Artificial Sequence: Synthetic oligonucleotide
  Target: ATXN1; (+) strand; PAM type: NRG; PAM sequence: TGG
aagatgggcctcagaggttc

SEQ ID NO: 110923 - DNA, 20 bp, Artificial Sequence
  Description of Artificial Sequence: Synthetic oligonucleotide
  Target: ATXN1; (+) strand; PAM type: NRG; PAM sequence: GGG
agatgggcctcagaggttct

SEQ ID NO: 110924 - DNA, 20 bp, Artificial Sequence
  Description of Artificial Sequence: Synthetic oligonucleotide
  Target: ATXN1; (+) strand; PAM type: NRG; PAM sequence: TGG
cagaggttctgggcttttta

SEQ ID NO: 110925 - DNA, 20 bp, Artificial Sequence
  Description of Artificial Sequence: Synthetic oligonucleotide
  Target: ATXN1; (+) strand; PAM type: NRG; PAM sequence: TAG
ttctgggctttttatggaat

SEQ ID NO: 110926 - DNA, 20 bp, Artificial Sequence
  Description of Artificial Sequence: Synthetic oligonucleotide
  Target: ATXN1; (+) strand; PAM type: NRG; PAM sequence: AGG
tctgggctttttatggaatt

SEQ ID NO: 110927 - DNA, 20 bp, Artificial Sequence
  Description of Artificial Sequence: Synthetic oligonucleotide
  Target: ATXN1; (+) strand; PAM type: NRG; PAM sequence: TGG
gctttttatggaattaggca

SEQ ID NO: 110928 - DNA, 20 bp, Artificial Sequence
  Description of Artificial Sequence: Synthetic oligonucleotide
  Target: ATXN1; (+) strand; PAM type: NRG; PAM sequence: GGG
ctttttatggaattaggcat

SEQ ID NO: 110929 - DNA, 20 bp, Artificial Sequence
  Description of Artificial Sequence: Synthetic oligonucleotide
  Target: ATXN1; (+) strand; PAM type: NRG; PAM sequence: AAG
tttatggaattaggcatggg

SEQ ID NO: 110930 - DNA, 20 bp, Artificial Sequence
  Description of Artificial Sequence: Synthetic oligonucleotide
  Target: ATXN1; (+) strand; PAM type: NRG; PAM sequence: CAG
atggaattaggcatgggaag

SEQ ID NO: 110931 - DNA, 20 bp, Artificial Sequence
  Description of Artificial Sequence: Synthetic oligonucleotide
  Target: ATXN1; (+) strand; PAM type: NRG; PAM sequence: CAG
caaacgttatcttaactcca

SEQ ID NO: 110932 - DNA, 20 bp, Artificial Sequence
  Description of Artificial Sequence: Synthetic oligonucleotide
  Target: ATXN1; (+) strand; PAM type: NRG; PAM sequence: CAG
aaaaccttcctcttgacaac

SEQ ID NO: 110933 - DNA, 20 bp, Artificial Sequence
  Description of Artificial Sequence: Synthetic oligonucleotide
  Target: ATXN1; (+) strand; PAM type: NRG; PAM sequence: GAG
aaccttcctcttgacaacca

SEQ ID NO: 110934 - DNA, 20 bp, Artificial Sequence
  Description of Artificial Sequence: Synthetic oligonucleotide
  Target: ATXN1; (+) strand; PAM type: NRG; PAM sequence: AGG
accttcctcttgacaaccag

SEQ ID NO: 110935 - DNA, 20 bp, Artificial Sequence
  Description of Artificial Sequence: Synthetic oligonucleotide
  Target: ATXN1; (+) strand; PAM type: NRG; PAM sequence: GAG
cttcctcttgacaaccagag

SEQ ID NO: 110936 - DNA, 20 bp, Artificial Sequence
  Description of Artificial Sequence: Synthetic oligonucleotide
  Target: ATXN1; (+) strand; PAM type: NRG; PAM sequence: AGG
ttcctcttgacaaccagagg

SEQ ID NO: 110937 - DNA, 20 bp, Artificial Sequence
  Description of Artificial Sequence: Synthetic oligonucleotide
  Target: ATXN1; (+) strand; PAM type: NRG; PAM sequence: AAG
ctcttgacaaccagaggagg

SEQ ID NO: 110938 - DNA, 20 bp, Artificial Sequence
  Description of Artificial Sequence: Synthetic oligonucleotide
  Target: ATXN1; (+) strand; PAM type: NRG; PAM sequence: AGG
tcttgacaaccagaggagga

SEQ ID NO: 110939 - DNA, 20 bp, Artificial Sequence
  Description of Artificial Sequence: Synthetic oligonucleotide
  Target: ATXN1; (+) strand; PAM type: NRG; PAM sequence: TGG
tgacaaccagaggaggaagg

SEQ ID NO: 110940 - DNA, 20 bp, Artificial Sequence
  Description of Artificial Sequence: Synthetic oligonucleotide
  Target: ATXN1; (+) strand; PAM type: NRG; PAM sequence: CAG
ggaggaaggtggttttaacc

SEQ ID NO: 110941 - DNA, 20 bp, Artificial Sequence
  Description of Artificial Sequence: Synthetic oligonucleotide
  Target: ATXN1; (+) strand; PAM type: NRG; PAM sequence: TAG
ccagtctgaattcaaatctg

SEQ ID NO: 110942 - DNA, 20 bp, Artificial Sequence
  Description of Artificial Sequence: Synthetic oligonucleotide
  Target: ATXN1; (+) strand; PAM type: NRG; PAM sequence: TAG
tctgaattcaaatctgtaga

SEQ ID NO: 110943 - DNA, 20 bp, Artificial Sequence
  Description of Artificial Sequence: Synthetic oligonucleotide
  Target: ATXN1; (+) strand; PAM type: NRG; PAM sequence: CAG
tttttttaactctcttaaaa

SEQ ID NO: 110944 - DNA, 20 bp, Artificial Sequence
  Description of Artificial Sequence: Synthetic oligonucleotide
  Target: ATXN1; (+) strand; PAM type: NRG; PAM sequence: TAG
attatatatacatacacatg

SEQ ID NO: 110945 - DNA, 20 bp, Artificial Sequence
  Description of Artificial Sequence: Synthetic oligonucleotide
  Target: ATXN1; (+) strand; PAM type: NRG; PAM sequence: TGG
tgtgcacgtgtatgtatgta

SEQ ID NO: 110946 - DNA, 20 bp, Artificial Sequence
  Description of Artificial Sequence: Synthetic oligonucleotide
  Target: ATXN1; (+) strand; PAM type: NRG; PAM sequence: CAG
catgtacacacacatacact

SEQ ID NO: 110947 - DNA, 20 bp, Artificial Sequence
  Description of Artificial Sequence: Synthetic oligonucleotide
  Target: ATXN1; (+) strand; PAM type: NRG; PAM sequence: AAG
tacacacacatacactcaga

SEQ ID NO: 110948 - DNA, 20 bp, Artificial Sequence
  Description of Artificial Sequence: Synthetic oligonucleotide
  Target: ATXN1; (+) strand; PAM type: NRG; PAM sequence: TGG
acacatacactcagaaagac

SEQ ID NO: 110949 - DNA, 20 bp, Artificial Sequence
  Description of Artificial Sequence: Synthetic oligonucleotide
  Target: ATXN1; (+) strand; PAM type: NRG; PAM sequence: GGG
cacatacactcagaaagact

SEQ ID NO: 110950 - DNA, 20 bp, Artificial Sequence
  Description of Artificial Sequence: Synthetic oligonucleotide
  Target: ATXN1; (+) strand; PAM type: NRG; PAM sequence: TGG
actcagaaagactgggactc

SEQ ID NO: 110951 - DNA, 20 bp, Artificial Sequence
  Description of Artificial Sequence: Synthetic oligonucleotide
  Target: ATXN1; (+) strand; PAM type: NRG; PAM sequence: CAG
cagaaagactgggactctgg

SEQ ID NO: 110952 - DNA, 20 bp, Artificial Sequence
  Description of Artificial Sequence: Synthetic oligonucleotide
  Target: ATXN1; (+) strand; PAM type: NRG; PAM sequence: AGG
agaaagactgggactctggc

SEQ ID NO: 110953 - DNA, 20 bp, Artificial Sequence
  Description of Artificial Sequence: Synthetic oligonucleotide
  Target: ATXN1; (+) strand; PAM type: NRG; PAM sequence: CAG
actgggactctggcaggaac

SEQ ID NO: 110954 - DNA, 20 bp, Artificial Sequence
  Description of Artificial Sequence: Synthetic oligonucleotide
  Target: ATXN1; (+) strand; PAM type: NRG; PAM sequence: TAG
attctgccacatcccaaacc

SEQ ID NO: 110955 - DNA, 20 bp, Artificial Sequence
  Description of Artificial Sequence: Synthetic oligonucleotide
  Target: ATXN1; (+) strand; PAM type: NRG; PAM sequence: CAG
ctgccacatcccaaacctag

SEQ ID NO: 110956 - DNA, 20 bp, Artificial Sequence
  Description of Artificial Sequence: Synthetic oligonucleotide
  Target: ATXN1; (+) strand; PAM type: NRG; PAM sequence: AAG
catcccaaacctagcagacc

SEQ ID NO: 110957 - DNA, 20 bp, Artificial Sequence
  Description of Artificial Sequence: Synthetic oligonucleotide
  Target: ATXN1; (+) strand; PAM type: NRG; PAM sequence: TGG
tagcagaccaagttcaactt

SEQ ID NO: 110958 - DNA, 20 bp, Artificial Sequence
  Description of Artificial Sequence: Synthetic oligonucleotide
  Target: ATXN1; (+) strand; PAM type: NRG; PAM sequence: CAG
atgcatcatcaccttcacgc

SEQ ID NO: 110959 - DNA, 20 bp, Artificial Sequence
  Description of Artificial Sequence: Synthetic oligonucleotide
  Target: ATXN1; (+) strand; PAM type: NRG; PAM sequence: CGG
acgccagaatcacaaacaca

SEQ ID NO: 110960 - DNA, 20 bp, Artificial Sequence
  Description of Artificial Sequence: Synthetic oligonucleotide
  Target: ATXN1; (+) strand; PAM type: NRG; PAM sequence: GGG
cgccagaatcacaaacacac

SEQ ID NO: 110961 - DNA, 20 bp, Artificial Sequence
  Description of Artificial Sequence: Synthetic oligonucleotide
  Target: ATXN1; (+) strand; PAM type: NRG; PAM sequence: AAG
agaatcacaaacacacgggc

SEQ ID NO: 110962 - DNA, 20 bp, Artificial Sequence
  Description of Artificial Sequence: Synthetic oligonucleotide
  Target: ATXN1; (+) strand; PAM type: NRG; PAM sequence: GAG
aatcacaaacacacgggcaa

SEQ ID NO: 110963 - DNA, 20 bp, Artificial Sequence
  Description of Artificial Sequence: Synthetic oligonucleotide
  Target: ATXN1; (+) strand; PAM type: NRG; PAM sequence: AGG
atcacaaacacacgggcaag

SEQ ID NO: 110964 - DNA, 20 bp, Artificial Sequence
  Description of Artificial Sequence: Synthetic oligonucleotide
  Target: ATXN1; (+) strand; PAM type: NRG; PAM sequence: CAG
cgggcaagaggttgaaatcc

SEQ ID NO: 110965 - DNA, 20 bp, Artificial Sequence
  Description of Artificial Sequence: Synthetic oligonucleotide
  Target: ATXN1; (+) strand; PAM type: NRG; PAM sequence: AGG
gggcaagaggttgaaatccc

SEQ ID NO: 110966 - DNA, 20 bp, Artificial Sequence
  Description of Artificial Sequence: Synthetic oligonucleotide
  Target: ATXN1; (+) strand; PAM type: NRG; PAM sequence: CGG
aggttgaaatcccaggtcct

SEQ ID NO: 110967 - DNA, 20 bp, Artificial Sequence
  Description of Artificial Sequence: Synthetic oligonucleotide
  Target: ATXN1; (+) strand; PAM type: NRG; PAM sequence: CAG
atcccaggtcctcggcttct

SEQ ID NO: 110968 - DNA, 20 bp, Artificial Sequence
  Description of Artificial Sequence: Synthetic oligonucleotide
  Target: ATXN1; (+) strand; PAM type: NRG; PAM sequence: CAG
cggcttctcagctgacacat

SEQ ID NO: 110969 - DNA, 20 bp, Artificial Sequence
  Description of Artificial Sequence: Synthetic oligonucleotide
  Target: ATXN1; (+) strand; PAM type: NRG; PAM sequence: GAG
gcttctcagctgacacatca

SEQ ID NO: 110970 - DNA, 20 bp, Artificial Sequence
  Description of Artificial Sequence: Synthetic oligonucleotide
  Target: ATXN1; (+) strand; PAM type: NRG; PAM sequence: AAG
tcagagtttatgcgttttct

SEQ ID NO: 110971 - DNA, 20 bp, Artificial Sequence
  Description of Artificial Sequence: Synthetic oligonucleotide
  Target: ATXN1; (+) strand; PAM type: NRG; PAM sequence: AAG
gagtttatgcgttttctaag

SEQ ID NO: 110972 - DNA, 20 bp, Artificial Sequence
  Description of Artificial Sequence: Synthetic oligonucleotide
  Target: ATXN1; (+) strand; PAM type: NRG; PAM sequence: GAG
gtttatgcgttttctaagaa

SEQ ID NO: 110973 - DNA, 20 bp, Artificial Sequence
  Description of Artificial Sequence: Synthetic oligonucleotide
  Target: ATXN1; (+) strand; PAM type: NRG; PAM sequence: AGG
tttatgcgttttctaagaag

SEQ ID NO: 110974 - DNA, 20 bp, Artificial Sequence
  Description of Artificial Sequence: Synthetic oligonucleotide
  Target: ATXN1; (+) strand; PAM type: NRG; PAM sequence: AAG
atgcgttttctaagaagagg

SEQ ID NO: 110975 - DNA, 20 bp, Artificial Sequence
  Description of Artificial Sequence: Synthetic oligonucleotide
  Target: ATXN1; (+) strand; PAM type: NRG; PAM sequence: AAG
ctaagaagaggaagttattc

SEQ ID NO: 110976 - DNA, 20 bp, Artificial Sequence
  Description of Artificial Sequence: Synthetic oligonucleotide
  Target: ATXN1; (+) strand; PAM type: NRG; PAM sequence: AAG
tctttaaaaaaaaatttttt

SEQ ID NO: 110977 - DNA, 20 bp, Artificial Sequence
  Description of Artificial Sequence: Synthetic oligonucleotide
  Target: ATXN1; (+) strand; PAM type: NRG; PAM sequence: CAG
taaaaaaaaattttttaaga

SEQ ID NO: 110978 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaattttttaagac

SEQ ID NO: 110979 - DNA, 20 bp, Artificial Sequence
  Description of Artificial Sequence: Synthetic oligonucleotide
  Target: ATXN1; (+) strand; PAM type: NRG; PAM sequence: GGG
aaaaaaaattttttaagaca

SEQ ID NO: 110980 - DNA, 20 bp, Artificial Sequence
  Description of Artificial Sequence: Synthetic oligonucleotide
  Target: ATXN1; (+) strand; PAM type: NRG; PAM sequence: CAG
cagggtctcactttgtcact

SEQ ID NO: 110981 - DNA, 20 bp, Artificial Sequence
  Description of Artificial Sequence: Synthetic oligonucleotide
  Target: ATXN1; (+) strand; PAM type: NRG; PAM sequence: AGG
agggtctcactttgtcactc

SEQ ID NO: 110982 - DNA, 20 bp, Artificial Sequence
  Description of Artificial Sequence: Synthetic oligonucleotide
  Target: ATXN1; (+) strand; PAM type: NRG; PAM sequence: TGG
tctcactttgtcactcaggt

SEQ ID NO: 110983 - DNA, 20 bp, Artificial Sequence
  Description of Artificial Sequence: Synthetic oligonucleotide
  Target: ATXN1; (+) strand; PAM type: NRG; PAM sequence: GAG
tcactttgtcactcaggttg

SEQ ID NO: 110984 - DNA, 20 bp, Artificial Sequence
  Description of Artificial Sequence: Synthetic oligonucleotide
  Target: ATXN1; (+) strand; PAM type: NRG; PAM sequence: CAG
ttgtcactcaggttggagtg

SEQ ID NO: 110985 - DNA, 20 bp, Artificial Sequence
  Description of Artificial Sequence: Synthetic oligonucleotide
  Target: ATXN1; (+) strand; PAM type: NRG; PAM sequence: TGG
tcactcaggttggagtgcag

SEQ ID NO: 110986 - DNA, 20 bp, Artificial Sequence
  Description of Artificial Sequence: Synthetic oligonucleotide
  Target: ATXN1; (+) strand; PAM type: NRG; PAM sequence: CAG
ggagtgcagtggtgtaatct

SEQ ID NO: 110987 - DNA, 20 bp, Artificial Sequence
  Description of Artificial Sequence: Synthetic oligonucleotide
  Target: ATXN1; (+) strand; PAM type: NRG; PAM sequence: CAG
ggtgtaatctcagctcactt

SEQ ID NO: 110988 - DNA, 20 bp, Artificial Sequence
  Description of Artificial Sequence: Synthetic oligonucleotide
  Target: ATXN1; (+) strand; PAM type: NRG; PAM sequence: TGG
tcacttcagccttgaccttc

SEQ ID NO: 110989 - DNA, 20 bp, Artificial Sequence
  Description of Artificial Sequence: Synthetic oligonucleotide
  Target: ATXN1; (+) strand; PAM type: NRG; PAM sequence: GGG
cacttcagccttgaccttct

SEQ ID NO: 110990 - DNA, 20 bp, Artificial Sequence
  Description of Artificial Sequence: Synthetic oligonucleotide
  Target: ATXN1; (+) strand; PAM type: NRG; PAM sequence: AAG
agccttgaccttctgggttc

SEQ ID NO: 110991 - DNA, 20 bp, Artificial Sequence
  Description of Artificial Sequence: Synthetic oligonucleotide
  Target: ATXN1; (+) strand; PAM type: NRG; PAM sequence: CAG
ttcaagcaattctcctgctt

SEQ ID NO: 110992 - DNA, 20 bp, Artificial Sequence
  Description of Artificial Sequence: Synthetic oligonucleotide
  Target: ATXN1; (+) strand; PAM type: NRG; PAM sequence: AAG
ttctcctgcttcagcccctt

SEQ ID NO: 110993 - DNA, 20 bp, Artificial Sequence
  Description of Artificial Sequence: Synthetic oligonucleotide
  Target: ATXN1; (+) strand; PAM type: NRG; PAM sequence: TAG
tcctgcttcagccccttaag

SEQ ID NO: 110994 - DNA, 20 bp, Artificial Sequence
  Description of Artificial Sequence: Synthetic oligonucleotide
  Target: ATXN1; (+) strand; PAM type: NRG; PAM sequence: TGG
gcttcagccccttaagtagt

SEQ ID NO: 110995 - DNA, 20 bp, Artificial Sequence
  Description of Artificial Sequence: Synthetic oligonucleotide
  Target: ATXN1; (+) strand; PAM type: NRG; PAM sequence: GGG
cttcagccccttaagtagtt

SEQ ID NO: 110996 - DNA, 20 bp, Artificial Sequence
  Description of Artificial Sequence: Synthetic oligonucleotide
  Target: ATXN1; (+) strand; PAM type: NRG; PAM sequence: CAG
cccttaagtagttgggacta

SEQ ID NO: 110997 - DNA, 20 bp, Artificial Sequence
  Description of Artificial Sequence: Synthetic oligonucleotide
  Target: ATXN1; (+) strand; PAM type: NRG; PAM sequence: TAG
ctgactaatttttgtatttt

SEQ ID NO: 110998 - DNA, 20 bp, Artificial Sequence
  Description of Artificial Sequence: Synthetic oligonucleotide
  Target: ATXN1; (+) strand; PAM type: NRG; PAM sequence: TAG
actaatttttgtatttttag

SEQ ID NO: 110999 - DNA, 20 bp, Artificial Sequence
  Description of Artificial Sequence: Synthetic oligonucleotide
  Target: ATXN1; (+) strand; PAM type: NRG; PAM sequence: GAG
taatttttgtatttttagta

SEQ ID NO: 111000 - DNA, 20 bp, Artificial Sequence
  Description of Artificial Sequence: Synthetic oligonucleotide
  Target: ATXN1; (+) strand; PAM type: NRG; PAM sequence: TGG
ttttgtatttttagtagaga

SEQ ID NO: 111001 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtagagat

SEQ ID NO: 111002 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagatg

SEQ ID NO: 111003 - DNA, 20 bp, Artificial Sequence
  Description of Artificial Sequence: Synthetic oligonucleotide
  Target: ATXN1; (+) strand; PAM type: NRG; PAM sequence: TGG
gagatggggtttcgccacat

SEQ ID NO: 111004 - DNA, 20 bp, Artificial Sequence
  Description of Artificial Sequence: Synthetic oligonucleotide
  Target: ATXN1; (+) strand; PAM type: NRG; PAM sequence: CAG
tggggtttcgccacattggc

SEQ ID NO: 111005 - DNA, 20 bp, Artificial Sequence
  Description of Artificial Sequence: Synthetic oligonucleotide
  Target: ATXN1; (+) strand; PAM type: NRG; PAM sequence: AGG
ggggtttcgccacattggcc

SEQ ID NO: 111006 - DNA, 20 bp, Artificial Sequence
  Description of Artificial Sequence: Synthetic oligonucleotide
  Target: ATXN1; (+) strand; PAM type: NRG; PAM sequence: TGG
tttcgccacattggccaggc

SEQ ID NO: 111007 - DNA, 20 bp, Artificial Sequence
  Description of Artificial Sequence: Synthetic oligonucleotide
  Target: ATXN1; (+) strand; PAM type: NRG; PAM sequence: GAG
caggctggtctcgaactctt

SEQ ID NO: 111008 - DNA, 20 bp, Artificial Sequence
  Description of Artificial Sequence: Synthetic oligonucleotide
  Target: ATXN1; (+) strand; PAM type: NRG; PAM sequence: AAG
ggtctcgaactcttgagctc

SEQ ID NO: 111009 - DNA, 20 bp, Artificial Sequence
  Description of Artificial Sequence: Synthetic oligonucleotide
  Target: ATXN1; (+) strand; PAM type: NRG; PAM sequence: TGG
ctcaagtgatcctcacacct

SEQ ID NO: 111010 - DNA, 20 bp, Artificial Sequence
  Description of Artificial Sequence: Synthetic oligonucleotide
  Target: ATXN1; (+) strand; PAM type: NRG; PAM sequence: AAG
cctcacaccttggcctccaa

SEQ ID NO: 111011 - DNA, 20 bp, Artificial Sequence
  Description of Artificial Sequence: Synthetic oligonucleotide
  Target: ATXN1; (+) strand; PAM type: NRG; PAM sequence: TAG
accttggcctccaaaagtgc

SEQ ID NO: 111012 - DNA, 20 bp, Artificial Sequence
  Description of Artificial Sequence: Synthetic oligonucleotide
  Target: ATXN1; (+) strand; PAM type: NRG; PAM sequence: AGG
ccttggcctccaaaagtgct

SEQ ID NO: 111013 - DNA, 20 bp, Artificial Sequence
  Description of Artificial Sequence: Synthetic oligonucleotide
  Target: ATXN1; (+) strand; PAM type: NRG; PAM sequence: CAG
ctccaaaagtgctaggatta

SEQ ID NO: 111014 - DNA, 20 bp, Artificial Sequence
  Description of Artificial Sequence: Synthetic oligonucleotide
  Target: ATXN1; (+) strand; PAM type: NRG; PAM sequence: AGG
tccaaaagtgctaggattac

SEQ ID NO: 111015 - DNA, 20 bp, Artificial Sequence
  Description of Artificial Sequence: Synthetic oligonucleotide
  Target: ATXN1; (+) strand; PAM type: NRG; PAM sequence: GAG
agtgctaggattacaggcgt

SEQ ID NO: 111016 - DNA, 20 bp, Artificial Sequence
  Description of Artificial Sequence: Synthetic oligonucleotide
  Target: ATXN1; (+) strand; PAM type: NRG; PAM sequence: TGG
aggattacaggcgtgagcca

SEQ ID NO: 111017 - DNA, 20 bp, Artificial Sequence
  Description of Artificial Sequence: Synthetic oligonucleotide
  Target: ATXN1; (+) strand; PAM type: NRG; PAM sequence: CGG
caggcgtgagccatggcgcc

SEQ ID NO: 111018 - DNA, 20 bp, Artificial Sequence
  Description of Artificial Sequence: Synthetic oligonucleotide
  Target: ATXN1; (+) strand; PAM type: NRG; PAM sequence: AAG
gagccatggcgcccggccct

SEQ ID NO: 111019 - DNA, 20 bp, Artificial Sequence
  Description of Artificial Sequence: Synthetic oligonucleotide
  Target: ATXN1; (+) strand; PAM type: NRG; PAM sequence: CAG
ggccctaagctctttaaatg

SEQ ID NO: 111020 - DNA, 20 bp, Artificial Sequence
  Description of Artificial Sequence: Synthetic oligonucleotide
  Target: ATXN1; (+) strand; PAM type: NRG; PAM sequence: GAG
ttattaccctgtcccctcct

SEQ ID NO: 111021 - DNA, 20 bp, Artificial Sequence
  Description of Artificial Sequence: Synthetic oligonucleotide
  Target: ATXN1; (+) strand; PAM type: NRG; PAM sequence: AAG
actctcctcatcctgaaaaa

SEQ ID NO: 111022 - DNA, 20 bp, Artificial Sequence
  Description of Artificial Sequence: Synthetic oligonucleotide
  Target: ATXN1; (+) strand; PAM type: NRG; PAM sequence: CAG
cctcatcctgaaaaaaagca

SEQ ID NO: 111023 - DNA, 20 bp, Artificial Sequence
  Description of Artificial Sequence: Synthetic oligonucleotide
  Target: ATXN1; (+) strand; PAM type: NRG; PAM sequence: CAG
atcctgaaaaaaagcacaga

SEQ ID NO: 111024 - DNA, 20 bp, Artificial Sequence
  Description of Artificial Sequence: Synthetic oligonucleotide
  Target: ATXN1; (+) strand; PAM type: NRG; PAM sequence: CAG
ctgaaaaaaagcacagacag

SEQ ID NO: 111025 - DNA, 20 bp, Artificial Sequence
  Description of Artificial Sequence: Synthetic oligonucleotide
  Target: ATXN1; (+) strand; PAM type: NRG; PAM sequence: AGG
tgaaaaaaagcacagacagc

SEQ ID NO: 111026 - DNA, 20 bp, Artificial Sequence
  Description of Artificial Sequence: Synthetic oligonucleotide
  Target: ATXN1; (+) strand; PAM type: NRG; PAM sequence: TGG
aaaagcacagacagcaggaa

SEQ ID NO: 111027 - DNA, 20 bp, Artificial Sequence
  Description of Artificial Sequence: Synthetic oligonucleotide
  Target: ATXN1; (+) strand; PAM type: NRG; PAM sequence: TAG
cagcaggaatggacaatcta

SEQ ID NO: 111028 - DNA, 20 bp, Artificial Sequence
  Description of Artificial Sequence: Synthetic oligonucleotide
  Target: ATXN1; (+) strand; PAM type: NRG; PAM sequence: AGG
agcaggaatggacaatctat

SEQ ID NO: 111029 - DNA, 20 bp, Artificial Sequence
  Description of Artificial Sequence: Synthetic oligonucleotide
  Target: ATXN1; (+) strand; PAM type: NRG; PAM sequence: TGG
aatggacaatctataggttg

SEQ ID NO: 111030 - DNA, 20 bp, Artificial Sequence
  Description of Artificial Sequence: Synthetic oligonucleotide
  Target: ATXN1; (+) strand; PAM type: NRG; PAM sequence: GGG
atggacaatctataggttgt

SEQ ID NO: 111031 - DNA, 20 bp, Artificial Sequence
  Description of Artificial Sequence: Synthetic oligonucleotide
  Target: ATXN1; (+) strand; PAM type: NRG; PAM sequence: GGG
tggacaatctataggttgtg

SEQ ID NO: 111032 - DNA, 20 bp, Artificial Sequence
  Description of Artificial Sequence: Synthetic oligonucleotide
  Target: ATXN1; (+) strand; PAM type: NRG; PAM sequence: TGG
ggggctgcatgtgatatttc

SEQ ID NO: 111033 - DNA, 20 bp, Artificial Sequence
  Description of Artificial Sequence: Synthetic oligonucleotide
  Target: ATXN1; (+) strand; PAM type: NRG; PAM sequence: AAG
gctttcacgttctgttcttg

SEQ ID NO: 111034 - DNA, 20 bp, Artificial Sequence
  Description of Artificial Sequence: Synthetic oligonucleotide
  Target: ATXN1; (+) strand; PAM type: NRG; PAM sequence: AAG
tcacgttctgttcttgaagt

SEQ ID NO: 111035 - DNA, 20 bp, Artificial Sequence
  Description of Artificial Sequence: Synthetic oligonucleotide
  Target: ATXN1; (+) strand; PAM type: NRG; PAM sequence: AAG
ctgttcttgaagtaagctta

SEQ ID NO: 111036 - DNA, 20 bp, Artificial Sequence
  Description of Artificial Sequence: Synthetic oligonucleotide
  Target: ATXN1; (+) strand; PAM type: NRG; PAM sequence: TGG
ataacatactctccctgcta

SEQ ID NO: 111037 - DNA, 20 bp, Artificial Sequence
  Description of Artificial Sequence: Synthetic oligonucleotide
  Target: ATXN1; (+) strand; PAM type: NRG; PAM sequence: AAG
actctccctgctatggttaa

SEQ ID NO: 111038 - DNA, 20 bp, Artificial Sequence
  Description of Artificial Sequence: Synthetic oligonucleotide
  Target: ATXN1; (+) strand; PAM type: NRG; PAM sequence: TAG
gctatggttaaaagaattct

SEQ ID NO: 111039 - DNA, 20 bp, Artificial Sequence
  Description of Artificial Sequence: Synthetic oligonucleotide
  Target: ATXN1; (+) strand; PAM type: NRG; PAM sequence: AGG
ctatggttaaaagaattctt

SEQ ID NO: 111040 - DNA, 20 bp, Artificial Sequence
  Description of Artificial Sequence: Synthetic oligonucleotide
  Target: ATXN1; (+) strand; PAM type: NRG; PAM sequence: TGG
aaaagaattcttaggatctt

SEQ ID NO: 111041 - DNA, 20 bp, Artificial Sequence
  Description of Artificial Sequence: Synthetic oligonucleotide
  Target: ATXN1; (+) strand; PAM type: NRG; PAM sequence: GGG
aaagaattcttaggatcttt

SEQ ID NO: 111042 - DNA, 20 bp, Artificial Sequence
  Description of Artificial Sequence: Synthetic oligonucleotide
  Target: ATXN1; (+) strand; PAM type: NRG; PAM sequence: AAG
tgggaaaaaaaaaaatctca

SEQ ID NO: 111043 - DNA, 20 bp, Artificial Sequence
  Description of Artificial Sequence: Synthetic oligonucleotide
  Target: ATXN1; (+) strand; PAM type: NRG; PAM sequence: TAG
tcaaagtaaatatgacaata

SEQ ID NO: 111044 - DNA, 20 bp, Artificial Sequence
  Description of Artificial Sequence: Synthetic oligonucleotide
  Target: ATXN1; (+) strand; PAM type: NRG; PAM sequence: GAG
aaagtaaatatgacaatata

SEQ ID NO: 111045 - DNA, 20 bp, Artificial Sequence
  Description of Artificial Sequence: Synthetic oligonucleotide
  Target: ATXN1; (+) strand; PAM type: NRG; PAM sequence: TGG
atatgacaatatagagacac

SEQ ID NO: 111046 - DNA, 20 bp, Artificial Sequence
  Description of Artificial Sequence: Synthetic oligonucleotide
  Target: ATXN1; (+) strand; PAM type: NRG; PAM sequence: GAG
atgacaatatagagacactg

SEQ ID NO: 111047 - DNA, 20 bp, Artificial Sequence
  Description of Artificial Sequence: Synthetic oligonucleotide
  Target: ATXN1; (+) strand; PAM type: NRG; PAM sequence: AGG
tgacaatatagagacactgg

SEQ ID NO: 111048 - DNA, 20 bp, Artificial Sequence
  Description of Artificial Sequence: Synthetic oligonucleotide
  Target: ATXN1; (+) strand; PAM type: NRG; PAM sequence: GGG
gacaatatagagacactgga

SEQ ID NO: 111049 - DNA, 20 bp, Artificial Sequence
  Description of Artificial Sequence: Synthetic oligonucleotide
  Target: ATXN1; (+) strand; PAM type: NRG; PAM sequence: GAG
caatatagagacactggagg

SEQ ID NO: 111050 - DNA, 20 bp, Artificial Sequence
  Description of Artificial Sequence: Synthetic oligonucleotide
  Target: ATXN1; (+) strand; PAM type: NRG; PAM sequence: TAG
tggagggagctctaaacatc

SEQ ID NO: 111051 - DNA, 20 bp, Artificial Sequence
  Description of Artificial Sequence: Synthetic oligonucleotide
  Target: ATXN1; (+) strand; PAM type: NRG; PAM sequence: TAG
gagctctaaacatctagtga

SEQ ID NO: 111052 - DNA, 20 bp, Artificial Sequence
  Description of Artificial Sequence: Synthetic oligonucleotide
  Target: ATXN1; (+) strand; PAM type: NRG; PAM sequence: AGG
agctctaaacatctagtgat

SEQ ID NO: 111053 - DNA, 20 bp, Artificial Sequence
  Description of Artificial Sequence: Synthetic oligonucleotide
  Target: ATXN1; (+) strand; PAM type: NRG; PAM sequence: AAG
ttatgtatcctaaaattgaa

SEQ ID NO: 111054 - DNA, 20 bp, Artificial Sequence
  Description of Artificial Sequence: Synthetic oligonucleotide
  Target: ATXN1; (+) strand; PAM type: NRG; PAM sequence: TGG
attgaaaagttactgctttg

SEQ ID NO: 111055 - DNA, 20 bp, Artificial Sequence
  Description of Artificial Sequence: Synthetic oligonucleotide
  Target: ATXN1; (+) strand; PAM type: NRG; PAM sequence: GGG
ttgaaaagttactgctttgt

SEQ ID NO: 111056 - DNA, 20 bp, Artificial Sequence
  Description of Artificial Sequence: Synthetic oligonucleotide
  Target: ATXN1; (+) strand; PAM type: NRG; PAM sequence: TGG
tactgctttgtgggataata

SEQ ID NO: 111057 - DNA, 20 bp, Artificial Sequence
  Description of Artificial Sequence: Synthetic oligonucleotide
  Target: ATXN1; (+) strand; PAM type: NRG; PAM sequence: TGG
tgggataatatggtaaattc

SEQ ID NO: 111058 - DNA, 20 bp, Artificial Sequence
  Description of Artificial Sequence: Synthetic oligonucleotide
  Target: ATXN1; (+) strand; PAM type: NRG; PAM sequence: TAG
atatggtaaattctggcttt

SEQ ID NO: 111059 - DNA, 20 bp, Artificial Sequence
  Description of Artificial Sequence: Synthetic oligonucleotide
  Target: ATXN1; (+) strand; PAM type: NRG; PAM sequence: CAG
gcccattcttaatactgatt

SEQ ID NO: 111060 - DNA, 20 bp, Artificial Sequence
  Description of Artificial Sequence: Synthetic oligonucleotide
  Target: ATXN1; (+) strand; PAM type: NRG; PAM sequence: GAG
ccattcttaatactgattca

SEQ ID NO: 111061 - DNA, 20 bp, Artificial Sequence
  Description of Artificial Sequence: Synthetic oligonucleotide
  Target: ATXN1; (+) strand; PAM type: NRG; PAM sequence: CAG
ttcttaatactgattcagag

SEQ ID NO: 111062 - DNA, 20 bp, Artificial Sequence
  Description of Artificial Sequence: Synthetic oligonucleotide
  Target: ATXN1; (+) strand; PAM type: NRG; PAM sequence: AAG
ttaatactgattcagagcag

SEQ ID NO: 111063 - DNA, 20 bp, Artificial Sequence
  Description of Artificial Sequence: Synthetic oligonucleotide
  Target: ATXN1; (+) strand; PAM type: NRG; PAM sequence: TAG
tactgattcagagcagaaga

SEQ ID NO: 111064 - DNA, 20 bp, Artificial Sequence
  Description of Artificial Sequence: Synthetic oligonucleotide
  Target: ATXN1; (+) strand; PAM type: NRG; PAM sequence: CGG
catatcaacgtgtgtgcatg

SEQ ID NO: 111065 - DNA, 20 bp, Artificial Sequence
  Description of Artificial Sequence: Synthetic oligonucleotide
  Target: ATXN1; (+) strand; PAM type: NRG; PAM sequence: GGG
atatcaacgtgtgtgcatgc

SEQ ID NO: 111066 - DNA, 20 bp, Artificial Sequence
  Description of Artificial Sequence: Synthetic oligonucleotide
  Target: ATXN1; (+) strand; PAM type: NRG; PAM sequence: GGG
tatcaacgtgtgtgcatgcg

SEQ ID NO: 111067 - DNA, 20 bp, Artificial Sequence
  Description of Artificial Sequence: Synthetic oligonucleotide
  Target: ATXN1; (+) strand; PAM type: NRG; PAM sequence: CAG
caacgtgtgtgcatgcgggg

SEQ ID NO: 111068 - DNA, 20 bp, Artificial Sequence
  Description of Artificial Sequence: Synthetic oligonucleotide
  Target: ATXN1; (+) strand; PAM type: NRG; PAM sequence: AGG
aacgtgtgtgcatgcggggc

SEQ ID NO: 111069 - DNA, 20 bp, Artificial Sequence
  Description of Artificial Sequence: Synthetic oligonucleotide
  Target: ATXN1; (+) strand; PAM type: NRG; PAM sequence: GAG
cgtgtgtgcatgcggggcag

SEQ ID NO: 111070 - DNA, 20 bp, Artificial Sequence
  Description of Artificial Sequence: Synthetic oligonucleotide
  Target: ATXN1; (+) strand; PAM type: NRG; PAM sequence: AGG
gtgtgtgcatgcggggcagg

SEQ ID NO: 111071 - DNA, 20 bp, Artificial Sequence
  Description of Artificial Sequence: Synthetic oligonucleotide
  Target: ATXN1; (+) strand; PAM type: NRG; PAM sequence: TGG
tgtgcatgcggggcaggagg

SEQ ID NO: 111072 - DNA, 20 bp, Artificial Sequence
  Description of Artificial Sequence: Synthetic oligonucleotide
  Target: ATXN1; (+) strand; PAM type: NRG; PAM sequence: GGG
gtgcatgcggggcaggaggt

SEQ ID NO: 111073 - DNA, 20 bp, Artificial Sequence
  Description of Artificial Sequence: Synthetic oligonucleotide
  Target: ATXN1; (+) strand; PAM type: NRG; PAM sequence: GGG
tgcatgcggggcaggaggtg

SEQ ID NO: 111074 - DNA, 20 bp, Artificial Sequence
  Description of Artificial Sequence: Synthetic oligonucleotide
  Target: ATXN1; (+) strand; PAM type: NRG; PAM sequence: GGG
gcatgcggggcaggaggtgg

SEQ ID NO: 111075 - DNA, 20 bp, Artificial Sequence
  Description of Artificial Sequence: Synthetic oligonucleotide
  Target: ATXN1; (+) strand; PAM type: NRG; PAM sequence: GGG
catgcggggcaggaggtggg

SEQ ID NO: 111076 - DNA, 20 bp, Artificial Sequence
  Description of Artificial Sequence: Synthetic oligonucleotide
  Target: ATXN1; (+) strand; PAM type: NRG; PAM sequence: GAG
tgcggggcaggaggtggggg

SEQ ID NO: 111077 - DNA, 20 bp, Artificial Sequence
  Description of Artificial Sequence: Synthetic oligonucleotide
  Target: ATXN1; (+) strand; PAM type: NRG; PAM sequence: AAG
atatgactctttacccaaaa

SEQ ID NO: 111078 - DNA, 20 bp, Artificial Sequence
  Description of Artificial Sequence: Synthetic oligonucleotide
  Target: ATXN1; (+) strand; PAM type: NRG; PAM sequence: AGG
tatgactctttacccaaaaa

SEQ ID NO: 111079 - DNA, 20 bp, Artificial Sequence
  Description of Artificial Sequence: Synthetic oligonucleotide
  Target: ATXN1; (+) strand; PAM type: NRG; PAM sequence: GAG
tgactctttacccaaaaaag

SEQ ID NO: 111080 - DNA, 20 bp, Artificial Sequence
  Description of Artificial Sequence: Synthetic oligonucleotide
  Target: ATXN1; (+) strand; PAM type: NRG; PAM sequence: AGG
gactctttacccaaaaaagg

SEQ ID NO: 111081 - DNA, 20 bp, Artificial Sequence
  Description of Artificial Sequence: Synthetic oligonucleotide
  Target: ATXN1; (+) strand; PAM type: NRG; PAM sequence: TGG
aaaaggaggccatttattct

SEQ ID NO: 111082 - DNA, 20 bp, Artificial Sequence
  Description of Artificial Sequence: Synthetic oligonucleotide
  Target: ATXN1; (+) strand; PAM type: NRG; PAM sequence: CAG
ccatttattcttggcttcca

SEQ ID NO: 111083 - DNA, 20 bp, Artificial Sequence
  Description of Artificial Sequence: Synthetic oligonucleotide
  Target: ATXN1; (+) strand; PAM type: NRG; PAM sequence: AGG
catttattcttggcttccac

SEQ ID NO: 111084 - DNA, 20 bp, Artificial Sequence
  Description of Artificial Sequence: Synthetic oligonucleotide
  Target: ATXN1; (+) strand; PAM type: NRG; PAM sequence: GGG
atttattcttggcttccaca

SEQ ID NO: 111085 - DNA, 20 bp, Artificial Sequence
  Description of Artificial Sequence: Synthetic oligonucleotide
  Target: ATXN1; (+) strand; PAM type: NRG; PAM sequence: AAG
gcttccacagggcctctgaa

SEQ ID NO: 111086 - DNA, 20 bp, Artificial Sequence
  Description of Artificial Sequence: Synthetic oligonucleotide
  Target: ATXN1; (+) strand; PAM type: NRG; PAM sequence: TGG
atactctgaaaatattttct

SEQ ID NO: 111087 - DNA, 20 bp, Artificial Sequence
  Description of Artificial Sequence: Synthetic oligonucleotide
  Target: ATXN1; (+) strand; PAM type: NRG; PAM sequence: GAG
actctgaaaatattttcttg

SEQ ID NO: 111088 - DNA, 20 bp, Artificial Sequence
  Description of Artificial Sequence: Synthetic oligonucleotide
  Target: ATXN1; (+) strand; PAM type: NRG; PAM sequence: GAG
tctgaaaatattttcttgga

SEQ ID NO: 111089 - DNA, 20 bp, Artificial Sequence
  Description of Artificial Sequence: Synthetic oligonucleotide
  Target: ATXN1; (+) strand; PAM type: NRG; PAM sequence: AAG
ttttcttggagagttcttta

SEQ ID NO: 111090 - DNA, 20 bp, Artificial Sequence
  Description of Artificial Sequence: Synthetic oligonucleotide
  Target: ATXN1; (+) strand; PAM type: NRG; PAM sequence: CAG
tcttggagagttctttaaag

SEQ ID NO: 111091 - DNA, 20 bp, Artificial Sequence
  Description of Artificial Sequence: Synthetic oligonucleotide
  Target: ATXN1; (+) strand; PAM type: NRG; PAM sequence: AAG
ggagagttctttaaagcaga

SEQ ID NO: 111092 - DNA, 20 bp, Artificial Sequence
  Description of Artificial Sequence: Synthetic oligonucleotide
  Target: ATXN1; (+) strand; PAM type: NRG; PAM sequence: AAG
tctttaaagcagaaagattt

SEQ ID NO: 111093 - DNA, 20 bp, Artificial Sequence
  Description of Artificial Sequence: Synthetic oligonucleotide
  Target: ATXN1; (+) strand; PAM type: NRG; PAM sequence: GAG
tttaaagcagaaagatttaa

SEQ ID NO: 111094 - DNA, 20 bp, Artificial Sequence
  Description of Artificial Sequence: Synthetic oligonucleotide
  Target: ATXN1; (+) strand; PAM type: NRG; PAM sequence: AGG
ttaaagcagaaagatttaag

SEQ ID NO: 111095 - DNA, 20 bp, Artificial Sequence
  Description of Artificial Sequence: Synthetic oligonucleotide
  Target: ATXN1; (+) strand; PAM type: NRG; PAM sequence: CAG
aagcagaaagatttaagagg

SEQ ID NO: 111096 - DNA, 20 bp, Artificial Sequence
  Description of Artificial Sequence: Synthetic oligonucleotide
  Target: ATXN1; (+) strand; PAM type: NRG; PAM sequence: AGG
agcagaaagatttaagaggc

SEQ ID NO: 111097 - DNA, 20 bp, Artificial Sequence
  Description of Artificial Sequence: Synthetic oligonucleotide
  Target: ATXN1; (+) strand; PAM type: NRG; PAM sequence: AAG
taagaggcaggaacataaca

SEQ ID NO: 111098 - DNA, 20 bp, Artificial Sequence
  Description of Artificial Sequence: Synthetic oligonucleotide
  Target: ATXN1; (+) strand; PAM type: NRG; PAM sequence: AGG
aagaggcaggaacataacaa

SEQ ID NO: 111099 - DNA, 20 bp, Artificial Sequence
  Description of Artificial Sequence: Synthetic oligonucleotide
  Target: ATXN1; (+) strand; PAM type: NRG; PAM sequence: AAG
aggcaggaacataacaaagg

SEQ ID NO: 111100 - DNA, 20 bp, Artificial Sequence
  Description of Artificial Sequence: Synthetic oligonucleotide
  Target: ATXN1; (+) strand; PAM type: NRG; PAM sequence: TGG
gaacataacaaaggaagtac

SEQ ID NO: 111101 - DNA, 20 bp, Artificial Sequence
  Description of Artificial Sequence: Synthetic oligonucleotide
  Target: ATXN1; (+) strand; PAM type: NRG; PAM sequence: AAG
acaaaggaagtactggacca

SEQ ID NO: 111102 - DNA, 20 bp, Artificial Sequence
  Description of Artificial Sequence: Synthetic oligonucleotide
  Target: ATXN1; (+) strand; PAM type: NRG; PAM sequence: GAG
aggaagtactggaccaaagt

SEQ ID NO: 111103 - DNA, 20 bp, Artificial Sequence
  Description of Artificial Sequence: Synthetic oligonucleotide
  Target: ATXN1; (+) strand; PAM type: NRG; PAM sequence: GAG
aagtgagccttgtttgaact

SEQ ID NO: 111104 - DNA, 20 bp, Artificial Sequence
  Description of Artificial Sequence: Synthetic oligonucleotide
  Target: ATXN1; (+) strand; PAM type: NRG; PAM sequence: AAG
gttttcacattttccactaa

SEQ ID NO: 111105 - DNA, 20 bp, Artificial Sequence
  Description of Artificial Sequence: Synthetic oligonucleotide
  Target: ATXN1; (+) strand; PAM type: NRG; PAM sequence: AGG
ttttcacattttccactaaa

SEQ ID NO: 111106 - DNA, 20 bp, Artificial Sequence
  Description of Artificial Sequence: Synthetic oligonucleotide
  Target: ATXN1; (+) strand; PAM type: NRG; PAM sequence: TGG
ctaaaaggtgctttgtcctt

SEQ ID NO: 111107 - DNA, 20 bp, Artificial Sequence
  Description of Artificial Sequence: Synthetic oligonucleotide
  Target: ATXN1; (+) strand; PAM type: NRG; PAM sequence: GGG
taaaaggtgctttgtccttt

SEQ ID NO: 111108 - DNA, 20 bp, Artificial Sequence
  Description of Artificial Sequence: Synthetic oligonucleotide
  Target: ATXN1; (+) strand; PAM type: NRG; PAM sequence: GAG
aaaggtgctttgtcctttgg

SEQ ID NO: 111109 - DNA, 20 bp, Artificial Sequence
  Description of Artificial Sequence: Synthetic oligonucleotide
  Target: ATXN1; (+) strand; PAM type: NRG; PAM sequence: AGG
aaggtgctttgtcctttggg

SEQ ID NO: 111110 - DNA, 20 bp, Artificial Sequence
  Description of Artificial Sequence: Synthetic oligonucleotide
  Target: ATXN1; (+) strand; PAM type: NRG; PAM sequence: CAG
ttcatcccacctttccctcc

SEQ ID NO: 111111 - DNA, 20 bp, Artificial Sequence
  Description of Artificial Sequence: Synthetic oligonucleotide
  Target: ATXN1; (+) strand; PAM type: NRG; PAM sequence: GAG
catcccacctttccctccca

SEQ ID NO: 111112 - DNA, 20 bp, Artificial Sequence
  Description of Artificial Sequence: Synthetic oligonucleotide
  Target: ATXN1; (+) strand; PAM type: NRG; PAM sequence: CAG
cctttccctcccagagcccc

SEQ ID NO: 111113 - DNA, 20 bp, Artificial Sequence
  Description of Artificial Sequence: Synthetic oligonucleotide
  Target: ATXN1; (+) strand; PAM type: NRG; PAM sequence: GAG
ctcccagagcccccagcaat

SEQ ID NO: 111114 - DNA, 20 bp, Artificial Sequence
  Description of Artificial Sequence: Synthetic oligonucleotide
  Target: ATXN1; (+) strand; PAM type: NRG; PAM sequence: GAG
cccagagcccccagcaatga

SEQ ID NO: 111115 - DNA, 20 bp, Artificial Sequence
  Description of Artificial Sequence: Synthetic oligonucleotide
  Target: ATXN1; (+) strand; PAM type: NRG; PAM sequence: AGG
ccagagcccccagcaatgag

SEQ ID NO: 111116 - DNA, 20 bp, Artificial Sequence
  Description of Artificial Sequence: Synthetic oligonucleotide
  Target: ATXN1; (+) strand; PAM type: NRG; PAM sequence: GGG
cagagcccccagcaatgaga

SEQ ID NO: 111117 - DNA, 20 bp, Artificial Sequence
  Description of Artificial Sequence: Synthetic oligonucleotide
  Target: ATXN1; (+) strand; PAM type: NRG; PAM sequence: TGG
cccagcaatgagagggcgtc

SEQ ID NO: 111118 - DNA, 20 bp, Artificial Sequence
  Description of Artificial Sequence: Synthetic oligonucleotide
  Target: ATXN1; (+) strand; PAM type: NRG; PAM sequence: CAG
ggcgtctggttcacatctgt

SEQ ID NO: 111119 - DNA, 20 bp, Artificial Sequence
  Description of Artificial Sequence: Synthetic oligonucleotide
  Target: ATXN1; (+) strand; PAM type: NRG; PAM sequence: AGG
gcgtctggttcacatctgtc

SEQ ID NO: 111120 - DNA, 20 bp, Artificial Sequence
  Description of Artificial Sequence: Synthetic oligonucleotide
  Target: ATXN1; (+) strand; PAM type: NRG; PAM sequence: CAG
tggttcacatctgtcaggtc

SEQ ID NO: 111121 - DNA, 20 bp, Artificial Sequence
  Description of Artificial Sequence: Synthetic oligonucleotide
  Target: ATXN1; (+) strand; PAM type: NRG; PAM sequence: AAG
gtcaggtccagaacctgact

SEQ ID NO: 111122 - DNA, 20 bp, Artificial Sequence
  Description of Artificial Sequence: Synthetic oligonucleotide
  Target: ATXN1; (+) strand; PAM type: NRG; PAM sequence: AAG
tccagaacctgactaagcac

SEQ ID NO: 111123 - DNA, 20 bp, Artificial Sequence
  Description of Artificial Sequence: Synthetic oligonucleotide
  Target: ATXN1; (+) strand; PAM type: NRG; PAM sequence: TGG
aagcacaagttctgtcctga

SEQ ID NO: 111124 - DNA, 20 bp, Artificial Sequence
  Description of Artificial Sequence: Synthetic oligonucleotide
  Target: ATXN1; (+) strand; PAM type: NRG; PAM sequence: GGG
agcacaagttctgtcctgat

SEQ ID NO: 111125 - DNA, 20 bp, Artificial Sequence
  Description of Artificial Sequence: Synthetic oligonucleotide
  Target: ATXN1; (+) strand; PAM type: NRG; PAM sequence: AAG
gttctgtcctgatgggactc

SEQ ID NO: 111126 - DNA, 20 bp, Artificial Sequence
  Description of Artificial Sequence: Synthetic oligonucleotide
  Target: ATXN1; (+) strand; PAM type: NRG; PAM sequence: GAG
tctgtcctgatgggactcaa

SEQ ID NO: 111127 - DNA, 20 bp, Artificial Sequence
  Description of Artificial Sequence: Synthetic oligonucleotide
  Target: ATXN1; (+) strand; PAM type: NRG; PAM sequence: GAG
gatgggactcaagagatgct

SEQ ID NO: 111128 - DNA, 20 bp, Artificial Sequence
  Description of Artificial Sequence: Synthetic oligonucleotide
  Target: ATXN1; (+) strand; PAM type: NRG; PAM sequence: GAG
ggactcaagagatgctgagt

SEQ ID NO: 111129 - DNA, 20 bp, Artificial Sequence
  Description of Artificial Sequence: Synthetic oligonucleotide
  Target: ATXN1; (+) strand; PAM type: NRG; PAM sequence: AGG
gactcaagagatgctgagtg

SEQ ID NO: 111130 - DNA, 20 bp, Artificial Sequence
  Description of Artificial Sequence: Synthetic oligonucleotide
  Target: ATXN1; (+) strand; PAM type: NRG; PAM sequence: GGG
actcaagagatgctgagtga

SEQ ID NO: 111131 - DNA, 20 bp, Artificial Sequence
  Description of Artificial Sequence: Synthetic oligonucleotide
  Target: ATXN1; (+) strand; PAM type: NRG; PAM sequence: GGG
ctcaagagatgctgagtgag

SEQ ID NO: 111132 - DNA, 20 bp, Artificial Sequence
  Description of Artificial Sequence: Synthetic oligonucleotide
  Target: ATXN1; (+) strand; PAM type: NRG; PAM sequence: GGG
tcaagagatgctgagtgagg

SEQ ID NO: 111133 - DNA, 20 bp, Artificial Sequence
  Description of Artificial Sequence: Synthetic oligonucleotide
  Target: ATXN1; (+) strand; PAM type: NRG; PAM sequence: TGG
agggggcattttgacaccct

SEQ ID NO: 111134 - DNA, 20 bp, Artificial Sequence
  Description of Artificial Sequence: Synthetic oligonucleotide
  Target: ATXN1; (+) strand; PAM type: NRG; PAM sequence: GGG
gggggcattttgacaccctt

SEQ ID NO: 111135 - DNA, 20 bp, Artificial Sequence
  Description of Artificial Sequence: Synthetic oligonucleotide
  Target: ATXN1; (+) strand; PAM type: NRG; PAM sequence: GGG
ggggcattttgacacccttg

SEQ ID NO: 111136 - DNA, 20 bp, Artificial Sequence
  Description of Artificial Sequence: Synthetic oligonucleotide
  Target: ATXN1; (+) strand; PAM type: NRG; PAM sequence: CAG
cttggggttcctgtcacgct

SEQ ID NO: 111137 - DNA, 20 bp, Artificial Sequence
  Description of Artificial Sequence: Synthetic oligonucleotide
  Target: ATXN1; (+) strand; PAM type: NRG; PAM sequence: CAG
gcttcctgctcgacttttac

SEQ ID NO: 111138 - DNA, 20 bp, Artificial Sequence
  Description of Artificial Sequence: Synthetic oligonucleotide
  Target: ATXN1; (+) strand; PAM type: NRG; PAM sequence: GAG
ttcctgctcgacttttacca

SEQ ID NO: 111139 - DNA, 20 bp, Artificial Sequence
  Description of Artificial Sequence: Synthetic oligonucleotide
  Target: ATXN1; (+) strand; PAM type: NRG; PAM sequence: TGG
gacttttaccagagtctgcc

SEQ ID NO: 111140 - DNA, 20 bp, Artificial Sequence
  Description of Artificial Sequence: Synthetic oligonucleotide
  Target: ATXN1; (+) strand; PAM type: NRG; PAM sequence: AAG
ttaccagagtctgcctggta

SEQ ID NO: 111141 - DNA, 20 bp, Artificial Sequence
  Description of Artificial Sequence: Synthetic oligonucleotide
  Target: ATXN1; (+) strand; PAM type: NRG; PAM sequence: CAG
gcctggtaaagtctttcctc

SEQ ID NO: 111142 - DNA, 20 bp, Artificial Sequence
  Description of Artificial Sequence: Synthetic oligonucleotide
  Target: ATXN1; (+) strand; PAM type: NRG; PAM sequence: AAG
gtaaagtctttcctccagtt

SEQ ID NO: 111143 - DNA, 20 bp, Artificial Sequence
  Description of Artificial Sequence: Synthetic oligonucleotide
  Target: ATXN1; (+) strand; PAM type: NRG; PAM sequence: AGG
taaagtctttcctccagtta

SEQ ID NO: 111144 - DNA, 20 bp, Artificial Sequence
  Description of Artificial Sequence: Synthetic oligonucleotide
  Target: ATXN1; (+) strand; PAM type: NRG; PAM sequence: TGG
tttcctccagttaaggtccc

SEQ ID NO: 111145 - DNA, 20 bp, Artificial Sequence
  Description of Artificial Sequence: Synthetic oligonucleotide
  Target: ATXN1; (+) strand; PAM type: NRG; PAM sequence: GGG
ttcctccagttaaggtccct

SEQ ID NO: 111146 - DNA, 20 bp, Artificial Sequence
  Description of Artificial Sequence: Synthetic oligonucleotide
  Target: ATXN1; (+) strand; PAM type: NRG; PAM sequence: AAG
aaggtccctgggttgtattc

SEQ ID NO: 111147 - DNA, 20 bp, Artificial Sequence
  Description of Artificial Sequence: Synthetic oligonucleotide
  Target: ATXN1; (+) strand; PAM type: NRG; PAM sequence: CAG
ggttgtattcaagctgtccc

SEQ ID NO: 111148 - DNA, 20 bp, Artificial Sequence
  Description of Artificial Sequence: Synthetic oligonucleotide
  Target: ATXN1; (+) strand; PAM type: NRG; PAM sequence: TAG
gcacacacactccacgttgt

SEQ ID NO: 111149 - DNA, 20 bp, Artificial Sequence
  Description of Artificial Sequence: Synthetic oligonucleotide
  Target: ATXN1; (+) strand; PAM type: NRG; PAM sequence: TGG
actccacgttgttagttttc

SEQ ID NO: 111150 - DNA, 20 bp, Artificial Sequence
  Description of Artificial Sequence: Synthetic oligonucleotide
  Target: ATXN1; (+) strand; PAM type: NRG; PAM sequence: GGG
ctccacgttgttagttttct

SEQ ID NO: 111151 - DNA, 20 bp, Artificial Sequence
  Description of Artificial Sequence: Synthetic oligonucleotide
  Target: ATXN1; (+) strand; PAM type: NRG; PAM sequence: TAG
aaatgtcactgttccctctt

SEQ ID NO: 111152 - DNA, 20 bp, Artificial Sequence
  Description of Artificial Sequence: Synthetic oligonucleotide
  Target: ATXN1; (+) strand; PAM type: NRG; PAM sequence: TGG
tgtcactgttccctctttag

SEQ ID NO: 111153 - DNA, 20 bp, Artificial Sequence
  Description of Artificial Sequence: Synthetic oligonucleotide
  Target: ATXN1; (+) strand; PAM type: NRG; PAM sequence: CGG
actgttccctctttagtggc

SEQ ID NO: 111154 - DNA, 20 bp, Artificial Sequence
  Description of Artificial Sequence: Synthetic oligonucleotide
  Target: ATXN1; (+) strand; PAM type: NRG; PAM sequence: CAG
cctctttagtggccggatct

SEQ ID NO: 111155 - DNA, 20 bp, Artificial Sequence
  Description of Artificial Sequence: Synthetic oligonucleotide
  Target: ATXN1; (+) strand; PAM type: NRG; PAM sequence: TGG
ttagtggccggatctcagcc

SEQ ID NO: 111156 - DNA, 20 bp, Artificial Sequence
  Description of Artificial Sequence: Synthetic oligonucleotide
  Target: ATXN1; (+) strand; PAM type: NRG; PAM sequence: GGG
tagtggccggatctcagcct

SEQ ID NO: 111157 - DNA, 20 bp, Artificial Sequence
  Description of Artificial Sequence: Synthetic oligonucleotide
  Target: ATXN1; (+) strand; PAM type: NRG; PAM sequence: GAG
gtggccggatctcagcctgg

SEQ ID NO: 111158 - DNA, 20 bp, Artificial Sequence
  Description of Artificial Sequence: Synthetic oligonucleotide
  Target: ATXN1; (+) strand; PAM type: NRG; PAM sequence: GAG
ctcagcctgggagtccgact

SEQ ID NO: 111159 - DNA, 20 bp, Artificial Sequence
  Description of Artificial Sequence: Synthetic oligonucleotide
  Target: ATXN1; (+) strand; PAM type: NRG; PAM sequence: GAG
cagcctgggagtccgactga

SEQ ID NO: 111160 - DNA, 20 bp, Artificial Sequence
  Description of Artificial Sequence: Synthetic oligonucleotide
  Target: ATXN1; (+) strand; PAM type: NRG; PAM sequence: AAG
ctgggagtccgactgagagc

SEQ ID NO: 111161 - DNA, 20 bp, Artificial Sequence
  Description of Artificial Sequence: Synthetic oligonucleotide
  Target: ATXN1; (+) strand; PAM type: NRG; PAM sequence: AGG
tgggagtccgactgagagca

SEQ ID NO: 111162 - DNA, 20 bp, Artificial Sequence
  Description of Artificial Sequence: Synthetic oligonucleotide
  Target: ATXN1; (+) strand; PAM type: NRG; PAM sequence: GGG
gggagtccgactgagagcaa

SEQ ID NO: 111163 - DNA, 20 bp, Artificial Sequence
  Description of Artificial Sequence: Synthetic oligonucleotide
  Target: ATXN1; (+) strand; PAM type: NRG; PAM sequence: GGG
ggagtccgactgagagcaag

SEQ ID NO: 111164 - DNA, 20 bp, Artificial Sequence
  Description of Artificial Sequence: Synthetic oligonucleotide
  Target: ATXN1; (+) strand; PAM type: NRG; PAM sequence: CGG
gactgagagcaaggggctgt

SEQ ID NO: 111165 - DNA, 20 bp, Artificial Sequence
  Description of Artificial Sequence: Synthetic oligonucleotide
  Target: ATXN1; (+) strand; PAM type: NRG; PAM sequence: CAG
agagcaaggggctgtcggta

SEQ ID NO: 111166 - DNA, 20 bp, Artificial Sequence
  Description of Artificial Sequence: Synthetic oligonucleotide
  Target: ATXN1; (+) strand; PAM type: NRG; PAM sequence: TGG
aaggggctgtcggtacagcc

SEQ ID NO: 111167 - DNA, 20 bp, Artificial Sequence
  Description of Artificial Sequence: Synthetic oligonucleotide
  Target: ATXN1; (+) strand; PAM type: NRG; PAM sequence: GGG
aggggctgtcggtacagcct

SEQ ID NO: 111168 - DNA, 20 bp, Artificial Sequence
  Description of Artificial Sequence: Synthetic oligonucleotide
  Target: ATXN1; (+) strand; PAM type: NRG; PAM sequence: GGG
ggggctgtcggtacagcctg

SEQ ID NO: 111169 - DNA, 20 bp, Artificial Sequence
  Description of Artificial Sequence: Synthetic oligonucleotide
  Target: ATXN1; (+) strand; PAM type: NRG; PAM sequence: GAG
ggctgtcggtacagcctggg

SEQ ID NO: 111170 - DNA, 20 bp, Artificial Sequence
  Description of Artificial Sequence: Synthetic oligonucleotide
  Target: ATXN1; (+) strand; PAM type: NRG; PAM sequence: GAG
ctgtcggtacagcctgggga

SEQ ID NO: 111171 - DNA, 20 bp, Artificial Sequence
  Description of Artificial Sequence: Synthetic oligonucleotide
  Target: ATXN1; (+) strand; PAM type: NRG; PAM sequence: AGG
tgtcggtacagcctggggag

SEQ ID NO: 111172 - DNA, 20 bp, Artificial Sequence
  Description of Artificial Sequence: Synthetic oligonucleotide
  Target: ATXN1; (+) strand; PAM type: NRG; PAM sequence: GGG
gtcggtacagcctggggaga

SEQ ID NO: 111173 - DNA, 20 bp, Artificial Sequence
  Description of Artificial Sequence: Synthetic oligonucleotide
  Target: ATXN1; (+) strand; PAM type: NRG; PAM sequence: CAG
gtcccacccccacctcacac

SEQ ID NO: 111174 - DNA, 20 bp, Artificial Sequence
  Description of Artificial Sequence: Synthetic oligonucleotide
  Target: ATXN1; (+) strand; PAM type: NRG; PAM sequence: TAG
cgtctccactcacctgtttc

SEQ ID NO: 111175 - DNA, 20 bp, Artificial Sequence
  Description of Artificial Sequence: Synthetic oligonucleotide
  Target: ATXN1; (+) strand; PAM type: NRG; PAM sequence: TGG
ccactcacctgtttctagcc

SEQ ID NO: 111176 - DNA, 20 bp, Artificial Sequence
  Description of Artificial Sequence: Synthetic oligonucleotide
  Target: ATXN1; (+) strand; PAM type: NRG; PAM sequence: GGG
cactcacctgtttctagcct

SEQ ID NO: 111177 - DNA, 20 bp, Artificial Sequence
  Description of Artificial Sequence: Synthetic oligonucleotide
  Target: ATXN1; (+) strand; PAM type: NRG; PAM sequence: CAG
ggaaactttcttccttcatt

SEQ ID NO: 111178 - DNA, 20 bp, Artificial Sequence
  Description of Artificial Sequence: Synthetic oligonucleotide
  Target: ATXN1; (+) strand; PAM type: NRG; PAM sequence: TGG
aaaacattaatgctactgtg

SEQ ID NO: 111179 - DNA, 20 bp, Artificial Sequence
  Description of Artificial Sequence: Synthetic oligonucleotide
  Target: ATXN1; (+) strand; PAM type: NRG; PAM sequence: GGG
aaacattaatgctactgtgt

SEQ ID NO: 111180 - DNA, 20 bp, Artificial Sequence
  Description of Artificial Sequence: Synthetic oligonucleotide
  Target: ATXN1; (+) strand; PAM type: NRG; PAM sequence: GGG
aacattaatgctactgtgtg

SEQ ID NO: 111181 - DNA, 20 bp, Artificial Sequence
  Description of Artificial Sequence: Synthetic oligonucleotide
  Target: ATXN1; (+) strand; PAM type: NRG; PAM sequence: TGG
taatgctactgtgtggggct

SEQ ID NO: 111182 - DNA, 20 bp, Artificial Sequence
  Description of Artificial Sequence: Synthetic oligonucleotide
  Target: ATXN1; (+) strand; PAM type: NRG; PAM sequence: AAG
tgctactgtgtggggcttgg

SEQ ID NO: 111183 - DNA, 20 bp, Artificial Sequence
  Description of Artificial Sequence: Synthetic oligonucleotide
  Target: ATXN1; (+) strand; PAM type: NRG; PAM sequence: TGG
gtggggcttggaagatgtcc

SEQ ID NO: 111184 - DNA, 20 bp, Artificial Sequence
  Description of Artificial Sequence: Synthetic oligonucleotide
  Target: ATXN1; (+) strand; PAM type: NRG; PAM sequence: TGG
ttggaagatgtcctggtgtt

SEQ ID NO: 111185 - DNA, 20 bp, Artificial Sequence
  Description of Artificial Sequence: Synthetic oligonucleotide
  Target: ATXN1; (+) strand; PAM type: NRG; PAM sequence: GGG
tggaagatgtcctggtgttt

SEQ ID NO: 111186 - DNA, 20 bp, Artificial Sequence
  Description of Artificial Sequence: Synthetic oligonucleotide
  Target: ATXN1; (+) strand; PAM type: NRG; PAM sequence: CAG
ctggtgtttgggtactttct

SEQ ID NO: 111187 - DNA, 20 bp, Artificial Sequence
  Description of Artificial Sequence: Synthetic oligonucleotide
  Target: ATXN1; (+) strand; PAM type: NRG; PAM sequence: AAG
gtgtttgggtactttctcag

SEQ ID NO: 111188 - DNA, 20 bp, Artificial Sequence
  Description of Artificial Sequence: Synthetic oligonucleotide
  Target: ATXN1; (+) strand; PAM type: NRG; PAM sequence: AAG
ttgggtactttctcagaagc

SEQ ID NO: 111189 - DNA, 20 bp, Artificial Sequence
  Description of Artificial Sequence: Synthetic oligonucleotide
  Target: ATXN1; (+) strand; PAM type: NRG; PAM sequence: TGG
agaagcaagactttctcatt

SEQ ID NO: 111190 - DNA, 20 bp, Artificial Sequence
  Description of Artificial Sequence: Synthetic oligonucleotide
  Target: ATXN1; (+) strand; PAM type: NRG; PAM sequence: GGG
gaagcaagactttctcattt

SEQ ID NO: 111191 - DNA, 20 bp, Artificial Sequence
  Description of Artificial Sequence: Synthetic oligonucleotide
  Target: ATXN1; (+) strand; PAM type: NRG; PAM sequence: CAG
ctctgaatatcaaatgtgac

SEQ ID NO: 111192 - DNA, 20 bp, Artificial Sequence
  Description of Artificial Sequence: Synthetic oligonucleotide
  Target: ATXN1; (+) strand; PAM type: NRG; PAM sequence: AAG
atcaaatgtgaccagccaac

SEQ ID NO: 111193 - DNA, 20 bp, Artificial Sequence
  Description of Artificial Sequence: Synthetic oligonucleotide
  Target: ATXN1; (+) strand; PAM type: NRG; PAM sequence: CAG
gccaacaagtatgtacattt

SEQ ID NO: 111194 - DNA, 20 bp, Artificial Sequence
  Description of Artificial Sequence: Synthetic oligonucleotide
  Target: ATXN1; (+) strand; PAM type: NRG; PAM sequence: TGG
ttcagtccctcaccttttcc

SEQ ID NO: 111195 - DNA, 20 bp, Artificial Sequence
  Description of Artificial Sequence: Synthetic oligonucleotide
  Target: ATXN1; (+) strand; PAM type: NRG; PAM sequence: GAG
cagtccctcaccttttcctg

SEQ ID NO: 111196 - DNA, 20 bp, Artificial Sequence
  Description of Artificial Sequence: Synthetic oligonucleotide
  Target: ATXN1; (+) strand; PAM type: NRG; PAM sequence: TAG
cctcaccttttcctggagaa

SEQ ID NO: 111197 - DNA, 20 bp, Artificial Sequence
  Description of Artificial Sequence: Synthetic oligonucleotide
  Target: ATXN1; (+) strand; PAM type: NRG; PAM sequence: GAG
tcaccttttcctggagaata

SEQ ID NO: 111198 - DNA, 20 bp, Artificial Sequence
  Description of Artificial Sequence: Synthetic oligonucleotide
  Target: ATXN1; (+) strand; PAM type: NRG; PAM sequence: AAG
tagagtttgatatgaacatt

SEQ ID NO: 111199 - DNA, 20 bp, Artificial Sequence
  Description of Artificial Sequence: Synthetic oligonucleotide
  Target: ATXN1; (+) strand; PAM type: NRG; PAM sequence: TGG
agtttgatatgaacattaag

SEQ ID NO: 111200 - DNA, 20 bp, Artificial Sequence
  Description of Artificial Sequence: Synthetic oligonucleotide
  Target: ATXN1; (+) strand; PAM type: NRG; PAM sequence: CAG
aacattaagtggatttacat

SEQ ID NO: 111201 - DNA, 20 bp, Artificial Sequence
  Description of Artificial Sequence: Synthetic oligonucleotide
  Target: ATXN1; (+) strand; PAM type: NRG; PAM sequence: CAG
ggatttacatcagtgctcct

SEQ ID NO: 111202 - DNA, 20 bp, Artificial Sequence
  Description of Artificial Sequence: Synthetic oligonucleotide
  Target: ATXN1; (+) strand; PAM type: NRG; PAM sequence: CAG
gtgctcctcagcacacacga

SEQ ID NO: 111203 - DNA, 20 bp, Artificial Sequence
  Description of Artificial Sequence: Synthetic oligonucleotide
  Target: ATXN1; (+) strand; PAM type: NRG; PAM sequence: TGG
gacagaaaatatatctgctc

SEQ ID NO: 111204 - DNA, 20 bp, Artificial Sequence
  Description of Artificial Sequence: Synthetic oligonucleotide
  Target: ATXN1; (+) strand; PAM type: NRG; PAM sequence: AAG
tatatctgctctggactaat

SEQ ID NO: 111205 - DNA, 20 bp, Artificial Sequence
  Description of Artificial Sequence: Synthetic oligonucleotide
  Target: ATXN1; (+) strand; PAM type: NRG; PAM sequence: CAG
ctggactaataagtatatca

SEQ ID NO: 111206 - DNA, 20 bp, Artificial Sequence
  Description of Artificial Sequence: Synthetic oligonucleotide
  Target: ATXN1; (+) strand; PAM type: NRG; PAM sequence: AGG
tggactaataagtatatcac

SEQ ID NO: 111207 - DNA, 20 bp, Artificial Sequence
  Description of Artificial Sequence: Synthetic oligonucleotide
  Target: ATXN1; (+) strand; PAM type: NRG; PAM sequence: TAG
cacaggcacaaacaactctg

SEQ ID NO: 111208 - DNA, 20 bp, Artificial Sequence
  Description of Artificial Sequence: Synthetic oligonucleotide
  Target: ATXN1; (+) strand; PAM type: NRG; PAM sequence: AAG
ctgtagccaacttttgatta

SEQ ID NO: 111209 - DNA, 20 bp, Artificial Sequence
  Description of Artificial Sequence: Synthetic oligonucleotide
  Target: ATXN1; (+) strand; PAM type: NRG; PAM sequence: CAG
ccaacttttgattaaagaca

SEQ ID NO: 111210 - DNA, 20 bp, Artificial Sequence
  Description of Artificial Sequence: Synthetic oligonucleotide
  Target: ATXN1; (+) strand; PAM type: NRG; PAM sequence: AAG
aagacacagtctctaccatt

SEQ ID NO: 111211 - DNA, 20 bp, Artificial Sequence
  Description of Artificial Sequence: Synthetic oligonucleotide
  Target: ATXN1; (+) strand; PAM type: NRG; PAM sequence: AGG
agacacagtctctaccatta

SEQ ID NO: 111212 - DNA, 20 bp, Artificial Sequence
  Description of Artificial Sequence: Synthetic oligonucleotide
  Target: ATXN1; (+) strand; PAM type: NRG; PAM sequence: GAG
acacagtctctaccattaag

SEQ ID NO: 111213 - DNA, 20 bp, Artificial Sequence
  Description of Artificial Sequence: Synthetic oligonucleotide
  Target: ATXN1; (+) strand; PAM type: NRG; PAM sequence: CAG
cagtctctaccattaaggag

SEQ ID NO: 111214 - DNA, 20 bp, Artificial Sequence
  Description of Artificial Sequence: Synthetic oligonucleotide
  Target: ATXN1; (+) strand; PAM type: NRG; PAM sequence: AAG
catctatatcacaccaataa

SEQ ID NO: 111215 - DNA, 20 bp, Artificial Sequence
  Description of Artificial Sequence: Synthetic oligonucleotide
  Target: ATXN1; (+) strand; PAM type: NRG; PAM sequence: AAG
atatcacaccaataaaagcc

SEQ ID NO: 111216 - DNA, 20 bp, Artificial Sequence
  Description of Artificial Sequence: Synthetic oligonucleotide
  Target: ATXN1; (+) strand; PAM type: NRG; PAM sequence: GAG
atcacaccaataaaagccaa

SEQ ID NO: 111217 - DNA, 20 bp, Artificial Sequence
  Description of Artificial Sequence: Synthetic oligonucleotide
  Target: ATXN1; (+) strand; PAM type: NRG; PAM sequence: TAG
ccaataaaagccaagagtcc

SEQ ID NO: 111218 - DNA, 20 bp, Artificial Sequence
  Description of Artificial Sequence: Synthetic oligonucleotide
  Target: ATXN1; (+) strand; PAM type: NRG; PAM sequence: CAG
ataaaagccaagagtcctag

SEQ ID NO: 111219 - DNA, 20 bp, Artificial Sequence
  Description of Artificial Sequence: Synthetic oligonucleotide
  Target: ATXN1; (+) strand; PAM type: NRG; PAM sequence: TAG
gtttgctacaaacgactacg

SEQ ID NO: 111220 - DNA, 20 bp, Artificial Sequence
  Description of Artificial Sequence: Synthetic oligonucleotide
  Target: ATXN1; (+) strand; PAM type: NRG; PAM sequence: GAG
gctacaaacgactacgtagt

SEQ ID NO: 111221 - DNA, 20 bp, Artificial Sequence
  Description of Artificial Sequence: Synthetic oligonucleotide
  Target: ATXN1; (+) strand; PAM type: NRG; PAM sequence: GAG
tacaaacgactacgtagtga

SEQ ID NO: 111222 - DNA, 20 bp, Artificial Sequence
  Description of Artificial Sequence: Synthetic oligonucleotide
  Target: ATXN1; (+) strand; PAM type: NRG; PAM sequence: TAG
aacgactacgtagtgagagt

SEQ ID NO: 111223 - DNA, 20 bp, Artificial Sequence
  Description of Artificial Sequence: Synthetic oligonucleotide
  Target: ATXN1; (+) strand; PAM type: NRG; PAM sequence: AGG
acgactacgtagtgagagtt

SEQ ID NO: 111224 - DNA, 20 bp, Artificial Sequence
  Description of Artificial Sequence: Synthetic oligonucleotide
  Target: ATXN1; (+) strand; PAM type: NRG; PAM sequence: TGG
gtgagagttaggaactattc

SEQ ID NO: 111225 - DNA, 20 bp, Artificial Sequence
  Description of Artificial Sequence: Synthetic oligonucleotide
  Target: ATXN1; (+) strand; PAM type: NRG; PAM sequence: AAG
ggattctgtattttatccta

SEQ ID NO: 111226 - DNA, 20 bp, Artificial Sequence
  Description of Artificial Sequence: Synthetic oligonucleotide
  Target: ATXN1; (+) strand; PAM type: NRG; PAM sequence: CAG
agacctttatttaaattttc

SEQ ID NO: 111227 - DNA, 20 bp, Artificial Sequence
  Description of Artificial Sequence: Synthetic oligonucleotide
  Target: ATXN1; (+) strand; PAM type: NRG; PAM sequence: CAG
tatctccttcccattccact

SEQ ID NO: 111228 - DNA, 20 bp, Artificial Sequence
  Description of Artificial Sequence: Synthetic oligonucleotide
  Target: ATXN1; (+) strand; PAM type: NRG; PAM sequence: AAG
catttgacattgcttccccc

SEQ ID NO: 111229 - DNA, 20 bp, Artificial Sequence
  Description of Artificial Sequence: Synthetic oligonucleotide
  Target: ATXN1; (+) strand; PAM type: NRG; PAM sequence: TGG
ctgtgatgtcatgcaccttg

SEQ ID NO: 111230 - DNA, 20 bp, Artificial Sequence
  Description of Artificial Sequence: Synthetic oligonucleotide
  Target: ATXN1; (+) strand; PAM type: NRG; PAM sequence: TGG
gatgtcatgcaccttgtgga

SEQ ID NO: 111231 - DNA, 20 bp, Artificial Sequence
  Description of Artificial Sequence: Synthetic oligonucleotide
  Target: ATXN1; (+) strand; PAM type: NRG; PAM sequence: CAG
gctataattcaaaatgctct

SEQ ID NO: 111232 - DNA, 20 bp, Artificial Sequence
  Description of Artificial Sequence: Synthetic oligonucleotide
  Target: ATXN1; (+) strand; PAM type: NRG; PAM sequence: AGG
ctataattcaaaatgctctc

SEQ ID NO: 111233 - DNA, 20 bp, Artificial Sequence
  Description of Artificial Sequence: Synthetic oligonucleotide
  Target: ATXN1; (+) strand; PAM type: NRG; PAM sequence: GGG
tataattcaaaatgctctca

SEQ ID NO: 111234 - DNA, 20 bp, Artificial Sequence
  Description of Artificial Sequence: Synthetic oligonucleotide
  Target: ATXN1; (+) strand; PAM type: NRG; PAM sequence: GAG
taattcaaaatgctctcagg

SEQ ID NO: 111235 - DNA, 20 bp, Artificial Sequence
  Description of Artificial Sequence: Synthetic oligonucleotide
  Target: ATXN1; (+) strand; PAM type: NRG; PAM sequence: TGG
tcaaaatgctctcagggagc

SEQ ID NO: 111236 - DNA, 20 bp, Artificial Sequence
  Description of Artificial Sequence: Synthetic oligonucleotide
  Target: ATXN1; (+) strand; PAM type: NRG; PAM sequence: GGG
caaaatgctctcagggagct

SEQ ID NO: 111237 - DNA, 20 bp, Artificial Sequence
  Description of Artificial Sequence: Synthetic oligonucleotide
  Target: ATXN1; (+) strand; PAM type: NRG; PAM sequence: GAG
aaatgctctcagggagctgg

SEQ ID NO: 111238 - DNA, 20 bp, Artificial Sequence
  Description of Artificial Sequence: Synthetic oligonucleotide
  Target: ATXN1; (+) strand; PAM type: NRG; PAM sequence: AAG
ctctcagggagctgggagca

SEQ ID NO: 111239 - DNA, 20 bp, Artificial Sequence
  Description of Artificial Sequence: Synthetic oligonucleotide
  Target: ATXN1; (+) strand; PAM type: NRG; PAM sequence: GAG
ctcagggagctgggagcaaa

SEQ ID NO: 111240 - DNA, 20 bp, Artificial Sequence
  Description of Artificial Sequence: Synthetic oligonucleotide
  Target: ATXN1; (+) strand; PAM type: NRG; PAM sequence: TGG
ggagcaaagagaaaacacat

SEQ ID NO: 111241 - DNA, 20 bp, Artificial Sequence
  Description of Artificial Sequence: Synthetic oligonucleotide
  Target: ATXN1; (+) strand; PAM type: NRG; PAM sequence: CAG
gagaaaacacattggtgatg

SEQ ID NO: 111242 - DNA, 20 bp, Artificial Sequence
  Description of Artificial Sequence: Synthetic oligonucleotide
  Target: ATXN1; (+) strand; PAM type: NRG; PAM sequence: AGG
agaaaacacattggtgatgc

SEQ ID NO: 111243 - DNA, 20 bp, Artificial Sequence
  Description of Artificial Sequence: Synthetic oligonucleotide
  Target: ATXN1; (+) strand; PAM type: NRG; PAM sequence: AAG
aaacacattggtgatgcagg

SEQ ID NO: 111244 - DNA, 20 bp, Artificial Sequence
  Description of Artificial Sequence: Synthetic oligonucleotide
  Target: ATXN1; (+) strand; PAM type: NRG; PAM sequence: AAG
aataaaacaatctgtttgaa

SEQ ID NO: 111245 - DNA, 20 bp, Artificial Sequence
  Description of Artificial Sequence: Synthetic oligonucleotide
  Target: ATXN1; (+) strand; PAM type: NRG; PAM sequence: CAG
aacaatctgtttgaaaagca

SEQ ID NO: 111246 - DNA, 20 bp, Artificial Sequence
  Description of Artificial Sequence: Synthetic oligonucleotide
  Target: ATXN1; (+) strand; PAM type: NRG; PAM sequence: AGG
acaatctgtttgaaaagcac

SEQ ID NO: 111247 - DNA, 20 bp, Artificial Sequence
  Description of Artificial Sequence: Synthetic oligonucleotide
  Target: ATXN1; (+) strand; PAM type: NRG; PAM sequence: TAG
gcacaggtttcataaaatgt

SEQ ID NO: 111248 - DNA, 20 bp, Artificial Sequence
  Description of Artificial Sequence: Synthetic oligonucleotide
  Target: ATXN1; (+) strand; PAM type: NRG; PAM sequence: TGG
gtttcataaaatgttagcgc

SEQ ID NO: 111249 - DNA, 20 bp, Artificial Sequence
  Description of Artificial Sequence: Synthetic oligonucleotide
  Target: ATXN1; (+) strand; PAM type: NRG; PAM sequence: TGG
ataaaatgttagcgctggaa

SEQ ID NO: 111250 - DNA, 20 bp, Artificial Sequence
  Description of Artificial Sequence: Synthetic oligonucleotide
  Target: ATXN1; (+) strand; PAM type: NRG; PAM sequence: AAG
aaatgttagcgctggaatgg

SEQ ID NO: 111251 - DNA, 20 bp, Artificial Sequence
  Description of Artificial Sequence: Synthetic oligonucleotide
  Target: ATXN1; (+) strand; PAM type: NRG; PAM sequence: CAG
cgctggaatggaagcgattt

SEQ ID NO: 111252 - DNA, 20 bp, Artificial Sequence
  Description of Artificial Sequence: Synthetic oligonucleotide
  Target: ATXN1; (+) strand; PAM type: NRG; PAM sequence: GAG
ctggaatggaagcgatttca

SEQ ID NO: 111253 - DNA, 20 bp, Artificial Sequence
  Description of Artificial Sequence: Synthetic oligonucleotide
  Target: ATXN1; (+) strand; PAM type: NRG; PAM sequence: AAG
tttcagagatgaactcttgc

SEQ ID NO: 111254 - DNA, 20 bp, Artificial Sequence
  Description of Artificial Sequence: Synthetic oligonucleotide
  Target: ATXN1; (+) strand; PAM type: NRG; PAM sequence: TGG
atgaactcttgcaagcactc

SEQ ID NO: 111255 - DNA, 20 bp, Artificial Sequence
  Description of Artificial Sequence: Synthetic oligonucleotide
  Target: ATXN1; (+) strand; PAM type: NRG; PAM sequence: CGG
aactcttgcaagcactctgg

SEQ ID NO: 111256 - DNA, 20 bp, Artificial Sequence
  Description of Artificial Sequence: Synthetic oligonucleotide
  Target: ATXN1; (+) strand; PAM type: NRG; PAM sequence: AAG
tgcaagcactctggcggccg

SEQ ID NO: 111257 - DNA, 20 bp, Artificial Sequence
  Description of Artificial Sequence: Synthetic oligonucleotide
  Target: ATXN1; (+) strand; PAM type: NRG; PAM sequence: TGG
ggccgaagcatccaaattcc

SEQ ID NO: 111258 - DNA, 20 bp, Artificial Sequence
  Description of Artificial Sequence: Synthetic oligonucleotide
  Target: ATXN1; (+) strand; PAM type: NRG; PAM sequence: TGG
atccaaattcctggttgctg

SEQ ID NO: 111259 - DNA, 20 bp, Artificial Sequence
  Description of Artificial Sequence: Synthetic oligonucleotide
  Target: ATXN1; (+) strand; PAM type: NRG; PAM sequence: TGG
aaattcctggttgctgtggt

SEQ ID NO: 111260 - DNA, 20 bp, Artificial Sequence
  Description of Artificial Sequence: Synthetic oligonucleotide
  Target: ATXN1; (+) strand; PAM type: NRG; PAM sequence: TGG
tcctggttgctgtggttggc

SEQ ID NO: 111261 - DNA, 20 bp, Artificial Sequence
  Description of Artificial Sequence: Synthetic oligonucleotide
  Target: ATXN1; (+) strand; PAM type: NRG; PAM sequence: GAG
ctggttgctgtggttggctg

SEQ ID NO: 111262 - DNA, 20 bp, Artificial Sequence
  Description of Artificial Sequence: Synthetic oligonucleotide
  Target: ATXN1; (+) strand; PAM type: NRG; PAM sequence: AGG
tggttgctgtggttggctgg

SEQ ID NO: 111263 - DNA, 20 bp, Artificial Sequence
  Description of Artificial Sequence: Synthetic oligonucleotide
  Target: ATXN1; (+) strand; PAM type: NRG; PAM sequence: GAG
gttgctgtggttggctggag

SEQ ID NO: 111264 - DNA, 20 bp, Artificial Sequence
  Description of Artificial Sequence: Synthetic oligonucleotide
  Target: ATXN1; (+) strand; PAM type: NRG; PAM sequence: TAG
cctgcctttgactcttatca

SEQ ID NO: 111265 - DNA, 20 bp, Artificial Sequence
  Description of Artificial Sequence: Synthetic oligonucleotide
  Target: ATXN1; (+) strand; PAM type: NRG; PAM sequence: CAG
ctcttatcatagactgcttg

SEQ ID NO: 111266 - DNA, 20 bp, Artificial Sequence
  Description of Artificial Sequence: Synthetic oligonucleotide
  Target: ATXN1; (+) strand; PAM type: NRG; PAM sequence: TGG
cttgcagctcatcctgtcct

SEQ ID NO: 111267 - DNA, 20 bp, Artificial Sequence
  Description of Artificial Sequence: Synthetic oligonucleotide
  Target: ATXN1; (+) strand; PAM type: NRG; PAM sequence: AAG
atttgtgcataccatgtgcg

SEQ ID NO: 111268 - DNA, 20 bp, Artificial Sequence
  Description of Artificial Sequence: Synthetic oligonucleotide
  Target: ATXN1; (+) strand; PAM type: NRG; PAM sequence: CAG
gtcctttacgctcatgaaat

SEQ ID NO: 111269 - DNA, 20 bp, Artificial Sequence
  Description of Artificial Sequence: Synthetic oligonucleotide
  Target: ATXN1; (+) strand; PAM type: NRG; PAM sequence: CAG
acgctcatgaaatcagtgct

SEQ ID NO: 111270 - DNA, 20 bp, Artificial Sequence
  Description of Artificial Sequence: Synthetic oligonucleotide
  Target: ATXN1; (+) strand; PAM type: NRG; PAM sequence: AAG
atgaaatcagtgctcagctg

SEQ ID NO: 111271 - DNA, 20 bp, Artificial Sequence
  Description of Artificial Sequence: Synthetic oligonucleotide
  Target: ATXN1; (+) strand; PAM type: NRG; PAM sequence: TGG
gctgaagacattaaatttac

SEQ ID NO: 111272 - DNA, 20 bp, Artificial Sequence
  Description of Artificial Sequence: Synthetic oligonucleotide
  Target: ATXN1; (+) strand; PAM type: NRG; PAM sequence: CGG
gaagacattaaatttactgg

SEQ ID NO: 111273 - DNA, 20 bp, Artificial Sequence
  Description of Artificial Sequence: Synthetic oligonucleotide
  Target: ATXN1; (+) strand; PAM type: NRG; PAM sequence: AAG
attaaatttactggcggtga

SEQ ID NO: 111274 - DNA, 20 bp, Artificial Sequence
  Description of Artificial Sequence: Synthetic oligonucleotide
  Target: ATXN1; (+) strand; PAM type: NRG; PAM sequence: AAG
atttactggcggtgaaagaa

SEQ ID NO: 111275 - DNA, 20 bp, Artificial Sequence
  Description of Artificial Sequence: Synthetic oligonucleotide
  Target: ATXN1; (+) strand; PAM type: NRG; PAM sequence: CGG
actggcggtgaaagaaaagt

SEQ ID NO: 111276 - DNA, 20 bp, Artificial Sequence
  Description of Artificial Sequence: Synthetic oligonucleotide
  Target: ATXN1; (+) strand; PAM type: NRG; PAM sequence: GGG
ctggcggtgaaagaaaagtc

SEQ ID NO: 111277 - DNA, 20 bp, Artificial Sequence
  Description of Artificial Sequence: Synthetic oligonucleotide
  Target: ATXN1; (+) strand; PAM type: NRG; PAM sequence: TGG
gtgaaagaaaagtcgggaaa

SEQ ID NO: 111278 - DNA, 20 bp, Artificial Sequence
  Description of Artificial Sequence: Synthetic oligonucleotide
  Target: ATXN1; (+) strand; PAM type: NRG; PAM sequence: AAG
aagaaaagtcgggaaatgga

SEQ ID NO: 111279 - DNA, 20 bp, Artificial Sequence
  Description of Artificial Sequence: Synthetic oligonucleotide
  Target: ATXN1; (+) strand; PAM type: NRG; PAM sequence: GAG
gaaaagtcgggaaatggaaa

SEQ ID NO: 111280 - DNA, 20 bp, Artificial Sequence
  Description of Artificial Sequence: Synthetic oligonucleotide
  Target: ATXN1; (+) strand; PAM type: NRG; PAM sequence: AGG
aaaagtcgggaaatggaaag

SEQ ID NO: 111281 - DNA, 20 bp, Artificial Sequence
  Description of Artificial Sequence: Synthetic oligonucleotide
  Target: ATXN1; (+) strand; PAM type: NRG; PAM sequence: TGG
cgggaaatggaaagaggtgc

SEQ ID NO: 111282 - DNA, 20 bp, Artificial Sequence
  Description of Artificial Sequence: Synthetic oligonucleotide
  Target: ATXN1; (+) strand; PAM type: NRG; PAM sequence: CGG
aatggaaagaggtgctggaa

SEQ ID NO: 111283 - DNA, 20 bp, Artificial Sequence
  Description of Artificial Sequence: Synthetic oligonucleotide
  Target: ATXN1; (+) strand; PAM type: NRG; PAM sequence: GGG
atggaaagaggtgctggaac

SEQ ID NO: 111284 - DNA, 20 bp, Artificial Sequence
  Description of Artificial Sequence: Synthetic oligonucleotide
  Target: ATXN1; (+) strand; PAM type: NRG; PAM sequence: GGG
tggaaagaggtgctggaacg

SEQ ID NO: 111285 - DNA, 20 bp, Artificial Sequence
  Description of Artificial Sequence: Synthetic oligonucleotide
  Target: ATXN1; (+) strand; PAM type: NRG; PAM sequence: GGG
ggaaagaggtgctggaacgg

SEQ ID NO: 111286 - DNA, 20 bp, Artificial Sequence
  Description of Artificial Sequence: Synthetic oligonucleotide
  Target: ATXN1; (+) strand; PAM type: NRG; PAM sequence: TGG
agaggtgctggaacgggggc

SEQ ID NO: 111287 - DNA, 20 bp, Artificial Sequence
  Description of Artificial Sequence: Synthetic oligonucleotide
  Target: ATXN1; (+) strand; PAM type: NRG; PAM sequence: GGG
gaggtgctggaacgggggct

SEQ ID NO: 111288 - DNA, 20 bp, Artificial Sequence
  Description of Artificial Sequence: Synthetic oligonucleotide
  Target: ATXN1; (+) strand; PAM type: NRG; PAM sequence: AAG
gtgctggaacgggggctggg

SEQ ID NO: 111289 - DNA, 20 bp, Artificial Sequence
  Description of Artificial Sequence: Synthetic oligonucleotide
  Target: ATXN1; (+) strand; PAM type: NRG; PAM sequence: AGG
tgctggaacgggggctggga

SEQ ID NO: 111290 - DNA, 20 bp, Artificial Sequence
  Description of Artificial Sequence: Synthetic oligonucleotide
  Target: ATXN1; (+) strand; PAM type: NRG; PAM sequence: AAG
tggaacgggggctgggaagg

SEQ ID NO: 111291 - DNA, 20 bp, Artificial Sequence
  Description of Artificial Sequence: Synthetic oligonucleotide
  Target: ATXN1; (+) strand; PAM type: NRG; PAM sequence: AGG
ggaacgggggctgggaagga

SEQ ID NO: 111292 - DNA, 20 bp, Artificial Sequence
  Description of Artificial Sequence: Synthetic oligonucleotide
  Target: ATXN1; (+) strand; PAM type: NRG; PAM sequence: CAG
tgggaaggaaggccgcactg

SEQ ID NO: 111293 - DNA, 20 bp, Artificial Sequence
  Description of Artificial Sequence: Synthetic oligonucleotide
  Target: ATXN1; (+) strand; PAM type: NRG; PAM sequence: TGG
aggccgcactgcagtgctct

SEQ ID NO: 111294 - DNA, 20 bp, Artificial Sequence
  Description of Artificial Sequence: Synthetic oligonucleotide
  Target: ATXN1; (+) strand; PAM type: NRG; PAM sequence: TGG
ccgcactgcagtgctcttgg

SEQ ID NO: 111295 - DNA, 20 bp, Artificial Sequence
  Description of Artificial Sequence: Synthetic oligonucleotide
  Target: ATXN1; (+) strand; PAM type: NRG; PAM sequence: GGG
cgcactgcagtgctcttggt

SEQ ID NO: 111296 - DNA, 20 bp, Artificial Sequence
  Description of Artificial Sequence: Synthetic oligonucleotide
  Target: ATXN1; (+) strand; PAM type: NRG; PAM sequence: GGG
gcactgcagtgctcttggtg

SEQ ID NO: 111297 - DNA, 20 bp, Artificial Sequence
  Description of Artificial Sequence: Synthetic oligonucleotide
  Target: ATXN1; (+) strand; PAM type: NRG; PAM sequence: CAG
cctactgcttcatgaaatgc

SEQ ID NO: 111298 - DNA, 20 bp, Artificial Sequence
  Description of Artificial Sequence: Synthetic oligonucleotide
  Target: ATXN1; (+) strand; PAM type: NRG; PAM sequence: TAG
aaatgccagtgtatgaacca

SEQ ID NO: 111299 - DNA, 20 bp, Artificial Sequence
  Description of Artificial Sequence: Synthetic oligonucleotide
  Target: ATXN1; (+) strand; PAM type: NRG; PAM sequence: AAG
tgtatgaaccatagcatgtg

SEQ ID NO: 111300 - DNA, 20 bp, Artificial Sequence
  Description of Artificial Sequence: Synthetic oligonucleotide
  Target: ATXN1; (+) strand; PAM type: NRG; PAM sequence: AGG
gtatgaaccatagcatgtga

SEQ ID NO: 111301 - DNA, 20 bp, Artificial Sequence
  Description of Artificial Sequence: Synthetic oligonucleotide
  Target: ATXN1; (+) strand; PAM type: NRG; PAM sequence: CAG
tactgcacaatgttcactct

SEQ ID NO: 111302 - DNA, 20 bp, Artificial Sequence
  Description of Artificial Sequence: Synthetic oligonucleotide
  Target: ATXN1; (+) strand; PAM type: NRG; PAM sequence: AAG
gcacaatgttcactctcaga

SEQ ID NO: 111303 - DNA, 20 bp, Artificial Sequence
  Description of Artificial Sequence: Synthetic oligonucleotide
  Target: ATXN1; (+) strand; PAM type: NRG; PAM sequence: GAG
aatactataaacctgtgttt

SEQ ID NO: 111304 - DNA, 20 bp, Artificial Sequence
  Description of Artificial Sequence: Synthetic oligonucleotide
  Target: ATXN1; (+) strand; PAM type: NRG; PAM sequence: CAG
tatttctcttgctttcaatg

SEQ ID NO: 111305 - DNA, 20 bp, Artificial Sequence
  Description of Artificial Sequence: Synthetic oligonucleotide
  Target: ATXN1; (+) strand; PAM type: NRG; PAM sequence: TAG
tcttgctttcaatgcagatt

SEQ ID NO: 111306 - DNA, 20 bp, Artificial Sequence
  Description of Artificial Sequence: Synthetic oligonucleotide
  Target: ATXN1; (+) strand; PAM type: NRG; PAM sequence: GAG
tttagctgattgttcaacgt

SEQ ID NO: 111307 - DNA, 20 bp, Artificial Sequence
  Description of Artificial Sequence: Synthetic oligonucleotide
  Target: ATXN1; (+) strand; PAM type: NRG; PAM sequence: AGG
ttagctgattgttcaacgtg

SEQ ID NO: 111308 - DNA, 20 bp, Artificial Sequence
  Description of Artificial Sequence: Synthetic oligonucleotide
  Target: ATXN1; (+) strand; PAM type: NRG; PAM sequence: CAG
aaaacaaccctctctcttca

SEQ ID NO: 111309 - DNA, 20 bp, Artificial Sequence
  Description of Artificial Sequence: Synthetic oligonucleotide
  Target: ATXN1; (+) strand; PAM type: NRG; PAM sequence: AAG
ccctatgactttccttcatt

SEQ ID NO: 111310 - DNA, 20 bp, Artificial Sequence
  Description of Artificial Sequence: Synthetic oligonucleotide
  Target: ATXN1; (+) strand; PAM type: NRG; PAM sequence: GAG
ttccttcattaagttaaaat

SEQ ID NO: 111311 - DNA, 20 bp, Artificial Sequence
  Description of Artificial Sequence: Synthetic oligonucleotide
  Target: ATXN1; (+) strand; PAM type: NRG; PAM sequence: GAG
ccttcattaagttaaaatga

SEQ ID NO: 111312 - DNA, 20 bp, Artificial Sequence
  Description of Artificial Sequence: Synthetic oligonucleotide
  Target: ATXN1; (+) strand; PAM type: NRG; PAM sequence: AAG
gttaaaatgagagactaaaa

SEQ ID NO: 111313 - DNA, 20 bp, Artificial Sequence
  Description of Artificial Sequence: Synthetic oligonucleotide
  Target: ATXN1; (+) strand; PAM type: NRG; PAM sequence: TGG
aaaatgagagactaaaaaag

SEQ ID NO: 111314 - DNA, 20 bp, Artificial Sequence
  Description of Artificial Sequence: Synthetic oligonucleotide
  Target: ATXN1; (+) strand; PAM type: NRG; PAM sequence: AAG
ctaaaaaagtggaacatgtg

SEQ ID NO: 111315 - DNA, 20 bp, Artificial Sequence
  Description of Artificial Sequence: Synthetic oligonucleotide
  Target: ATXN1; (+) strand; PAM type: NRG; PAM sequence: AGG
taaaaaagtggaacatgtga

SEQ ID NO: 111316 - DNA, 20 bp, Artificial Sequence
  Description of Artificial Sequence: Synthetic oligonucleotide
  Target: ATXN1; (+) strand; PAM type: NRG; PAM sequence: GAG
ggaacatgtgaaggaatgat

SEQ ID NO: 111317 - DNA, 20 bp, Artificial Sequence
  Description of Artificial Sequence: Synthetic oligonucleotide
  Target: ATXN1; (+) strand; PAM type: NRG; PAM sequence: AGG
gaacatgtgaaggaatgatg

SEQ ID NO: 111318 - DNA, 20 bp, Artificial Sequence
  Description of Artificial Sequence: Synthetic oligonucleotide
  Target: ATXN1; (+) strand; PAM type: NRG; PAM sequence: CAG
tgaaggaatgatgaggtcaa

SEQ ID NO: 111319 - DNA, 20 bp, Artificial Sequence
  Description of Artificial Sequence: Synthetic oligonucleotide
  Target: ATXN1; (+) strand; PAM type: NRG; PAM sequence: CAG
gatgaggtcaacagcattct

SEQ ID NO: 111320 - DNA, 20 bp, Artificial Sequence
  Description of Artificial Sequence: Synthetic oligonucleotide
  Target: ATXN1; (+) strand; PAM type: NRG; PAM sequence: AAG
ctctctaaattaatcatacc

SEQ ID NO: 111321 - DNA, 20 bp, Artificial Sequence
  Description of Artificial Sequence: Synthetic oligonucleotide
  Target: ATXN1; (+) strand; PAM type: NRG; PAM sequence: AGG
tctctaaattaatcatacca

SEQ ID NO: 111322 - DNA, 20 bp, Artificial Sequence
  Description of Artificial Sequence: Synthetic oligonucleotide
  Target: ATXN1; (+) strand; PAM type: NRG; PAM sequence: GAG
tctaaattaatcataccaag

SEQ ID NO: 111323 - DNA, 20 bp, Artificial Sequence
  Description of Artificial Sequence: Synthetic oligonucleotide
  Target: ATXN1; (+) strand; PAM type: NRG; PAM sequence: AAG
aatcataccaaggagaaccc

SEQ ID NO: 111324 - DNA, 20 bp, Artificial Sequence
  Description of Artificial Sequence: Synthetic oligonucleotide
  Target: ATXN1; (+) strand; PAM type: NRG; PAM sequence: AAG
ccaagttaaataattttttc

SEQ ID NO: 111325 - DNA, 20 bp, Artificial Sequence
  Description of Artificial Sequence: Synthetic oligonucleotide
  Target: ATXN1; (+) strand; PAM type: NRG; PAM sequence: AAG
tctaaataaaactttaaata

SEQ ID NO: 111326 - DNA, 20 bp, Artificial Sequence
  Description of Artificial Sequence: Synthetic oligonucleotide
  Target: ATXN1; (+) strand; PAM type: NRG; PAM sequence: TGG
actttaaataaagctttatt

SEQ ID NO: 111327 - DNA, 20 bp, Artificial Sequence
  Description of Artificial Sequence: Synthetic oligonucleotide
  Target: ATXN1; (+) strand; PAM type: NRG; PAM sequence: CAG
gctttatttggttttactca

SEQ ID NO: 111328 - DNA, 20 bp, Artificial Sequence
  Description of Artificial Sequence: Synthetic oligonucleotide
  Target: ATXN1; (+) strand; PAM type: NRG; PAM sequence: GAG
ctcacagccaaccaataatt

SEQ ID NO: 111329 - DNA, 20 bp, Artificial Sequence
  Description of Artificial Sequence: Synthetic oligonucleotide
  Target: ATXN1; (+) strand; PAM type: NRG; PAM sequence: AAG
ttgagtcatctctattttta

SEQ ID NO: 111330 - DNA, 20 bp, Artificial Sequence
  Description of Artificial Sequence: Synthetic oligonucleotide
  Target: ATXN1; (+) strand; PAM type: NRG; PAM sequence: AAG
tctatttttaaagtaatgtg

SEQ ID NO: 111331 - DNA, 20 bp, Artificial Sequence
  Description of Artificial Sequence: Synthetic oligonucleotide
  Target: ATXN1; (+) strand; PAM type: NRG; PAM sequence: CAG
ttttaaagtaatgtgaagat

SEQ ID NO: 111332 - DNA, 20 bp, Artificial Sequence
  Description of Artificial Sequence: Synthetic oligonucleotide
  Target: ATXN1; (+) strand; PAM type: NRG; PAM sequence: TAG
aaagtaatgtgaagatcagt

SEQ ID NO: 111333 - DNA, 20 bp, Artificial Sequence
  Description of Artificial Sequence: Synthetic oligonucleotide
  Target: ATXN1; (+) strand; PAM type: NRG; PAM sequence: CGG
atcagttagttcaaacctaa

SEQ ID NO: 111334 - DNA, 20 bp, Artificial Sequence
  Description of Artificial Sequence: Synthetic oligonucleotide
  Target: ATXN1; (+) strand; PAM type: NRG; PAM sequence: CGG
agttcaaacctaacggatac

SEQ ID NO: 111335 - DNA, 20 bp, Artificial Sequence
  Description of Artificial Sequence: Synthetic oligonucleotide
  Target: ATXN1; (+) strand; PAM type: NRG; PAM sequence: GGG
gttcaaacctaacggatacc

SEQ ID NO: 111336 - DNA, 20 bp, Artificial Sequence
  Description of Artificial Sequence: Synthetic oligonucleotide
  Target: ATXN1; (+) strand; PAM type: NRG; PAM sequence: GAG
accgggcattcataactttt

SEQ ID NO: 111337 - DNA, 20 bp, Artificial Sequence
  Description of Artificial Sequence: Synthetic oligonucleotide
  Target: ATXN1; (+) strand; PAM type: NRG; PAM sequence: AGG
ccgggcattcataacttttg

SEQ ID NO: 111338 - DNA, 20 bp, Artificial Sequence
  Description of Artificial Sequence: Synthetic oligonucleotide
  Target: ATXN1; (+) strand; PAM type: NRG; PAM sequence: GGG
cgggcattcataacttttga

SEQ ID NO: 111339 - DNA, 20 bp, Artificial Sequence
  Description of Artificial Sequence: Synthetic oligonucleotide
  Target: ATXN1; (+) strand; PAM type: NRG; PAM sequence: TAG
ataacttttgagggcattac

SEQ ID NO: 111340 - DNA, 20 bp, Artificial Sequence
  Description of Artificial Sequence: Synthetic oligonucleotide
  Target: ATXN1; (+) strand; PAM type: NRG; PAM sequence: AAG
ccctatttccttaatgtaaa

SEQ ID NO: 111341 - DNA, 20 bp, Artificial Sequence
  Description of Artificial Sequence: Synthetic oligonucleotide
  Target: ATXN1; (+) strand; PAM type: NRG; PAM sequence: AAG
tttccttaatgtaaaaagta

SEQ ID NO: 111342 - DNA, 20 bp, Artificial Sequence
  Description of Artificial Sequence: Synthetic oligonucleotide
  Target: ATXN1; (+) strand; PAM type: NRG; PAM sequence: TAG
ccttaatgtaaaaagtaaag

SEQ ID NO: 111343 - DNA, 20 bp, Artificial Sequence
  Description of Artificial Sequence: Synthetic oligonucleotide
  Target: ATXN1; (+) strand; PAM type: NRG; PAM sequence: GAG
ttaatgtaaaaagtaaagta

SEQ ID NO: 111344 - DNA, 20 bp, Artificial Sequence
  Description of Artificial Sequence: Synthetic oligonucleotide
  Target: ATXN1; (+) strand; PAM type: NRG; PAM sequence: AGG
taatgtaaaaagtaaagtag

SEQ ID NO: 111345 - DNA, 20 bp, Artificial Sequence
  Description of Artificial Sequence: Synthetic oligonucleotide
  Target: ATXN1; (+) strand; PAM type: NRG; PAM sequence: AAG
aaagtagaggttcctcttca

SEQ ID NO: 111346 - DNA, 20 bp, Artificial Sequence
  Description of Artificial Sequence: Synthetic oligonucleotide
  Target: ATXN1; (+) strand; PAM type: NRG; PAM sequence: TAG
gattttcctccccatctaat

SEQ ID NO: 111347 - DNA, 20 bp, Artificial Sequence
  Description of Artificial Sequence: Synthetic oligonucleotide
  Target: ATXN1; (+) strand; PAM type: NRG; PAM sequence: AGG
attttcctccccatctaatt

SEQ ID NO: 111348 - DNA, 20 bp, Artificial Sequence
  Description of Artificial Sequence: Synthetic oligonucleotide
  Target: ATXN1; (+) strand; PAM type: NRG; PAM sequence: TAG
cccatctaattaggaattaa

SEQ ID NO: 111349 - DNA, 20 bp, Artificial Sequence
  Description of Artificial Sequence: Synthetic oligonucleotide
  Target: ATXN1; (+) strand; PAM type: NRG; PAM sequence: TAG
gaattaatagtactttctct

SEQ ID NO: 111350 - DNA, 20 bp, Artificial Sequence
  Description of Artificial Sequence: Synthetic oligonucleotide
  Target: ATXN1; (+) strand; PAM type: NRG; PAM sequence: AAG
ttaatagtactttctcttag

SEQ ID NO: 111351 - DNA, 20 bp, Artificial Sequence
  Description of Artificial Sequence: Synthetic oligonucleotide
  Target: ATXN1; (+) strand; PAM type: NRG; PAM sequence: AAG
ttagaagcaaaatttattca

SEQ ID NO: 111352 - DNA, 20 bp, Artificial Sequence
  Description of Artificial Sequence: Synthetic oligonucleotide
  Target: ATXN1; (+) strand; PAM type: NRG; PAM sequence: TAG
taacattcttaaatatctgc

SEQ ID NO: 111353 - DNA, 20 bp, Artificial Sequence
  Description of Artificial Sequence: Synthetic oligonucleotide
  Target: ATXN1; (+) strand; PAM type: NRG; PAM sequence: AAG
aatatctgctagctgtaata

SEQ ID NO: 111354 - DNA, 20 bp, Artificial Sequence
  Description of Artificial Sequence: Synthetic oligonucleotide
  Target: ATXN1; (+) strand; PAM type: NRG; PAM sequence: TAG
atcaatgtactttatgttct

SEQ ID NO: 111355 - DNA, 20 bp, Artificial Sequence
  Description of Artificial Sequence: Synthetic oligonucleotide
  Target: ATXN1; (+) strand; PAM type: NRG; PAM sequence: TAG
tgttcttagctcccacaatt

SEQ ID NO: 111356 - DNA, 20 bp, Artificial Sequence
  Description of Artificial Sequence: Synthetic oligonucleotide
  Target: ATXN1; (+) strand; PAM type: NRG; PAM sequence: TAG
tttagcctaaatatttaccc

SEQ ID NO: 111357 - DNA, 20 bp, Artificial Sequence
  Description of Artificial Sequence: Synthetic oligonucleotide
  Target: ATXN1; (+) strand; PAM type: NRG; PAM sequence: TGG
ttaccctagcatgcttatac

SEQ ID NO: 111358 - DNA, 20 bp, Artificial Sequence
  Description of Artificial Sequence: Synthetic oligonucleotide
  Target: ATXN1; (+) strand; PAM type: NRG; PAM sequence: AAG
tagcatgcttatactggtcc

SEQ ID NO: 111359 - DNA, 20 bp, Artificial Sequence
  Description of Artificial Sequence: Synthetic oligonucleotide
  Target: ATXN1; (+) strand; PAM type: NRG; PAM sequence: AAG
atgcttatactggtccaagc

SEQ ID NO: 111360 - DNA, 20 bp, Artificial Sequence
  Description of Artificial Sequence: Synthetic oligonucleotide
  Target: ATXN1; (+) strand; PAM type: NRG; PAM sequence: TAG
atactggtccaagcaagcat

SEQ ID NO: 111361 - DNA, 20 bp, Artificial Sequence
  Description of Artificial Sequence: Synthetic oligonucleotide
  Target: ATXN1; (+) strand; PAM type: NRG; PAM sequence: AGG
tactggtccaagcaagcatt

SEQ ID NO: 111362 - DNA, 20 bp, Artificial Sequence
  Description of Artificial Sequence: Synthetic oligonucleotide
  Target: ATXN1; (+) strand; PAM type: NRG; PAM sequence: TAG
tccaagcaagcattaggtca

SEQ ID NO: 111363 - DNA, 20 bp, Artificial Sequence
  Description of Artificial Sequence: Synthetic oligonucleotide
  Target: ATXN1; (+) strand; PAM type: NRG; PAM sequence: AAG
ctgttcctcttccttatttg

SEQ ID NO: 111364 - DNA, 20 bp, Artificial Sequence
  Description of Artificial Sequence: Synthetic oligonucleotide
  Target: ATXN1; (+) strand; PAM type: NRG; PAM sequence: AGG
tgttcctcttccttatttga

SEQ ID NO: 111365 - DNA, 20 bp, Artificial Sequence
  Description of Artificial Sequence: Synthetic oligonucleotide
  Target: ATXN1; (+) strand; PAM type: NRG; PAM sequence: CAG
tgaaggttttttacctttct

SEQ ID NO: 111366 - DNA, 20 bp, Artificial Sequence
  Description of Artificial Sequence: Synthetic oligonucleotide
  Target: ATXN1; (+) strand; PAM type: NRG; PAM sequence: AAG
tacctttctcagcatttcac

SEQ ID NO: 111367 - DNA, 20 bp, Artificial Sequence
  Description of Artificial Sequence: Synthetic oligonucleotide
  Target: ATXN1; (+) strand; PAM type: NRG; PAM sequence: AAG
ctgcttttgctgcttttaaa

SEQ ID NO: 111368 - DNA, 20 bp, Artificial Sequence
  Description of Artificial Sequence: Synthetic oligonucleotide
  Target: ATXN1; (+) strand; PAM type: NRG; PAM sequence: AAG
tgctgcttttaaaaagttct

SEQ ID NO: 111369 - DNA, 20 bp, Artificial Sequence
  Description of Artificial Sequence: Synthetic oligonucleotide
  Target: ATXN1; (+) strand; PAM type: NRG; PAM sequence: TAG
tttaaaaagttctaagctgc

SEQ ID NO: 111370 - DNA, 20 bp, Artificial Sequence
  Description of Artificial Sequence: Synthetic oligonucleotide
  Target: ATXN1; (+) strand; PAM type: NRG; PAM sequence: CGG
gttctaagctgctagccatt

SEQ ID NO: 111371 - DNA, 20 bp, Artificial Sequence
  Description of Artificial Sequence: Synthetic oligonucleotide
  Target: ATXN1; (+) strand; PAM type: NRG; PAM sequence: GGG
ttctaagctgctagccattc

SEQ ID NO: 111372 - DNA, 20 bp, Artificial Sequence
  Description of Artificial Sequence: Synthetic oligonucleotide
  Target: ATXN1; (+) strand; PAM type: NRG; PAM sequence: CAG
ctagccattcgggacaaata

SEQ ID NO: 111373 - DNA, 20 bp, Artificial Sequence
  Description of Artificial Sequence: Synthetic oligonucleotide
  Target: ATXN1; (+) strand; PAM type: NRG; PAM sequence: GAG
tcgggacaaatacagaatgt

SEQ ID NO: 111374 - DNA, 20 bp, Artificial Sequence
  Description of Artificial Sequence: Synthetic oligonucleotide
  Target: ATXN1; (+) strand; PAM type: NRG; PAM sequence: AGG
cgggacaaatacagaatgtg

SEQ ID NO: 111375 - DNA, 20 bp, Artificial Sequence
  Description of Artificial Sequence: Synthetic oligonucleotide
  Target: ATXN1; (+) strand; PAM type: NRG; PAM sequence: CAG
cagaatgtgaggtcccattc

SEQ ID NO: 111376 - DNA, 20 bp, Artificial Sequence
  Description of Artificial Sequence: Synthetic oligonucleotide
  Target: ATXN1; (+) strand; PAM type: NRG; PAM sequence: TGG
tgaggtcccattccagccaa

SEQ ID NO: 111377 - DNA, 20 bp, Artificial Sequence
  Description of Artificial Sequence: Synthetic oligonucleotide
  Target: ATXN1; (+) strand; PAM type: NRG; PAM sequence: TGG
ccattccagccaatggaaac

SEQ ID NO: 111378 - DNA, 20 bp, Artificial Sequence
  Description of Artificial Sequence: Synthetic oligonucleotide
  Target: ATXN1; (+) strand; PAM type: NRG; PAM sequence: TAG
cagccaatggaaactggaca

SEQ ID NO: 111379 - DNA, 20 bp, Artificial Sequence
  Description of Artificial Sequence: Synthetic oligonucleotide
  Target: ATXN1; (+) strand; PAM type: NRG; PAM sequence: CAG
ccaatggaaactggacatag

SEQ ID NO: 111380 - DNA, 20 bp, Artificial Sequence
  Description of Artificial Sequence: Synthetic oligonucleotide
  Target: ATXN1; (+) strand; PAM type: NRG; PAM sequence: TAG
atggaaactggacatagcag

SEQ ID NO: 111381 - DNA, 20 bp, Artificial Sequence
  Description of Artificial Sequence: Synthetic oligonucleotide
  Target: ATXN1; (+) strand; PAM type: NRG; PAM sequence: AGG
tggaaactggacatagcagt

SEQ ID NO: 111382 - DNA, 20 bp, Artificial Sequence
  Description of Artificial Sequence: Synthetic oligonucleotide
  Target: ATXN1; (+) strand; PAM type: NRG; PAM sequence: GGG
ggaaactggacatagcagta

SEQ ID NO: 111383 - DNA, 20 bp, Artificial Sequence
  Description of Artificial Sequence: Synthetic oligonucleotide
  Target: ATXN1; (+) strand; PAM type: NRG; PAM sequence: TGG
aactggacatagcagtaggg

SEQ ID NO: 111384 - DNA, 20 bp, Artificial Sequence
  Description of Artificial Sequence: Synthetic oligonucleotide
  Target: ATXN1; (+) strand; PAM type: NRG; PAM sequence: CAG
tagcagtagggtggacgcgt

SEQ ID NO: 111385 - DNA, 20 bp, Artificial Sequence
  Description of Artificial Sequence: Synthetic oligonucleotide
  Target: ATXN1; (+) strand; PAM type: NRG; PAM sequence: AGG
agcagtagggtggacgcgtc

SEQ ID NO: 111386 - DNA, 20 bp, Artificial Sequence
  Description of Artificial Sequence: Synthetic oligonucleotide
  Target: ATXN1; (+) strand; PAM type: NRG; PAM sequence: TGG
ctttgttccgtgtactcttg

SEQ ID NO: 111387 - DNA, 20 bp, Artificial Sequence
  Description of Artificial Sequence: Synthetic oligonucleotide
  Target: ATXN1; (+) strand; PAM type: NRG; PAM sequence: TGG
tactcttgtggcaaaactgc

SEQ ID NO: 111388 - DNA, 20 bp, Artificial Sequence
  Description of Artificial Sequence: Synthetic oligonucleotide
  Target: ATXN1; (+) strand; PAM type: NRG; PAM sequence: AAG
cttgtggcaaaactgctggc

SEQ ID NO: 111389 - DNA, 20 bp, Artificial Sequence
  Description of Artificial Sequence: Synthetic oligonucleotide
  Target: ATXN1; (+) strand; PAM type: NRG; PAM sequence: CAG
tggcaagtgtaccctttctg

SEQ ID NO: 111390 - DNA, 20 bp, Artificial Sequence
  Description of Artificial Sequence: Synthetic oligonucleotide
  Target: ATXN1; (+) strand; PAM type: NRG; PAM sequence: AAG
aagtgtaccctttctgcaga

SEQ ID NO: 111391 - DNA, 20 bp, Artificial Sequence
  Description of Artificial Sequence: Synthetic oligonucleotide
  Target: ATXN1; (+) strand; PAM type: NRG; PAM sequence: TGG
ctttctgcagaaagtaaaaa

SEQ ID NO: 111392 - DNA, 20 bp, Artificial Sequence
  Description of Artificial Sequence: Synthetic oligonucleotide
  Target: ATXN1; (+) strand; PAM type: NRG; PAM sequence: GAG
aaagtaaaaatggtcttgct

SEQ ID NO: 111393 - DNA, 20 bp, Artificial Sequence
  Description of Artificial Sequence: Synthetic oligonucleotide
  Target: ATXN1; (+) strand; PAM type: NRG; PAM sequence: AGG
aagtaaaaatggtcttgctg

SEQ ID NO: 111394 - DNA, 20 bp, Artificial Sequence
  Description of Artificial Sequence: Synthetic oligonucleotide
  Target: ATXN1; (+) strand; PAM type: NRG; PAM sequence: AAG
aggaaattaaatttatgttc

SEQ ID NO: 111395 - DNA, 20 bp, Artificial Sequence
  Description of Artificial Sequence: Synthetic oligonucleotide
  Target: ATXN1; (+) strand; PAM type: NRG; PAM sequence: AGG
ggaaattaaatttatgttca

SEQ ID NO: 111396 - DNA, 20 bp, Artificial Sequence
  Description of Artificial Sequence: Synthetic oligonucleotide
  Target: ATXN1; (+) strand; PAM type: NRG; PAM sequence: CAG
gttcaaggtctatttcttta

SEQ ID NO: 111397 - DNA, 20 bp, Artificial Sequence
  Description of Artificial Sequence: Synthetic oligonucleotide
  Target: ATXN1; (+) strand; PAM type: NRG; PAM sequence: AAG
tctatttctttacagcacca

SEQ ID NO: 111398 - DNA, 20 bp, Artificial Sequence
  Description of Artificial Sequence: Synthetic oligonucleotide
  Target: ATXN1; (+) strand; PAM type: NRG; PAM sequence: AAG
tctttacagcaccaaagaac

SEQ ID NO: 111399 - DNA, 20 bp, Artificial Sequence
  Description of Artificial Sequence: Synthetic oligonucleotide
  Target: ATXN1; (+) strand; PAM type: NRG; PAM sequence: AAG
aacaagcatttctaacactt

SEQ ID NO: 111400 - DNA, 20 bp, Artificial Sequence
  Description of Artificial Sequence: Synthetic oligonucleotide
  Target: ATXN1; (+) strand; PAM type: NRG; PAM sequence: TGG
aacacttaagatgtgtacta

SEQ ID NO: 111401 - DNA, 20 bp, Artificial Sequence
  Description of Artificial Sequence: Synthetic oligonucleotide
  Target: ATXN1; (+) strand; PAM type: NRG; PAM sequence: CAG
taagatgtgtactatggaat

SEQ ID NO: 111402 - DNA, 20 bp, Artificial Sequence
  Description of Artificial Sequence: Synthetic oligonucleotide
  Target: ATXN1; (+) strand; PAM type: NRG; PAM sequence: AAG
ctatggaatcagatttgtaa

SEQ ID NO: 111403 - DNA, 20 bp, Artificial Sequence
  Description of Artificial Sequence: Synthetic oligonucleotide
  Target: ATXN1; (+) strand; PAM type: NRG; PAM sequence: CAG
atcagatttgtaaaagttca

SEQ ID NO: 111404 - DNA, 20 bp, Artificial Sequence
  Description of Artificial Sequence: Synthetic oligonucleotide
  Target: ATXN1; (+) strand; PAM type: NRG; PAM sequence: CGG
agatttgtaaaagttcacag

SEQ ID NO: 111405 - DNA, 20 bp, Artificial Sequence
  Description of Artificial Sequence: Synthetic oligonucleotide
  Target: ATXN1; (+) strand; PAM type: NRG; PAM sequence: CAG
tttgtaaaagttcacagcgg

SEQ ID NO: 111406 - DNA, 20 bp, Artificial Sequence
  Description of Artificial Sequence: Synthetic oligonucleotide
  Target: ATXN1; (+) strand; PAM type: NRG; PAM sequence: AGG
ttgtaaaagttcacagcggc

SEQ ID NO: 111407 - DNA, 20 bp, Artificial Sequence
  Description of Artificial Sequence: Synthetic oligonucleotide
  Target: ATXN1; (+) strand; PAM type: NRG; PAM sequence: GAG
gtaaaagttcacagcggcag

SEQ ID NO: 111408 - DNA, 20 bp, Artificial Sequence
  Description of Artificial Sequence: Synthetic oligonucleotide
  Target: ATXN1; (+) strand; PAM type: NRG; PAM sequence: TAG
agttcacagcggcaggagac

SEQ ID NO: 111409 - DNA, 20 bp, Artificial Sequence
  Description of Artificial Sequence: Synthetic oligonucleotide
  Target: ATXN1; (+) strand; PAM type: NRG; PAM sequence: GAG
ggagactagtgatcatccat

SEQ ID NO: 111410 - DNA, 20 bp, Artificial Sequence
  Description of Artificial Sequence: Synthetic oligonucleotide
  Target: ATXN1; (+) strand; PAM type: NRG; PAM sequence: AGG
gagactagtgatcatccatg

SEQ ID NO: 111411 - DNA, 20 bp, Artificial Sequence
  Description of Artificial Sequence: Synthetic oligonucleotide
  Target: ATXN1; (+) strand; PAM type: NRG; PAM sequence: AAG
actagtgatcatccatgagg

SEQ ID NO: 111412 - DNA, 20 bp, Artificial Sequence
  Description of Artificial Sequence: Synthetic oligonucleotide
  Target: ATXN1; (+) strand; PAM type: NRG; PAM sequence: TAG
gatcatccatgaggaagtta

SEQ ID NO: 111413 - DNA, 20 bp, Artificial Sequence
  Description of Artificial Sequence: Synthetic oligonucleotide
  Target: ATXN1; (+) strand; PAM type: NRG; PAM sequence: CAG
tccatgaggaagttatagct

SEQ ID NO: 111414 - DNA, 20 bp, Artificial Sequence
  Description of Artificial Sequence: Synthetic oligonucleotide
  Target: ATXN1; (+) strand; PAM type: NRG; PAM sequence: GAG
catgaggaagttatagctca

SEQ ID NO: 111415 - DNA, 20 bp, Artificial Sequence
  Description of Artificial Sequence: Synthetic oligonucleotide
  Target: ATXN1; (+) strand; PAM type: NRG; PAM sequence: GAG
tgaggaagttatagctcaga

SEQ ID NO: 111416 - DNA, 20 bp, Artificial Sequence
  Description of Artificial Sequence: Synthetic oligonucleotide
  Target: ATXN1; (+) strand; PAM type: NRG; PAM sequence: TGG
gttatagctcagagagataa

SEQ ID NO: 111417 - DNA, 20 bp, Artificial Sequence
  Description of Artificial Sequence: Synthetic oligonucleotide
  Target: ATXN1; (+) strand; PAM type: NRG; PAM sequence: GGG
ttatagctcagagagataat

SEQ ID NO: 111418 - DNA, 20 bp, Artificial Sequence
  Description of Artificial Sequence: Synthetic oligonucleotide
  Target: ATXN1; (+) strand; PAM type: NRG; PAM sequence: GAG
gagagataatgggcatgcct

SEQ ID NO: 111419 - DNA, 20 bp, Artificial Sequence
  Description of Artificial Sequence: Synthetic oligonucleotide
  Target: ATXN1; (+) strand; PAM type: NRG; PAM sequence: CAG
aatgggcatgcctgagatca

SEQ ID NO: 111420 - DNA, 20 bp, Artificial Sequence
  Description of Artificial Sequence: Synthetic oligonucleotide
  Target: ATXN1; (+) strand; PAM type: NRG; PAM sequence: GAG
tgggcatgcctgagatcaca

SEQ ID NO: 111421 - DNA, 20 bp, Artificial Sequence
  Description of Artificial Sequence: Synthetic oligonucleotide
  Target: ATXN1; (+) strand; PAM type: NRG; PAM sequence: TGG
cagagtaatgactgttaact

SEQ ID NO: 111422 - DNA, 20 bp, Artificial Sequence
  Description of Artificial Sequence: Synthetic oligonucleotide
  Target: ATXN1; (+) strand; PAM type: NRG; PAM sequence: AAG
ttaacttggcttcattttaa

SEQ ID NO: 111423 - DNA, 20 bp, Artificial Sequence
  Description of Artificial Sequence: Synthetic oligonucleotide
  Target: ATXN1; (+) strand; PAM type: NRG; PAM sequence: TGG
cattttaaaagattgtgttg

SEQ ID NO: 111424 - DNA, 20 bp, Artificial Sequence
  Description of Artificial Sequence: Synthetic oligonucleotide
  Target: ATXN1; (+) strand; PAM type: NRG; PAM sequence: GGG
attttaaaagattgtgttgt

SEQ ID NO: 111425 - DNA, 20 bp, Artificial Sequence
  Description of Artificial Sequence: Synthetic oligonucleotide
  Target: ATXN1; (+) strand; PAM type: NRG; PAM sequence: AAG
tgggcactacccttatctta

SEQ ID NO: 111426 - DNA, 20 bp, Artificial Sequence
  Description of Artificial Sequence: Synthetic oligonucleotide
  Target: ATXN1; (+) strand; PAM type: NRG; PAM sequence: AAG
ttttttaaatgttctcctct

SEQ ID NO: 111427 - DNA, 20 bp, Artificial Sequence
  Description of Artificial Sequence: Synthetic oligonucleotide
  Target: ATXN1; (+) strand; PAM type: NRG; PAM sequence: AGG
tttttaaatgttctcctcta

SEQ ID NO: 111428 - DNA, 20 bp, Artificial Sequence
  Description of Artificial Sequence: Synthetic oligonucleotide
  Target: ATXN1; (+) strand; PAM type: NRG; PAM sequence: TGG
ctttatgattcaaaataata

SEQ ID NO: 111429 - DNA, 20 bp, Artificial Sequence
  Description of Artificial Sequence: Synthetic oligonucleotide
  Target: ATXN1; (+) strand; PAM type: NRG; PAM sequence: CGG
atgattcaaaataatatggt

SEQ ID NO: 111430 - DNA, 20 bp, Artificial Sequence
  Description of Artificial Sequence: Synthetic oligonucleotide
  Target: ATXN1; (+) strand; PAM type: NRG; PAM sequence: TGG
aataatatggtcggaatgaa

SEQ ID NO: 111431 - DNA, 20 bp, Artificial Sequence
  Description of Artificial Sequence: Synthetic oligonucleotide
  Target: ATXN1; (+) strand; PAM type: NRG; PAM sequence: GGG
ataatatggtcggaatgaat

SEQ ID NO: 111432 - DNA, 20 bp, Artificial Sequence
  Description of Artificial Sequence: Synthetic oligonucleotide
  Target: ATXN1; (+) strand; PAM type: NRG; PAM sequence: AAG
atatggtcggaatgaatggg

SEQ ID NO: 111433 - DNA, 20 bp, Artificial Sequence
  Description of Artificial Sequence: Synthetic oligonucleotide
  Target: ATXN1; (+) strand; PAM type: NRG; PAM sequence: AGG
tatggtcggaatgaatggga

SEQ ID NO: 111434 - DNA, 20 bp, Artificial Sequence
  Description of Artificial Sequence: Synthetic oligonucleotide
  Target: ATXN1; (+) strand; PAM type: NRG; PAM sequence: CAG
aaggatactgctgtgtccac

SEQ ID NO: 111435 - DNA, 20 bp, Artificial Sequence
  Description of Artificial Sequence: Synthetic oligonucleotide
  Target: ATXN1; (+) strand; PAM type: NRG; PAM sequence: TGG
tgtgtccaccagtgcctaac

SEQ ID NO: 111436 - DNA, 20 bp, Artificial Sequence
  Description of Artificial Sequence: Synthetic oligonucleotide
  Target: ATXN1; (+) strand; PAM type: NRG; PAM sequence: TGG
tgcctaactggacatttaaa

SEQ ID NO: 111437 - DNA, 20 bp, Artificial Sequence
  Description of Artificial Sequence: Synthetic oligonucleotide
  Target: ATXN1; (+) strand; PAM type: NRG; PAM sequence: CAG
ctaactggacatttaaatgg

SEQ ID NO: 111438 - DNA, 20 bp, Artificial Sequence
  Description of Artificial Sequence: Synthetic oligonucleotide
  Target: ATXN1; (+) strand; PAM type: NRG; PAM sequence: AAG
actggacatttaaatggcag

SEQ ID NO: 111439 - DNA, 20 bp, Artificial Sequence
  Description of Artificial Sequence: Synthetic oligonucleotide
  Target: ATXN1; (+) strand; PAM type: NRG; PAM sequence: TGG
ggcagaagctcttcttccaa

SEQ ID NO: 111440 - DNA, 20 bp, Artificial Sequence
  Description of Artificial Sequence: Synthetic oligonucleotide
  Target: ATXN1; (+) strand; PAM type: NRG; PAM sequence: GAG
aatggcacattgaaatcact

SEQ ID NO: 111441 - DNA, 20 bp, Artificial Sequence
  Description of Artificial Sequence: Synthetic oligonucleotide
  Target: ATXN1; (+) strand; PAM type: NRG; PAM sequence: GAG
tggcacattgaaatcactga

SEQ ID NO: 111442 - DNA, 20 bp, Artificial Sequence
  Description of Artificial Sequence: Synthetic oligonucleotide
  Target: ATXN1; (+) strand; PAM type: NRG; PAM sequence: TAG
actgagagatgaccttctca

SEQ ID NO: 111443 - DNA, 20 bp, Artificial Sequence
  Description of Artificial Sequence: Synthetic oligonucleotide
  Target: ATXN1; (+) strand; PAM type: NRG; PAM sequence: AAG
agagatgaccttctcatagt

SEQ ID NO: 111444 - DNA, 20 bp, Artificial Sequence
  Description of Artificial Sequence: Synthetic oligonucleotide
  Target: ATXN1; (+) strand; PAM type: NRG; PAM sequence: AGG
gagatgaccttctcatagta

SEQ ID NO: 111445 - DNA, 20 bp, Artificial Sequence
  Description of Artificial Sequence: Synthetic oligonucleotide
  Target: ATXN1; (+) strand; PAM type: NRG; PAM sequence: AAG
tctcatagtaaggctgtcct

SEQ ID NO: 111446 - DNA, 20 bp, Artificial Sequence
  Description of Artificial Sequence: Synthetic oligonucleotide
  Target: ATXN1; (+) strand; PAM type: NRG; PAM sequence: AGG
ctcatagtaaggctgtccta

SEQ ID NO: 111447 - DNA, 20 bp, Artificial Sequence
  Description of Artificial Sequence: Synthetic oligonucleotide
  Target: ATXN1; (+) strand; PAM type: NRG; PAM sequence: AAG
tgttgaaacatgctcctcaa

SEQ ID NO: 111448 - DNA, 20 bp, Artificial Sequence
  Description of Artificial Sequence: Synthetic oligonucleotide
  Target: ATXN1; (+) strand; PAM type: NRG; PAM sequence: TGG
aaagtatctgtatcaacttt

SEQ ID NO: 111449 - DNA, 20 bp, Artificial Sequence
  Description of Artificial Sequence: Synthetic oligonucleotide
  Target: ATXN1; (+) strand; PAM type: NRG; PAM sequence: AAG
gtatcaacttttggatgctg

SEQ ID NO: 111450 - DNA, 20 bp, Artificial Sequence
  Description of Artificial Sequence: Synthetic oligonucleotide
  Target: ATXN1; (+) strand; PAM type: NRG; PAM sequence: TGG
caacttttggatgctgaagc

SEQ ID NO: 111451 - DNA, 20 bp, Artificial Sequence
  Description of Artificial Sequence: Synthetic oligonucleotide
  Target: ATXN1; (+) strand; PAM type: NRG; PAM sequence: TGG
ctggttttactcacaacatc

SEQ ID NO: 111452 - DNA, 20 bp, Artificial Sequence
  Description of Artificial Sequence: Synthetic oligonucleotide
  Target: ATXN1; (+) strand; PAM type: NRG; PAM sequence: TAG
caacatctggtttgcttata

SEQ ID NO: 111453 - DNA, 20 bp, Artificial Sequence
  Description of Artificial Sequence: Synthetic oligonucleotide
  Target: ATXN1; (+) strand; PAM type: NRG; PAM sequence: TAG
atatagcatatcaattcaat

SEQ ID NO: 111454 - DNA, 20 bp, Artificial Sequence
  Description of Artificial Sequence: Synthetic oligonucleotide
  Target: ATXN1; (+) strand; PAM type: NRG; PAM sequence: AAG
tcaattcaattagatattaa

SEQ ID NO: 111455 - DNA, 20 bp, Artificial Sequence
  Description of Artificial Sequence: Synthetic oligonucleotide
  Target: ATXN1; (+) strand; PAM type: NRG; PAM sequence: AGG
caattcaattagatattaaa

SEQ ID NO: 111456 - DNA, 20 bp, Artificial Sequence
  Description of Artificial Sequence: Synthetic oligonucleotide
  Target: ATXN1; (+) strand; PAM type: NRG; PAM sequence: TAG
gatattaaaaggtacttatt

SEQ ID NO: 111457 - DNA, 20 bp, Artificial Sequence
  Description of Artificial Sequence: Synthetic oligonucleotide
  Target: ATXN1; (+) strand; PAM type: NRG; PAM sequence: TGG
ttaaaaggtacttatttagt

SEQ ID NO: 111458 - DNA, 20 bp, Artificial Sequence
  Description of Artificial Sequence: Synthetic oligonucleotide
  Target: ATXN1; (+) strand; PAM type: NRG; PAM sequence: AAG
aggtacttatttagttggtg

SEQ ID NO: 111459 - DNA, 20 bp, Artificial Sequence
  Description of Artificial Sequence: Synthetic oligonucleotide
  Target: ATXN1; (+) strand; PAM type: NRG; PAM sequence: CAG
tagttggtgaagttgaaatg

SEQ ID NO: 111460 - DNA, 20 bp, Artificial Sequence
  Description of Artificial Sequence: Synthetic oligonucleotide
  Target: ATXN1; (+) strand; PAM type: NRG; PAM sequence: GAG
gttggtgaagttgaaatgca

SEQ ID NO: 111461 - DNA, 20 bp, Artificial Sequence
  Description of Artificial Sequence: Synthetic oligonucleotide
  Target: ATXN1; (+) strand; PAM type: NRG; PAM sequence: GAG
tggtgaagttgaaatgcaga

SEQ ID NO: 111462 - DNA, 20 bp, Artificial Sequence
  Description of Artificial Sequence: Synthetic oligonucleotide
  Target: ATXN1; (+) strand; PAM type: NRG; PAM sequence: AGG
ggtgaagttgaaatgcagag

SEQ ID NO: 111463 - DNA, 20 bp, Artificial Sequence
  Description of Artificial Sequence: Synthetic oligonucleotide
  Target: ATXN1; (+) strand; PAM type: NRG; PAM sequence: GAG
tgaagttgaaatgcagagag

SEQ ID NO: 111464 - DNA, 20 bp, Artificial Sequence
  Description of Artificial Sequence: Synthetic oligonucleotide
  Target: ATXN1; (+) strand; PAM type: NRG; PAM sequence: CAG
agagaggagactaaaattcc

SEQ ID NO: 111465 - DNA, 20 bp, Artificial Sequence
  Description of Artificial Sequence: Synthetic oligonucleotide
  Target: ATXN1; (+) strand; PAM type: NRG; PAM sequence: AGG
gagaggagactaaaattccc

SEQ ID NO: 111466 - DNA, 20 bp, Artificial Sequence
  Description of Artificial Sequence: Synthetic oligonucleotide
  Target: ATXN1; (+) strand; PAM type: NRG; PAM sequence: GGG
agaggagactaaaattccca

SEQ ID NO: 111467 - DNA, 20 bp, Artificial Sequence
  Description of Artificial Sequence: Synthetic oligonucleotide
  Target: ATXN1; (+) strand; PAM type: NRG; PAM sequence: GGG
gaggagactaaaattcccag

SEQ ID NO: 111468 - DNA, 20 bp, Artificial Sequence
  Description of Artificial Sequence: Synthetic oligonucleotide
  Target: ATXN1; (+) strand; PAM type: NRG; PAM sequence: CAG
gactaaaattcccaggggca

SEQ ID NO: 111469 - DNA, 20 bp, Artificial Sequence
  Description of Artificial Sequence: Synthetic oligonucleotide
  Target: ATXN1; (+) strand; PAM type: NRG; PAM sequence: TGG
aattcccaggggcacagttg

SEQ ID NO: 111470 - DNA, 20 bp, Artificial Sequence
  Description of Artificial Sequence: Synthetic oligonucleotide
  Target: ATXN1; (+) strand; PAM type: NRG; PAM sequence: GAG
ttcccaggggcacagttgtg

SEQ ID NO: 111471 - DNA, 20 bp, Artificial Sequence
  Description of Artificial Sequence: Synthetic oligonucleotide
  Target: ATXN1; (+) strand; PAM type: NRG; PAM sequence: TAG
caggggcacagttgtggagt

SEQ ID NO: 111472 - DNA, 20 bp, Artificial Sequence
  Description of Artificial Sequence: Synthetic oligonucleotide
  Target: ATXN1; (+) strand; PAM type: NRG; PAM sequence: AGG
aggggcacagttgtggagtt

SEQ ID NO: 111473 - DNA, 20 bp, Artificial Sequence
  Description of Artificial Sequence: Synthetic oligonucleotide
  Target: ATXN1; (+) strand; PAM type: NRG; PAM sequence: TAG
gcacagttgtggagttaggc

SEQ ID NO: 111474 - DNA, 20 bp, Artificial Sequence
  Description of Artificial Sequence: Synthetic oligonucleotide
  Target: ATXN1; (+) strand; PAM type: NRG; PAM sequence: AAG
agttgtggagttaggctaga

SEQ ID NO: 111475 - DNA, 20 bp, Artificial Sequence
  Description of Artificial Sequence: Synthetic oligonucleotide
  Target: ATXN1; (+) strand; PAM type: NRG; PAM sequence: CAG
aaagctgtgctcttaaatcc

SEQ ID NO: 111476 - DNA, 20 bp, Artificial Sequence
  Description of Artificial Sequence: Synthetic oligonucleotide
  Target: ATXN1; (+) strand; PAM type: NRG; PAM sequence: AGG
aagctgtgctcttaaatccc

SEQ ID NO: 111477 - DNA, 20 bp, Artificial Sequence
  Description of Artificial Sequence: Synthetic oligonucleotide
  Target: ATXN1; (+) strand; PAM type: NRG; PAM sequence: CAG
tgtgctcttaaatcccaggc

SEQ ID NO: 111478 - DNA, 20 bp, Artificial Sequence
  Description of Artificial Sequence: Synthetic oligonucleotide
  Target: ATXN1; (+) strand; PAM type: NRG; PAM sequence: TAG
gctcttaaatcccaggccag

SEQ ID NO: 111479 - DNA, 20 bp, Artificial Sequence
  Description of Artificial Sequence: Synthetic oligonucleotide
  Target: ATXN1; (+) strand; PAM type: NRG; PAM sequence: TAG
ggccagtagcttttcatcat

SEQ ID NO: 111480 - DNA, 20 bp, Artificial Sequence
  Description of Artificial Sequence: Synthetic oligonucleotide
  Target: ATXN1; (+) strand; PAM type: NRG; PAM sequence: TAG
cttttcatcattagactatg

SEQ ID NO: 111481 - DNA, 20 bp, Artificial Sequence
  Description of Artificial Sequence: Synthetic oligonucleotide
  Target: ATXN1; (+) strand; PAM type: NRG; PAM sequence: TAG
tcatcattagactatgtagc

SEQ ID NO: 111482 - DNA, 20 bp, Artificial Sequence
  Description of Artificial Sequence: Synthetic oligonucleotide
  Target: ATXN1; (+) strand; PAM type: NRG; PAM sequence: AAG
tcattagactatgtagctag

SEQ ID NO: 111483 - DNA, 20 bp, Artificial Sequence
  Description of Artificial Sequence: Synthetic oligonucleotide
  Target: ATXN1; (+) strand; PAM type: NRG; PAM sequence: TGG
tatgtagctagaagccccat

SEQ ID NO: 111484 - DNA, 20 bp, Artificial Sequence
  Description of Artificial Sequence: Synthetic oligonucleotide
  Target: ATXN1; (+) strand; PAM type: NRG; PAM sequence: GAG
tgtagctagaagccccattg

SEQ ID NO: 111485 - DNA, 20 bp, Artificial Sequence
  Description of Artificial Sequence: Synthetic oligonucleotide
  Target: ATXN1; (+) strand; PAM type: NRG; PAM sequence: AGG
gtagctagaagccccattgg

SEQ ID NO: 111486 - DNA, 20 bp, Artificial Sequence
  Description of Artificial Sequence: Synthetic oligonucleotide
  Target: ATXN1; (+) strand; PAM type: NRG; PAM sequence: GGG
tagctagaagccccattgga

SEQ ID NO: 111487 - DNA, 20 bp, Artificial Sequence
  Description of Artificial Sequence: Synthetic oligonucleotide
  Target: ATXN1; (+) strand; PAM type: NRG; PAM sequence: GAG
gaagccccattggagggtct

SEQ ID NO: 111488 - DNA, 20 bp, Artificial Sequence
  Description of Artificial Sequence: Synthetic oligonucleotide
  Target: ATXN1; (+) strand; PAM type: NRG; PAM sequence: CAG
ccattggagggtctgagctg

SEQ ID NO: 111489 - DNA, 20 bp, Artificial Sequence
  Description of Artificial Sequence: Synthetic oligonucleotide
  Target: ATXN1; (+) strand; PAM type: NRG; PAM sequence: CGG
gggtctgagctgcagacaca

SEQ ID NO: 111490 - DNA, 20 bp, Artificial Sequence
  Description of Artificial Sequence: Synthetic oligonucleotide
  Target: ATXN1; (+) strand; PAM type: NRG; PAM sequence: CAG
ctgcagacacacggttaacc

SEQ ID NO: 111491 - DNA, 20 bp, Artificial Sequence
  Description of Artificial Sequence: Synthetic oligonucleotide
  Target: ATXN1; (+) strand; PAM type: NRG; PAM sequence: AGG
tgcagacacacggttaaccc

SEQ ID NO: 111492 - DNA, 20 bp, Artificial Sequence
  Description of Artificial Sequence: Synthetic oligonucleotide
  Target: ATXN1; (+) strand; PAM type: NRG; PAM sequence: CAG
cacggttaacccaggcaaat

SEQ ID NO: 111493 - DNA, 20 bp, Artificial Sequence
  Description of Artificial Sequence: Synthetic oligonucleotide
  Target: ATXN1; (+) strand; PAM type: NRG; PAM sequence: AGG
acggttaacccaggcaaatc

SEQ ID NO: 111494 - DNA, 20 bp, Artificial Sequence
  Description of Artificial Sequence: Synthetic oligonucleotide
  Target: ATXN1; (+) strand; PAM type: NRG; PAM sequence: TGG
caggcaaatcaggtctcatc

SEQ ID NO: 111495 - DNA, 20 bp, Artificial Sequence
  Description of Artificial Sequence: Synthetic oligonucleotide
  Target: ATXN1; (+) strand; PAM type: NRG; PAM sequence: GGG
aggcaaatcaggtctcatct

SEQ ID NO: 111496 - DNA, 20 bp, Artificial Sequence
  Description of Artificial Sequence: Synthetic oligonucleotide
  Target: ATXN1; (+) strand; PAM type: NRG; PAM sequence: TGG
aggtctcatctgggcatctc

SEQ ID NO: 111497 - DNA, 20 bp, Artificial Sequence
  Description of Artificial Sequence: Synthetic oligonucleotide
  Target: ATXN1; (+) strand; PAM type: NRG; PAM sequence: TGG
tgggcatctctggatacgtc

SEQ ID NO: 111498 - DNA, 20 bp, Artificial Sequence
  Description of Artificial Sequence: Synthetic oligonucleotide
  Target: ATXN1; (+) strand; PAM type: NRG; PAM sequence: GGG
gggcatctctggatacgtct

SEQ ID NO: 111499 - DNA, 20 bp, Artificial Sequence
  Description of Artificial Sequence: Synthetic oligonucleotide
  Target: ATXN1; (+) strand; PAM type: NRG; PAM sequence: TGG
catctctggatacgtctggg

SEQ ID NO: 111500 - DNA, 20 bp, Artificial Sequence
  Description of Artificial Sequence: Synthetic oligonucleotide
  Target: ATXN1; (+) strand; PAM type: NRG; PAM sequence: AAG
atacgtctgggtggcctgtg

SEQ ID NO: 111501 - DNA, 20 bp, Artificial Sequence
  Description of Artificial Sequence: Synthetic oligonucleotide
  Target: ATXN1; (+) strand; PAM type: NRG; PAM sequence: TGG
cgtctgggtggcctgtgaag

SEQ ID NO: 111502 - DNA, 20 bp, Artificial Sequence
  Description of Artificial Sequence: Synthetic oligonucleotide
  Target: ATXN1; (+) strand; PAM type: NRG; PAM sequence: TGG
tgggtggcctgtgaagtgga

SEQ ID NO: 111503 - DNA, 20 bp, Artificial Sequence
  Description of Artificial Sequence: Synthetic oligonucleotide
  Target: ATXN1; (+) strand; PAM type: NRG; PAM sequence: TGG
ggatggatgttctgtttgtg

SEQ ID NO: 111504 - DNA, 20 bp, Artificial Sequence
  Description of Artificial Sequence: Synthetic oligonucleotide
  Target: ATXN1; (+) strand; PAM type: NRG; PAM sequence: GAG
atggatgttctgtttgtgtg

SEQ ID NO: 111505 - DNA, 20 bp, Artificial Sequence
  Description of Artificial Sequence: Synthetic oligonucleotide
  Target: ATXN1; (+) strand; PAM type: NRG; PAM sequence: AGG
tggatgttctgtttgtgtgg

SEQ ID NO: 111506 - DNA, 20 bp, Artificial Sequence
  Description of Artificial Sequence: Synthetic oligonucleotide
  Target: ATXN1; (+) strand; PAM type: NRG; PAM sequence: GAG
tgtgtggaggcctgtttgat

SEQ ID NO: 111507 - DNA, 20 bp, Artificial Sequence
  Description of Artificial Sequence: Synthetic oligonucleotide
  Target: ATXN1; (+) strand; PAM type: NRG; PAM sequence: TGG
ggcctgtttgatgagcctcc

SEQ ID NO: 111508 - DNA, 20 bp, Artificial Sequence
  Description of Artificial Sequence: Synthetic oligonucleotide
  Target: ATXN1; (+) strand; PAM type: NRG; PAM sequence: AAG
ctgtttgatgagcctcctgg

SEQ ID NO: 111509 - DNA, 20 bp, Artificial Sequence
  Description of Artificial Sequence: Synthetic oligonucleotide
  Target: ATXN1; (+) strand; PAM type: NRG; PAM sequence: AAG
gatgagcctcctggaagaaa

SEQ ID NO: 111510 - DNA, 20 bp, Artificial Sequence
  Description of Artificial Sequence: Synthetic oligonucleotide
  Target: ATXN1; (+) strand; PAM type: NRG; PAM sequence: CAG
cctcctggaagaaaaagaaa

SEQ ID NO: 111511 - DNA, 20 bp, Artificial Sequence
  Description of Artificial Sequence: Synthetic oligonucleotide
  Target: ATXN1; (+) strand; PAM type: NRG; PAM sequence: AGG
ctcctggaagaaaaagaaac

SEQ ID NO: 111512 - DNA, 20 bp, Artificial Sequence
  Description of Artificial Sequence: Synthetic oligonucleotide
  Target: ATXN1; (+) strand; PAM type: NRG; PAM sequence: CAG
ctggaagaaaaagaaacagg

SEQ ID NO: 111513 - DNA, 20 bp, Artificial Sequence
  Description of Artificial Sequence: Synthetic oligonucleotide
  Target: ATXN1; (+) strand; PAM type: NRG; PAM sequence: CAG
gaaaaagaaacaggcagtga

SEQ ID NO: 111514 - DNA, 20 bp, Artificial Sequence
  Description of Artificial Sequence: Synthetic oligonucleotide
  Target: ATXN1; (+) strand; PAM type: NRG; PAM sequence: AGG
aaaaagaaacaggcagtgac

SEQ ID NO: 111515 - DNA, 20 bp, Artificial Sequence
  Description of Artificial Sequence: Synthetic oligonucleotide
  Target: ATXN1; (+) strand; PAM type: NRG; PAM sequence: CAG
ggcagtgacaggaaacctgc

SEQ ID NO: 111516 - DNA, 20 bp, Artificial Sequence
  Description of Artificial Sequence: Synthetic oligonucleotide
  Target: ATXN1; (+) strand; PAM type: NRG; PAM sequence: AGG
gcagtgacaggaaacctgcc

SEQ ID NO: 111517 - DNA, 20 bp, Artificial Sequence
  Description of Artificial Sequence: Synthetic oligonucleotide
  Target: ATXN1; (+) strand; PAM type: NRG; PAM sequence: GGG
cagtgacaggaaacctgcca

SEQ ID NO: 111518 - DNA, 20 bp, Artificial Sequence
  Description of Artificial Sequence: Synthetic oligonucleotide
  Target: ATXN1; (+) strand; PAM type: NRG; PAM sequence: TGG
aggaaacctgccagggataa

SEQ ID NO: 111519 - DNA, 20 bp, Artificial Sequence
  Description of Artificial Sequence: Synthetic oligonucleotide
  Target: ATXN1; (+) strand; PAM type: NRG; PAM sequence: TGG
ccagggataatggtgccatg

SEQ ID NO: 111520 - DNA, 20 bp, Artificial Sequence
  Description of Artificial Sequence: Synthetic oligonucleotide
  Target: ATXN1; (+) strand; PAM type: NRG; PAM sequence: AAG
atggtgccatgtggtatctg

SEQ ID NO: 111521 - DNA, 20 bp, Artificial Sequence
  Description of Artificial Sequence: Synthetic oligonucleotide
  Target: ATXN1; (+) strand; PAM type: NRG; PAM sequence: CAG
gccatgtggtatctgaagtc

SEQ ID NO: 111522 - DNA, 20 bp, Artificial Sequence
  Description of Artificial Sequence: Synthetic oligonucleotide
  Target: ATXN1; (+) strand; PAM type: NRG; PAM sequence: TAG
cagtaattcttcaaccttct

SEQ ID NO: 111523 - DNA, 20 bp, Artificial Sequence
  Description of Artificial Sequence: Synthetic oligonucleotide
  Target: ATXN1; (+) strand; PAM type: NRG; PAM sequence: CAG
taattcttcaaccttcttag

SEQ ID NO: 111524 - DNA, 20 bp, Artificial Sequence
  Description of Artificial Sequence: Synthetic oligonucleotide
  Target: ATXN1; (+) strand; PAM type: NRG; PAM sequence: GAG
ttcttagcagcttgctgtgt

SEQ ID NO: 111525 - DNA, 20 bp, Artificial Sequence
  Description of Artificial Sequence: Synthetic oligonucleotide
  Target: ATXN1; (+) strand; PAM type: NRG; PAM sequence: AGG
tcttagcagcttgctgtgtg

SEQ ID NO: 111526 - DNA, 20 bp, Artificial Sequence
  Description of Artificial Sequence: Synthetic oligonucleotide
  Target: ATXN1; (+) strand; PAM type: NRG; PAM sequence: AAG
tagcagcttgctgtgtgagg

SEQ ID NO: 111527 - DNA, 20 bp, Artificial Sequence
  Description of Artificial Sequence: Synthetic oligonucleotide
  Target: ATXN1; (+) strand; PAM type: NRG; PAM sequence: AGG
agcagcttgctgtgtgagga

SEQ ID NO: 111528 - DNA, 20 bp, Artificial Sequence
  Description of Artificial Sequence: Synthetic oligonucleotide
  Target: ATXN1; (+) strand; PAM type: NRG; PAM sequence: CAG
gtgtgaggaaggaactgacc

SEQ ID NO: 111529 - DNA, 20 bp, Artificial Sequence
  Description of Artificial Sequence: Synthetic oligonucleotide
  Target: ATXN1; (+) strand; PAM type: NRG; PAM sequence: GAG
gtgaggaaggaactgaccca

SEQ ID NO: 111530 - DNA, 20 bp, Artificial Sequence
  Description of Artificial Sequence: Synthetic oligonucleotide
  Target: ATXN1; (+) strand; PAM type: NRG; PAM sequence: TGG
aggaaggaactgacccagag

SEQ ID NO: 111531 - DNA, 20 bp, Artificial Sequence
  Description of Artificial Sequence: Synthetic oligonucleotide
  Target: ATXN1; (+) strand; PAM type: NRG; PAM sequence: TGG
aggaactgacccagagtggt

SEQ ID NO: 111532 - DNA, 20 bp, Artificial Sequence
  Description of Artificial Sequence: Synthetic oligonucleotide
  Target: ATXN1; (+) strand; PAM type: NRG; PAM sequence: GGG
ggaactgacccagagtggtt

SEQ ID NO: 111533 - DNA, 20 bp, Artificial Sequence
  Description of Artificial Sequence: Synthetic oligonucleotide
  Target: ATXN1; (+) strand; PAM type: NRG; PAM sequence: AAG
tgacccagagtggttgggtt

SEQ ID NO: 111534 - DNA, 20 bp, Artificial Sequence
  Description of Artificial Sequence: Synthetic oligonucleotide
  Target: ATXN1; (+) strand; PAM type: NRG; PAM sequence: AGG
gacccagagtggttgggtta

SEQ ID NO: 111535 - DNA, 20 bp, Artificial Sequence
  Description of Artificial Sequence: Synthetic oligonucleotide
  Target: ATXN1; (+) strand; PAM type: NRG; PAM sequence: TAG
ttgggttaaggtgcatctgc

SEQ ID NO: 111536 - DNA, 20 bp, Artificial Sequence
  Description of Artificial Sequence: Synthetic oligonucleotide
  Target: ATXN1; (+) strand; PAM type: NRG; PAM sequence: AGG
tgggttaaggtgcatctgct

SEQ ID NO: 111537 - DNA, 20 bp, Artificial Sequence
  Description of Artificial Sequence: Synthetic oligonucleotide
  Target: ATXN1; (+) strand; PAM type: NRG; PAM sequence: CGG
aggtgcatctgctaggcatg

SEQ ID NO: 111538 - DNA, 20 bp, Artificial Sequence
  Description of Artificial Sequence: Synthetic oligonucleotide
  Target: ATXN1; (+) strand; PAM type: NRG; PAM sequence: GGG
ggtgcatctgctaggcatgc

SEQ ID NO: 111539 - DNA, 20 bp, Artificial Sequence
  Description of Artificial Sequence: Synthetic oligonucleotide
  Target: ATXN1; (+) strand; PAM type: NRG; PAM sequence: TGG
atctgctaggcatgcgggat

SEQ ID NO: 111540 - DNA, 20 bp, Artificial Sequence
  Description of Artificial Sequence: Synthetic oligonucleotide
  Target: ATXN1; (+) strand; PAM type: NRG; PAM sequence: GGG
tctgctaggcatgcgggatt

SEQ ID NO: 111541 - DNA, 20 bp, Artificial Sequence
  Description of Artificial Sequence: Synthetic oligonucleotide
  Target: ATXN1; (+) strand; PAM type: NRG; PAM sequence: GGG
ctgctaggcatgcgggattg

SEQ ID NO: 111542 - DNA, 20 bp, Artificial Sequence
  Description of Artificial Sequence: Synthetic oligonucleotide
  Target: ATXN1; (+) strand; PAM type: NRG; PAM sequence: GGG
tgctaggcatgcgggattgg

SEQ ID NO: 111543 - DNA, 20 bp, Artificial Sequence
  Description of Artificial Sequence: Synthetic oligonucleotide
  Target: ATXN1; (+) strand; PAM type: NRG; PAM sequence: TGG
ggcatgcgggattgggggca

SEQ ID NO: 111544 - DNA, 20 bp, Artificial Sequence
  Description of Artificial Sequence: Synthetic oligonucleotide
  Target: ATXN1; (+) strand; PAM type: NRG; PAM sequence: GGG
gcatgcgggattgggggcat

SEQ ID NO: 111545 - DNA, 20 bp, Artificial Sequence
  Description of Artificial Sequence: Synthetic oligonucleotide
  Target: ATXN1; (+) strand; PAM type: NRG; PAM sequence: GGG
catgcgggattgggggcatg

SEQ ID NO: 111546 - DNA, 20 bp, Artificial Sequence
  Description of Artificial Sequence: Synthetic oligonucleotide
  Target: ATXN1; (+) strand; PAM type: NRG; PAM sequence: GGG
atgcgggattgggggcatgg

SEQ ID NO: 111547 - DNA, 20 bp, Artificial Sequence
  Description of Artificial Sequence: Synthetic oligonucleotide
  Target: ATXN1; (+) strand; PAM type: NRG; PAM sequence: CAG
gggcatgggggtgtcaacaa

SEQ ID NO: 111548 - DNA, 20 bp, Artificial Sequence
  Description of Artificial Sequence: Synthetic oligonucleotide
  Target: ATXN1; (+) strand; PAM type: NRG; PAM sequence: AGG
ggcatgggggtgtcaacaac

SEQ ID NO: 111549 - DNA, 20 bp, Artificial Sequence
  Description of Artificial Sequence: Synthetic oligonucleotide
  Target: ATXN1; (+) strand; PAM type: NRG; PAM sequence: GGG
gcatgggggtgtcaacaaca

SEQ ID NO: 111550 - DNA, 20 bp, Artificial Sequence
  Description of Artificial Sequence: Synthetic oligonucleotide
  Target: ATXN1; (+) strand; PAM type: NRG; PAM sequence: GGG
catgggggtgtcaacaacag

SEQ ID NO: 111551 - DNA, 20 bp, Artificial Sequence
  Description of Artificial Sequence: Synthetic oligonucleotide
  Target: ATXN1; (+) strand; PAM type: NRG; PAM sequence: TAG
aacaacaggggatataacat

SEQ ID NO: 111552 - DNA, 20 bp, Artificial Sequence
  Description of Artificial Sequence: Synthetic oligonucleotide
  Target: ATXN1; (+) strand; PAM type: NRG; PAM sequence: AGG
acaacaggggatataacatt

SEQ ID NO: 111553 - DNA, 20 bp, Artificial Sequence
  Description of Artificial Sequence: Synthetic oligonucleotide
  Target: ATXN1; (+) strand; PAM type: NRG; PAM sequence: CAG
attaggaatatctaccaacc

SEQ ID NO: 111554 - DNA, 20 bp, Artificial Sequence
  Description of Artificial Sequence: Synthetic oligonucleotide
  Target: ATXN1; (+) strand; PAM type: NRG; PAM sequence: TGG
tatctaccaacccagcccct

SEQ ID NO: 111555 - DNA, 20 bp, Artificial Sequence
  Description of Artificial Sequence: Synthetic oligonucleotide
  Target: ATXN1; (+) strand; PAM type: NRG; PAM sequence: GGG
atctaccaacccagcccctt

SEQ ID NO: 111556 - DNA, 20 bp, Artificial Sequence
  Description of Artificial Sequence: Synthetic oligonucleotide
  Target: ATXN1; (+) strand; PAM type: NRG; PAM sequence: GGG
tctaccaacccagccccttg

SEQ ID NO: 111557 - DNA, 20 bp, Artificial Sequence
  Description of Artificial Sequence: Synthetic oligonucleotide
  Target: ATXN1; (+) strand; PAM type: NRG; PAM sequence: GAG
taccaacccagccccttggg

SEQ ID NO: 111558 - DNA, 20 bp, Artificial Sequence
  Description of Artificial Sequence: Synthetic oligonucleotide
  Target: ATXN1; (+) strand; PAM type: NRG; PAM sequence: AGG
accaacccagccccttgggg

SEQ ID NO: 111559 - DNA, 20 bp, Artificial Sequence
  Description of Artificial Sequence: Synthetic oligonucleotide
  Target: ATXN1; (+) strand; PAM type: NRG; PAM sequence: GGG
ccaacccagccccttgggga

SEQ ID NO: 111560 - DNA, 20 bp, Artificial Sequence
  Description of Artificial Sequence: Synthetic oligonucleotide
  Target: ATXN1; (+) strand; PAM type: NRG; PAM sequence: GGG
caacccagccccttggggag

SEQ ID NO: 111561 - DNA, 20 bp, Artificial Sequence
  Description of Artificial Sequence: Synthetic oligonucleotide
  Target: ATXN1; (+) strand; PAM type: NRG; PAM sequence: CAG
cagccccttggggaggggtg

SEQ ID NO: 111562 - DNA, 20 bp, Artificial Sequence
  Description of Artificial Sequence: Synthetic oligonucleotide
  Target: ATXN1; (+) strand; PAM type: NRG; PAM sequence: AGG
agccccttggggaggggtgc

SEQ ID NO: 111563 - DNA, 20 bp, Artificial Sequence
  Description of Artificial Sequence: Synthetic oligonucleotide
  Target: ATXN1; (+) strand; PAM type: NRG; PAM sequence: AAG
cccttggggaggggtgcagg

SEQ ID NO: 111564 - DNA, 20 bp, Artificial Sequence
  Description of Artificial Sequence: Synthetic oligonucleotide
  Target: ATXN1; (+) strand; PAM type: NRG; PAM sequence: GAG
cttggggaggggtgcaggaa

SEQ ID NO: 111565 - DNA, 20 bp, Artificial Sequence
  Description of Artificial Sequence: Synthetic oligonucleotide
  Target: ATXN1; (+) strand; PAM type: NRG; PAM sequence: TGG
aggggtgcaggaagagaccg

SEQ ID NO: 111566 - DNA, 20 bp, Artificial Sequence
  Description of Artificial Sequence: Synthetic oligonucleotide
  Target: ATXN1; (+) strand; PAM type: NRG; PAM sequence: GGG
ggggtgcaggaagagaccgt

SEQ ID NO: 111567 - DNA, 20 bp, Artificial Sequence
  Description of Artificial Sequence: Synthetic oligonucleotide
  Target: ATXN1; (+) strand; PAM type: NRG; PAM sequence: GGG
gggtgcaggaagagaccgtg

SEQ ID NO: 111568 - DNA, 20 bp, Artificial Sequence
  Description of Artificial Sequence: Synthetic oligonucleotide
  Target: ATXN1; (+) strand; PAM type: NRG; PAM sequence: AAG
gaagagaccgtggggccata

SEQ ID NO: 111569 - DNA, 20 bp, Artificial Sequence
  Description of Artificial Sequence: Synthetic oligonucleotide
  Target: ATXN1; (+) strand; PAM type: NRG; PAM sequence: GAG
cgtggggccataaagaacct

SEQ ID NO: 111570 - DNA, 20 bp, Artificial Sequence
  Description of Artificial Sequence: Synthetic oligonucleotide
  Target: ATXN1; (+) strand; PAM type: NRG; PAM sequence: AGG
gtggggccataaagaacctg

SEQ ID NO: 111571 - DNA, 20 bp, Artificial Sequence
  Description of Artificial Sequence: Synthetic oligonucleotide
  Target: ATXN1; (+) strand; PAM type: NRG; PAM sequence: TGG
cctgaggccaccatgttttg

SEQ ID NO: 111572 - DNA, 20 bp, Artificial Sequence
  Description of Artificial Sequence: Synthetic oligonucleotide
  Target: ATXN1; (+) strand; PAM type: NRG; PAM sequence: CAG
gccaccatgttttgtggtct

SEQ ID NO: 111573 - DNA, 20 bp, Artificial Sequence
  Description of Artificial Sequence: Synthetic oligonucleotide
  Target: ATXN1; (+) strand; PAM type: NRG; PAM sequence: AAG
accatgttttgtggtctcag

SEQ ID NO: 111574 - DNA, 20 bp, Artificial Sequence
  Description of Artificial Sequence: Synthetic oligonucleotide
  Target: ATXN1; (+) strand; PAM type: NRG; PAM sequence: GAG
catgttttgtggtctcagaa

SEQ ID NO: 111575 - DNA, 20 bp, Artificial Sequence
  Description of Artificial Sequence: Synthetic oligonucleotide
  Target: ATXN1; (+) strand; PAM type: NRG; PAM sequence: CAG
agaagagaactttcaccact

SEQ ID NO: 111576 - DNA, 20 bp, Artificial Sequence
  Description of Artificial Sequence: Synthetic oligonucleotide
  Target: ATXN1; (+) strand; PAM type: NRG; PAM sequence: AGG
gaagagaactttcaccactc

SEQ ID NO: 111577 - DNA, 20 bp, Artificial Sequence
  Description of Artificial Sequence: Synthetic oligonucleotide
  Target: ATXN1; (+) strand; PAM type: NRG; PAM sequence: TAG
gaactttcaccactcaggaa

SEQ ID NO: 111578 - DNA, 20 bp, Artificial Sequence
  Description of Artificial Sequence: Synthetic oligonucleotide
  Target: ATXN1; (+) strand; PAM type: NRG; PAM sequence: GAG
actttcaccactcaggaata

SEQ ID NO: 111579 - DNA, 20 bp, Artificial Sequence
  Description of Artificial Sequence: Synthetic oligonucleotide
  Target: ATXN1; (+) strand; PAM type: NRG; PAM sequence: GAG
tttcaccactcaggaataga

SEQ ID NO: 111580 - DNA, 20 bp, Artificial Sequence
  Description of Artificial Sequence: Synthetic oligonucleotide
  Target: ATXN1; (+) strand; PAM type: NRG; PAM sequence: AGG
ttcaccactcaggaatagag

SEQ ID NO: 111581 - DNA, 20 bp, Artificial Sequence
  Description of Artificial Sequence: Synthetic oligonucleotide
  Target: ATXN1; (+) strand; PAM type: NRG; PAM sequence: TGG
acacatatccctgctgtact

SEQ ID NO: 111582 - DNA, 20 bp, Artificial Sequence
  Description of Artificial Sequence: Synthetic oligonucleotide
  Target: ATXN1; (+) strand; PAM type: NRG; PAM sequence: AAG
tgtacttggcaacaaaataa

SEQ ID NO: 111583 - DNA, 20 bp, Artificial Sequence
  Description of Artificial Sequence: Synthetic oligonucleotide
  Target: ATXN1; (+) strand; PAM type: NRG; PAM sequence: AAG
acttggcaacaaaataaaag

SEQ ID NO: 111584 - DNA, 20 bp, Artificial Sequence
  Description of Artificial Sequence: Synthetic oligonucleotide
  Target: ATXN1; (+) strand; PAM type: NRG; PAM sequence: CAG
catcaaccctcatgacatca

SEQ ID NO: 111585 - DNA, 20 bp, Artificial Sequence
  Description of Artificial Sequence: Synthetic oligonucleotide
  Target: ATXN1; (+) strand; PAM type: NRG; PAM sequence: AGG
atcaaccctcatgacatcac

SEQ ID NO: 111586 - DNA, 20 bp, Artificial Sequence
  Description of Artificial Sequence: Synthetic oligonucleotide
  Target: ATXN1; (+) strand; PAM type: NRG; PAM sequence: GGG
tcaaccctcatgacatcaca

SEQ ID NO: 111587 - DNA, 20 bp, Artificial Sequence
  Description of Artificial Sequence: Synthetic oligonucleotide
  Target: ATXN1; (+) strand; PAM type: NRG; PAM sequence: CAG
accctcatgacatcacaggg

SEQ ID NO: 111588 - DNA, 20 bp, Artificial Sequence
  Description of Artificial Sequence: Synthetic oligonucleotide
  Target: ATXN1; (+) strand; PAM type: NRG; PAM sequence: CGG
atgacatcacagggcagaaa

SEQ ID NO: 111589 - DNA, 20 bp, Artificial Sequence
  Description of Artificial Sequence: Synthetic oligonucleotide
  Target: ATXN1; (+) strand; PAM type: NRG; PAM sequence: GGG
tgacatcacagggcagaaac

SEQ ID NO: 111590 - DNA, 20 bp, Artificial Sequence
  Description of Artificial Sequence: Synthetic oligonucleotide
  Target: ATXN1; (+) strand; PAM type: NRG; PAM sequence: GAG
acatcacagggcagaaacgg

SEQ ID NO: 111591 - DNA, 20 bp, Artificial Sequence
  Description of Artificial Sequence: Synthetic oligonucleotide
  Target: ATXN1; (+) strand; PAM type: NRG; PAM sequence: GAG
gggagttgataataacattc

SEQ ID NO: 111592 - DNA, 20 bp, Artificial Sequence
  Description of Artificial Sequence: Synthetic oligonucleotide
  Target: ATXN1; (+) strand; PAM type: NRG; PAM sequence: AAG
agttgataataacattcgag

SEQ ID NO: 111593 - DNA, 20 bp, Artificial Sequence
  Description of Artificial Sequence: Synthetic oligonucleotide
  Target: ATXN1; (+) strand; PAM type: NRG; PAM sequence: AGG
gttgataataacattcgaga

SEQ ID NO: 111594 - DNA, 20 bp, Artificial Sequence
  Description of Artificial Sequence: Synthetic oligonucleotide
  Target: ATXN1; (+) strand; PAM type: NRG; PAM sequence: GGG
ttgataataacattcgagaa

SEQ ID NO: 111595 - DNA, 20 bp, Artificial Sequence
  Description of Artificial Sequence: Synthetic oligonucleotide
  Target: ATXN1; (+) strand; PAM type: NRG; PAM sequence: GGG
tgataataacattcgagaag

SEQ ID NO: 111596 - DNA, 20 bp, Artificial Sequence
  Description of Artificial Sequence: Synthetic oligonucleotide
  Target: ATXN1; (+) strand; PAM type: NRG; PAM sequence: GGG
gataataacattcgagaagg

SEQ ID NO: 111597 - DNA, 20 bp, Artificial Sequence
  Description of Artificial Sequence: Synthetic oligonucleotide
  Target: ATXN1; (+) strand; PAM type: NRG; PAM sequence: TGG
taacattcgagaagggggtc

SEQ ID NO: 111598 - DNA, 20 bp, Artificial Sequence
  Description of Artificial Sequence: Synthetic oligonucleotide
  Target: ATXN1; (+) strand; PAM type: NRG; PAM sequence: GGG
aacattcgagaagggggtct

SEQ ID NO: 111599 - DNA, 20 bp, Artificial Sequence
  Description of Artificial Sequence: Synthetic oligonucleotide
  Target: ATXN1; (+) strand; PAM type: NRG; PAM sequence: GGG
acattcgagaagggggtctg

SEQ ID NO: 111600 - DNA, 20 bp, Artificial Sequence
  Description of Artificial Sequence: Synthetic oligonucleotide
  Target: ATXN1; (+) strand; PAM type: NRG; PAM sequence: CAG
tctggggccttgtgaaatct

SEQ ID NO: 111601 - DNA, 20 bp, Artificial Sequence
  Description of Artificial Sequence: Synthetic oligonucleotide
  Target: ATXN1; (+) strand; PAM type: NRG; PAM sequence: TAG
tgtctcctttaaataaacta

SEQ ID NO: 111602 - DNA, 20 bp, Artificial Sequence
  Description of Artificial Sequence: Synthetic oligonucleotide
  Target: ATXN1; (+) strand; PAM type: NRG; PAM sequence: TAG
taaactatagttattttaaa

SEQ ID NO: 111603 - DNA, 20 bp, Artificial Sequence
  Description of Artificial Sequence: Synthetic oligonucleotide
  Target: ATXN1; (+) strand; PAM type: NRG; PAM sequence: TGG
actatagttattttaaatag

SEQ ID NO: 111604 - DNA, 20 bp, Artificial Sequence
  Description of Artificial Sequence: Synthetic oligonucleotide
  Target: ATXN1; (+) strand; PAM type: NRG; PAM sequence: AAG
tttaaatagtggcctcacca

SEQ ID NO: 111605 - DNA, 20 bp, Artificial Sequence
  Description of Artificial Sequence: Synthetic oligonucleotide
  Target: ATXN1; (+) strand; PAM type: NRG; PAM sequence: AAG
tctatatccattccattatt

SEQ ID NO: 111606 - DNA, 20 bp, Artificial Sequence
  Description of Artificial Sequence: Synthetic oligonucleotide
  Target: ATXN1; (+) strand; PAM type: NRG; PAM sequence: AAG
ttccattattaagtatgtta

SEQ ID NO: 111607 - DNA, 20 bp, Artificial Sequence
  Description of Artificial Sequence: Synthetic oligonucleotide
  Target: ATXN1; (+) strand; PAM type: NRG; PAM sequence: AAG
cattattaagtatgttaaag

SEQ ID NO: 111608 - DNA, 20 bp, Artificial Sequence
  Description of Artificial Sequence: Synthetic oligonucleotide
  Target: ATXN1; (+) strand; PAM type: NRG; PAM sequence: AAG
cttaaatactttccttcatc

SEQ ID NO: 111609 - DNA, 20 bp, Artificial Sequence
  Description of Artificial Sequence: Synthetic oligonucleotide
  Target: ATXN1; (+) strand; PAM type: NRG; PAM sequence: GAG
aatactttccttcatcaagt

SEQ ID NO: 111610 - DNA, 20 bp, Artificial Sequence
  Description of Artificial Sequence: Synthetic oligonucleotide
  Target: ATXN1; (+) strand; PAM type: NRG; PAM sequence: TGG
ccttcatcaagtgagaaccc

SEQ ID NO: 111611 - DNA, 20 bp, Artificial Sequence
  Description of Artificial Sequence: Synthetic oligonucleotide
  Target: ATXN1; (+) strand; PAM type: NRG; PAM sequence: AAG
tcatcaagtgagaaccctgg

SEQ ID NO: 111612 - DNA, 20 bp, Artificial Sequence
  Description of Artificial Sequence: Synthetic oligonucleotide
  Target: ATXN1; (+) strand; PAM type: NRG; PAM sequence: AAG
tcaagtgagaaccctggaag

SEQ ID NO: 111613 - DNA, 20 bp, Artificial Sequence
  Description of Artificial Sequence: Synthetic oligonucleotide
  Target: ATXN1; (+) strand; PAM type: NRG; PAM sequence: GAG
tgagaaccctggaagaagat

SEQ ID NO: 111614 - DNA, 20 bp, Artificial Sequence
  Description of Artificial Sequence: Synthetic oligonucleotide
  Target: ATXN1; (+) strand; PAM type: NRG; PAM sequence: GAG
ccctggaagaagatgagaat

SEQ ID NO: 111615 - DNA, 20 bp, Artificial Sequence
  Description of Artificial Sequence: Synthetic oligonucleotide
  Target: ATXN1; (+) strand; PAM type: NRG; PAM sequence: AGG
cctggaagaagatgagaatg

SEQ ID NO: 111616 - DNA, 20 bp, Artificial Sequence
  Description of Artificial Sequence: Synthetic oligonucleotide
  Target: ATXN1; (+) strand; PAM type: NRG; PAM sequence: GAG
atgagaatgaggaacatgat

SEQ ID NO: 111617 - DNA, 20 bp, Artificial Sequence
  Description of Artificial Sequence: Synthetic oligonucleotide
  Target: ATXN1; (+) strand; PAM type: NRG; PAM sequence: AGG
tgagaatgaggaacatgatg

SEQ ID NO: 111618 - DNA, 20 bp, Artificial Sequence
  Description of Artificial Sequence: Synthetic oligonucleotide
  Target: ATXN1; (+) strand; PAM type: NRG; PAM sequence: TGG
aatgaggaacatgatgagga

SEQ ID NO: 111619 - DNA, 20 bp, Artificial Sequence
  Description of Artificial Sequence: Synthetic oligonucleotide
  Target: ATXN1; (+) strand; PAM type: NRG; PAM sequence: AAG
gatggtaaaaaaaaaaaaaa

SEQ ID NO: 111620 - DNA, 20 bp, Artificial Sequence
  Description of Artificial Sequence: Synthetic oligonucleotide
  Target: ATXN1; (+) strand; PAM type: NRG; PAM sequence: CAG
aaaaaaaaaaaaaaagttaa

SEQ ID NO: 111621 - DNA, 20 bp, Artificial Sequence
  Description of Artificial Sequence: Synthetic oligonucleotide
  Target: ATXN1; (+) strand; PAM type: NRG; PAM sequence: CAG
aaaaaaagttaacagtaact

SEQ ID NO: 111622 - DNA, 20 bp, Artificial Sequence
  Description of Artificial Sequence: Synthetic oligonucleotide
  Target: ATXN1; (+) strand; PAM type: NRG; PAM sequence: AGG
aaaaaagttaacagtaactc

SEQ ID NO: 111623 - DNA, 20 bp, Artificial Sequence
  Description of Artificial Sequence: Synthetic oligonucleotide
  Target: ATXN1; (+) strand; PAM type: NRG; PAM sequence: CAG
aactcaggcctatcatctga

SEQ ID NO: 111624 - DNA, 20 bp, Artificial Sequence
  Description of Artificial Sequence: Synthetic oligonucleotide
  Target: ATXN1; (+) strand; PAM type: NRG; PAM sequence: AGG
actcaggcctatcatctgac

SEQ ID NO: 111625 - DNA, 20 bp, Artificial Sequence
  Description of Artificial Sequence: Synthetic oligonucleotide
  Target: ATXN1; (+) strand; PAM type: NRG; PAM sequence: AAG
cctatcatctgacaggcact

SEQ ID NO: 111626 - DNA, 20 bp, Artificial Sequence
  Description of Artificial Sequence: Synthetic oligonucleotide
  Target: ATXN1; (+) strand; PAM type: NRG; PAM sequence: CAG
tttgtcacttacaacctttt

SEQ ID NO: 111627 - DNA, 20 bp, Artificial Sequence
  Description of Artificial Sequence: Synthetic oligonucleotide
  Target: ATXN1; (+) strand; PAM type: NRG; PAM sequence: AGG
ttgtcacttacaaccttttc

SEQ ID NO: 111628 - DNA, 20 bp, Artificial Sequence
  Description of Artificial Sequence: Synthetic oligonucleotide
  Target: ATXN1; (+) strand; PAM type: NRG; PAM sequence: GGG
tgtcacttacaaccttttca

SEQ ID NO: 111629 - DNA, 20 bp, Artificial Sequence
  Description of Artificial Sequence: Synthetic oligonucleotide
  Target: ATXN1; (+) strand; PAM type: NRG; PAM sequence: AAG
cttttcagggttttaatgat

SEQ ID NO: 111630 - DNA, 20 bp, Artificial Sequence
  Description of Artificial Sequence: Synthetic oligonucleotide
  Target: ATXN1; (+) strand; PAM type: NRG; PAM sequence: AGG
ttttcagggttttaatgata

SEQ ID NO: 111631 - DNA, 20 bp, Artificial Sequence
  Description of Artificial Sequence: Synthetic oligonucleotide
  Target: ATXN1; (+) strand; PAM type: NRG; PAM sequence: AAG
cagggttttaatgataagga

SEQ ID NO: 111632 - DNA, 20 bp, Artificial Sequence
  Description of Artificial Sequence: Synthetic oligonucleotide
  Target: ATXN1; (+) strand; PAM type: NRG; PAM sequence: AAG
gttttaatgataaggaaagt

SEQ ID NO: 111633 - DNA, 20 bp, Artificial Sequence
  Description of Artificial Sequence: Synthetic oligonucleotide
  Target: ATXN1; (+) strand; PAM type: NRG; PAM sequence: AGG
ttttaatgataaggaaagta

SEQ ID NO: 111634 - DNA, 20 bp, Artificial Sequence
  Description of Artificial Sequence: Synthetic oligonucleotide
  Target: ATXN1; (+) strand; PAM type: NRG; PAM sequence: TGG
taaggaaagtaaggataatg

SEQ ID NO: 111635 - DNA, 20 bp, Artificial Sequence
  Description of Artificial Sequence: Synthetic oligonucleotide
  Target: ATXN1; (+) strand; PAM type: NRG; PAM sequence: AAG
tttattttctcacaactaat

SEQ ID NO: 111636 - DNA, 20 bp, Artificial Sequence
  Description of Artificial Sequence: Synthetic oligonucleotide
  Target: ATXN1; (+) strand; PAM type: NRG; PAM sequence: TAG
attttctcacaactaataag

SEQ ID NO: 111637 - DNA, 20 bp, Artificial Sequence
  Description of Artificial Sequence: Synthetic oligonucleotide
  Target: ATXN1; (+) strand; PAM type: NRG; PAM sequence: AAG
tcacaactaataagtagctg

SEQ ID NO: 111638 - DNA, 20 bp, Artificial Sequence
  Description of Artificial Sequence: Synthetic oligonucleotide
  Target: ATXN1; (+) strand; PAM type: NRG; PAM sequence: TAG
caactaataagtagctgaag

SEQ ID NO: 111639 - DNA, 20 bp, Artificial Sequence
  Description of Artificial Sequence: Synthetic oligonucleotide
  Target: ATXN1; (+) strand; PAM type: NRG; PAM sequence: AAG
ctgaagtagaacttgaaccc

SEQ ID NO: 111640 - DNA, 20 bp, Artificial Sequence
  Description of Artificial Sequence: Synthetic oligonucleotide
  Target: ATXN1; (+) strand; PAM type: NRG; PAM sequence: TAG
attttaaaaaacctgttttt

SEQ ID NO: 111641 - DNA, 20 bp, Artificial Sequence
  Description of Artificial Sequence: Synthetic oligonucleotide
  Target: ATXN1; (+) strand; PAM type: NRG; PAM sequence: GAG
tttaaaaaacctgtttttta

SEQ ID NO: 111642 - DNA, 20 bp, Artificial Sequence
  Description of Artificial Sequence: Synthetic oligonucleotide
  Target: ATXN1; (+) strand; PAM type: NRG; PAM sequence: GAG
aaaacctgttttttagagtt

SEQ ID NO: 111643 - DNA, 20 bp, Artificial Sequence
  Description of Artificial Sequence: Synthetic oligonucleotide
  Target: ATXN1; (+) strand; PAM type: NRG; PAM sequence: AGG
aaacctgttttttagagttg

SEQ ID NO: 111644 - DNA, 20 bp, Artificial Sequence
  Description of Artificial Sequence: Synthetic oligonucleotide
  Target: ATXN1; (+) strand; PAM type: NRG; PAM sequence: CAG
gagttgaggtctctgtcatc

SEQ ID NO: 111645 - DNA, 20 bp, Artificial Sequence
  Description of Artificial Sequence: Synthetic oligonucleotide
  Target: ATXN1; (+) strand; PAM type: NRG; PAM sequence: AGG
agttgaggtctctgtcatcc

SEQ ID NO: 111646 - DNA, 20 bp, Artificial Sequence
  Description of Artificial Sequence: Synthetic oligonucleotide
  Target: ATXN1; (+) strand; PAM type: NRG; PAM sequence: TGG
gaggtctctgtcatccaggc

SEQ ID NO: 111647 - DNA, 20 bp, Artificial Sequence
  Description of Artificial Sequence: Synthetic oligonucleotide
  Target: ATXN1; (+) strand; PAM type: NRG; PAM sequence: GAG
ggtctctgtcatccaggctg

SEQ ID NO: 111648 - DNA, 20 bp, Artificial Sequence
  Description of Artificial Sequence: Synthetic oligonucleotide
  Target: ATXN1; (+) strand; PAM type: NRG; PAM sequence: AGG
gtctctgtcatccaggctgg

SEQ ID NO: 111649 - DNA, 20 bp, Artificial Sequence
  Description of Artificial Sequence: Synthetic oligonucleotide
  Target: ATXN1; (+) strand; PAM type: NRG; PAM sequence: GGG
tctctgtcatccaggctgga

SEQ ID NO: 111650 - DNA, 20 bp, Artificial Sequence
  Description of Artificial Sequence: Synthetic oligonucleotide
  Target: ATXN1; (+) strand; PAM type: NRG; PAM sequence: TAG
ctgtcatccaggctggaggg

SEQ ID NO: 111651 - DNA, 20 bp, Artificial Sequence
  Description of Artificial Sequence: Synthetic oligonucleotide
  Target: ATXN1; (+) strand; PAM type: NRG; PAM sequence: TGG
tcatccaggctggagggtag

SEQ ID NO: 111652 - DNA, 20 bp, Artificial Sequence
  Description of Artificial Sequence: Synthetic oligonucleotide
  Target: ATXN1; (+) strand; PAM type: NRG; PAM sequence: TAG
ggagggtagtggcatgttct

SEQ ID NO: 111653 - DNA, 20 bp, Artificial Sequence
  Description of Artificial Sequence: Synthetic oligonucleotide
  Target: ATXN1; (+) strand; PAM type: NRG; PAM sequence: CAG
ggcatgttcttagctcactg

SEQ ID NO: 111654 - DNA, 20 bp, Artificial Sequence
  Description of Artificial Sequence: Synthetic oligonucleotide
  Target: ATXN1; (+) strand; PAM type: NRG; PAM sequence: TGG
tcactgcagcctcaatctcc

SEQ ID NO: 111655 - DNA, 20 bp, Artificial Sequence
  Description of Artificial Sequence: Synthetic oligonucleotide
  Target: ATXN1; (+) strand; PAM type: NRG; PAM sequence: GGG
cactgcagcctcaatctcct

SEQ ID NO: 111656 - DNA, 20 bp, Artificial Sequence
  Description of Artificial Sequence: Synthetic oligonucleotide
  Target: ATXN1; (+) strand; PAM type: NRG; PAM sequence: AAG
agcctcaatctcctgggttc

SEQ ID NO: 111657 - DNA, 20 bp, Artificial Sequence
  Description of Artificial Sequence: Synthetic oligonucleotide
  Target: ATXN1; (+) strand; PAM type: NRG; PAM sequence: CAG
ttcaagcgatcctcctgtct

SEQ ID NO: 111658 - DNA, 20 bp, Artificial Sequence
  Description of Artificial Sequence: Synthetic oligonucleotide
  Target: ATXN1; (+) strand; PAM type: NRG; PAM sequence: GAG
tcctcctgtctcagtctgct

SEQ ID NO: 111659 - DNA, 20 bp, Artificial Sequence
  Description of Artificial Sequence: Synthetic oligonucleotide
  Target: ATXN1; (+) strand; PAM type: NRG; PAM sequence: TAG
tcctgtctcagtctgctgag

SEQ ID NO: 111660 - DNA, 20 bp, Artificial Sequence
  Description of Artificial Sequence: Synthetic oligonucleotide
  Target: ATXN1; (+) strand; PAM type: NRG; PAM sequence: TGG
gtctcagtctgctgagtagc

SEQ ID NO: 111661 - DNA, 20 bp, Artificial Sequence
  Description of Artificial Sequence: Synthetic oligonucleotide
  Target: ATXN1; (+) strand; PAM type: NRG; PAM sequence: GGG
tctcagtctgctgagtagct

SEQ ID NO: 111662 - DNA, 20 bp, Artificial Sequence
  Description of Artificial Sequence: Synthetic oligonucleotide
  Target: ATXN1; (+) strand; PAM type: NRG; PAM sequence: TGG
gctgagtagctgggactaca

SEQ ID NO: 111663 - DNA, 20 bp, Artificial Sequence
  Description of Artificial Sequence: Synthetic oligonucleotide
  Target: ATXN1; (+) strand; PAM type: NRG; PAM sequence: GAG
gtagctgggactacatggat

SEQ ID NO: 111664 - DNA, 20 bp, Artificial Sequence
  Description of Artificial Sequence: Synthetic oligonucleotide
  Target: ATXN1; (+) strand; PAM type: NRG; PAM sequence: TGG
ccaaaatttaattcttacct

SEQ ID NO: 111665 - DNA, 20 bp, Artificial Sequence
  Description of Artificial Sequence: Synthetic oligonucleotide
  Target: ATXN1; (+) strand; PAM type: NRG; PAM sequence: AAG
taattcttaccttggcaccc

SEQ ID NO: 111666 - DNA, 20 bp, Artificial Sequence
  Description of Artificial Sequence: Synthetic oligonucleotide
  Target: ATXN1; (+) strand; PAM type: NRG; PAM sequence: GAG
attcttaccttggcacccaa

SEQ ID NO: 111667 - DNA, 20 bp, Artificial Sequence
  Description of Artificial Sequence: Synthetic oligonucleotide
  Target: ATXN1; (+) strand; PAM type: NRG; PAM sequence: AGG
ttcttaccttggcacccaag

SEQ ID NO: 111668 - DNA, 20 bp, Artificial Sequence
  Description of Artificial Sequence: Synthetic oligonucleotide
  Target: ATXN1; (+) strand; PAM type: NRG; PAM sequence: GGG
tcttaccttggcacccaaga

SEQ ID NO: 111669 - DNA, 20 bp, Artificial Sequence
  Description of Artificial Sequence: Synthetic oligonucleotide
  Target: ATXN1; (+) strand; PAM type: NRG; PAM sequence: TGG
ttggcacccaagagggtgtt

SEQ ID NO: 111670 - DNA, 20 bp, Artificial Sequence
  Description of Artificial Sequence: Synthetic oligonucleotide
  Target: ATXN1; (+) strand; PAM type: NRG; PAM sequence: CAG
ccaagagggtgtttggcaca

SEQ ID NO: 111671 - DNA, 20 bp, Artificial Sequence
  Description of Artificial Sequence: Synthetic oligonucleotide
  Target: ATXN1; (+) strand; PAM type: NRG; PAM sequence: TAG
agagggtgtttggcacacag

SEQ ID NO: 111672 - DNA, 20 bp, Artificial Sequence
  Description of Artificial Sequence: Synthetic oligonucleotide
  Target: ATXN1; (+) strand; PAM type: NRG; PAM sequence: AGG
gagggtgtttggcacacagt

SEQ ID NO: 111673 - DNA, 20 bp, Artificial Sequence
  Description of Artificial Sequence: Synthetic oligonucleotide
  Target: ATXN1; (+) strand; PAM type: NRG; PAM sequence: TGG
agtaggtgcttcataaaaat

SEQ ID NO: 111674 - DNA, 20 bp, Artificial Sequence
  Description of Artificial Sequence: Synthetic oligonucleotide
  Target: ATXN1; (+) strand; PAM type: NRG; PAM sequence: AAG
ttggtgactgaacaaataaa

SEQ ID NO: 111675 - DNA, 20 bp, Artificial Sequence
  Description of Artificial Sequence: Synthetic oligonucleotide
  Target: ATXN1; (+) strand; PAM type: NRG; PAM sequence: TGG
gaacaaataaaaagaataca

SEQ ID NO: 111676 - DNA, 20 bp, Artificial Sequence
  Description of Artificial Sequence: Synthetic oligonucleotide
  Target: ATXN1; (+) strand; PAM type: NRG; PAM sequence: GGG
aacaaataaaaagaatacat

SEQ ID NO: 111677 - DNA, 20 bp, Artificial Sequence
  Description of Artificial Sequence: Synthetic oligonucleotide
  Target: ATXN1; (+) strand; PAM type: NRG; PAM sequence: AAG
aaaaagaatacatgggttct

SEQ ID NO: 111678 - DNA, 20 bp, Artificial Sequence
  Description of Artificial Sequence: Synthetic oligonucleotide
  Target: ATXN1; (+) strand; PAM type: NRG; PAM sequence: AGG
aaaagaatacatgggttcta

SEQ ID NO: 111679 - DNA, 20 bp, Artificial Sequence
  Description of Artificial Sequence: Synthetic oligonucleotide
  Target: ATXN1; (+) strand; PAM type: NRG; PAM sequence: TAG
aatacatgggttctaaggtt

SEQ ID NO: 111680 - DNA, 20 bp, Artificial Sequence
  Description of Artificial Sequence: Synthetic oligonucleotide
  Target: ATXN1; (+) strand; PAM type: NRG; PAM sequence: TGG
ctaaggtttagtcaatcaaa

SEQ ID NO: 111681 - DNA, 20 bp, Artificial Sequence
  Description of Artificial Sequence: Synthetic oligonucleotide
  Target: ATXN1; (+) strand; PAM type: NRG; PAM sequence: GAG
agtcaatcaaatggtgcaat

SEQ ID NO: 111682 - DNA, 20 bp, Artificial Sequence
  Description of Artificial Sequence: Synthetic oligonucleotide
  Target: ATXN1; (+) strand; PAM type: NRG; PAM sequence: TGG
gcctcattcttcacctaaac

SEQ ID NO: 111683 - DNA, 20 bp, Artificial Sequence
  Description of Artificial Sequence: Synthetic oligonucleotide
  Target: ATXN1; (+) strand; PAM type: NRG; PAM sequence: AAG
attcttcacctaaactggtt

SEQ ID NO: 111684 - DNA, 20 bp, Artificial Sequence
  Description of Artificial Sequence: Synthetic oligonucleotide
  Target: ATXN1; (+) strand; PAM type: NRG; PAM sequence: CAG
taaactggttaagtatacct

SEQ ID NO: 111685 - DNA, 20 bp, Artificial Sequence
  Description of Artificial Sequence: Synthetic oligonucleotide
  Target: ATXN1; (+) strand; PAM type: NRG; PAM sequence: TAG
acctcagtcatttaacctaa

SEQ ID NO: 111686 - DNA, 20 bp, Artificial Sequence
  Description of Artificial Sequence: Synthetic oligonucleotide
  Target: ATXN1; (+) strand; PAM type: NRG; PAM sequence: CAG
gtcatttaacctaatagaaa

SEQ ID NO: 111687 - DNA, 20 bp, Artificial Sequence
  Description of Artificial Sequence: Synthetic oligonucleotide
  Target: ATXN1; (+) strand; PAM type: NRG; PAM sequence: CAG
attataatcaaataatgtca

SEQ ID NO: 111688 - DNA, 20 bp, Artificial Sequence
  Description of Artificial Sequence: Synthetic oligonucleotide
  Target: ATXN1; (+) strand; PAM type: NRG; PAM sequence: AGG
ttataatcaaataatgtcac

SEQ ID NO: 111689 - DNA, 20 bp, Artificial Sequence
  Description of Artificial Sequence: Synthetic oligonucleotide
  Target: ATXN1; (+) strand; PAM type: NRG; PAM sequence: AAG
caggatcgatatttcctgct

SEQ ID NO: 111690 - DNA, 20 bp, Artificial Sequence
  Description of Artificial Sequence: Synthetic oligonucleotide
  Target: ATXN1; (+) strand; PAM type: NRG; PAM sequence: AGG
aggatcgatatttcctgcta

SEQ ID NO: 111691 - DNA, 20 bp, Artificial Sequence
  Description of Artificial Sequence: Synthetic oligonucleotide
  Target: ATXN1; (+) strand; PAM type: NRG; PAM sequence: CGG
ctgctaaggaataaatgact

SEQ ID NO: 111692 - DNA, 20 bp, Artificial Sequence
  Description of Artificial Sequence: Synthetic oligonucleotide
  Target: ATXN1; (+) strand; PAM type: NRG; PAM sequence: CAG
tttattttctaaaacttact

SEQ ID NO: 111693 - DNA, 20 bp, Artificial Sequence
  Description of Artificial Sequence: Synthetic oligonucleotide
  Target: ATXN1; (+) strand; PAM type: NRG; PAM sequence: CAG
ttgccccgatatttatacat

SEQ ID NO: 111694 - DNA, 20 bp, Artificial Sequence
  Description of Artificial Sequence: Synthetic oligonucleotide
  Target: ATXN1; (+) strand; PAM type: NRG; PAM sequence: CAG
ccccgatatttatacatcag

SEQ ID NO: 111695 - DNA, 20 bp, Artificial Sequence
  Description of Artificial Sequence: Synthetic oligonucleotide
  Target: ATXN1; (+) strand; PAM type: NRG; PAM sequence: AGG
cccgatatttatacatcagc

SEQ ID NO: 111696 - DNA, 20 bp, Artificial Sequence
  Description of Artificial Sequence: Synthetic oligonucleotide
  Target: ATXN1; (+) strand; PAM type: NRG; PAM sequence: GAG
cgatatttatacatcagcag

SEQ ID NO: 111697 - DNA, 20 bp, Artificial Sequence
  Description of Artificial Sequence: Synthetic oligonucleotide
  Target: ATXN1; (+) strand; PAM type: NRG; PAM sequence: TGG
atttatacatcagcaggaga

SEQ ID NO: 111698 - DNA, 20 bp, Artificial Sequence
  Description of Artificial Sequence: Synthetic oligonucleotide
  Target: ATXN1; (+) strand; PAM type: NRG; PAM sequence: GAG
cagcaggagatggttacccc

SEQ ID NO: 111699 - DNA, 20 bp, Artificial Sequence
  Description of Artificial Sequence: Synthetic oligonucleotide
  Target: ATXN1; (+) strand; PAM type: NRG; PAM sequence: AAG
caggagatggttaccccgag

SEQ ID NO: 111700 - DNA, 20 bp, Artificial Sequence
  Description of Artificial Sequence: Synthetic oligonucleotide
  Target: ATXN1; (+) strand; PAM type: NRG; PAM sequence: TAG
tctgttccacacaattgcct

SEQ ID NO: 111701 - DNA, 20 bp, Artificial Sequence
  Description of Artificial Sequence: Synthetic oligonucleotide
  Target: ATXN1; (+) strand; PAM type: NRG; PAM sequence: CAG
aaactaaaaaaaaaaaacca

SEQ ID NO: 111702 - DNA, 20 bp, Artificial Sequence
  Description of Artificial Sequence: Synthetic oligonucleotide
  Target: ATXN1; (+) strand; PAM type: NRG; PAM sequence: TAG
aaaaaaaaccacagtaactg

SEQ ID NO: 111703 - DNA, 20 bp, Artificial Sequence
  Description of Artificial Sequence: Synthetic oligonucleotide
  Target: ATXN1; (+) strand; PAM type: NRG; PAM sequence: GAG
acagtaactgtagttgttat

SEQ ID NO: 111704 - DNA, 20 bp, Artificial Sequence
  Description of Artificial Sequence: Synthetic oligonucleotide
  Target: ATXN1; (+) strand; PAM type: NRG; PAM sequence: AAG
gttatgagcaccaacatttt

SEQ ID NO: 111705 - DNA, 20 bp, Artificial Sequence
  Description of Artificial Sequence: Synthetic oligonucleotide
  Target: ATXN1; (+) strand; PAM type: NRG; PAM sequence: TGG
taattaaaaatttgacttgc

SEQ ID NO: 111706 - DNA, 20 bp, Artificial Sequence
  Description of Artificial Sequence: Synthetic oligonucleotide
  Target: ATXN1; (+) strand; PAM type: NRG; PAM sequence: CAG
taaaaatttgacttgctggc

SEQ ID NO: 111707 - DNA, 20 bp, Artificial Sequence
  Description of Artificial Sequence: Synthetic oligonucleotide
  Target: ATXN1; (+) strand; PAM type: NRG; PAM sequence: AGG
aaaaatttgacttgctggcc

SEQ ID NO: 111708 - DNA, 20 bp, Artificial Sequence
  Description of Artificial Sequence: Synthetic oligonucleotide
  Target: ATXN1; (+) strand; PAM type: NRG; PAM sequence: TGG
gacttgctggccaggcaccg

SEQ ID NO: 111709 - DNA, 20 bp, Artificial Sequence
  Description of Artificial Sequence: Synthetic oligonucleotide
  Target: ATXN1; (+) strand; PAM type: NRG; PAM sequence: AAG
gtggctcatgcctctaatca

SEQ ID NO: 111710 - DNA, 20 bp, Artificial Sequence
  Description of Artificial Sequence: Synthetic oligonucleotide
  Target: ATXN1; (+) strand; PAM type: NRG; PAM sequence: TGG
tgcctctaatcaaagcactt

SEQ ID NO: 111711 - DNA, 20 bp, Artificial Sequence
  Description of Artificial Sequence: Synthetic oligonucleotide
  Target: ATXN1; (+) strand; PAM type: NRG; PAM sequence: GGG
gcctctaatcaaagcacttt

SEQ ID NO: 111712 - DNA, 20 bp, Artificial Sequence
  Description of Artificial Sequence: Synthetic oligonucleotide
  Target: ATXN1; (+) strand; PAM type: NRG; PAM sequence: GAG
ctctaatcaaagcactttgg

SEQ ID NO: 111713 - DNA, 20 bp, Artificial Sequence
  Description of Artificial Sequence: Synthetic oligonucleotide
  Target: ATXN1; (+) strand; PAM type: NRG; PAM sequence: AGG
tctaatcaaagcactttggg

SEQ ID NO: 111714 - DNA, 20 bp, Artificial Sequence
  Description of Artificial Sequence: Synthetic oligonucleotide
  Target: ATXN1; (+) strand; PAM type: NRG; PAM sequence: CAG
aatcaaagcactttgggagg

SEQ ID NO: 111715 - DNA, 20 bp, Artificial Sequence
  Description of Artificial Sequence: Synthetic oligonucleotide
  Target: ATXN1; (+) strand; PAM type: NRG; PAM sequence: GAG
tcaaagcactttgggaggca

SEQ ID NO: 111716 - DNA, 20 bp, Artificial Sequence
  Description of Artificial Sequence: Synthetic oligonucleotide
  Target: ATXN1; (+) strand; PAM type: NRG; PAM sequence: AGG
caaagcactttgggaggcag

SEQ ID NO: 111717 - DNA, 20 bp, Artificial Sequence
  Description of Artificial Sequence: Synthetic oligonucleotide
  Target: ATXN1; (+) strand; PAM type: NRG; PAM sequence: CAG
agcactttgggaggcagagg

SEQ ID NO: 111718 - DNA, 20 bp, Artificial Sequence
  Description of Artificial Sequence: Synthetic oligonucleotide
  Target: ATXN1; (+) strand; PAM type: NRG; PAM sequence: AGG
gcactttgggaggcagaggc

SEQ ID NO: 111719 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggcagaggcagg

SEQ ID NO: 111720 - DNA, 20 bp, Artificial Sequence
  Description of Artificial Sequence: Synthetic oligonucleotide
  Target: ATXN1; (+) strand; PAM type: NRG; PAM sequence: AAG
cagaggcaggtggatcactt

SEQ ID NO: 111721 - DNA, 20 bp, Artificial Sequence
  Description of Artificial Sequence: Synthetic oligonucleotide
  Target: ATXN1; (+) strand; PAM type: NRG; PAM sequence: AGG
agaggcaggtggatcactta

SEQ ID NO: 111722 - DNA, 20 bp, Artificial Sequence
  Description of Artificial Sequence: Synthetic oligonucleotide
  Target: ATXN1; (+) strand; PAM type: NRG; PAM sequence: CAG
gcaggtggatcacttaaggt

SEQ ID NO: 111723 - DNA, 20 bp, Artificial Sequence
  Description of Artificial Sequence: Synthetic oligonucleotide
  Target: ATXN1; (+) strand; PAM type: NRG; PAM sequence: AGG
caggtggatcacttaaggtc

SEQ ID NO: 111724 - DNA, 20 bp, Artificial Sequence
  Description of Artificial Sequence: Synthetic oligonucleotide
  Target: ATXN1; (+) strand; PAM type: NRG; PAM sequence: GAG
ggtggatcacttaaggtcag

SEQ ID NO: 111725 - DNA, 20 bp, Artificial Sequence
  Description of Artificial Sequence: Synthetic oligonucleotide
  Target: ATXN1; (+) strand; PAM type: NRG; PAM sequence: AAG
tcacttaaggtcaggagttc

SEQ ID NO: 111726 - DNA, 20 bp, Artificial Sequence
  Description of Artificial Sequence: Synthetic oligonucleotide
  Target: ATXN1; (+) strand; PAM type: NRG; PAM sequence: CAG
taaggtcaggagttcaagac

SEQ ID NO: 111727 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcaagaccagcc

SEQ ID NO: 111728 - DNA, 20 bp, Artificial Sequence
  Description of Artificial Sequence: Synthetic oligonucleotide
  Target: ATXN1; (+) strand; PAM type: NRG; PAM sequence: TAG
caagaccagcctggccaaca

SEQ ID NO: 111729 - DNA, 20 bp, Artificial Sequence
  Description of Artificial Sequence: Synthetic oligonucleotide
  Target: ATXN1; (+) strand; PAM type: NRG; PAM sequence: TGG
taaaaatacaaaaattaacc

SEQ ID NO: 111730 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattaacctggcg

SEQ ID NO: 111731 - DNA, 20 bp, Artificial Sequence
  Description of Artificial Sequence: Synthetic oligonucleotide
  Target: ATXN1; (+) strand; PAM type: NRG; PAM sequence: TGG
caaaaattaacctggcgtgg

SEQ ID NO: 111732 - DNA, 20 bp, Artificial Sequence
  Description of Artificial Sequence: Synthetic oligonucleotide
  Target: ATXN1; (+) strand; PAM type: NRG; PAM sequence: TAG
ggcgtggtggctcacgcctg

SEQ ID NO: 111733 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctgtagtct

SEQ ID NO: 111734 - DNA, 20 bp, Artificial Sequence
  Description of Artificial Sequence: Synthetic oligonucleotide
  Target: ATXN1; (+) strand; PAM type: NRG; PAM sequence: CGG
cgcctgtagtctcagctact

SEQ ID NO: 111735 - DNA, 20 bp, Artificial Sequence
  Description of Artificial Sequence: Synthetic oligonucleotide
  Target: ATXN1; (+) strand; PAM type: NRG; PAM sequence: GGG
gcctgtagtctcagctactc

SEQ ID NO: 111736 - DNA, 20 bp, Artificial Sequence
  Description of Artificial Sequence: Synthetic oligonucleotide
  Target: ATXN1; (+) strand; PAM type: NRG; PAM sequence: GAG
ctgtagtctcagctactcgg

SEQ ID NO: 111737 - DNA, 20 bp, Artificial Sequence
  Description of Artificial Sequence: Synthetic oligonucleotide
  Target: ATXN1; (+) strand; PAM type: NRG; PAM sequence: AGG
tgtagtctcagctactcggg

SEQ ID NO: 111738 - DNA, 20 bp, Artificial Sequence
  Description of Artificial Sequence: Synthetic oligonucleotide
  Target: ATXN1; (+) strand; PAM type: NRG; PAM sequence: GAG
tctcagctactcgggaggct

SEQ ID NO: 111739 - DNA, 20 bp, Artificial Sequence
  Description of Artificial Sequence: Synthetic oligonucleotide
  Target: ATXN1; (+) strand; PAM type: NRG; PAM sequence: AGG
ctcagctactcgggaggctg

SEQ ID NO: 111740 - DNA, 20 bp, Artificial Sequence
  Description of Artificial Sequence: Synthetic oligonucleotide
  Target: ATXN1; (+) strand; PAM type: NRG; PAM sequence: CAG
agctactcgggaggctgagg

SEQ ID NO: 111741 - DNA, 20 bp, Artificial Sequence
  Description of Artificial Sequence: Synthetic oligonucleotide
  Target: ATXN1; (+) strand; PAM type: NRG; PAM sequence: AGG
gctactcgggaggctgaggc

SEQ ID NO: 111742 - DNA, 20 bp, Artificial Sequence
  Description of Artificial Sequence: Synthetic oligonucleotide
  Target: ATXN1; (+) strand; PAM type: NRG; PAM sequence: GGG
ctactcgggaggctgaggca

SEQ ID NO: 111743 - DNA, 20 bp, Artificial Sequence
  Description of Artificial Sequence: Synthetic oligonucleotide
  Target: ATXN1; (+) strand; PAM type: NRG; PAM sequence: GGG
tactcgggaggctgaggcag

SEQ ID NO: 111744 - DNA, 20 bp, Artificial Sequence
  Description of Artificial Sequence: Synthetic oligonucleotide
  Target: ATXN1; (+) strand; PAM type: NRG; PAM sequence: TAG
gggaggctgaggcaggggaa

SEQ ID NO: 111745 - DNA, 20 bp, Artificial Sequence
  Description of Artificial Sequence: Synthetic oligonucleotide
  Target: ATXN1; (+) strand; PAM type: NRG; PAM sequence: TGG
gcaggggaatagcttgaacc

SEQ ID NO: 111746 - DNA, 20 bp, Artificial Sequence
  Description of Artificial Sequence: Synthetic oligonucleotide
  Target: ATXN1; (+) strand; PAM type: NRG; PAM sequence: GGG
caggggaatagcttgaacct

SEQ ID NO: 111747 - DNA, 20 bp, Artificial Sequence
  Description of Artificial Sequence: Synthetic oligonucleotide
  Target: ATXN1; (+) strand; PAM type: NRG; PAM sequence: GAG
ggggaatagcttgaacctgg

SEQ ID NO: 111748 - DNA, 20 bp, Artificial Sequence
  Description of Artificial Sequence: Synthetic oligonucleotide
  Target: ATXN1; (+) strand; PAM type: NRG; PAM sequence: AGG
gggaatagcttgaacctggg

SEQ ID NO: 111749 - DNA, 20 bp, Artificial Sequence
  Description of Artificial Sequence: Synthetic oligonucleotide
  Target: ATXN1; (+) strand; PAM type: NRG; PAM sequence: TGG
aatagcttgaacctgggagg

SEQ ID NO: 111750 - DNA, 20 bp, Artificial Sequence
  Description of Artificial Sequence: Synthetic oligonucleotide
  Target: ATXN1; (+) strand; PAM type: NRG; PAM sequence: GAG
tagcttgaacctgggaggtg

SEQ ID NO: 111751 - DNA, 20 bp, Artificial Sequence
  Description of Artificial Sequence: Synthetic oligonucleotide
  Target: ATXN1; (+) strand; PAM type: NRG; PAM sequence: AGG
agcttgaacctgggaggtgg

SEQ ID NO: 111752 - DNA, 20 bp, Artificial Sequence
  Description of Artificial Sequence: Synthetic oligonucleotide
  Target: ATXN1; (+) strand; PAM type: NRG; PAM sequence: CAG
aacctgggaggtggaggcta

SEQ ID NO: 111753 - DNA, 20 bp, Artificial Sequence
  Description of Artificial Sequence: Synthetic oligonucleotide
  Target: ATXN1; (+) strand; PAM type: NRG; PAM sequence: GAG
tgggaggtggaggctacagt

SEQ ID NO: 111754 - DNA, 20 bp, Artificial Sequence
  Description of Artificial Sequence: Synthetic oligonucleotide
  Target: ATXN1; (+) strand; PAM type: NRG; PAM sequence: AAG
ggtggaggctacagtgagct

SEQ ID NO: 111755 - DNA, 20 bp, Artificial Sequence
  Description of Artificial Sequence: Synthetic oligonucleotide
  Target: ATXN1; (+) strand; PAM type: NRG; PAM sequence: CAG
aagatcgtgccactgcattc

SEQ ID NO: 111756 - DNA, 20 bp, Artificial Sequence
  Description of Artificial Sequence: Synthetic oligonucleotide
  Target: ATXN1; (+) strand; PAM type: NRG; PAM sequence: TGG
cgtgccactgcattccagcc

SEQ ID NO: 111757 - DNA, 20 bp, Artificial Sequence
  Description of Artificial Sequence: Synthetic oligonucleotide
  Target: ATXN1; (+) strand; PAM type: NRG; PAM sequence: GGG
gtgccactgcattccagcct

SEQ ID NO: 111758 - DNA, 20 bp, Artificial Sequence
  Description of Artificial Sequence: Synthetic oligonucleotide
  Target: ATXN1; (+) strand; PAM type: NRG; PAM sequence: TAG
ctgcattccagcctgggcaa

SEQ ID NO: 111759 - DNA, 20 bp, Artificial Sequence
  Description of Artificial Sequence: Synthetic oligonucleotide
  Target: ATXN1; (+) strand; PAM type: NRG; PAM sequence: GAG
gcattccagcctgggcaata

SEQ ID NO: 111760 - DNA, 20 bp, Artificial Sequence
  Description of Artificial Sequence: Synthetic oligonucleotide
  Target: ATXN1; (+) strand; PAM type: NRG; PAM sequence: AAG
tccagcctgggcaatagagt

SEQ ID NO: 111761 - DNA, 20 bp, Artificial Sequence
  Description of Artificial Sequence: Synthetic oligonucleotide
  Target: ATXN1; (+) strand; PAM type: NRG; PAM sequence: TAG
cctgggcaatagagtaagac

SEQ ID NO: 111762 - DNA, 20 bp, Artificial Sequence
  Description of Artificial Sequence: Synthetic oligonucleotide
  Target: ATXN1; (+) strand; PAM type: NRG; PAM sequence: AGG
ctgggcaatagagtaagact

SEQ ID NO: 111763 - DNA, 20 bp, Artificial Sequence
  Description of Artificial Sequence: Synthetic oligonucleotide
  Target: ATXN1; (+) strand; PAM type: NRG; PAM sequence: AAG
tctcaaaaaaaaaaaaaaaa

SEQ ID NO: 111764 - DNA, 20 bp, Artificial Sequence
  Description of Artificial Sequence: Synthetic oligonucleotide
  Target: ATXN1; (+) strand; PAM type: NRG; PAM sequence: AAG
tgccgtttatgcaatttcaa

SEQ ID NO: 111765 - DNA, 20 bp, Artificial Sequence
  Description of Artificial Sequence: Synthetic oligonucleotide
  Target: ATXN1; (+) strand; PAM type: NRG; PAM sequence: TGG
gtttatgcaatttcaaaagc

SEQ ID NO: 111766 - DNA, 20 bp, Artificial Sequence
  Description of Artificial Sequence: Synthetic oligonucleotide
  Target: ATXN1; (+) strand; PAM type: NRG; PAM sequence: TAG
atttcaaaagctggcttttg

SEQ ID NO: 111767 - DNA, 20 bp, Artificial Sequence
  Description of Artificial Sequence: Synthetic oligonucleotide
  Target: ATXN1; (+) strand; PAM type: NRG; PAM sequence: AGG
tttcaaaagctggcttttgt

SEQ ID NO: 111768 - DNA, 20 bp, Artificial Sequence
  Description of Artificial Sequence: Synthetic oligonucleotide
  Target: ATXN1; (+) strand; PAM type: NRG; PAM sequence: AAG
tgtaggtctaaaattgttgt

SEQ ID NO: 111769 - DNA, 20 bp, Artificial Sequence
  Description of Artificial Sequence: Synthetic oligonucleotide
  Target: ATXN1; (+) strand; PAM type: NRG; PAM sequence: AAG
ttgttgtaagacaattttaa

SEQ ID NO: 111770 - DNA, 20 bp, Artificial Sequence
  Description of Artificial Sequence: Synthetic oligonucleotide
  Target: ATXN1; (+) strand; PAM type: NRG; PAM sequence: CAG
aagacaattttaaaagcttc

SEQ ID NO: 111771 - DNA, 20 bp, Artificial Sequence
  Description of Artificial Sequence: Synthetic oligonucleotide
  Target: ATXN1; (+) strand; PAM type: NRG; PAM sequence: CAG
tttaaaagcttccagacgtg

SEQ ID NO: 111772 - DNA, 20 bp, Artificial Sequence
  Description of Artificial Sequence: Synthetic oligonucleotide
  Target: ATXN1; (+) strand; PAM type: NRG; PAM sequence: TGG
gcttccagacgtgcagaatc

SEQ ID NO: 111773 - DNA, 20 bp, Artificial Sequence
  Description of Artificial Sequence: Synthetic oligonucleotide
  Target: ATXN1; (+) strand; PAM type: NRG; PAM sequence: GGG
cttccagacgtgcagaatct

SEQ ID NO: 111774 - DNA, 20 bp, Artificial Sequence
  Description of Artificial Sequence: Synthetic oligonucleotide
  Target: ATXN1; (+) strand; PAM type: NRG; PAM sequence: GGG
ttccagacgtgcagaatctg

SEQ ID NO: 111775 - DNA, 20 bp, Artificial Sequence
  Description of Artificial Sequence: Synthetic oligonucleotide
  Target: ATXN1; (+) strand; PAM type: NRG; PAM sequence: CAG
cttctttgccccccacccca

SEQ ID NO: 111776 - DNA, 20 bp, Artificial Sequence
  Description of Artificial Sequence: Synthetic oligonucleotide
  Target: ATXN1; (+) strand; PAM type: NRG; PAM sequence: TGG
ccccacagcctcacatgtct

SEQ ID NO: 111777 - DNA, 20 bp, Artificial Sequence
  Description of Artificial Sequence: Synthetic oligonucleotide
  Target: ATXN1; (+) strand; PAM type: NRG; PAM sequence: CGG
gcctcacatgtcttggtttg

SEQ ID NO: 111778 - DNA, 20 bp, Artificial Sequence
  Description of Artificial Sequence: Synthetic oligonucleotide
  Target: ATXN1; (+) strand; PAM type: NRG; PAM sequence: CAG
cttggtttgcggcttttaaa

SEQ ID NO: 111779 - DNA, 20 bp, Artificial Sequence
  Description of Artificial Sequence: Synthetic oligonucleotide
  Target: ATXN1; (+) strand; PAM type: NRG; PAM sequence: GAG
gtttgcggcttttaaacagc

SEQ ID NO: 111780 - DNA, 20 bp, Artificial Sequence
  Description of Artificial Sequence: Synthetic oligonucleotide
  Target: ATXN1; (+) strand; PAM type: NRG; PAM sequence: TAG
ggcttttaaacagcgagttc

SEQ ID NO: 111781 - DNA, 20 bp, Artificial Sequence
  Description of Artificial Sequence: Synthetic oligonucleotide
  Target: ATXN1; (+) strand; PAM type: NRG; PAM sequence: GAG
cttttaaacagcgagttcta

SEQ ID NO: 111782 - DNA, 20 bp, Artificial Sequence
  Description of Artificial Sequence: Synthetic oligonucleotide
  Target: ATXN1; (+) strand; PAM type: NRG; PAM sequence: AAG
ttaaacagcgagttctagag

SEQ ID NO: 111783 - DNA, 20 bp, Artificial Sequence
  Description of Artificial Sequence: Synthetic oligonucleotide
  Target: ATXN1; (+) strand; PAM type: NRG; PAM sequence: TGG
caaaactgtgctccacctgc

SEQ ID NO: 111784 - DNA, 20 bp, Artificial Sequence
  Description of Artificial Sequence: Synthetic oligonucleotide
  Target: ATXN1; (+) strand; PAM type: NRG; PAM sequence: TGG
tgctccacctgctggccttc

SEQ ID NO: 111785 - DNA, 20 bp, Artificial Sequence
  Description of Artificial Sequence: Synthetic oligonucleotide
  Target: ATXN1; (+) strand; PAM type: NRG; PAM sequence: GGG
gctccacctgctggccttct

SEQ ID NO: 111786 - DNA, 20 bp, Artificial Sequence
  Description of Artificial Sequence: Synthetic oligonucleotide
  Target: ATXN1; (+) strand; PAM type: NRG; PAM sequence: GGG
ctccacctgctggccttctg

SEQ ID NO: 111787 - DNA, 20 bp, Artificial Sequence
  Description of Artificial Sequence: Synthetic oligonucleotide
  Target: ATXN1; (+) strand; PAM type: NRG; PAM sequence: AAG
cacctgctggccttctgggg

SEQ ID NO: 111788 - DNA, 20 bp, Artificial Sequence
  Description of Artificial Sequence: Synthetic oligonucleotide
  Target: ATXN1; (+) strand; PAM type: NRG; PAM sequence: TGG
ccttctggggaagctgcgtc

SEQ ID NO: 111789 - DNA, 20 bp, Artificial Sequence
  Description of Artificial Sequence: Synthetic oligonucleotide
  Target: ATXN1; (+) strand; PAM type: NRG; PAM sequence: GGG
cttctggggaagctgcgtct

SEQ ID NO: 111790 - DNA, 20 bp, Artificial Sequence
  Description of Artificial Sequence: Synthetic oligonucleotide
  Target: ATXN1; (+) strand; PAM type: NRG; PAM sequence: TGG
tgcgtctgggctgatgatgc

SEQ ID NO: 111791 - DNA, 20 bp, Artificial Sequence
  Description of Artificial Sequence: Synthetic oligonucleotide
  Target: ATXN1; (+) strand; PAM type: NRG; PAM sequence: CGG
tgggctgatgatgctggttg

SEQ ID NO: 111792 - DNA, 20 bp, Artificial Sequence
  Description of Artificial Sequence: Synthetic oligonucleotide
  Target: ATXN1; (+) strand; PAM type: NRG; PAM sequence: GGG
gggctgatgatgctggttgc

SEQ ID NO: 111793 - DNA, 20 bp, Artificial Sequence
  Description of Artificial Sequence: Synthetic oligonucleotide
  Target: ATXN1; (+) strand; PAM type: NRG; PAM sequence: GAG
gatgatgctggttgcgggtt

SEQ ID NO: 111794 - DNA, 20 bp, Artificial Sequence
  Description of Artificial Sequence: Synthetic oligonucleotide
  Target: ATXN1; (+) strand; PAM type: NRG; PAM sequence: AAG
gttgcgggttgagcgaaaac

SEQ ID NO: 111795 - DNA, 20 bp, Artificial Sequence
  Description of Artificial Sequence: Synthetic oligonucleotide
  Target: ATXN1; (+) strand; PAM type: NRG; PAM sequence: AGG
ttgcgggttgagcgaaaaca

SEQ ID NO: 111796 - DNA, 20 bp, Artificial Sequence
  Description of Artificial Sequence: Synthetic oligonucleotide
  Target: ATXN1; (+) strand; PAM type: NRG; PAM sequence: CAG
ggttgagcgaaaacaaggaa

SEQ ID NO: 111797 - DNA, 20 bp, Artificial Sequence
  Description of Artificial Sequence: Synthetic oligonucleotide
  Target: ATXN1; (+) strand; PAM type: NRG; PAM sequence: GAG
cgaaaacaaggaacagattt

SEQ ID NO: 111798 - DNA, 20 bp, Artificial Sequence
  Description of Artificial Sequence: Synthetic oligonucleotide
  Target: ATXN1; (+) strand; PAM type: NRG; PAM sequence: AAG
aacagatttgagtttgtcca

SEQ ID NO: 111799 - DNA, 20 bp, Artificial Sequence
  Description of Artificial Sequence: Synthetic oligonucleotide
  Target: ATXN1; (+) strand; PAM type: NRG; PAM sequence: TGG
gagtttgtccaaagcatgct

SEQ ID NO: 111800 - DNA, 20 bp, Artificial Sequence
  Description of Artificial Sequence: Synthetic oligonucleotide
  Target: ATXN1; (+) strand; PAM type: NRG; PAM sequence: AAG
tacttgaaaattaacccttc

SEQ ID NO: 111801 - DNA, 20 bp, Artificial Sequence
  Description of Artificial Sequence: Synthetic oligonucleotide
  Target: ATXN1; (+) strand; PAM type: NRG; PAM sequence: TGG
gaaaattaacccttcaagac

SEQ ID NO: 111802 - DNA, 20 bp, Artificial Sequence
  Description of Artificial Sequence: Synthetic oligonucleotide
  Target: ATXN1; (+) strand; PAM type: NRG; PAM sequence: GGG
aaaattaacccttcaagact

SEQ ID NO: 111803 - DNA, 20 bp, Artificial Sequence
  Description of Artificial Sequence: Synthetic oligonucleotide
  Target: ATXN1; (+) strand; PAM type: NRG; PAM sequence: CAG
ttcaagactgggcatgtgtc

SEQ ID NO: 111804 - DNA, 20 bp, Artificial Sequence
  Description of Artificial Sequence: Synthetic oligonucleotide
  Target: ATXN1; (+) strand; PAM type: NRG; PAM sequence: AAG
atgtgtccagtgatgctctg

SEQ ID NO: 111805 - DNA, 20 bp, Artificial Sequence
  Description of Artificial Sequence: Synthetic oligonucleotide
  Target: ATXN1; (+) strand; PAM type: NRG; PAM sequence: TGG
gtccagtgatgctctgaagc

SEQ ID NO: 111806 - DNA, 20 bp, Artificial Sequence
  Description of Artificial Sequence: Synthetic oligonucleotide
  Target: ATXN1; (+) strand; PAM type: NRG; PAM sequence: AAG
gtgatgctctgaagctggca

SEQ ID NO: 111807 - DNA, 20 bp, Artificial Sequence
  Description of Artificial Sequence: Synthetic oligonucleotide
  Target: ATXN1; (+) strand; PAM type: NRG; PAM sequence: GAG
gctctgaagctggcaaagat

SEQ ID NO: 111808 - DNA, 20 bp, Artificial Sequence
  Description of Artificial Sequence: Synthetic oligonucleotide
  Target: ATXN1; (+) strand; PAM type: NRG; PAM sequence: CAG
aaagatgagcatcaaatcac

SEQ ID NO: 111809 - DNA, 20 bp, Artificial Sequence
  Description of Artificial Sequence: Synthetic oligonucleotide
  Target: ATXN1; (+) strand; PAM type: NRG; PAM sequence: TGG
atcaaatcaccagacgtgca

SEQ ID NO: 111810 - DNA, 20 bp, Artificial Sequence
  Description of Artificial Sequence: Synthetic oligonucleotide
  Target: ATXN1; (+) strand; PAM type: NRG; PAM sequence: GAG
caaatcaccagacgtgcatg

SEQ ID NO: 111811 - DNA, 20 bp, Artificial Sequence
  Description of Artificial Sequence: Synthetic oligonucleotide
  Target: ATXN1; (+) strand; PAM type: NRG; PAM sequence: GAG
aatcaccagacgtgcatgga

SEQ ID NO: 111812 - DNA, 20 bp, Artificial Sequence
  Description of Artificial Sequence: Synthetic oligonucleotide
  Target: ATXN1; (+) strand; PAM type: NRG; PAM sequence: GAG
cagacgtgcatggagagcat

SEQ ID NO: 111813 - DNA, 20 bp, Artificial Sequence
  Description of Artificial Sequence: Synthetic oligonucleotide
  Target: ATXN1; (+) strand; PAM type: NRG; PAM sequence: TAG
gagctgaacgaccgtcgtga

SEQ ID NO: 111814 - DNA, 20 bp, Artificial Sequence
  Description of Artificial Sequence: Synthetic oligonucleotide
  Target: ATXN1; (+) strand; PAM type: NRG; PAM sequence: AGG
agctgaacgaccgtcgtgat

SEQ ID NO: 111815 - DNA, 20 bp, Artificial Sequence
  Description of Artificial Sequence: Synthetic oligonucleotide
  Target: ATXN1; (+) strand; PAM type: NRG; PAM sequence: TGG
aacgaccgtcgtgataggct

SEQ ID NO: 111816 - DNA, 20 bp, Artificial Sequence
  Description of Artificial Sequence: Synthetic oligonucleotide
  Target: ATXN1; (+) strand; PAM type: NRG; PAM sequence: CAG
gaccgtcgtgataggcttgg

SEQ ID NO: 111817 - DNA, 20 bp, Artificial Sequence
  Description of Artificial Sequence: Synthetic oligonucleotide
  Target: ATXN1; (+) strand; PAM type: NRG; PAM sequence: GAG
ccgtcgtgataggcttggca

SEQ ID NO: 111818 - DNA, 20 bp, Artificial Sequence
  Description of Artificial Sequence: Synthetic oligonucleotide
  Target: ATXN1; (+) strand; PAM type: NRG; PAM sequence: AGG
cgtcgtgataggcttggcag

SEQ ID NO: 111819 - DNA, 20 bp, Artificial Sequence
  Description of Artificial Sequence: Synthetic oligonucleotide
  Target: ATXN1; (+) strand; PAM type: NRG; PAM sequence: AAG
gataggcttggcagaggatg

SEQ ID NO: 111820 - DNA, 20 bp, Artificial Sequence
  Description of Artificial Sequence: Synthetic oligonucleotide
  Target: ATXN1; (+) strand; PAM type: NRG; PAM sequence: CAG
aggcttggcagaggatgaag

SEQ ID NO: 111821 - DNA, 20 bp, Artificial Sequence
  Description of Artificial Sequence: Synthetic oligonucleotide
  Target: ATXN1; (+) strand; PAM type: NRG; PAM sequence: GAG
gcttggcagaggatgaagca

SEQ ID NO: 111822 - DNA, 20 bp, Artificial Sequence
  Description of Artificial Sequence: Synthetic oligonucleotide
  Target: ATXN1; (+) strand; PAM type: NRG; PAM sequence: AGG
cttggcagaggatgaagcag

SEQ ID NO: 111823 - DNA, 20 bp, Artificial Sequence
  Description of Artificial Sequence: Synthetic oligonucleotide
  Target: ATXN1; (+) strand; PAM type: NRG; PAM sequence: GGG
ttggcagaggatgaagcaga

SEQ ID NO: 111824 - DNA, 20 bp, Artificial Sequence
  Description of Artificial Sequence: Synthetic oligonucleotide
  Target: ATXN1; (+) strand; PAM type: NRG; PAM sequence: TGG
gcagaggatgaagcagaggg

SEQ ID NO: 111825 - DNA, 20 bp, Artificial Sequence
  Description of Artificial Sequence: Synthetic oligonucleotide
  Target: ATXN1; (+) strand; PAM type: NRG; PAM sequence: CGG
gatgaagcagagggtggcac

SEQ ID NO: 111826 - DNA, 20 bp, Artificial Sequence
  Description of Artificial Sequence: Synthetic oligonucleotide
  Target: ATXN1; (+) strand; PAM type: NRG; PAM sequence: GAG
tgaagcagagggtggcaccg

SEQ ID NO: 111827 - DNA, 20 bp, Artificial Sequence
  Description of Artificial Sequence: Synthetic oligonucleotide
  Target: ATXN1; (+) strand; PAM type: NRG; PAM sequence: TGG
ggtggcaccggagccctacc

SEQ ID NO: 111828 - DNA, 20 bp, Artificial Sequence
  Description of Artificial Sequence: Synthetic oligonucleotide
  Target: ATXN1; (+) strand; PAM type: NRG; PAM sequence: GGG
gtggcaccggagccctacct

SEQ ID NO: 111829 - DNA, 20 bp, Artificial Sequence
  Description of Artificial Sequence: Synthetic oligonucleotide
  Target: ATXN1; (+) strand; PAM type: NRG; PAM sequence: TGG
ccggagccctacctgggtgc

SEQ ID NO: 111830 - DNA, 20 bp, Artificial Sequence
  Description of Artificial Sequence: Synthetic oligonucleotide
  Target: ATXN1; (+) strand; PAM type: NRG; PAM sequence: CGG
cctgggtgctggcactgcct

SEQ ID NO: 111831 - DNA, 20 bp, Artificial Sequence
  Description of Artificial Sequence: Synthetic oligonucleotide
  Target: ATXN1; (+) strand; PAM type: NRG; PAM sequence: CAG
ctatgacgccgtgtgaatca

SEQ ID NO: 111832 - DNA, 20 bp, Artificial Sequence
  Description of Artificial Sequence: Synthetic oligonucleotide
  Target: ATXN1; (+) strand; PAM type: NRG; PAM sequence: TAG
gccgtgtgaatcacagcatc

SEQ ID NO: 111833 - DNA, 20 bp, Artificial Sequence
  Description of Artificial Sequence: Synthetic oligonucleotide
  Target: ATXN1; (+) strand; PAM type: NRG; PAM sequence: CGG
gtgtgaatcacagcatctag

SEQ ID NO: 111834 - DNA, 20 bp, Artificial Sequence
  Description of Artificial Sequence: Synthetic oligonucleotide
  Target: ATXN1; (+) strand; PAM type: NRG; PAM sequence: AAG
ttaattgacatctctttctg

SEQ ID NO: 111835 - DNA, 20 bp, Artificial Sequence
  Description of Artificial Sequence: Synthetic oligonucleotide
  Target: ATXN1; (+) strand; PAM type: NRG; PAM sequence: AGG
taattgacatctctttctga

SEQ ID NO: 111836 - DNA, 20 bp, Artificial Sequence
  Description of Artificial Sequence: Synthetic oligonucleotide
  Target: ATXN1; (+) strand; PAM type: NRG; PAM sequence: CAG
ttctgaaggaatttacaatc

SEQ ID NO: 111837 - DNA, 20 bp, Artificial Sequence
  Description of Artificial Sequence: Synthetic oligonucleotide
  Target: ATXN1; (+) strand; PAM type: NRG; PAM sequence: AAG
tacaatccagttgatgatgt

SEQ ID NO: 111838 - DNA, 20 bp, Artificial Sequence
  Description of Artificial Sequence: Synthetic oligonucleotide
  Target: ATXN1; (+) strand; PAM type: NRG; PAM sequence: AAG
gatgtaagacccactatcat

SEQ ID NO: 111839 - DNA, 20 bp, Artificial Sequence
  Description of Artificial Sequence: Synthetic oligonucleotide
  Target: ATXN1; (+) strand; PAM type: NRG; PAM sequence: TAG
acccactatcataagccaat

SEQ ID NO: 111840 - DNA, 20 bp, Artificial Sequence
  Description of Artificial Sequence: Synthetic oligonucleotide
  Target: ATXN1; (+) strand; PAM type: NRG; PAM sequence: GAG
ccactatcataagccaatta

SEQ ID NO: 111841 - DNA, 20 bp, Artificial Sequence
  Description of Artificial Sequence: Synthetic oligonucleotide
  Target: ATXN1; (+) strand; PAM type: NRG; PAM sequence: AAG
agccaattagagaaccaaac

SEQ ID NO: 111842 - DNA, 20 bp, Artificial Sequence
  Description of Artificial Sequence: Synthetic oligonucleotide
  Target: ATXN1; (+) strand; PAM type: NRG; PAM sequence: AAG
agagaaccaaacaagtgctg

SEQ ID NO: 111843 - DNA, 20 bp, Artificial Sequence
  Description of Artificial Sequence: Synthetic oligonucleotide
  Target: ATXN1; (+) strand; PAM type: NRG; PAM sequence: AGG
gagaaccaaacaagtgctga

SEQ ID NO: 111844 - DNA, 20 bp, Artificial Sequence
  Description of Artificial Sequence: Synthetic oligonucleotide
  Target: ATXN1; (+) strand; PAM type: NRG; PAM sequence: GGG
agaaccaaacaagtgctgaa

SEQ ID NO: 111845 - DNA, 20 bp, Artificial Sequence
  Description of Artificial Sequence: Synthetic oligonucleotide
  Target: ATXN1; (+) strand; PAM type: NRG; PAM sequence: TGG
aagtgctgaagggaccccta

SEQ ID NO: 111846 - DNA, 20 bp, Artificial Sequence
  Description of Artificial Sequence: Synthetic oligonucleotide
  Target: ATXN1; (+) strand; PAM type: NRG; PAM sequence: GAG
gtgctgaagggacccctatg

SEQ ID NO: 111847 - DNA, 20 bp, Artificial Sequence
  Description of Artificial Sequence: Synthetic oligonucleotide
  Target: ATXN1; (+) strand; PAM type: NRG; PAM sequence: AGG
tgctgaagggacccctatgg

SEQ ID NO: 111848 - DNA, 20 bp, Artificial Sequence
  Description of Artificial Sequence: Synthetic oligonucleotide
  Target: ATXN1; (+) strand; PAM type: NRG; PAM sequence: CAG
tgaagggacccctatggagg

SEQ ID NO: 111849 - DNA, 20 bp, Artificial Sequence
  Description of Artificial Sequence: Synthetic oligonucleotide
  Target: ATXN1; (+) strand; PAM type: NRG; PAM sequence: GAG
aagggacccctatggaggca

SEQ ID NO: 111850 - DNA, 20 bp, Artificial Sequence
  Description of Artificial Sequence: Synthetic oligonucleotide
  Target: ATXN1; (+) strand; PAM type: NRG; PAM sequence: CAG
ggcagagaacctgaaatgaa

SEQ ID NO: 111851 - DNA, 20 bp, Artificial Sequence
  Description of Artificial Sequence: Synthetic oligonucleotide
  Target: ATXN1; (+) strand; PAM type: NRG; PAM sequence: AAG
agaacctgaaatgaacagtg

SEQ ID NO: 111852 - DNA, 20 bp, Artificial Sequence
  Description of Artificial Sequence: Synthetic oligonucleotide
  Target: ATXN1; (+) strand; PAM type: NRG; PAM sequence: AAG
aagactaaatctgacttaca

SEQ ID NO: 111853 - DNA, 20 bp, Artificial Sequence
  Description of Artificial Sequence: Synthetic oligonucleotide
  Target: ATXN1; (+) strand; PAM type: NRG; PAM sequence: AGG
agactaaatctgacttacaa

SEQ ID NO: 111854 - DNA, 20 bp, Artificial Sequence
  Description of Artificial Sequence: Synthetic oligonucleotide
  Target: ATXN1; (+) strand; PAM type: NRG; PAM sequence: GAG
taaatctgacttacaaaggt

SEQ ID NO: 111855 - DNA, 20 bp, Artificial Sequence
  Description of Artificial Sequence: Synthetic oligonucleotide
  Target: ATXN1; (+) strand; PAM type: NRG; PAM sequence: AGG
aaatctgacttacaaaggtg

SEQ ID NO: 111856 - DNA, 20 bp, Artificial Sequence
  Description of Artificial Sequence: Synthetic oligonucleotide
  Target: ATXN1; (+) strand; PAM type: NRG; PAM sequence: GAG
atctgacttacaaaggtgag

SEQ ID NO: 111857 - DNA, 20 bp, Artificial Sequence
  Description of Artificial Sequence: Synthetic oligonucleotide
  Target: ATXN1; (+) strand; PAM type: NRG; PAM sequence: CAG
tgacttacaaaggtgaggag

SEQ ID NO: 111858 - DNA, 20 bp, Artificial Sequence
  Description of Artificial Sequence: Synthetic oligonucleotide
  Target: ATXN1; (+) strand; PAM type: NRG; PAM sequence: AGG
gacttacaaaggtgaggagc

SEQ ID NO: 111859 - DNA, 20 bp, Artificial Sequence
  Description of Artificial Sequence: Synthetic oligonucleotide
  Target: ATXN1; (+) strand; PAM type: NRG; PAM sequence: GGG
acttacaaaggtgaggagca

SEQ ID NO: 111860 - DNA, 20 bp, Artificial Sequence
  Description of Artificial Sequence: Synthetic oligonucleotide
  Target: ATXN1; (+) strand; PAM type: NRG; PAM sequence: GAG
ttacaaaggtgaggagcagg

SEQ ID NO: 111861 - DNA, 20 bp, Artificial Sequence
  Description of Artificial Sequence: Synthetic oligonucleotide
  Target: ATXN1; (+) strand; PAM type: NRG; PAM sequence: TGG
ttctttcctaatgcttgcac

SEQ ID NO: 111862 - DNA, 20 bp, Artificial Sequence
  Description of Artificial Sequence: Synthetic oligonucleotide
  Target: ATXN1; (+) strand; PAM type: NRG; PAM sequence: GGG
tctttcctaatgcttgcact

SEQ ID NO: 111863 - DNA, 20 bp, Artificial Sequence
  Description of Artificial Sequence: Synthetic oligonucleotide
  Target: ATXN1; (+) strand; PAM type: NRG; PAM sequence: CAG
gggatttctgacgaatacct

SEQ ID NO: 111864 - DNA, 20 bp, Artificial Sequence
  Description of Artificial Sequence: Synthetic oligonucleotide
  Target: ATXN1; (+) strand; PAM type: NRG; PAM sequence: GAG
gatttctgacgaatacctca

SEQ ID NO: 111865 - DNA, 20 bp, Artificial Sequence
  Description of Artificial Sequence: Synthetic oligonucleotide
  Target: ATXN1; (+) strand; PAM type: NRG; PAM sequence: AGG
atttctgacgaatacctcag

SEQ ID NO: 111866 - DNA, 20 bp, Artificial Sequence
  Description of Artificial Sequence: Synthetic oligonucleotide
  Target: ATXN1; (+) strand; PAM type: NRG; PAM sequence: TGG
gaatacctcagaggctatgt

SEQ ID NO: 111867 - DNA, 20 bp, Artificial Sequence
  Description of Artificial Sequence: Synthetic oligonucleotide
  Target: ATXN1; (+) strand; PAM type: NRG; PAM sequence: GGG
aatacctcagaggctatgtt

SEQ ID NO: 111868 - DNA, 20 bp, Artificial Sequence
  Description of Artificial Sequence: Synthetic oligonucleotide
  Target: ATXN1; (+) strand; PAM type: NRG; PAM sequence: TAG
atgttgggctttttctgatg

SEQ ID NO: 111869 - DNA, 20 bp, Artificial Sequence
  Description of Artificial Sequence: Synthetic oligonucleotide
  Target: ATXN1; (+) strand; PAM type: NRG; PAM sequence: TGG
tttctgatgtagcgatattt

SEQ ID NO: 111870 - DNA, 20 bp, Artificial Sequence
  Description of Artificial Sequence: Synthetic oligonucleotide
  Target: ATXN1; (+) strand; PAM type: NRG; PAM sequence: GAG
tctgatgtagcgatattttg

SEQ ID NO: 111871 - DNA, 20 bp, Artificial Sequence
  Description of Artificial Sequence: Synthetic oligonucleotide
  Target: ATXN1; (+) strand; PAM type: NRG; PAM sequence: TGG
tagcgatattttggagatta

SEQ ID NO: 111872 - DNA, 20 bp, Artificial Sequence
  Description of Artificial Sequence: Synthetic oligonucleotide
  Target: ATXN1; (+) strand; PAM type: NRG; PAM sequence: CAG
tttggagattatggttcaac

SEQ ID NO: 111873 - DNA, 20 bp, Artificial Sequence
  Description of Artificial Sequence: Synthetic oligonucleotide
  Target: ATXN1; (+) strand; PAM type: NRG; PAM sequence: GAG
tgatttgtctaaacctgttt

SEQ ID NO: 111874 - DNA, 20 bp, Artificial Sequence
  Description of Artificial Sequence: Synthetic oligonucleotide
  Target: ATXN1; (+) strand; PAM type: NRG; PAM sequence: AGG
gatttgtctaaacctgtttg

SEQ ID NO: 111875 - DNA, 20 bp, Artificial Sequence
  Description of Artificial Sequence: Synthetic oligonucleotide
  Target: ATXN1; (+) strand; PAM type: NRG; PAM sequence: AAG
atcattcccttccctacata

SEQ ID NO: 111876 - DNA, 20 bp, Artificial Sequence
  Description of Artificial Sequence: Synthetic oligonucleotide
  Target: ATXN1; (+) strand; PAM type: NRG; PAM sequence: AAG
ataatatgcaaaaaatccaa

SEQ ID NO: 111877 - DNA, 20 bp, Artificial Sequence
  Description of Artificial Sequence: Synthetic oligonucleotide
  Target: ATXN1; (+) strand; PAM type: NRG; PAM sequence: AGG
taatatgcaaaaaatccaaa

SEQ ID NO: 111878 - DNA, 20 bp, Artificial Sequence
  Description of Artificial Sequence: Synthetic oligonucleotide
  Target: ATXN1; (+) strand; PAM type: NRG; PAM sequence: GGG
aatatgcaaaaaatccaaaa

SEQ ID NO: 111879 - DNA, 20 bp, Artificial Sequence
  Description of Artificial Sequence: Synthetic oligonucleotide
  Target: ATXN1; (+) strand; PAM type: NRG; PAM sequence: TAG
ggtgcaatcatttgttttac

SEQ ID NO: 111880 - DNA, 20 bp, Artificial Sequence
  Description of Artificial Sequence: Synthetic oligonucleotide
  Target: ATXN1; (+) strand; PAM type: NRG; PAM sequence: AAG
agaatcttctttatgttcta

SEQ ID NO: 111881 - DNA, 20 bp, Artificial Sequence
  Description of Artificial Sequence: Synthetic oligonucleotide
  Target: ATXN1; (+) strand; PAM type: NRG; PAM sequence: GAG
atgcatttctttcaaattgt

SEQ ID NO: 111882 - DNA, 20 bp, Artificial Sequence
  Description of Artificial Sequence: Synthetic oligonucleotide
  Target: ATXN1; (+) strand; PAM type: NRG; PAM sequence: AAG
gtgagcctccaatgaactac

SEQ ID NO: 111883 - DNA, 20 bp, Artificial Sequence
  Description of Artificial Sequence: Synthetic oligonucleotide
  Target: ATXN1; (+) strand; PAM type: NRG; PAM sequence: CAG
ccaatgaactacaagcttgt

SEQ ID NO: 111884 - DNA, 20 bp, Artificial Sequence
  Description of Artificial Sequence: Synthetic oligonucleotide
  Target: ATXN1; (+) strand; PAM type: NRG; PAM sequence: CAG
ttgtcagaattacatctatt

SEQ ID NO: 111885 - DNA, 20 bp, Artificial Sequence
  Description of Artificial Sequence: Synthetic oligonucleotide
  Target: ATXN1; (+) strand; PAM type: NRG; PAM sequence: AGG
tgtcagaattacatctattc

SEQ ID NO: 111886 - DNA, 20 bp, Artificial Sequence
  Description of Artificial Sequence: Synthetic oligonucleotide
  Target: ATXN1; (+) strand; PAM type: NRG; PAM sequence: TGG
caggtcatatacaacatccg

SEQ ID NO: 111887 - DNA, 20 bp, Artificial Sequence
  Description of Artificial Sequence: Synthetic oligonucleotide
  Target: ATXN1; (+) strand; PAM type: NRG; PAM sequence: GAG
ggtcatatacaacatccgtg

SEQ ID NO: 111888 - DNA, 20 bp, Artificial Sequence
  Description of Artificial Sequence: Synthetic oligonucleotide
  Target: ATXN1; (+) strand; PAM type: NRG; PAM sequence: AAG
tatacaacatccgtggagca

SEQ ID NO: 111889 - DNA, 20 bp, Artificial Sequence
  Description of Artificial Sequence: Synthetic oligonucleotide
  Target: ATXN1; (+) strand; PAM type: NRG; PAM sequence: AAG
cgtggagcaaagtgaatttg

SEQ ID NO: 111890 - DNA, 20 bp, Artificial Sequence
  Description of Artificial Sequence: Synthetic oligonucleotide
  Target: ATXN1; (+) strand; PAM type: NRG; PAM sequence: AAG
agcaaagtgaatttgaagtt

SEQ ID NO: 111891 - DNA, 20 bp, Artificial Sequence
  Description of Artificial Sequence: Synthetic oligonucleotide
  Target: ATXN1; (+) strand; PAM type: NRG; PAM sequence: TAG
tttgaagttaagtctcctct

SEQ ID NO: 111892 - DNA, 20 bp, Artificial Sequence
  Description of Artificial Sequence: Synthetic oligonucleotide
  Target: ATXN1; (+) strand; PAM type: NRG; PAM sequence: TAG
agttaagtctcctcttagtg

SEQ ID NO: 111893 - DNA, 20 bp, Artificial Sequence
  Description of Artificial Sequence: Synthetic oligonucleotide
  Target: ATXN1; (+) strand; PAM type: NRG; PAM sequence: CAG
taagtctcctcttagtgtag

SEQ ID NO: 111894 - DNA, 20 bp, Artificial Sequence
  Description of Artificial Sequence: Synthetic oligonucleotide
  Target: ATXN1; (+) strand; PAM type: NRG; PAM sequence: GAG
tagcagtacgtattttgaat

SEQ ID NO: 111895 - DNA, 20 bp, Artificial Sequence
  Description of Artificial Sequence: Synthetic oligonucleotide
  Target: ATXN1; (+) strand; PAM type: NRG; PAM sequence: CGG
gtacgtattttgaatgagaa

SEQ ID NO: 111896 - DNA, 20 bp, Artificial Sequence
  Description of Artificial Sequence: Synthetic oligonucleotide
  Target: ATXN1; (+) strand; PAM type: NRG; PAM sequence: CAG
gtattttgaatgagaacggc

SEQ ID NO: 111897 - DNA, 20 bp, Artificial Sequence
  Description of Artificial Sequence: Synthetic oligonucleotide
  Target: ATXN1; (+) strand; PAM type: NRG; PAM sequence: AAG
aatgagaacggccagtgcta

SEQ ID NO: 111898 - DNA, 20 bp, Artificial Sequence
  Description of Artificial Sequence: Synthetic oligonucleotide
  Target: ATXN1; (+) strand; PAM type: NRG; PAM sequence: TGG
agaacggccagtgctaaaga

SEQ ID NO: 111899 - DNA, 20 bp, Artificial Sequence
  Description of Artificial Sequence: Synthetic oligonucleotide
  Target: ATXN1; (+) strand; PAM type: NRG; PAM sequence: TAG
ccagtgctaaagatggaaaa

SEQ ID NO: 111900 - DNA, 20 bp, Artificial Sequence
  Description of Artificial Sequence: Synthetic oligonucleotide
  Target: ATXN1; (+) strand; PAM type: NRG; PAM sequence: AGG
cagtgctaaagatggaaaat

SEQ ID NO: 111901 - DNA, 20 bp, Artificial Sequence
  Description of Artificial Sequence: Synthetic oligonucleotide
  Target: ATXN1; (+) strand; PAM type: NRG; PAM sequence: TGG
tgctaaagatggaaaatagg

SEQ ID NO: 111902 - DNA, 20 bp, Artificial Sequence
  Description of Artificial Sequence: Synthetic oligonucleotide
  Target: ATXN1; (+) strand; PAM type: NRG; PAM sequence: GGG
gctaaagatggaaaataggt

SEQ ID NO: 111903 - DNA, 20 bp, Artificial Sequence
  Description of Artificial Sequence: Synthetic oligonucleotide
  Target: ATXN1; (+) strand; PAM type: NRG; PAM sequence: TGG
aaagatggaaaataggtggg

SEQ ID NO: 111904 - DNA, 20 bp, Artificial Sequence
  Description of Artificial Sequence: Synthetic oligonucleotide
  Target: ATXN1; (+) strand; PAM type: NRG; PAM sequence: CAG
atggaaaataggtgggtggc

SEQ ID NO: 111905 - DNA, 20 bp, Artificial Sequence
  Description of Artificial Sequence: Synthetic oligonucleotide
  Target: ATXN1; (+) strand; PAM type: NRG; PAM sequence: AGG
tggaaaataggtgggtggcc

SEQ ID NO: 111906 - DNA, 20 bp, Artificial Sequence
  Description of Artificial Sequence: Synthetic oligonucleotide
  Target: ATXN1; (+) strand; PAM type: NRG; PAM sequence: CAG
aataggtgggtggccaggca

SEQ ID NO: 111907 - DNA, 20 bp, Artificial Sequence
  Description of Artificial Sequence: Synthetic oligonucleotide
  Target: ATXN1; (+) strand; PAM type: NRG; PAM sequence: TGG
aggtgggtggccaggcacag

SEQ ID NO: 111908 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctgtaatcc

SEQ ID NO: 111909 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagctctt

SEQ ID NO: 111910 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagctcttt

SEQ ID NO: 111911 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctctttgg

SEQ ID NO: 111912 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctctttggg

SEQ ID NO: 111913 - DNA, 20 bp, Artificial Sequence
  Description of Artificial Sequence: Synthetic oligonucleotide
  Target: ATXN1; (+) strand; PAM type: NRG; PAM sequence: CAG
agctctttgggaggccaatg

SEQ ID NO: 111914 - DNA, 20 bp, Artificial Sequence
  Description of Artificial Sequence: Synthetic oligonucleotide
  Target: ATXN1; (+) strand; PAM type: NRG; PAM sequence: AGG
gctctttgggaggccaatgc

SEQ ID NO: 111915 - DNA, 20 bp, Artificial Sequence
  Description of Artificial Sequence: Synthetic oligonucleotide
  Target: ATXN1; (+) strand; PAM type: NRG; PAM sequence: CGG
ctttgggaggccaatgcagg

SEQ ID NO: 111916 - DNA, 20 bp, Artificial Sequence
  Description of Artificial Sequence: Synthetic oligonucleotide
  Target: ATXN1; (+) strand; PAM type: NRG; PAM sequence: GAG
ccaatgcaggcggatcactt

SEQ ID NO: 111917 - DNA, 20 bp, Artificial Sequence
  Description of Artificial Sequence: Synthetic oligonucleotide
  Target: ATXN1; (+) strand; PAM type: NRG; PAM sequence: AGG
caatgcaggcggatcacttg

SEQ ID NO: 111918 - DNA, 20 bp, Artificial Sequence
  Description of Artificial Sequence: Synthetic oligonucleotide
  Target: ATXN1; (+) strand; PAM type: NRG; PAM sequence: CAG
gcaggcggatcacttgaggc

SEQ ID NO: 111919 - DNA, 20 bp, Artificial Sequence
  Description of Artificial Sequence: Synthetic oligonucleotide
  Target: ATXN1; (+) strand; PAM type: NRG; PAM sequence: AGG
caggcggatcacttgaggcc

SEQ ID NO: 111920 - DNA, 20 bp, Artificial Sequence
  Description of Artificial Sequence: Synthetic oligonucleotide
  Target: ATXN1; (+) strand; PAM type: NRG; PAM sequence: GAG
ggcggatcacttgaggccag

SEQ ID NO: 111921 - DNA, 20 bp, Artificial Sequence
  Description of Artificial Sequence: Synthetic oligonucleotide
  Target: ATXN1; (+) strand; PAM type: NRG; PAM sequence: GAG
tcacttgaggccaggagttt

SEQ ID NO: 111922 - DNA, 20 bp, Artificial Sequence
  Description of Artificial Sequence: Synthetic oligonucleotide
  Target: ATXN1; (+) strand; PAM type: NRG; PAM sequence: TGG
ccaggagtttgagaccatcc

SEQ ID NO: 111923 - DNA, 20 bp, Artificial Sequence
  Description of Artificial Sequence: Synthetic oligonucleotide
  Target: ATXN1; (+) strand; PAM type: NRG; PAM sequence: TAG
tctaccaaaaatacaaaaat

SEQ ID NO: 111924 - DNA, 20 bp, Artificial Sequence
  Description of Artificial Sequence: Synthetic oligonucleotide
  Target: ATXN1; (+) strand; PAM type: NRG; PAM sequence: TAG
atacaaaaattagccgtgtg

SEQ ID NO: 111925 - DNA, 20 bp, Artificial Sequence
  Description of Artificial Sequence: Synthetic oligonucleotide
  Target: ATXN1; (+) strand; PAM type: NRG; PAM sequence: TAG
caaaaattagccgtgtgtag

SEQ ID NO: 111926 - DNA, 20 bp, Artificial Sequence
  Description of Artificial Sequence: Synthetic oligonucleotide
  Target: ATXN1; (+) strand; PAM type: NRG; PAM sequence: TAG
tgtgtagtagcacatgcctg

SEQ ID NO: 111927 - DNA, 20 bp, Artificial Sequence
  Description of Artificial Sequence: Synthetic oligonucleotide
  Target: ATXN1; (+) strand; PAM type: NRG; PAM sequence: CAG
gtagcacatgcctgtagttt

SEQ ID NO: 111928 - DNA, 20 bp, Artificial Sequence
  Description of Artificial Sequence: Synthetic oligonucleotide
  Target: ATXN1; (+) strand; PAM type: NRG; PAM sequence: TGG
tgcctgtagtttcagctact

SEQ ID NO: 111929 - DNA, 20 bp, Artificial Sequence
  Description of Artificial Sequence: Synthetic oligonucleotide
  Target: ATXN1; (+) strand; PAM type: NRG; PAM sequence: GGG
gcctgtagtttcagctactt

SEQ ID NO: 111930 - DNA, 20 bp, Artificial Sequence
  Description of Artificial Sequence: Synthetic oligonucleotide
  Target: ATXN1; (+) strand; PAM type: NRG; PAM sequence: GAG
ctgtagtttcagctacttgg

SEQ ID NO: 111931 - DNA, 20 bp, Artificial Sequence
  Description of Artificial Sequence: Synthetic oligonucleotide
  Target: ATXN1; (+) strand; PAM type: NRG; PAM sequence: AGG
tgtagtttcagctacttggg

SEQ ID NO: 111932 - DNA, 20 bp, Artificial Sequence
  Description of Artificial Sequence: Synthetic oligonucleotide
  Target: ATXN1; (+) strand; PAM type: NRG; PAM sequence: GAG
tttcagctacttgggaggct

SEQ ID NO: 111933 - DNA, 20 bp, Artificial Sequence
  Description of Artificial Sequence: Synthetic oligonucleotide
  Target: ATXN1; (+) strand; PAM type: NRG; PAM sequence: AGG
ttcagctacttgggaggctg

SEQ ID NO: 111934 - DNA, 20 bp, Artificial Sequence
  Description of Artificial Sequence: Synthetic oligonucleotide
  Target: ATXN1; (+) strand; PAM type: NRG; PAM sequence: CAG
agctacttgggaggctgagg

SEQ ID NO: 111935 - DNA, 20 bp, Artificial Sequence
  Description of Artificial Sequence: Synthetic oligonucleotide
  Target: ATXN1; (+) strand; PAM type: NRG; PAM sequence: AGG
gctacttgggaggctgaggc

SEQ ID NO: 111936 - DNA, 20 bp, Artificial Sequence
  Description of Artificial Sequence: Synthetic oligonucleotide
  Target: ATXN1; (+) strand; PAM type: NRG; PAM sequence: GAG
tacttgggaggctgaggcag

SEQ ID NO: 111937 - DNA, 20 bp, Artificial Sequence
  Description of Artificial Sequence: Synthetic oligonucleotide
  Target: ATXN1; (+) strand; PAM type: NRG; PAM sequence: TGG
gcaggagaattgcttgaacc

SEQ ID NO: 111938 - DNA, 20 bp, Artificial Sequence
  Description of Artificial Sequence: Synthetic oligonucleotide
  Target: ATXN1; (+) strand; PAM type: NRG; PAM sequence: GGG
caggagaattgcttgaacct

SEQ ID NO: 111939 - DNA, 20 bp, Artificial Sequence
  Description of Artificial Sequence: Synthetic oligonucleotide
  Target: ATXN1; (+) strand; PAM type: NRG; PAM sequence: GAG
ggagaattgcttgaacctgg

SEQ ID NO: 111940 - DNA, 20 bp, Artificial Sequence
  Description of Artificial Sequence: Synthetic oligonucleotide
  Target: ATXN1; (+) strand; PAM type: NRG; PAM sequence: AGG
gagaattgcttgaacctggg

SEQ ID NO: 111941 - DNA, 20 bp, Artificial Sequence
  Description of Artificial Sequence: Synthetic oligonucleotide
  Target: ATXN1; (+) strand; PAM type: NRG; PAM sequence: CGG
aattgcttgaacctgggagg

SEQ ID NO: 111942 - DNA, 20 bp, Artificial Sequence
  Description of Artificial Sequence: Synthetic oligonucleotide
  Target: ATXN1; (+) strand; PAM type: NRG; PAM sequence: GAG
ttgcttgaacctgggaggcg

SEQ ID NO: 111943 - DNA, 20 bp, Artificial Sequence
  Description of Artificial Sequence: Synthetic oligonucleotide
  Target: ATXN1; (+) strand; PAM type: NRG; PAM sequence: AGG
tgcttgaacctgggaggcgg

SEQ ID NO: 111944 - DNA, 20 bp, Artificial Sequence
  Description of Artificial Sequence: Synthetic oligonucleotide
  Target: ATXN1; (+) strand; PAM type: NRG; PAM sequence: CAG
aacctgggaggcggaggttg

SEQ ID NO: 111945 - DNA, 20 bp, Artificial Sequence
  Description of Artificial Sequence: Synthetic oligonucleotide
  Target: ATXN1; (+) strand; PAM type: NRG; PAM sequence: GAG
tgggaggcggaggttgcagt

SEQ ID NO: 111946 - DNA, 20 bp, Artificial Sequence
  Description of Artificial Sequence: Synthetic oligonucleotide
  Target: ATXN1; (+) strand; PAM type: NRG; PAM sequence: GAG
ggcggaggttgcagtgagct

SEQ ID NO: 111947 - DNA, 20 bp, Artificial Sequence
  Description of Artificial Sequence: Synthetic oligonucleotide
  Target: ATXN1; (+) strand; PAM type: NRG; PAM sequence: CGG
agtgagctgagatcacacca

SEQ ID NO: 111948 - DNA, 20 bp, Artificial Sequence
  Description of Artificial Sequence: Synthetic oligonucleotide
  Target: ATXN1; (+) strand; PAM type: NRG; PAM sequence: CAG
gagatcacaccacggcactc

SEQ ID NO: 111949 - DNA, 20 bp, Artificial Sequence
  Description of Artificial Sequence: Synthetic oligonucleotide
  Target: ATXN1; (+) strand; PAM type: NRG; PAM sequence: TGG
cacaccacggcactccagcc

SEQ ID NO: 111950 - DNA, 20 bp, Artificial Sequence
  Description of Artificial Sequence: Synthetic oligonucleotide
  Target: ATXN1; (+) strand; PAM type: NRG; PAM sequence: GGG
acaccacggcactccagcct

SEQ ID NO: 111951 - DNA, 20 bp, Artificial Sequence
  Description of Artificial Sequence: Synthetic oligonucleotide
  Target: ATXN1; (+) strand; PAM type: NRG; PAM sequence: CAG
cggcactccagcctgggtga

SEQ ID NO: 111952 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggtgaca

SEQ ID NO: 111953 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggtgacagagt

SEQ ID NO: 111954 - DNA, 20 bp, Artificial Sequence
  Description of Artificial Sequence: Synthetic oligonucleotide
  Target: ATXN1; (+) strand; PAM type: NRG; PAM sequence: AAG
tcaaaaaaaaaaaaaaaaaa

SEQ ID NO: 111955 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaaaaaaagaa

SEQ ID NO: 111956 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaagaaaagaa

SEQ ID NO: 111957 - DNA, 20 bp, Artificial Sequence
  Description of Artificial Sequence: Synthetic oligonucleotide
  Target: ATXN1; (+) strand; PAM type: NRG; PAM sequence: AAG
aaaaaaagaaaagaaaagaa

SEQ ID NO: 111958 - DNA, 20 bp, Artificial Sequence
  Description of Artificial Sequence: Synthetic oligonucleotide
  Target: ATXN1; (+) strand; PAM type: NRG; PAM sequence: AAG
agaaaagaaaagaaaagaaa

SEQ ID NO: 111959 - DNA, 20 bp, Artificial Sequence
  Description of Artificial Sequence: Synthetic oligonucleotide
  Target: ATXN1; (+) strand; PAM type: NRG; PAM sequence: AAG
gtaaaataatttgaaaacaa

SEQ ID NO: 111960 - DNA, 20 bp, Artificial Sequence
  Description of Artificial Sequence: Synthetic oligonucleotide
  Target: ATXN1; (+) strand; PAM type: NRG; PAM sequence: AAG
aatttgaaaacaaaagccta

SEQ ID NO: 111961 - DNA, 20 bp, Artificial Sequence
  Description of Artificial Sequence: Synthetic oligonucleotide
  Target: ATXN1; (+) strand; PAM type: NRG; PAM sequence: CAG
ctaaagatgcttgctgaaat

SEQ ID NO: 111962 - DNA, 20 bp, Artificial Sequence
  Description of Artificial Sequence: Synthetic oligonucleotide
  Target: ATXN1; (+) strand; PAM type: NRG; PAM sequence: TAG
tgcttgctgaaatcagctat

SEQ ID NO: 111963 - DNA, 20 bp, Artificial Sequence
  Description of Artificial Sequence: Synthetic oligonucleotide
  Target: ATXN1; (+) strand; PAM type: NRG; PAM sequence: CAG
agctattagtctgttctctt

SEQ ID NO: 111964 - DNA, 20 bp, Artificial Sequence
  Description of Artificial Sequence: Synthetic oligonucleotide
  Target: ATXN1; (+) strand; PAM type: NRG; PAM sequence: AGG
gctattagtctgttctcttc

SEQ ID NO: 111965 - DNA, 20 bp, Artificial Sequence
  Description of Artificial Sequence: Synthetic oligonucleotide
  Target: ATXN1; (+) strand; PAM type: NRG; PAM sequence: AAG
ttttatgtcttattgactct

SEQ ID NO: 111966 - DNA, 20 bp, Artificial Sequence
  Description of Artificial Sequence: Synthetic oligonucleotide
  Target: ATXN1; (+) strand; PAM type: NRG; PAM sequence: AGG
tttatgtcttattgactcta

SEQ ID NO: 111967 - DNA, 20 bp, Artificial Sequence
  Description of Artificial Sequence: Synthetic oligonucleotide
  Target: ATXN1; (+) strand; PAM type: NRG; PAM sequence: TGG
gtcttattgactctaaggta

SEQ ID NO: 111968 - DNA, 20 bp, Artificial Sequence
  Description of Artificial Sequence: Synthetic oligonucleotide
  Target: ATXN1; (+) strand; PAM type: NRG; PAM sequence: AAG
ttaatattgatattgaatta

SEQ ID NO: 111969 - DNA, 20 bp, Artificial Sequence
  Description of Artificial Sequence: Synthetic oligonucleotide
  Target: ATXN1; (+) strand; PAM type: NRG; PAM sequence: CAG
tattgatattgaattaaagt

SEQ ID NO: 111970 - DNA, 20 bp, Artificial Sequence
  Description of Artificial Sequence: Synthetic oligonucleotide
  Target: ATXN1; (+) strand; PAM type: NRG; PAM sequence: AAG
tattgaattaaagtcagtgc

SEQ ID NO: 111971 - DNA, 20 bp, Artificial Sequence
  Description of Artificial Sequence: Synthetic oligonucleotide
  Target: ATXN1; (+) strand; PAM type: NRG; PAM sequence: TAG
taaagtcagtgcaagatctg

SEQ ID NO: 111972 - DNA, 20 bp, Artificial Sequence
  Description of Artificial Sequence: Synthetic oligonucleotide
  Target: ATXN1; (+) strand; PAM type: NRG; PAM sequence: TAG
gtgcaagatctgtagtacat

SEQ ID NO: 111973 - DNA, 20 bp, Artificial Sequence
  Description of Artificial Sequence: Synthetic oligonucleotide
  Target: ATXN1; (+) strand; PAM type: NRG; PAM sequence: AAG
aagatctgtagtacattagt

SEQ ID NO: 111974 - DNA, 20 bp, Artificial Sequence
  Description of Artificial Sequence: Synthetic oligonucleotide
  Target: ATXN1; (+) strand; PAM type: NRG; PAM sequence: TGG
cattagtaagtatgcaaaaa

SEQ ID NO: 111975 - DNA, 20 bp, Artificial Sequence
  Description of Artificial Sequence: Synthetic oligonucleotide
  Target: ATXN1; (+) strand; PAM type: NRG; PAM sequence: GGG
attagtaagtatgcaaaaat

SEQ ID NO: 111976 - DNA, 20 bp, Artificial Sequence
  Description of Artificial Sequence: Synthetic oligonucleotide
  Target: ATXN1; (+) strand; PAM type: NRG; PAM sequence: AAG
tatgcaaaaatgggaaattg

SEQ ID NO: 111977 - DNA, 20 bp, Artificial Sequence
  Description of Artificial Sequence: Synthetic oligonucleotide
  Target: ATXN1; (+) strand; PAM type: NRG; PAM sequence: TAG
ggaaattgaagccctgttta

SEQ ID NO: 111978 - DNA, 20 bp, Artificial Sequence
  Description of Artificial Sequence: Synthetic oligonucleotide
  Target: ATXN1; (+) strand; PAM type: NRG; PAM sequence: AGG
gaaattgaagccctgtttat

SEQ ID NO: 111979 - DNA, 20 bp, Artificial Sequence
  Description of Artificial Sequence: Synthetic oligonucleotide
  Target: ATXN1; (+) strand; PAM type: NRG; PAM sequence: TGG
attgaagccctgtttatagg

SEQ ID NO: 111980 - DNA, 20 bp, Artificial Sequence
  Description of Artificial Sequence: Synthetic oligonucleotide
  Target: ATXN1; (+) strand; PAM type: NRG; PAM sequence: CAG
ccctgtttataggtggtact

SEQ ID NO: 111981 - DNA, 20 bp, Artificial Sequence
  Description of Artificial Sequence: Synthetic oligonucleotide
  Target: ATXN1; (+) strand; PAM type: NRG; PAM sequence: GAG
ctgtttataggtggtactca

SEQ ID NO: 111982 - DNA, 20 bp, Artificial Sequence
  Description of Artificial Sequence: Synthetic oligonucleotide
  Target: ATXN1; (+) strand; PAM type: NRG; PAM sequence: AAG
tttataggtggtactcagag

SEQ ID NO: 111983 - DNA, 20 bp, Artificial Sequence
  Description of Artificial Sequence: Synthetic oligonucleotide
  Target: ATXN1; (+) strand; PAM type: NRG; PAM sequence: AGG
ttataggtggtactcagaga

SEQ ID NO: 111984 - DNA, 20 bp, Artificial Sequence
  Description of Artificial Sequence: Synthetic oligonucleotide
  Target: ATXN1; (+) strand; PAM type: NRG; PAM sequence: CAG
ggtggtactcagagaaggcc

SEQ ID NO: 111985 - DNA, 20 bp, Artificial Sequence
  Description of Artificial Sequence: Synthetic oligonucleotide
  Target: ATXN1; (+) strand; PAM type: NRG; PAM sequence: AGG
gtggtactcagagaaggccc

SEQ ID NO: 111986 - DNA, 20 bp, Artificial Sequence
  Description of Artificial Sequence: Synthetic oligonucleotide
  Target: ATXN1; (+) strand; PAM type: NRG; PAM sequence: GGG
tggtactcagagaaggccca

SEQ ID NO: 111987 - DNA, 20 bp, Artificial Sequence
  Description of Artificial Sequence: Synthetic oligonucleotide
  Target: ATXN1; (+) strand; PAM type: NRG; PAM sequence: TGG
cagagaaggcccagggttgt

SEQ ID NO: 111988 - DNA, 20 bp, Artificial Sequence
  Description of Artificial Sequence: Synthetic oligonucleotide
  Target: ATXN1; (+) strand; PAM type: NRG; PAM sequence: TGG
ccagggttgttggtgccaac

SEQ ID NO: 111989 - DNA, 20 bp, Artificial Sequence
  Description of Artificial Sequence: Synthetic oligonucleotide
  Target: ATXN1; (+) strand; PAM type: NRG; PAM sequence: AAG
ttgttggtgccaactggaaa

SEQ ID NO: 111990 - DNA, 20 bp, Artificial Sequence
  Description of Artificial Sequence: Synthetic oligonucleotide
  Target: ATXN1; (+) strand; PAM type: NRG; PAM sequence: TAG
tttatatctgattatattaa

SEQ ID NO: 111991 - DNA, 20 bp, Artificial Sequence
  Description of Artificial Sequence: Synthetic oligonucleotide
  Target: ATXN1; (+) strand; PAM type: NRG; PAM sequence: TGG
tattaatagcaacattgatc

SEQ ID NO: 111992 - DNA, 20 bp, Artificial Sequence
  Description of Artificial Sequence: Synthetic oligonucleotide
  Target: ATXN1; (+) strand; PAM type: NRG; PAM sequence: TGG
attgatctggcattttgccc

SEQ ID NO: 111993 - DNA, 20 bp, Artificial Sequence
  Description of Artificial Sequence: Synthetic oligonucleotide
  Target: ATXN1; (+) strand; PAM type: NRG; PAM sequence: TAG
tctggcattttgccctggca

SEQ ID NO: 111994 - DNA, 20 bp, Artificial Sequence
  Description of Artificial Sequence: Synthetic oligonucleotide
  Target: ATXN1; (+) strand; PAM type: NRG; PAM sequence: AAG
catagttttttaccttcttg

SEQ ID NO: 111995 - DNA, 20 bp, Artificial Sequence
  Description of Artificial Sequence: Synthetic oligonucleotide
  Target: ATXN1; (+) strand; PAM type: NRG; PAM sequence: AGG
atagttttttaccttcttga

SEQ ID NO: 111996 - DNA, 20 bp, Artificial Sequence
  Description of Artificial Sequence: Synthetic oligonucleotide
  Target: ATXN1; (+) strand; PAM type: NRG; PAM sequence: TGG
ttaaaaaaaaaaaatctccc

SEQ ID NO: 111997 - DNA, 20 bp, Artificial Sequence
  Description of Artificial Sequence: Synthetic oligonucleotide
  Target: ATXN1; (+) strand; PAM type: NRG; PAM sequence: CAG
aaaaatctccctggctgcat

SEQ ID NO: 111998 - DNA, 20 bp, Artificial Sequence
  Description of Artificial Sequence: Synthetic oligonucleotide
  Target: ATXN1; (+) strand; PAM type: NRG; PAM sequence: AGG
aaaatctccctggctgcatc

SEQ ID NO: 111999 - DNA, 20 bp, Artificial Sequence
  Description of Artificial Sequence: Synthetic oligonucleotide
  Target: ATXN1; (+) strand; PAM type: NRG; PAM sequence: AAG
ccctggctgcatcaggattt

SEQ ID NO: 112000 - DNA, 20 bp, Artificial Sequence
  Description of Artificial Sequence: Synthetic oligonucleotide
  Target: ATXN1; (+) strand; PAM type: NRG; PAM sequence: TGG
tgcatcaggatttaagacat

SEQ ID NO: 112001 - DNA, 20 bp, Artificial Sequence
  Description of Artificial Sequence: Synthetic oligonucleotide
  Target: ATXN1; (+) strand; PAM type: NRG; PAM sequence: GGG
gcatcaggatttaagacatt

SEQ ID NO: 112002 - DNA, 20 bp, Artificial Sequence
  Description of Artificial Sequence: Synthetic oligonucleotide
  Target: ATXN1; (+) strand; PAM type: NRG; PAM sequence: GGG
catcaggatttaagacattg

SEQ ID NO: 112003 - DNA, 20 bp, Artificial Sequence
  Description of Artificial Sequence: Synthetic oligonucleotide
  Target: ATXN1; (+) strand; PAM type: NRG; PAM sequence: GAG
tcaggatttaagacattggg

SEQ ID NO: 112004 - DNA, 20 bp, Artificial Sequence
  Description of Artificial Sequence: Synthetic oligonucleotide
  Target: ATXN1; (+) strand; PAM type: NRG; PAM sequence: AAG
gatttaagacattggggaga

SEQ ID NO: 112005 - DNA, 20 bp, Artificial Sequence
  Description of Artificial Sequence: Synthetic oligonucleotide
  Target: ATXN1; (+) strand; PAM type: NRG; PAM sequence: AAG
taagacattggggagaaaga

SEQ ID NO: 112006 - DNA, 20 bp, Artificial Sequence
  Description of Artificial Sequence: Synthetic oligonucleotide
  Target: ATXN1; (+) strand; PAM type: NRG; PAM sequence: AGG
aagacattggggagaaagaa

SEQ ID NO: 112007 - DNA, 20 bp, Artificial Sequence
  Description of Artificial Sequence: Synthetic oligonucleotide
  Target: ATXN1; (+) strand; PAM type: NRG; PAM sequence: AAG
ttggggagaaagaaaggata

SEQ ID NO: 112008 - DNA, 20 bp, Artificial Sequence
  Description of Artificial Sequence: Synthetic oligonucleotide
  Target: ATXN1; (+) strand; PAM type: NRG; PAM sequence: GAG
ggggagaaagaaaggataaa

SEQ ID NO: 112009 - DNA, 20 bp, Artificial Sequence
  Description of Artificial Sequence: Synthetic oligonucleotide
  Target: ATXN1; (+) strand; PAM type: NRG; PAM sequence: AGG
gggagaaagaaaggataaag

SEQ ID NO: 112010 - DNA, 20 bp, Artificial Sequence
  Description of Artificial Sequence: Synthetic oligonucleotide
  Target: ATXN1; (+) strand; PAM type: NRG; PAM sequence: GGG
ggagaaagaaaggataaaga

SEQ ID NO: 112011 - DNA, 20 bp, Artificial Sequence
  Description of Artificial Sequence: Synthetic oligonucleotide
  Target: ATXN1; (+) strand; PAM type: NRG; PAM sequence: AAG
agaaaggataaagagggaac

SEQ ID NO: 112012 - DNA, 20 bp, Artificial Sequence
  Description of Artificial Sequence: Synthetic oligonucleotide
  Target: ATXN1; (+) strand; PAM type: NRG; PAM sequence: AGG
gaaaggataaagagggaaca

SEQ ID NO: 112013 - DNA, 20 bp, Artificial Sequence
  Description of Artificial Sequence: Synthetic oligonucleotide
  Target: ATXN1; (+) strand; PAM type: NRG; PAM sequence: GGG
aaaggataaagagggaacaa

SEQ ID NO: 112014 - DNA, 20 bp, Artificial Sequence
  Description of Artificial Sequence: Synthetic oligonucleotide
  Target: ATXN1; (+) strand; PAM type: NRG; PAM sequence: AAG
ataaagagggaacaagggca

SEQ ID NO: 112015 - DNA, 20 bp, Artificial Sequence
  Description of Artificial Sequence: Synthetic oligonucleotide
  Target: ATXN1; (+) strand; PAM type: NRG; PAM sequence: GAG
gagggaacaagggcaaagat

SEQ ID NO: 112016 - DNA, 20 bp, Artificial Sequence
  Description of Artificial Sequence: Synthetic oligonucleotide
  Target: ATXN1; (+) strand; PAM type: NRG; PAM sequence: AGG
agggaacaagggcaaagatg

SEQ ID NO: 112017 - DNA, 20 bp, Artificial Sequence
  Description of Artificial Sequence: Synthetic oligonucleotide
  Target: ATXN1; (+) strand; PAM type: NRG; PAM sequence: AAG
ggcaaagatgaggatcattg

SEQ ID NO: 112018 - DNA, 20 bp, Artificial Sequence
  Description of Artificial Sequence: Synthetic oligonucleotide
  Target: ATXN1; (+) strand; PAM type: NRG; PAM sequence: AAG
gaggatcattgaagacgttc

SEQ ID NO: 112019 - DNA, 20 bp, Artificial Sequence
  Description of Artificial Sequence: Synthetic oligonucleotide
  Target: ATXN1; (+) strand; PAM type: NRG; PAM sequence: AGG
aggatcattgaagacgttca

SEQ ID NO: 112020 - DNA, 20 bp, Artificial Sequence
  Description of Artificial Sequence: Synthetic oligonucleotide
  Target: ATXN1; (+) strand; PAM type: NRG; PAM sequence: TAG
gataattaaacttctgccca

SEQ ID NO: 112021 - DNA, 20 bp, Artificial Sequence
  Description of Artificial Sequence: Synthetic oligonucleotide
  Target: ATXN1; (+) strand; PAM type: NRG; PAM sequence: TGG
attaaacttctgcccatagc

SEQ ID NO: 112022 - DNA, 20 bp, Artificial Sequence
  Description of Artificial Sequence: Synthetic oligonucleotide
  Target: ATXN1; (+) strand; PAM type: NRG; PAM sequence: TGG
acttctgcccatagctggcc

SEQ ID NO: 112023 - DNA, 20 bp, Artificial Sequence
  Description of Artificial Sequence: Synthetic oligonucleotide
  Target: ATXN1; (+) strand; PAM type: NRG; PAM sequence: GGG
cttctgcccatagctggcct

SEQ ID NO: 112024 - DNA, 20 bp, Artificial Sequence
  Description of Artificial Sequence: Synthetic oligonucleotide
  Target: ATXN1; (+) strand; PAM type: NRG; PAM sequence: GGG
ttctgcccatagctggcctg

SEQ ID NO: 112025 - DNA, 20 bp, Artificial Sequence
  Description of Artificial Sequence: Synthetic oligonucleotide
  Target: ATXN1; (+) strand; PAM type: NRG; PAM sequence: GGG
tctgcccatagctggcctgg

SEQ ID NO: 112026 - DNA, 20 bp, Artificial Sequence
  Description of Artificial Sequence: Synthetic oligonucleotide
  Target: ATXN1; (+) strand; PAM type: NRG; PAM sequence: GAG
tgcccatagctggcctgggg

SEQ ID NO: 112027 - DNA, 20 bp, Artificial Sequence
  Description of Artificial Sequence: Synthetic oligonucleotide
  Target: ATXN1; (+) strand; PAM type: NRG; PAM sequence: TAG
gggagaaatgaatgtcaccg

SEQ ID NO: 112028 - DNA, 20 bp, Artificial Sequence
  Description of Artificial Sequence: Synthetic oligonucleotide
  Target: ATXN1; (+) strand; PAM type: NRG; PAM sequence: TGG
aaatgaatgtcaccgtagta

SEQ ID NO: 112029 - DNA, 20 bp, Artificial Sequence
  Description of Artificial Sequence: Synthetic oligonucleotide
  Target: ATXN1; (+) strand; PAM type: NRG; PAM sequence: TGG
atgtcaccgtagtatggatg

SEQ ID NO: 112030 - DNA, 20 bp, Artificial Sequence
  Description of Artificial Sequence: Synthetic oligonucleotide
  Target: ATXN1; (+) strand; PAM type: NRG; PAM sequence: TGG
caccgtagtatggatgtggc

SEQ ID NO: 112031 - DNA, 20 bp, Artificial Sequence
  Description of Artificial Sequence: Synthetic oligonucleotide
  Target: ATXN1; (+) strand; PAM type: NRG; PAM sequence: CAG
gtatggatgtggctggctca

SEQ ID NO: 112032 - DNA, 20 bp, Artificial Sequence
  Description of Artificial Sequence: Synthetic oligonucleotide
  Target: ATXN1; (+) strand; PAM type: NRG; PAM sequence: AAG
tgtggctggctcacagtgtg

SEQ ID NO: 112033 - DNA, 20 bp, Artificial Sequence
  Description of Artificial Sequence: Synthetic oligonucleotide
  Target: ATXN1; (+) strand; PAM type: NRG; PAM sequence: GAG
tggctggctcacagtgtgaa

SEQ ID NO: 112034 - DNA, 20 bp, Artificial Sequence
  Description of Artificial Sequence: Synthetic oligonucleotide
  Target: ATXN1; (+) strand; PAM type: NRG; PAM sequence: GAG
gctggctcacagtgtgaaga

SEQ ID NO: 112035 - DNA, 20 bp, Artificial Sequence
  Description of Artificial Sequence: Synthetic oligonucleotide
  Target: ATXN1; (+) strand; PAM type: NRG; PAM sequence: AAG
ggctcacagtgtgaagagag

SEQ ID NO: 112036 - DNA, 20 bp, Artificial Sequence
  Description of Artificial Sequence: Synthetic oligonucleotide
  Target: ATXN1; (+) strand; PAM type: NRG; PAM sequence: CAG
aagagagaagaccttgtttc

SEQ ID NO: 112037 - DNA, 20 bp, Artificial Sequence
  Description of Artificial Sequence: Synthetic oligonucleotide
  Target: ATXN1; (+) strand; PAM type: NRG; PAM sequence: CAG
accttgtttccagtcattca

SEQ ID NO: 112038 - DNA, 20 bp, Artificial Sequence
  Description of Artificial Sequence: Synthetic oligonucleotide
  Target: ATXN1; (+) strand; PAM type: NRG; PAM sequence: GAG
cagtcattcacagccctgtt

SEQ ID NO: 112039 - DNA, 20 bp, Artificial Sequence
  Description of Artificial Sequence: Synthetic oligonucleotide
  Target: ATXN1; (+) strand; PAM type: NRG; PAM sequence: AAG
cctaattccttcaccctctg

SEQ ID NO: 112040 - DNA, 20 bp, Artificial Sequence
  Description of Artificial Sequence: Synthetic oligonucleotide
  Target: ATXN1; (+) strand; PAM type: NRG; PAM sequence: AAG
tccaacattatttaattgat

SEQ ID NO: 112041 - DNA, 20 bp, Artificial Sequence
  Description of Artificial Sequence: Synthetic oligonucleotide
  Target: ATXN1; (+) strand; PAM type: NRG; PAM sequence: AAG
tcatcttgtcctttgtgttt

SEQ ID NO: 112042 - DNA, 20 bp, Artificial Sequence
  Description of Artificial Sequence: Synthetic oligonucleotide
  Target: ATXN1; (+) strand; PAM type: NRG; PAM sequence: TAG
tatgtatgtcttatctccct

SEQ ID NO: 112043 - DNA, 20 bp, Artificial Sequence
  Description of Artificial Sequence: Synthetic oligonucleotide
  Target: ATXN1; (+) strand; PAM type: NRG; PAM sequence: TAG
gtatgtcttatctcccttag

SEQ ID NO: 112044 - DNA, 20 bp, Artificial Sequence
  Description of Artificial Sequence: Synthetic oligonucleotide
  Target: ATXN1; (+) strand; PAM type: NRG; PAM sequence: CAG
tatctcccttagtagattgt

SEQ ID NO: 112045 - DNA, 20 bp, Artificial Sequence
  Description of Artificial Sequence: Synthetic oligonucleotide
  Target: ATXN1; (+) strand; PAM type: NRG; PAM sequence: GAG
tagtagattgtcagcttctt

SEQ ID NO: 112046 - DNA, 20 bp, Artificial Sequence
  Description of Artificial Sequence: Synthetic oligonucleotide
  Target: ATXN1; (+) strand; PAM type: NRG; PAM sequence: AGG
agtagattgtcagcttcttg

SEQ ID NO: 112047 - DNA, 20 bp, Artificial Sequence
  Description of Artificial Sequence: Synthetic oligonucleotide
  Target: ATXN1; (+) strand; PAM type: NRG; PAM sequence: CAG
ttatcttgaatgttttaact

SEQ ID NO: 112048 - DNA, 20 bp, Artificial Sequence
  Description of Artificial Sequence: Synthetic oligonucleotide
  Target: ATXN1; (+) strand; PAM type: NRG; PAM sequence: TAG
ctctctcgcactatcttgct

SEQ ID NO: 112049 - DNA, 20 bp, Artificial Sequence
  Description of Artificial Sequence: Synthetic oligonucleotide
  Target: ATXN1; (+) strand; PAM type: NRG; PAM sequence: AGG
tctctcgcactatcttgctt

SEQ ID NO: 112050 - DNA, 20 bp, Artificial Sequence
  Description of Artificial Sequence: Synthetic oligonucleotide
  Target: ATXN1; (+) strand; PAM type: NRG; PAM sequence: GGG
ctctcgcactatcttgctta

SEQ ID NO: 112051 - DNA, 20 bp, Artificial Sequence
  Description of Artificial Sequence: Synthetic oligonucleotide
  Target: ATXN1; (+) strand; PAM type: NRG; PAM sequence: AAG
tcgcactatcttgcttaggg

SEQ ID NO: 112052 - DNA, 20 bp, Artificial Sequence
  Description of Artificial Sequence: Synthetic oligonucleotide
  Target: ATXN1; (+) strand; PAM type: NRG; PAM sequence: TAG
ggaagacacccaataaatat

SEQ ID NO: 112053 - DNA, 20 bp, Artificial Sequence
  Description of Artificial Sequence: Synthetic oligonucleotide
  Target: ATXN1; (+) strand; PAM type: NRG; PAM sequence: AAG
cacccaataaatattagttg

SEQ ID NO: 112054 - DNA, 20 bp, Artificial Sequence
  Description of Artificial Sequence: Synthetic oligonucleotide
  Target: ATXN1; (+) strand; PAM type: NRG; PAM sequence: AAG
tattagttgaagacatgacc

SEQ ID NO: 112055 - DNA, 20 bp, Artificial Sequence
  Description of Artificial Sequence: Synthetic oligonucleotide
  Target: ATXN1; (+) strand; PAM type: NRG; PAM sequence: AAG
aagacatgaccaagtgcatg

SEQ ID NO: 112056 - DNA, 20 bp, Artificial Sequence
  Description of Artificial Sequence: Synthetic oligonucleotide
  Target: ATXN1; (+) strand; PAM type: NRG; PAM sequence: TAG
caagtgcatgaagtactgta

SEQ ID NO: 112057 - DNA, 20 bp, Artificial Sequence
  Description of Artificial Sequence: Synthetic oligonucleotide
  Target: ATXN1; (+) strand; PAM type: NRG; PAM sequence: AGG
aagtgcatgaagtactgtat

SEQ ID NO: 112058 - DNA, 20 bp, Artificial Sequence
  Description of Artificial Sequence: Synthetic oligonucleotide
  Target: ATXN1; (+) strand; PAM type: NRG; PAM sequence: AAG
actgtataggcttgctaaat

SEQ ID NO: 112059 - DNA, 20 bp, Artificial Sequence
  Description of Artificial Sequence: Synthetic oligonucleotide
  Target: ATXN1; (+) strand; PAM type: NRG; PAM sequence: AGG
ctgtataggcttgctaaata

SEQ ID NO: 112060 - DNA, 20 bp, Artificial Sequence
  Description of Artificial Sequence: Synthetic oligonucleotide
  Target: ATXN1; (+) strand; PAM type: NRG; PAM sequence: GGG
tgtataggcttgctaaataa

SEQ ID NO: 112061 - DNA, 20 bp, Artificial Sequence
  Description of Artificial Sequence: Synthetic oligonucleotide
  Target: ATXN1; (+) strand; PAM type: NRG; PAM sequence: CAG
ataggcttgctaaataaggg

SEQ ID NO: 112062 - DNA, 20 bp, Artificial Sequence
  Description of Artificial Sequence: Synthetic oligonucleotide
  Target: ATXN1; (+) strand; PAM type: NRG; PAM sequence: TGG
aagggcagtaaaaatgccat

SEQ ID NO: 112063 - DNA, 20 bp, Artificial Sequence
  Description of Artificial Sequence: Synthetic oligonucleotide
  Target: ATXN1; (+) strand; PAM type: NRG; PAM sequence: TAG
aaaaatgccattggatcttg

SEQ ID NO: 112064 - DNA, 20 bp, Artificial Sequence
  Description of Artificial Sequence: Synthetic oligonucleotide
  Target: ATXN1; (+) strand; PAM type: NRG; PAM sequence: AGG
aaaatgccattggatcttgt

SEQ ID NO: 112065 - DNA, 20 bp, Artificial Sequence
  Description of Artificial Sequence: Synthetic oligonucleotide
  Target: ATXN1; (+) strand; PAM type: NRG; PAM sequence: GAG
ggatcttgtaggcaaattct

SEQ ID NO: 112066 - DNA, 20 bp, Artificial Sequence
  Description of Artificial Sequence: Synthetic oligonucleotide
  Target: ATXN1; (+) strand; PAM type: NRG; PAM sequence: AGG
gatcttgtaggcaaattctg

SEQ ID NO: 112067 - DNA, 20 bp, Artificial Sequence
  Description of Artificial Sequence: Synthetic oligonucleotide
  Target: ATXN1; (+) strand; PAM type: NRG; PAM sequence: CGG
ggcaaattctgaggttgtaa

SEQ ID NO: 112068 - DNA, 20 bp, Artificial Sequence
  Description of Artificial Sequence: Synthetic oligonucleotide
  Target: ATXN1; (+) strand; PAM type: NRG; PAM sequence: TAG
attcactgaattgtgaacta

SEQ ID NO: 112069 - DNA, 20 bp, Artificial Sequence
  Description of Artificial Sequence: Synthetic oligonucleotide
  Target: ATXN1; (+) strand; PAM type: NRG; PAM sequence: TAG
tagaatatgaaccctgtcaa

SEQ ID NO: 112070 - DNA, 20 bp, Artificial Sequence
  Description of Artificial Sequence: Synthetic oligonucleotide
  Target: ATXN1; (+) strand; PAM type: NRG; PAM sequence: AGG
agaatatgaaccctgtcaat

SEQ ID NO: 112071 - DNA, 20 bp, Artificial Sequence
  Description of Artificial Sequence: Synthetic oligonucleotide
  Target: ATXN1; (+) strand; PAM type: NRG; PAM sequence: GAG
aatatgaaccctgtcaatag

SEQ ID NO: 112072 - DNA, 20 bp, Artificial Sequence
  Description of Artificial Sequence: Synthetic oligonucleotide
  Target: ATXN1; (+) strand; PAM type: NRG; PAM sequence: AAG
aataggagaaacctttctaa

SEQ ID NO: 112073 - DNA, 20 bp, Artificial Sequence
  Description of Artificial Sequence: Synthetic oligonucleotide
  Target: ATXN1; (+) strand; PAM type: NRG; PAM sequence: TAG
ttctttgttgtgcatgtttt

SEQ ID NO: 112074 - DNA, 20 bp, Artificial Sequence
  Description of Artificial Sequence: Synthetic oligonucleotide
  Target: ATXN1; (+) strand; PAM type: NRG; PAM sequence: AGG
tctttgttgtgcatgttttt

SEQ ID NO: 112075 - DNA, 20 bp, Artificial Sequence
  Description of Artificial Sequence: Synthetic oligonucleotide
  Target: ATXN1; (+) strand; PAM type: NRG; PAM sequence: GGG
ctttgttgtgcatgttttta

SEQ ID NO: 112076 - DNA, 20 bp, Artificial Sequence
  Description of Artificial Sequence: Synthetic oligonucleotide
  Target: ATXN1; (+) strand; PAM type: NRG; PAM sequence: CAG
tgtgcatgtttttagggatt

SEQ ID NO: 112077 - DNA, 20 bp, Artificial Sequence
  Description of Artificial Sequence: Synthetic oligonucleotide
  Target: ATXN1; (+) strand; PAM type: NRG; PAM sequence: CAG
atgtttttagggattcagtc

SEQ ID NO: 112078 - DNA, 20 bp, Artificial Sequence
  Description of Artificial Sequence: Synthetic oligonucleotide
  Target: ATXN1; (+) strand; PAM type: NRG; PAM sequence: CGG
ttcagtccagaactttcacc

SEQ ID NO: 112079 - DNA, 20 bp, Artificial Sequence
  Description of Artificial Sequence: Synthetic oligonucleotide
  Target: ATXN1; (+) strand; PAM type: NRG; PAM sequence: AAG
ttcacccggaaactcaaaac

SEQ ID NO: 112080 - DNA, 20 bp, Artificial Sequence
  Description of Artificial Sequence: Synthetic oligonucleotide
  Target: ATXN1; (+) strand; PAM type: NRG; PAM sequence: TAG
gaaactcaaaacaagaaatt

SEQ ID NO: 112081 - DNA, 20 bp, Artificial Sequence
  Description of Artificial Sequence: Synthetic oligonucleotide
  Target: ATXN1; (+) strand; PAM type: NRG; PAM sequence: CAG
aaatttagtttgaaataaat

SEQ ID NO: 112082 - DNA, 20 bp, Artificial Sequence
  Description of Artificial Sequence: Synthetic oligonucleotide
  Target: ATXN1; (+) strand; PAM type: NRG; PAM sequence: AGG
aatttagtttgaaataaatc

SEQ ID NO: 112083 - DNA, 20 bp, Artificial Sequence
  Description of Artificial Sequence: Synthetic oligonucleotide
  Target: ATXN1; (+) strand; PAM type: NRG; PAM sequence: AAG
gaaataaatcaggtcttaac

SEQ ID NO: 112084 - DNA, 20 bp, Artificial Sequence
  Description of Artificial Sequence: Synthetic oligonucleotide
  Target: ATXN1; (+) strand; PAM type: NRG; PAM sequence: GAG
taaatcaggtcttaacaagt

SEQ ID NO: 112085 - DNA, 20 bp, Artificial Sequence
  Description of Artificial Sequence: Synthetic oligonucleotide
  Target: ATXN1; (+) strand; PAM type: NRG; PAM sequence: GAG
aatcaggtcttaacaagtga

SEQ ID NO: 112086 - DNA, 20 bp, Artificial Sequence
  Description of Artificial Sequence: Synthetic oligonucleotide
  Target: ATXN1; (+) strand; PAM type: NRG; PAM sequence: AAG
ttaacaagtgagagactatt

SEQ ID NO: 112087 - DNA, 20 bp, Artificial Sequence
  Description of Artificial Sequence: Synthetic oligonucleotide
  Target: ATXN1; (+) strand; PAM type: NRG; PAM sequence: CAG
tgagagactattaagattaa

SEQ ID NO: 112088 - DNA, 20 bp, Artificial Sequence
  Description of Artificial Sequence: Synthetic oligonucleotide
  Target: ATXN1; (+) strand; PAM type: NRG; PAM sequence: TGG
ttaagattaacagactgtct

SEQ ID NO: 112089 - DNA, 20 bp, Artificial Sequence
  Description of Artificial Sequence: Synthetic oligonucleotide
  Target: ATXN1; (+) strand; PAM type: NRG; PAM sequence: CAG
gattaacagactgtcttgga

SEQ ID NO: 112090 - DNA, 20 bp, Artificial Sequence
  Description of Artificial Sequence: Synthetic oligonucleotide
  Target: ATXN1; (+) strand; PAM type: NRG; PAM sequence: AAG
tgcgtgtcccttatcatcta

SEQ ID NO: 112091 - DNA, 20 bp, Artificial Sequence
  Description of Artificial Sequence: Synthetic oligonucleotide
  Target: ATXN1; (+) strand; PAM type: NRG; PAM sequence: AGG
gcgtgtcccttatcatctaa

SEQ ID NO: 112092 - DNA, 20 bp, Artificial Sequence
  Description of Artificial Sequence: Synthetic oligonucleotide
  Target: ATXN1; (+) strand; PAM type: NRG; PAM sequence: GGG
cgtgtcccttatcatctaaa

SEQ ID NO: 112093 - DNA, 20 bp, Artificial Sequence
  Description of Artificial Sequence: Synthetic oligonucleotide
  Target: ATXN1; (+) strand; PAM type: NRG; PAM sequence: TAG
atcatctaaagggttactac

SEQ ID NO: 112094 - DNA, 20 bp, Artificial Sequence
  Description of Artificial Sequence: Synthetic oligonucleotide
  Target: ATXN1; (+) strand; PAM type: NRG; PAM sequence: CAG
catccttttctgctttatct

SEQ ID NO: 112095 - DNA, 20 bp, Artificial Sequence
  Description of Artificial Sequence: Synthetic oligonucleotide
  Target: ATXN1; (+) strand; PAM type: NRG; PAM sequence: GAG
tccttttctgctttatctca

SEQ ID NO: 112096 - DNA, 20 bp, Artificial Sequence
  Description of Artificial Sequence: Synthetic oligonucleotide
  Target: ATXN1; (+) strand; PAM type: NRG; PAM sequence: AGG
ccttttctgctttatctcag

SEQ ID NO: 112097 - DNA, 20 bp, Artificial Sequence
  Description of Artificial Sequence: Synthetic oligonucleotide
  Target: ATXN1; (+) strand; PAM type: NRG; PAM sequence: AAG
tttatctcagaggcccatta

SEQ ID NO: 112098 - DNA, 20 bp, Artificial Sequence
  Description of Artificial Sequence: Synthetic oligonucleotide
  Target: ATXN1; (+) strand; PAM type: NRG; PAM sequence: CAG
ggcccattaaagcatgtaac

SEQ ID NO: 112099 - DNA, 20 bp, Artificial Sequence
  Description of Artificial Sequence: Synthetic oligonucleotide
  Target: ATXN1; (+) strand; PAM type: NRG; PAM sequence: CAG
aagcatgtaaccagactgct

SEQ ID NO: 112100 - DNA, 20 bp, Artificial Sequence
  Description of Artificial Sequence: Synthetic oligonucleotide
  Target: ATXN1; (+) strand; PAM type: NRG; PAM sequence: AAG
tactaattttctctttccaa

SEQ ID NO: 112101 - DNA, 20 bp, Artificial Sequence
  Description of Artificial Sequence: Synthetic oligonucleotide
  Target: ATXN1; (+) strand; PAM type: NRG; PAM sequence: AAG
caacaaaataaaactccacc

SEQ ID NO: 112102 - DNA, 20 bp, Artificial Sequence
  Description of Artificial Sequence: Synthetic oligonucleotide
  Target: ATXN1; (+) strand; PAM type: NRG; PAM sequence: CGG
tatccatacaattctatcca

SEQ ID NO: 112103 - DNA, 20 bp, Artificial Sequence
  Description of Artificial Sequence: Synthetic oligonucleotide
  Target: ATXN1; (+) strand; PAM type: NRG; PAM sequence: CAG
tacaattctatccacggcaa

SEQ ID NO: 112104 - DNA, 20 bp, Artificial Sequence
  Description of Artificial Sequence: Synthetic oligonucleotide
  Target: ATXN1; (+) strand; PAM type: NRG; PAM sequence: CAG
tctatccacggcaacagcgt

SEQ ID NO: 112105 - DNA, 20 bp, Artificial Sequence
  Description of Artificial Sequence: Synthetic oligonucleotide
  Target: ATXN1; (+) strand; PAM type: NRG; PAM sequence: CAG
cggcaacagcgtcagtttct

SEQ ID NO: 112106 - DNA, 20 bp, Artificial Sequence
  Description of Artificial Sequence: Synthetic oligonucleotide
  Target: ATXN1; (+) strand; PAM type: NRG; PAM sequence: CAG
tttctcagaaatttcattgc

SEQ ID NO: 112107 - DNA, 20 bp, Artificial Sequence
  Description of Artificial Sequence: Synthetic oligonucleotide
  Target: ATXN1; (+) strand; PAM type: NRG; PAM sequence: AGG
ttctcagaaatttcattgcc

SEQ ID NO: 112108 - DNA, 20 bp, Artificial Sequence
  Description of Artificial Sequence: Synthetic oligonucleotide
  Target: ATXN1; (+) strand; PAM type: NRG; PAM sequence: TGG
gccaggctcccccacttcaa

SEQ ID NO: 112109 - DNA, 20 bp, Artificial Sequence
  Description of Artificial Sequence: Synthetic oligonucleotide
  Target: ATXN1; (+) strand; PAM type: NRG; PAM sequence: TAG
tcccccacttcaatggacaa

SEQ ID NO: 112110 - DNA, 20 bp, Artificial Sequence
  Description of Artificial Sequence: Synthetic oligonucleotide
  Target: ATXN1; (+) strand; PAM type: NRG; PAM sequence: AAG
cccacttcaatggacaatag

SEQ ID NO: 112111 - DNA, 20 bp, Artificial Sequence
  Description of Artificial Sequence: Synthetic oligonucleotide
  Target: ATXN1; (+) strand; PAM type: NRG; PAM sequence: CAG
tgcctcaatgtcgcaaactt

SEQ ID NO: 112112 - DNA, 20 bp, Artificial Sequence
  Description of Artificial Sequence: Synthetic oligonucleotide
  Target: ATXN1; (+) strand; PAM type: NRG; PAM sequence: AAG
cgcaaacttcagtgccgctc

SEQ ID NO: 112113 - DNA, 20 bp, Artificial Sequence
  Description of Artificial Sequence: Synthetic oligonucleotide
  Target: ATXN1; (+) strand; PAM type: NRG; PAM sequence: AGG
gcaaacttcagtgccgctca

SEQ ID NO: 112114 - DNA, 20 bp, Artificial Sequence
  Description of Artificial Sequence: Synthetic oligonucleotide
  Target: ATXN1; (+) strand; PAM type: NRG; PAM sequence: GAG
aaacttcagtgccgctcaag

SEQ ID NO: 112115 - DNA, 20 bp, Artificial Sequence
  Description of Artificial Sequence: Synthetic oligonucleotide
  Target: ATXN1; (+) strand; PAM type: NRG; PAM sequence: TAG
aaggagctaattaaatctcc

SEQ ID NO: 112116 - DNA, 20 bp, Artificial Sequence
  Description of Artificial Sequence: Synthetic oligonucleotide
  Target: ATXN1; (+) strand; PAM type: NRG; PAM sequence: AGG
aggagctaattaaatctcct

SEQ ID NO: 112117 - DNA, 20 bp, Artificial Sequence
  Description of Artificial Sequence: Synthetic oligonucleotide
  Target: ATXN1; (+) strand; PAM type: NRG; PAM sequence: AAG
gatgccctcacccacaccct

SEQ ID NO: 112118 - DNA, 20 bp, Artificial Sequence
  Description of Artificial Sequence: Synthetic oligonucleotide
  Target: ATXN1; (+) strand; PAM type: NRG; PAM sequence: AAG
cccacaccctaagaaatttg

SEQ ID NO: 112119 - DNA, 20 bp, Artificial Sequence
  Description of Artificial Sequence: Synthetic oligonucleotide
  Target: ATXN1; (+) strand; PAM type: NRG; PAM sequence: AGG
ccacaccctaagaaatttga

SEQ ID NO: 112120 - DNA, 20 bp, Artificial Sequence
  Description of Artificial Sequence: Synthetic oligonucleotide
  Target: ATXN1; (+) strand; PAM type: NRG; PAM sequence: GGG
cacaccctaagaaatttgaa

SEQ ID NO: 112121 - DNA, 20 bp, Artificial Sequence
  Description of Artificial Sequence: Synthetic oligonucleotide
  Target: ATXN1; (+) strand; PAM type: NRG; PAM sequence: AAG
attcaacaccattaaaataa

SEQ ID NO: 112122 - DNA, 20 bp, Artificial Sequence
  Description of Artificial Sequence: Synthetic oligonucleotide
  Target: ATXN1; (+) strand; PAM type: NRG; PAM sequence: AGG
ttcaacaccattaaaataaa

SEQ ID NO: 112123 - DNA, 20 bp, Artificial Sequence
  Description of Artificial Sequence: Synthetic oligonucleotide
  Target: ATXN1; (+) strand; PAM type: NRG; PAM sequence: AAG
ataaaaggcctttacatata

SEQ ID NO: 112124 - DNA, 20 bp, Artificial Sequence
  Description of Artificial Sequence: Synthetic oligonucleotide
  Target: ATXN1; (+) strand; PAM type: NRG; PAM sequence: AAG
tttgtccttttctccccaca

SEQ ID NO: 112125 - DNA, 20 bp, Artificial Sequence
  Description of Artificial Sequence: Synthetic oligonucleotide
  Target: ATXN1; (+) strand; PAM type: NRG; PAM sequence: TAG
gtccttttctccccacaaag

SEQ ID NO: 112126 - DNA, 20 bp, Artificial Sequence
  Description of Artificial Sequence: Synthetic oligonucleotide
  Target: ATXN1; (+) strand; PAM type: NRG; PAM sequence: TAG
cttttctccccacaaagtag

SEQ ID NO: 112127 - DNA, 20 bp, Artificial Sequence
  Description of Artificial Sequence: Synthetic oligonucleotide
  Target: ATXN1; (+) strand; PAM type: NRG; PAM sequence: AAG
gtagatttccaaattcccca

SEQ ID NO: 112128 - DNA, 20 bp, Artificial Sequence
  Description of Artificial Sequence: Synthetic oligonucleotide
  Target: ATXN1; (+) strand; PAM type: NRG; PAM sequence: AGG
tagatttccaaattccccaa

SEQ ID NO: 112129 - DNA, 20 bp, Artificial Sequence
  Description of Artificial Sequence: Synthetic oligonucleotide
  Target: ATXN1; (+) strand; PAM type: NRG; PAM sequence: GAG
ccaaattccccaaaggtcat

SEQ ID NO: 112130 - DNA, 20 bp, Artificial Sequence
  Description of Artificial Sequence: Synthetic oligonucleotide
  Target: ATXN1; (+) strand; PAM type: NRG; PAM sequence: TGG
ttccccaaaggtcatgagtt

SEQ ID NO: 112131 - DNA, 20 bp, Artificial Sequence
  Description of Artificial Sequence: Synthetic oligonucleotide
  Target: ATXN1; (+) strand; PAM type: NRG; PAM sequence: TGG
aaaggtcatgagtttggcaa

SEQ ID NO: 112132 - DNA, 20 bp, Artificial Sequence
  Description of Artificial Sequence: Synthetic oligonucleotide
  Target: ATXN1; (+) strand; PAM type: NRG; PAM sequence: TGG
tgagtttggcaatggaacaa

SEQ ID NO: 112133 - DNA, 20 bp, Artificial Sequence
  Description of Artificial Sequence: Synthetic oligonucleotide
  Target: ATXN1; (+) strand; PAM type: NRG; PAM sequence: CAG
caatggaacaatggcatccc

SEQ ID NO: 112134 - DNA, 20 bp, Artificial Sequence
  Description of Artificial Sequence: Synthetic oligonucleotide
  Target: ATXN1; (+) strand; PAM type: NRG; PAM sequence: GAG
atggaacaatggcatcccca

SEQ ID NO: 112135 - DNA, 20 bp, Artificial Sequence
  Description of Artificial Sequence: Synthetic oligonucleotide
  Target: ATXN1; (+) strand; PAM type: NRG; PAM sequence: TGG
catccccagagtgactgcct

SEQ ID NO: 112136 - DNA, 20 bp, Artificial Sequence
  Description of Artificial Sequence: Synthetic oligonucleotide
  Target: ATXN1; (+) strand; PAM type: NRG; PAM sequence: GGG
atccccagagtgactgcctt

SEQ ID NO: 112137 - DNA, 20 bp, Artificial Sequence
  Description of Artificial Sequence: Synthetic oligonucleotide
  Target: ATXN1; (+) strand; PAM type: NRG; PAM sequence: GGG
tccccagagtgactgccttg

SEQ ID NO: 112138 - DNA, 20 bp, Artificial Sequence
  Description of Artificial Sequence: Synthetic oligonucleotide
  Target: ATXN1; (+) strand; PAM type: NRG; PAM sequence: GAG
cccagagtgactgccttggg

SEQ ID NO: 112139 - DNA, 20 bp, Artificial Sequence
  Description of Artificial Sequence: Synthetic oligonucleotide
  Target: ATXN1; (+) strand; PAM type: NRG; PAM sequence: GAG
cagagtgactgccttgggga

SEQ ID NO: 112140 - DNA, 20 bp, Artificial Sequence
  Description of Artificial Sequence: Synthetic oligonucleotide
  Target: ATXN1; (+) strand; PAM type: NRG; PAM sequence: GAG
gagtgactgccttggggaga

SEQ ID NO: 112141 - DNA, 20 bp, Artificial Sequence
  Description of Artificial Sequence: Synthetic oligonucleotide
  Target: ATXN1; (+) strand; PAM type: NRG; PAM sequence: TGG
gagagagtttgctcctctct

SEQ ID NO: 112142 - DNA, 20 bp, Artificial Sequence
  Description of Artificial Sequence: Synthetic oligonucleotide
  Target: ATXN1; (+) strand; PAM type: NRG; PAM sequence: TGG
ctcctctcttggccatgccg

SEQ ID NO: 112143 - DNA, 20 bp, Artificial Sequence
  Description of Artificial Sequence: Synthetic oligonucleotide
  Target: ATXN1; (+) strand; PAM type: NRG; PAM sequence: GGG
tcctctcttggccatgccgt

SEQ ID NO: 112144 - DNA, 20 bp, Artificial Sequence
  Description of Artificial Sequence: Synthetic oligonucleotide
  Target: ATXN1; (+) strand; PAM type: NRG; PAM sequence: GGG
cctctcttggccatgccgtg

SEQ ID NO: 112145 - DNA, 20 bp, Artificial Sequence
  Description of Artificial Sequence: Synthetic oligonucleotide
  Target: ATXN1; (+) strand; PAM type: NRG; PAM sequence: GGG
ctctcttggccatgccgtgg

SEQ ID NO: 112146 - DNA, 20 bp, Artificial Sequence
  Description of Artificial Sequence: Synthetic oligonucleotide
  Target: ATXN1; (+) strand; PAM type: NRG; PAM sequence: TGG
gtgggggctgttgtctctct

SEQ ID NO: 112147 - DNA, 20 bp, Artificial Sequence
  Description of Artificial Sequence: Synthetic oligonucleotide
  Target: ATXN1; (+) strand; PAM type: NRG; PAM sequence: GGG
tgggggctgttgtctctctt

SEQ ID NO: 112148 - DNA, 20 bp, Artificial Sequence
  Description of Artificial Sequence: Synthetic oligonucleotide
  Target: ATXN1; (+) strand; PAM type: NRG; PAM sequence: GAG
ggggctgttgtctctcttgg

SEQ ID NO: 112149 - DNA, 20 bp, Artificial Sequence
  Description of Artificial Sequence: Synthetic oligonucleotide
  Target: ATXN1; (+) strand; PAM type: NRG; PAM sequence: AAG
ttgtctctcttgggagctgc

SEQ ID NO: 112150 - DNA, 20 bp, Artificial Sequence
  Description of Artificial Sequence: Synthetic oligonucleotide
  Target: ATXN1; (+) strand; PAM type: NRG; PAM sequence: AAG
gggagctgcaagcatcatca

SEQ ID NO: 112151 - DNA, 20 bp, Artificial Sequence
  Description of Artificial Sequence: Synthetic oligonucleotide
  Target: ATXN1; (+) strand; PAM type: NRG; PAM sequence: TGG
agctgcaagcatcatcaaag

SEQ ID NO: 112152 - DNA, 20 bp, Artificial Sequence
  Description of Artificial Sequence: Synthetic oligonucleotide
  Target: ATXN1; (+) strand; PAM type: NRG; PAM sequence: GAG
caagcatcatcaaagtggat

SEQ ID NO: 112153 - DNA, 20 bp, Artificial Sequence
  Description of Artificial Sequence: Synthetic oligonucleotide
  Target: ATXN1; (+) strand; PAM type: NRG; PAM sequence: AGG
aagcatcatcaaagtggatg

SEQ ID NO: 112154 - DNA, 20 bp, Artificial Sequence
  Description of Artificial Sequence: Synthetic oligonucleotide
  Target: ATXN1; (+) strand; PAM type: NRG; PAM sequence: GGG
agcatcatcaaagtggatga

SEQ ID NO: 112155 - DNA, 20 bp, Artificial Sequence
  Description of Artificial Sequence: Synthetic oligonucleotide
  Target: ATXN1; (+) strand; PAM type: NRG; PAM sequence: TGG
tcatcaaagtggatgagggc

SEQ ID NO: 112156 - DNA, 20 bp, Artificial Sequence
  Description of Artificial Sequence: Synthetic oligonucleotide
  Target: ATXN1; (+) strand; PAM type: NRG; PAM sequence: CAG
aagtggatgagggctggcca

SEQ ID NO: 112157 - DNA, 20 bp, Artificial Sequence
  Description of Artificial Sequence: Synthetic oligonucleotide
  Target: ATXN1; (+) strand; PAM type: NRG; PAM sequence: AAG
ggatgagggctggccacagc

SEQ ID NO: 112158 - DNA, 20 bp, Artificial Sequence
  Description of Artificial Sequence: Synthetic oligonucleotide
  Target: ATXN1; (+) strand; PAM type: NRG; PAM sequence: AAG
tgagggctggccacagcaag

SEQ ID NO: 112159 - DNA, 20 bp, Artificial Sequence
  Description of Artificial Sequence: Synthetic oligonucleotide
  Target: ATXN1; (+) strand; PAM type: NRG; PAM sequence: TGG
gctggccacagcaagaagta

SEQ ID NO: 112160 - DNA, 20 bp, Artificial Sequence
  Description of Artificial Sequence: Synthetic oligonucleotide
  Target: ATXN1; (+) strand; PAM type: NRG; PAM sequence: TAG
gaagtatggtctctgtccta

SEQ ID NO: 112161 - DNA, 20 bp, Artificial Sequence
  Description of Artificial Sequence: Synthetic oligonucleotide
  Target: ATXN1; (+) strand; PAM type: NRG; PAM sequence: TAG
gtctctgtcctatagttttc

SEQ ID NO: 112162 - DNA, 20 bp, Artificial Sequence
  Description of Artificial Sequence: Synthetic oligonucleotide
  Target: ATXN1; (+) strand; PAM type: NRG; PAM sequence: TAG
gtcctatagttttctagtgt

SEQ ID NO: 112163 - DNA, 20 bp, Artificial Sequence
  Description of Artificial Sequence: Synthetic oligonucleotide
  Target: ATXN1; (+) strand; PAM type: NRG; PAM sequence: AGG
tcctatagttttctagtgtt

SEQ ID NO: 112164 - DNA, 20 bp, Artificial Sequence
  Description of Artificial Sequence: Synthetic oligonucleotide
  Target: ATXN1; (+) strand; PAM type: NRG; PAM sequence: GGG
cctatagttttctagtgtta

SEQ ID NO: 112165 - DNA, 20 bp, Artificial Sequence
  Description of Artificial Sequence: Synthetic oligonucleotide
  Target: ATXN1; (+) strand; PAM type: NRG; PAM sequence: GAG
ttttctagtgttagggtgat

SEQ ID NO: 112166 - DNA, 20 bp, Artificial Sequence
  Description of Artificial Sequence: Synthetic oligonucleotide
  Target: ATXN1; (+) strand; PAM type: NRG; PAM sequence: AGG
tttctagtgttagggtgatg

SEQ ID NO: 112167 - DNA, 20 bp, Artificial Sequence
  Description of Artificial Sequence: Synthetic oligonucleotide
  Target: ATXN1; (+) strand; PAM type: NRG; PAM sequence: AAG
tgaggtctctatctattcac

SEQ ID NO: 112168 - DNA, 20 bp, Artificial Sequence
  Description of Artificial Sequence: Synthetic oligonucleotide
  Target: ATXN1; (+) strand; PAM type: NRG; PAM sequence: AAG
ggtctctatctattcacaag

SEQ ID NO: 112169 - DNA, 20 bp, Artificial Sequence
  Description of Artificial Sequence: Synthetic oligonucleotide
  Target: ATXN1; (+) strand; PAM type: NRG; PAM sequence: AAG
tatctattcacaagaagaaa

SEQ ID NO: 112170 - DNA, 20 bp, Artificial Sequence
  Description of Artificial Sequence: Synthetic oligonucleotide
  Target: ATXN1; (+) strand; PAM type: NRG; PAM sequence: GAG
tctattcacaagaagaaaaa

SEQ ID NO: 112171 - DNA, 20 bp, Artificial Sequence
  Description of Artificial Sequence: Synthetic oligonucleotide
  Target: ATXN1; (+) strand; PAM type: NRG; PAM sequence: TAG
aaaccattcccaaactatgt

SEQ ID NO: 112172 - DNA, 20 bp, Artificial Sequence
  Description of Artificial Sequence: Synthetic oligonucleotide
  Target: ATXN1; (+) strand; PAM type: NRG; PAM sequence: AAG
cccaaactatgttagaaatg

SEQ ID NO: 112173 - DNA, 20 bp, Artificial Sequence
  Description of Artificial Sequence: Synthetic oligonucleotide
  Target: ATXN1; (+) strand; PAM type: NRG; PAM sequence: AAG
aactatgttagaaatgaaga

SEQ ID NO: 112174 - DNA, 20 bp, Artificial Sequence
  Description of Artificial Sequence: Synthetic oligonucleotide
  Target: ATXN1; (+) strand; PAM type: NRG; PAM sequence: AGG
actatgttagaaatgaagaa

SEQ ID NO: 112175 - DNA, 20 bp, Artificial Sequence
  Description of Artificial Sequence: Synthetic oligonucleotide
  Target: ATXN1; (+) strand; PAM type: NRG; PAM sequence: GGG
ctatgttagaaatgaagaaa

SEQ ID NO: 112176 - DNA, 20 bp, Artificial Sequence
  Description of Artificial Sequence: Synthetic oligonucleotide
  Target: ATXN1; (+) strand; PAM type: NRG; PAM sequence: GGG
tatgttagaaatgaagaaag

SEQ ID NO: 112177 - DNA, 20 bp, Artificial Sequence
  Description of Artificial Sequence: Synthetic oligonucleotide
  Target: ATXN1; (+) strand; PAM type: NRG; PAM sequence: AAG
gttagaaatgaagaaagggg

SEQ ID NO: 112178 - DNA, 20 bp, Artificial Sequence
  Description of Artificial Sequence: Synthetic oligonucleotide
  Target: ATXN1; (+) strand; PAM type: NRG; PAM sequence: AGG
ttagaaatgaagaaagggga

SEQ ID NO: 112179 - DNA, 20 bp, Artificial Sequence
  Description of Artificial Sequence: Synthetic oligonucleotide
  Target: ATXN1; (+) strand; PAM type: NRG; PAM sequence: GGG
tagaaatgaagaaaggggaa

SEQ ID NO: 112180 - DNA, 20 bp, Artificial Sequence
  Description of Artificial Sequence: Synthetic oligonucleotide
  Target: ATXN1; (+) strand; PAM type: NRG; PAM sequence: TAG
tgaagaaaggggaagggaaa

SEQ ID NO: 112181 - DNA, 20 bp, Artificial Sequence
  Description of Artificial Sequence: Synthetic oligonucleotide
  Target: ATXN1; (+) strand; PAM type: NRG; PAM sequence: GAG
gaagggaaatagcacttgct

SEQ ID NO: 112182 - DNA, 20 bp, Artificial Sequence
  Description of Artificial Sequence: Synthetic oligonucleotide
  Target: ATXN1; (+) strand; PAM type: NRG; PAM sequence: CAG
agcacttcgtttaaatgtgc

SEQ ID NO: 112183 - DNA, 20 bp, Artificial Sequence
  Description of Artificial Sequence: Synthetic oligonucleotide
  Target: ATXN1; (+) strand; PAM type: NRG; PAM sequence: AAG
aatcctcacacaaccctaca

SEQ ID NO: 112184 - DNA, 20 bp, Artificial Sequence
  Description of Artificial Sequence: Synthetic oligonucleotide
  Target: ATXN1; (+) strand; PAM type: NRG; PAM sequence: TAG
cctcacacaaccctacaaag

SEQ ID NO: 112185 - DNA, 20 bp, Artificial Sequence
  Description of Artificial Sequence: Synthetic oligonucleotide
  Target: ATXN1; (+) strand; PAM type: NRG; PAM sequence: AAG
agaaatgatgactctattta

SEQ ID NO: 112186 - DNA, 20 bp, Artificial Sequence
  Description of Artificial Sequence: Synthetic oligonucleotide
  Target: ATXN1; (+) strand; PAM type: NRG; PAM sequence: AAG
aaagacaaactgaaactcaa

SEQ ID NO: 112187 - DNA, 20 bp, Artificial Sequence
  Description of Artificial Sequence: Synthetic oligonucleotide
  Target: ATXN1; (+) strand; PAM type: NRG; PAM sequence: CAG
agaacttcctcgaaatgata

SEQ ID NO: 112188 - DNA, 20 bp, Artificial Sequence
  Description of Artificial Sequence: Synthetic oligonucleotide
  Target: ATXN1; (+) strand; PAM type: NRG; PAM sequence: TAG
cttcctcgaaatgatacagt

SEQ ID NO: 112189 - DNA, 20 bp, Artificial Sequence
  Description of Artificial Sequence: Synthetic oligonucleotide
  Target: ATXN1; (+) strand; PAM type: NRG; PAM sequence: TGG
atgatacagttagcacatta

SEQ ID NO: 112190 - DNA, 20 bp, Artificial Sequence
  Description of Artificial Sequence: Synthetic oligonucleotide
  Target: ATXN1; (+) strand; PAM type: NRG; PAM sequence: CAG
cagttagcacattatggatg

SEQ ID NO: 112191 - DNA, 20 bp, Artificial Sequence
  Description of Artificial Sequence: Synthetic oligonucleotide
  Target: ATXN1; (+) strand; PAM type: NRG; PAM sequence: CAG
atggatgcagaattcaaacc

SEQ ID NO: 112192 - DNA, 20 bp, Artificial Sequence
  Description of Artificial Sequence: Synthetic oligonucleotide
  Target: ATXN1; (+) strand; PAM type: NRG; PAM sequence: AGG
tggatgcagaattcaaaccc

SEQ ID NO: 112193 - DNA, 20 bp, Artificial Sequence
  Description of Artificial Sequence: Synthetic oligonucleotide
  Target: ATXN1; (+) strand; PAM type: NRG; PAM sequence: TAG
aattcaaacccaggcctgtc

SEQ ID NO: 112194 - DNA, 20 bp, Artificial Sequence
  Description of Artificial Sequence: Synthetic oligonucleotide
  Target: ATXN1; (+) strand; PAM type: NRG; PAM sequence: AAG
tataccatgctgcctctcaa

SEQ ID NO: 112195 - DNA, 20 bp, Artificial Sequence
  Description of Artificial Sequence: Synthetic oligonucleotide
  Target: ATXN1; (+) strand; PAM type: NRG; PAM sequence: AGG
ataccatgctgcctctcaaa

SEQ ID NO: 112196 - DNA, 20 bp, Artificial Sequence
  Description of Artificial Sequence: Synthetic oligonucleotide
  Target: ATXN1; (+) strand; PAM type: NRG; PAM sequence: AAG
actgtttttgtttttttttt

SEQ ID NO: 112197 - DNA, 20 bp, Artificial Sequence
  Description of Artificial Sequence: Synthetic oligonucleotide
  Target: ATXN1; (+) strand; PAM type: NRG; PAM sequence: AGG
ctgtttttgtttttttttta

SEQ ID NO: 112198 - DNA, 20 bp, Artificial Sequence
  Description of Artificial Sequence: Synthetic oligonucleotide
  Target: ATXN1; (+) strand; PAM type: NRG; PAM sequence: TAG
ttttttttaaggtacaaata

SEQ ID NO: 112199 - DNA, 20 bp, Artificial Sequence
  Description of Artificial Sequence: Synthetic oligonucleotide
  Target: ATXN1; (+) strand; PAM type: NRG; PAM sequence: TGG
acaaatatagtttgtgcatt

SEQ ID NO: 112200 - DNA, 20 bp, Artificial Sequence
  Description of Artificial Sequence: Synthetic oligonucleotide
  Target: ATXN1; (+) strand; PAM type: NRG; PAM sequence: AAG
aatatagtttgtgcatttgg

SEQ ID NO: 112201 - DNA, 20 bp, Artificial Sequence
  Description of Artificial Sequence: Synthetic oligonucleotide
  Target: ATXN1; (+) strand; PAM type: NRG; PAM sequence: AAG
atagtttgtgcatttggaag

SEQ ID NO: 112202 - DNA, 20 bp, Artificial Sequence
  Description of Artificial Sequence: Synthetic oligonucleotide
  Target: ATXN1; (+) strand; PAM type: NRG; PAM sequence: CGG
tgtgcatttggaagaagatg

SEQ ID NO: 112203 - DNA, 20 bp, Artificial Sequence
  Description of Artificial Sequence: Synthetic oligonucleotide
  Target: ATXN1; (+) strand; PAM type: NRG; PAM sequence: CGG
atttggaagaagatgcggct

SEQ ID NO: 112204 - DNA, 20 bp, Artificial Sequence
  Description of Artificial Sequence: Synthetic oligonucleotide
  Target: ATXN1; (+) strand; PAM type: NRG; PAM sequence: GGG
tttggaagaagatgcggctc

SEQ ID NO: 112205 - DNA, 20 bp, Artificial Sequence
  Description of Artificial Sequence: Synthetic oligonucleotide
  Target: ATXN1; (+) strand; PAM type: NRG; PAM sequence: TAG
gggacccattctttttgtta

SEQ ID NO: 112206 - DNA, 20 bp, Artificial Sequence
  Description of Artificial Sequence: Synthetic oligonucleotide
  Target: ATXN1; (+) strand; PAM type: NRG; PAM sequence: AGG
ggacccattctttttgttat

SEQ ID NO: 112207 - DNA, 20 bp, Artificial Sequence
  Description of Artificial Sequence: Synthetic oligonucleotide
  Target: ATXN1; (+) strand; PAM type: NRG; PAM sequence: TAG
ataaacatccatcttactct

SEQ ID NO: 112208 - DNA, 20 bp, Artificial Sequence
  Description of Artificial Sequence: Synthetic oligonucleotide
  Target: ATXN1; (+) strand; PAM type: NRG; PAM sequence: TGG
ttagtttgacctttgtgccg

SEQ ID NO: 112209 - DNA, 20 bp, Artificial Sequence
  Description of Artificial Sequence: Synthetic oligonucleotide
  Target: ATXN1; (+) strand; PAM type: NRG; PAM sequence: GGG
tagtttgacctttgtgccgt

SEQ ID NO: 112210 - DNA, 20 bp, Artificial Sequence
  Description of Artificial Sequence: Synthetic oligonucleotide
  Target: ATXN1; (+) strand; PAM type: NRG; PAM sequence: CAG
gtgggctcatgtctgtaata

SEQ ID NO: 112211 - DNA, 20 bp, Artificial Sequence
  Description of Artificial Sequence: Synthetic oligonucleotide
  Target: ATXN1; (+) strand; PAM type: NRG; PAM sequence: AGG
tgggctcatgtctgtaatac

SEQ ID NO: 112212 - DNA, 20 bp, Artificial Sequence
  Description of Artificial Sequence: Synthetic oligonucleotide
  Target: ATXN1; (+) strand; PAM type: NRG; PAM sequence: AAG
aggaacccaatcatttctga

SEQ ID NO: 112213 - DNA, 20 bp, Artificial Sequence
  Description of Artificial Sequence: Synthetic oligonucleotide
  Target: ATXN1; (+) strand; PAM type: NRG; PAM sequence: CAG
atttctgaaagtctgtctaa

SEQ ID NO: 112214 - DNA, 20 bp, Artificial Sequence
  Description of Artificial Sequence: Synthetic oligonucleotide
  Target: ATXN1; (+) strand; PAM type: NRG; PAM sequence: CAG
tctaacagtgatattgtgtg

SEQ ID NO: 112215 - DNA, 20 bp, Artificial Sequence
  Description of Artificial Sequence: Synthetic oligonucleotide
  Target: ATXN1; (+) strand; PAM type: NRG; PAM sequence: TGG
tgcagcaaatgtttaatgaa

SEQ ID NO: 112216 - DNA, 20 bp, Artificial Sequence
  Description of Artificial Sequence: Synthetic oligonucleotide
  Target: ATXN1; (+) strand; PAM type: NRG; PAM sequence: GAG
caaatgtttaatgaatggat

SEQ ID NO: 112217 - DNA, 20 bp, Artificial Sequence
  Description of Artificial Sequence: Synthetic oligonucleotide
  Target: ATXN1; (+) strand; PAM type: NRG; PAM sequence: TGG
gatgagtgaatgtgaatcaa

SEQ ID NO: 112218 - DNA, 20 bp, Artificial Sequence
  Description of Artificial Sequence: Synthetic oligonucleotide
  Target: ATXN1; (+) strand; PAM type: NRG; PAM sequence: GGG
atgagtgaatgtgaatcaat

SEQ ID NO: 112219 - DNA, 20 bp, Artificial Sequence
  Description of Artificial Sequence: Synthetic oligonucleotide
  Target: ATXN1; (+) strand; PAM type: NRG; PAM sequence: TGG
agtgaatgtgaatcaatggg

SEQ ID NO: 112220 - DNA, 20 bp, Artificial Sequence
  Description of Artificial Sequence: Synthetic oligonucleotide
  Target: ATXN1; (+) strand; PAM type: NRG; PAM sequence: GGG
gtgaatgtgaatcaatgggt

SEQ ID NO: 112221 - DNA, 20 bp, Artificial Sequence
  Description of Artificial Sequence: Synthetic oligonucleotide
  Target: ATXN1; (+) strand; PAM type: NRG; PAM sequence: GGG
tgaatgtgaatcaatgggtg

SEQ ID NO: 112222 - DNA, 20 bp, Artificial Sequence
  Description of Artificial Sequence: Synthetic oligonucleotide
  Target: ATXN1; (+) strand; PAM type: NRG; PAM sequence: GGG
gaatgtgaatcaatgggtgg

SEQ ID NO: 112223 - DNA, 20 bp, Artificial Sequence
  Description of Artificial Sequence: Synthetic oligonucleotide
  Target: ATXN1; (+) strand; PAM type: NRG; PAM sequence: AAG
ataaataaatgaatgaatga

SEQ ID NO: 112224 - DNA, 20 bp, Artificial Sequence
  Description of Artificial Sequence: Synthetic oligonucleotide
  Target: ATXN1; (+) strand; PAM type: NRG; PAM sequence: GAG
tgaatgaaagtgaaactgac

SEQ ID NO: 112225 - DNA, 20 bp, Artificial Sequence
  Description of Artificial Sequence: Synthetic oligonucleotide
  Target: ATXN1; (+) strand; PAM type: NRG; PAM sequence: TGG
tgaaactgacgagcccatac

SEQ ID NO: 112226 - DNA, 20 bp, Artificial Sequence
  Description of Artificial Sequence: Synthetic oligonucleotide
  Target: ATXN1; (+) strand; PAM type: NRG; PAM sequence: GGG
gaaactgacgagcccatact

SEQ ID NO: 112227 - DNA, 20 bp, Artificial Sequence
  Description of Artificial Sequence: Synthetic oligonucleotide
  Target: ATXN1; (+) strand; PAM type: NRG; PAM sequence: CGG
agcccatactgggactgaat

SEQ ID NO: 112228 - DNA, 20 bp, Artificial Sequence
  Description of Artificial Sequence: Synthetic oligonucleotide
  Target: ATXN1; (+) strand; PAM type: NRG; PAM sequence: TGG
ctgggactgaatcggcaatg

SEQ ID NO: 112229 - DNA, 20 bp, Artificial Sequence
  Description of Artificial Sequence: Synthetic oligonucleotide
  Target: ATXN1; (+) strand; PAM type: NRG; PAM sequence: GGG
tgggactgaatcggcaatgt

SEQ ID NO: 112230 - DNA, 20 bp, Artificial Sequence
  Description of Artificial Sequence: Synthetic oligonucleotide
  Target: ATXN1; (+) strand; PAM type: NRG; PAM sequence: AAG
cggcaatgtgggcctcctga

SEQ ID NO: 112231 - DNA, 20 bp, Artificial Sequence
  Description of Artificial Sequence: Synthetic oligonucleotide
  Target: ATXN1; (+) strand; PAM type: NRG; PAM sequence: GAG
atgttaatcactactttttt

SEQ ID NO: 112232 - DNA, 20 bp, Artificial Sequence
  Description of Artificial Sequence: Synthetic oligonucleotide
  Target: ATXN1; (+) strand; PAM type: NRG; PAM sequence: TGG
gagctttgtgacatgatgtt

SEQ ID NO: 112233 - DNA, 20 bp, Artificial Sequence
  Description of Artificial Sequence: Synthetic oligonucleotide
  Target: ATXN1; (+) strand; PAM type: NRG; PAM sequence: GGG
agctttgtgacatgatgttt

SEQ ID NO: 112234 - DNA, 20 bp, Artificial Sequence
  Description of Artificial Sequence: Synthetic oligonucleotide
  Target: ATXN1; (+) strand; PAM type: NRG; PAM sequence: TGG
tgacatgatgtttgggtgtc

SEQ ID NO: 112235 - DNA, 20 bp, Artificial Sequence
  Description of Artificial Sequence: Synthetic oligonucleotide
  Target: ATXN1; (+) strand; PAM type: NRG; PAM sequence: GAG
acatgatgtttgggtgtctg

SEQ ID NO: 112236 - DNA, 20 bp, Artificial Sequence
  Description of Artificial Sequence: Synthetic oligonucleotide
  Target: ATXN1; (+) strand; PAM type: NRG; PAM sequence: TGG
gtctggagaaaaatcctgtg

SEQ ID NO: 112237 - DNA, 20 bp, Artificial Sequence
  Description of Artificial Sequence: Synthetic oligonucleotide
  Target: ATXN1; (+) strand; PAM type: NRG; PAM sequence: TGG
tggagaaaaatcctgtgtgg

SEQ ID NO: 112238 - DNA, 20 bp, Artificial Sequence
  Description of Artificial Sequence: Synthetic oligonucleotide
  Target: ATXN1; (+) strand; PAM type: NRG; PAM sequence: TGG
agaaaaatcctgtgtggtgg

SEQ ID NO: 112239 - DNA, 20 bp, Artificial Sequence
  Description of Artificial Sequence: Synthetic oligonucleotide
  Target: ATXN1; (+) strand; PAM type: NRG; PAM sequence: TGG
aatcctgtgtggtggtggtc

SEQ ID NO: 112240 - DNA, 20 bp, Artificial Sequence
  Description of Artificial Sequence: Synthetic oligonucleotide
  Target: ATXN1; (+) strand; PAM type: NRG; PAM sequence: GGG
atcctgtgtggtggtggtct

SEQ ID NO: 112241 - DNA, 20 bp, Artificial Sequence
  Description of Artificial Sequence: Synthetic oligonucleotide
  Target: ATXN1; (+) strand; PAM type: NRG; PAM sequence: TGG
gggcttttttactgacgcaa

SEQ ID NO: 112242 - DNA, 20 bp, Artificial Sequence
  Description of Artificial Sequence: Synthetic oligonucleotide
  Target: ATXN1; (+) strand; PAM type: NRG; PAM sequence: CAG
gatataattttgatttccat

SEQ ID NO: 112243 - DNA, 20 bp, Artificial Sequence
  Description of Artificial Sequence: Synthetic oligonucleotide
  Target: ATXN1; (+) strand; PAM type: NRG; PAM sequence: TAG
tttccatcagccactaaact

SEQ ID NO: 112244 - DNA, 20 bp, Artificial Sequence
  Description of Artificial Sequence: Synthetic oligonucleotide
  Target: ATXN1; (+) strand; PAM type: NRG; PAM sequence: AAG
cagccactaaacttagcctg

SEQ ID NO: 112245 - DNA, 20 bp, Artificial Sequence
  Description of Artificial Sequence: Synthetic oligonucleotide
  Target: ATXN1; (+) strand; PAM type: NRG; PAM sequence: AAG
gaagacaaaatttcctttga

SEQ ID NO: 112246 - DNA, 20 bp, Artificial Sequence
  Description of Artificial Sequence: Synthetic oligonucleotide
  Target: ATXN1; (+) strand; PAM type: NRG; PAM sequence: AGG
aagacaaaatttcctttgaa

SEQ ID NO: 112247 - DNA, 20 bp, Artificial Sequence
  Description of Artificial Sequence: Synthetic oligonucleotide
  Target: ATXN1; (+) strand; PAM type: NRG; PAM sequence: CAG
aaatttcctttgaaaggatt

SEQ ID NO: 112248 - DNA, 20 bp, Artificial Sequence
  Description of Artificial Sequence: Synthetic oligonucleotide
  Target: ATXN1; (+) strand; PAM type: NRG; PAM sequence: TAG
tcctttgaaaggattcagct

SEQ ID NO: 112249 - DNA, 20 bp, Artificial Sequence
  Description of Artificial Sequence: Synthetic oligonucleotide
  Target: ATXN1; (+) strand; PAM type: NRG; PAM sequence: AGG
cctttgaaaggattcagctt

SEQ ID NO: 112250 - DNA, 20 bp, Artificial Sequence
  Description of Artificial Sequence: Synthetic oligonucleotide
  Target: ATXN1; (+) strand; PAM type: NRG; PAM sequence: GGG
ctttgaaaggattcagctta

SEQ ID NO: 112251 - DNA, 20 bp, Artificial Sequence
  Description of Artificial Sequence: Synthetic oligonucleotide
  Target: ATXN1; (+) strand; PAM type: NRG; PAM sequence: GGG
tttgaaaggattcagcttag

SEQ ID NO: 112252 - DNA, 20 bp, Artificial Sequence
  Description of Artificial Sequence: Synthetic oligonucleotide
  Target: ATXN1; (+) strand; PAM type: NRG; PAM sequence: CAG
aaggattcagcttaggggaa

SEQ ID NO: 112253 - DNA, 20 bp, Artificial Sequence
  Description of Artificial Sequence: Synthetic oligonucleotide
  Target: ATXN1; (+) strand; PAM type: NRG; PAM sequence: AAG
agcttaggggaacagataat

SEQ ID NO: 112254 - DNA, 20 bp, Artificial Sequence
  Description of Artificial Sequence: Synthetic oligonucleotide
  Target: ATXN1; (+) strand; PAM type: NRG; PAM sequence: AGG
gcttaggggaacagataata

SEQ ID NO: 112255 - DNA, 20 bp, Artificial Sequence
  Description of Artificial Sequence: Synthetic oligonucleotide
  Target: ATXN1; (+) strand; PAM type: NRG; PAM sequence: GAG
ttaggggaacagataataag

SEQ ID NO: 112256 - DNA, 20 bp, Artificial Sequence
  Description of Artificial Sequence: Synthetic oligonucleotide
  Target: ATXN1; (+) strand; PAM type: NRG; PAM sequence: AGG
taggggaacagataataagg

SEQ ID NO: 112257 - DNA, 20 bp, Artificial Sequence
  Description of Artificial Sequence: Synthetic oligonucleotide
  Target: ATXN1; (+) strand; PAM type: NRG; PAM sequence: TGG
gggaacagataataaggagg

SEQ ID NO: 112258 - DNA, 20 bp, Artificial Sequence
  Description of Artificial Sequence: Synthetic oligonucleotide
  Target: ATXN1; (+) strand; PAM type: NRG; PAM sequence: TGG
ataataaggaggtggttatt

SEQ ID NO: 112259 - DNA, 20 bp, Artificial Sequence
  Description of Artificial Sequence: Synthetic oligonucleotide
  Target: ATXN1; (+) strand; PAM type: NRG; PAM sequence: GGG
taataaggaggtggttattt

SEQ ID NO: 112260 - DNA, 20 bp, Artificial Sequence
  Description of Artificial Sequence: Synthetic oligonucleotide
  Target: ATXN1; (+) strand; PAM type: NRG; PAM sequence: GGG
aataaggaggtggttatttg

SEQ ID NO: 112261 - DNA, 20 bp, Artificial Sequence
  Description of Artificial Sequence: Synthetic oligonucleotide
  Target: ATXN1; (+) strand; PAM type: NRG; PAM sequence: AAG
aggtggttatttggggaaac

SEQ ID NO: 112262 - DNA, 20 bp, Artificial Sequence
  Description of Artificial Sequence: Synthetic oligonucleotide
  Target: ATXN1; (+) strand; PAM type: NRG; PAM sequence: GAG
gtggttatttggggaaacaa

SEQ ID NO: 112263 - DNA, 20 bp, Artificial Sequence
  Description of Artificial Sequence: Synthetic oligonucleotide
  Target: ATXN1; (+) strand; PAM type: NRG; PAM sequence: AAG
ctaaaaatgaaacattctca

SEQ ID NO: 112264 - DNA, 20 bp, Artificial Sequence
  Description of Artificial Sequence: Synthetic oligonucleotide
  Target: ATXN1; (+) strand; PAM type: NRG; PAM sequence: TGG
aaatgaaacattctcaaagc

SEQ ID NO: 112265 - DNA, 20 bp, Artificial Sequence
  Description of Artificial Sequence: Synthetic oligonucleotide
  Target: ATXN1; (+) strand; PAM type: NRG; PAM sequence: AAG
gaaacattctcaaagctgga

SEQ ID NO: 112266 - DNA, 20 bp, Artificial Sequence
  Description of Artificial Sequence: Synthetic oligonucleotide
  Target: ATXN1; (+) strand; PAM type: NRG; PAM sequence: AAG
cattctcaaagctggaaagt

SEQ ID NO: 112267 - DNA, 20 bp, Artificial Sequence
  Description of Artificial Sequence: Synthetic oligonucleotide
  Target: ATXN1; (+) strand; PAM type: NRG; PAM sequence: AGG
attctcaaagctggaaagta

SEQ ID NO: 112268 - DNA, 20 bp, Artificial Sequence
  Description of Artificial Sequence: Synthetic oligonucleotide
  Target: ATXN1; (+) strand; PAM type: NRG; PAM sequence: TGG
aaatcaaacattgctctact

SEQ ID NO: 112269 - DNA, 20 bp, Artificial Sequence
  Description of Artificial Sequence: Synthetic oligonucleotide
  Target: ATXN1; (+) strand; PAM type: NRG; PAM sequence: GGG
aatcaaacattgctctactt

SEQ ID NO: 112270 - DNA, 20 bp, Artificial Sequence
  Description of Artificial Sequence: Synthetic oligonucleotide
  Target: ATXN1; (+) strand; PAM type: NRG; PAM sequence: GGG
atcaaacattgctctacttg

SEQ ID NO: 112271 - DNA, 20 bp, Artificial Sequence
  Description of Artificial Sequence: Synthetic oligonucleotide
  Target: ATXN1; (+) strand; PAM type: NRG; PAM sequence: TGG
tctacttggggttttgaaaa

SEQ ID NO: 112272 - DNA, 20 bp, Artificial Sequence
  Description of Artificial Sequence: Synthetic oligonucleotide
  Target: ATXN1; (+) strand; PAM type: NRG; PAM sequence: AAG
ggaacattgattgtttgtaa

SEQ ID NO: 112273 - DNA, 20 bp, Artificial Sequence
  Description of Artificial Sequence: Synthetic oligonucleotide
  Target: ATXN1; (+) strand; PAM type: NRG; PAM sequence: TGG
tgtaaaagtgatgcttaatt

SEQ ID NO: 112274 - DNA, 20 bp, Artificial Sequence
  Description of Artificial Sequence: Synthetic oligonucleotide
  Target: ATXN1; (+) strand; PAM type: NRG; PAM sequence: GAG
taaaagtgatgcttaatttg

SEQ ID NO: 112275 - DNA, 20 bp, Artificial Sequence
  Description of Artificial Sequence: Synthetic oligonucleotide
  Target: ATXN1; (+) strand; PAM type: NRG; PAM sequence: AGG
aaaagtgatgcttaatttgg

SEQ ID NO: 112276 - DNA, 20 bp, Artificial Sequence
  Description of Artificial Sequence: Synthetic oligonucleotide
  Target: ATXN1; (+) strand; PAM type: NRG; PAM sequence: AAG
tgatgcttaatttggaggat

SEQ ID NO: 112277 - DNA, 20 bp, Artificial Sequence
  Description of Artificial Sequence: Synthetic oligonucleotide
  Target: ATXN1; (+) strand; PAM type: NRG; PAM sequence: AAG
tgcttaatttggaggataag

SEQ ID NO: 112278 - DNA, 20 bp, Artificial Sequence
  Description of Artificial Sequence: Synthetic oligonucleotide
  Target: ATXN1; (+) strand; PAM type: NRG; PAM sequence: TAG
aagaagcgaacttctttcta

SEQ ID NO: 112279 - DNA, 20 bp, Artificial Sequence
  Description of Artificial Sequence: Synthetic oligonucleotide
  Target: ATXN1; (+) strand; PAM type: NRG; PAM sequence: AAG
gaacttctttctatagcctc

SEQ ID NO: 112280 - DNA, 20 bp, Artificial Sequence
  Description of Artificial Sequence: Synthetic oligonucleotide
  Target: ATXN1; (+) strand; PAM type: NRG; PAM sequence: AGG
aacttctttctatagcctca

SEQ ID NO: 112281 - DNA, 20 bp, Artificial Sequence
  Description of Artificial Sequence: Synthetic oligonucleotide
  Target: ATXN1; (+) strand; PAM type: NRG; PAM sequence: GAG
cttctttctatagcctcaag

SEQ ID NO: 112282 - DNA, 20 bp, Artificial Sequence
  Description of Artificial Sequence: Synthetic oligonucleotide
  Target: ATXN1; (+) strand; PAM type: NRG; PAM sequence: CGG
gagctaattaaaatgtgaca

SEQ ID NO: 112283 - DNA, 20 bp, Artificial Sequence
  Description of Artificial Sequence: Synthetic oligonucleotide
  Target: ATXN1; (+) strand; PAM type: NRG; PAM sequence: CAG
ctaattaaaatgtgacacgg

SEQ ID NO: 112284 - DNA, 20 bp, Artificial Sequence
  Description of Artificial Sequence: Synthetic oligonucleotide
  Target: ATXN1; (+) strand; PAM type: NRG; PAM sequence: TAG
cacggcagtgattatatact

SEQ ID NO: 112285 - DNA, 20 bp, Artificial Sequence
  Description of Artificial Sequence: Synthetic oligonucleotide
  Target: ATXN1; (+) strand; PAM type: NRG; PAM sequence: GAG
cggcagtgattatatactta

SEQ ID NO: 112286 - DNA, 20 bp, Artificial Sequence
  Description of Artificial Sequence: Synthetic oligonucleotide
  Target: ATXN1; (+) strand; PAM type: NRG; PAM sequence: AGG
ggcagtgattatatacttag

SEQ ID NO: 112287 - DNA, 20 bp, Artificial Sequence
  Description of Artificial Sequence: Synthetic oligonucleotide
  Target: ATXN1; (+) strand; PAM type: NRG; PAM sequence: TAG
tatatacttagaggtatcga

SEQ ID NO: 112288 - DNA, 20 bp, Artificial Sequence
  Description of Artificial Sequence: Synthetic oligonucleotide
  Target: ATXN1; (+) strand; PAM type: NRG; PAM sequence: AGG
atatacttagaggtatcgat

SEQ ID NO: 112289 - DNA, 20 bp, Artificial Sequence
  Description of Artificial Sequence: Synthetic oligonucleotide
  Target: ATXN1; (+) strand; PAM type: NRG; PAM sequence: CAG
gataggtcctcatttttcca

SEQ ID NO: 112290 - DNA, 20 bp, Artificial Sequence
  Description of Artificial Sequence: Synthetic oligonucleotide
  Target: ATXN1; (+) strand; PAM type: NRG; PAM sequence: CAG
gtcctcatttttccacagca

SEQ ID NO: 112291 - DNA, 20 bp, Artificial Sequence
  Description of Artificial Sequence: Synthetic oligonucleotide
  Target: ATXN1; (+) strand; PAM type: NRG; PAM sequence: CAG
cagcacagataatctcacgc

SEQ ID NO: 112292 - DNA, 20 bp, Artificial Sequence
  Description of Artificial Sequence: Synthetic oligonucleotide
  Target: ATXN1; (+) strand; PAM type: NRG; PAM sequence: AAG
cgccagctctcacctatatt

SEQ ID NO: 112293 - DNA, 20 bp, Artificial Sequence
  Description of Artificial Sequence: Synthetic oligonucleotide
  Target: ATXN1; (+) strand; PAM type: NRG; PAM sequence: TAG
ctctcacctatattaagtgt

SEQ ID NO: 112294 - DNA, 20 bp, Artificial Sequence
  Description of Artificial Sequence: Synthetic oligonucleotide
  Target: ATXN1; (+) strand; PAM type: NRG; PAM sequence: TGG
tatattaagtgttagacact

SEQ ID NO: 112295 - DNA, 20 bp, Artificial Sequence
  Description of Artificial Sequence: Synthetic oligonucleotide
  Target: ATXN1; (+) strand; PAM type: NRG; PAM sequence: CAG
taagtgttagacacttggta

SEQ ID NO: 112296 - DNA, 20 bp, Artificial Sequence
  Description of Artificial Sequence: Synthetic oligonucleotide
  Target: ATXN1; (+) strand; PAM type: NRG; PAM sequence: AGG
aagtgttagacacttggtac

SEQ ID NO: 112297 - DNA, 20 bp, Artificial Sequence
  Description of Artificial Sequence: Synthetic oligonucleotide
  Target: ATXN1; (+) strand; PAM type: NRG; PAM sequence: CGG
ttagacacttggtacaggaa

SEQ ID NO: 112298 - DNA, 20 bp, Artificial Sequence
  Description of Artificial Sequence: Synthetic oligonucleotide
  Target: ATXN1; (+) strand; PAM type: NRG; PAM sequence: CAG
cttccctatctctcactgtt

SEQ ID NO: 112299 - DNA, 20 bp, Artificial Sequence
  Description of Artificial Sequence: Synthetic oligonucleotide
  Target: ATXN1; (+) strand; PAM type: NRG; PAM sequence: AGG
ttccctatctctcactgttc

SEQ ID NO: 112300 - DNA, 20 bp, Artificial Sequence
  Description of Artificial Sequence: Synthetic oligonucleotide
  Target: ATXN1; (+) strand; PAM type: NRG; PAM sequence: GGG
tccctatctctcactgttca

SEQ ID NO: 112301 - DNA, 20 bp, Artificial Sequence
  Description of Artificial Sequence: Synthetic oligonucleotide
  Target: ATXN1; (+) strand; PAM type: NRG; PAM sequence: TGG
tctcactgttcagggacctt

SEQ ID NO: 112302 - DNA, 20 bp, Artificial Sequence
  Description of Artificial Sequence: Synthetic oligonucleotide
  Target: ATXN1; (+) strand; PAM type: NRG; PAM sequence: CAG
actgttcagggacctttggt

SEQ ID NO: 112303 - DNA, 20 bp, Artificial Sequence
  Description of Artificial Sequence: Synthetic oligonucleotide
  Target: ATXN1; (+) strand; PAM type: NRG; PAM sequence: CAG
gggacctttggtcagttcct

SEQ ID NO: 112304 - DNA, 20 bp, Artificial Sequence
  Description of Artificial Sequence: Synthetic oligonucleotide
  Target: ATXN1; (+) strand; PAM type: NRG; PAM sequence: GAG
cagcatattgtaccctaaat

SEQ ID NO: 112305 - DNA, 20 bp, Artificial Sequence
  Description of Artificial Sequence: Synthetic oligonucleotide
  Target: ATXN1; (+) strand; PAM type: NRG; PAM sequence: AGG
agcatattgtaccctaaatg

SEQ ID NO: 112306 - DNA, 20 bp, Artificial Sequence
  Description of Artificial Sequence: Synthetic oligonucleotide
  Target: ATXN1; (+) strand; PAM type: NRG; PAM sequence: GAG
tgtaccctaaatgaggtgat

SEQ ID NO: 112307 - DNA, 20 bp, Artificial Sequence
  Description of Artificial Sequence: Synthetic oligonucleotide
  Target: ATXN1; (+) strand; PAM type: NRG; PAM sequence: CAG
ccctaaatgaggtgatgaga

SEQ ID NO: 112308 - DNA, 20 bp, Artificial Sequence
  Description of Artificial Sequence: Synthetic oligonucleotide
  Target: ATXN1; (+) strand; PAM type: NRG; PAM sequence: GAG
tgaggtgatgagacagcatc

SEQ ID NO: 112309 - DNA, 20 bp, Artificial Sequence
  Description of Artificial Sequence: Synthetic oligonucleotide
  Target: ATXN1; (+) strand; PAM type: NRG; PAM sequence: CAG
catcgagccaactgaactat

SEQ ID NO: 112310 - DNA, 20 bp, Artificial Sequence
  Description of Artificial Sequence: Synthetic oligonucleotide
  Target: ATXN1; (+) strand; PAM type: NRG; PAM sequence: GAG
tcgagccaactgaactatca

SEQ ID NO: 112311 - DNA, 20 bp, Artificial Sequence
  Description of Artificial Sequence: Synthetic oligonucleotide
  Target: ATXN1; (+) strand; PAM type: NRG; PAM sequence: GAG
gagccaactgaactatcaga

SEQ ID NO: 112312 - DNA, 20 bp, Artificial Sequence
  Description of Artificial Sequence: Synthetic oligonucleotide
  Target: ATXN1; (+) strand; PAM type: NRG; PAM sequence: GAG
caactgaactatcagagagt

SEQ ID NO: 112313 - DNA, 20 bp, Artificial Sequence
  Description of Artificial Sequence: Synthetic oligonucleotide
  Target: ATXN1; (+) strand; PAM type: NRG; PAM sequence: AGG
aactgaactatcagagagtg

SEQ ID NO: 112314 - DNA, 20 bp, Artificial Sequence
  Description of Artificial Sequence: Synthetic oligonucleotide
  Target: ATXN1; (+) strand; PAM type: NRG; PAM sequence: CGG
agtgaggtcgtaatgcttat

SEQ ID NO: 112315 - DNA, 20 bp, Artificial Sequence
  Description of Artificial Sequence: Synthetic oligonucleotide
  Target: ATXN1; (+) strand; PAM type: NRG; PAM sequence: TGG
aaaacccatccaacccattt

SEQ ID NO: 112316 - DNA, 20 bp, Artificial Sequence
  Description of Artificial Sequence: Synthetic oligonucleotide
  Target: ATXN1; (+) strand; PAM type: NRG; PAM sequence: CAG
ccattttggtatgattcttg

SEQ ID NO: 112317 - DNA, 20 bp, Artificial Sequence
  Description of Artificial Sequence: Synthetic oligonucleotide
  Target: ATXN1; (+) strand; PAM type: NRG; PAM sequence: AAG
gtatgattcttgcagttact

SEQ ID NO: 112318 - DNA, 20 bp, Artificial Sequence
  Description of Artificial Sequence: Synthetic oligonucleotide
  Target: ATXN1; (+) strand; PAM type: NRG; PAM sequence: AGG
tatgattcttgcagttacta

SEQ ID NO: 112319 - DNA, 20 bp, Artificial Sequence
  Description of Artificial Sequence: Synthetic oligonucleotide
  Target: ATXN1; (+) strand; PAM type: NRG; PAM sequence: TGG
ttcttgcagttactaaggcc

SEQ ID NO: 112320 - DNA, 20 bp, Artificial Sequence
  Description of Artificial Sequence: Synthetic oligonucleotide
  Target: ATXN1; (+) strand; PAM type: NRG; PAM sequence: CAG
gccttcattctctctccact

SEQ ID NO: 112321 - DNA, 20 bp, Artificial Sequence
  Description of Artificial Sequence: Synthetic oligonucleotide
  Target: ATXN1; (+) strand; PAM type: NRG; PAM sequence: AAG
ctccactcagaattcacttt

SEQ ID NO: 112322 - DNA, 20 bp, Artificial Sequence
  Description of Artificial Sequence: Synthetic oligonucleotide
  Target: ATXN1; (+) strand; PAM type: NRG; PAM sequence: AAG
aattcactttaagctattat

SEQ ID NO: 112323 - DNA, 20 bp, Artificial Sequence
  Description of Artificial Sequence: Synthetic oligonucleotide
  Target: ATXN1; (+) strand; PAM type: NRG; PAM sequence: AAG
cactttaagctattataaga

SEQ ID NO: 112324 - DNA, 20 bp, Artificial Sequence
  Description of Artificial Sequence: Synthetic oligonucleotide
  Target: ATXN1; (+) strand; PAM type: NRG; PAM sequence: AAG
aagctattataagaaagcta

SEQ ID NO: 112325 - DNA, 20 bp, Artificial Sequence
  Description of Artificial Sequence: Synthetic oligonucleotide
  Target: ATXN1; (+) strand; PAM type: NRG; PAM sequence: CAG
taagaaagctaaagataaaa

SEQ ID NO: 112326 - DNA, 20 bp, Artificial Sequence
  Description of Artificial Sequence: Synthetic oligonucleotide
  Target: ATXN1; (+) strand; PAM type: NRG; PAM sequence: CAG
cataatgaaacactaatccc

SEQ ID NO: 112327 - DNA, 20 bp, Artificial Sequence
  Description of Artificial Sequence: Synthetic oligonucleotide
  Target: ATXN1; (+) strand; PAM type: NRG; PAM sequence: GAG
taatgaaacactaatcccca

SEQ ID NO: 112328 - DNA, 20 bp, Artificial Sequence
  Description of Artificial Sequence: Synthetic oligonucleotide
  Target: ATXN1; (+) strand; PAM type: NRG; PAM sequence: TAG
cccacgacacaaatgaatgc

SEQ ID NO: 112329 - DNA, 20 bp, Artificial Sequence
  Description of Artificial Sequence: Synthetic oligonucleotide
  Target: ATXN1; (+) strand; PAM type: NRG; PAM sequence: CAG
cgacacaaatgaatgctaga

SEQ ID NO: 112330 - DNA, 20 bp, Artificial Sequence
  Description of Artificial Sequence: Synthetic oligonucleotide
  Target: ATXN1; (+) strand; PAM type: NRG; PAM sequence: AAG
cacaaatgaatgctagacag

SEQ ID NO: 112331 - DNA, 20 bp, Artificial Sequence
  Description of Artificial Sequence: Synthetic oligonucleotide
  Target: ATXN1; (+) strand; PAM type: NRG; PAM sequence: TAG
acagaagataaccaaatgtc

SEQ ID NO: 112332 - DNA, 20 bp, Artificial Sequence
  Description of Artificial Sequence: Synthetic oligonucleotide
  Target: ATXN1; (+) strand; PAM type: NRG; PAM sequence: TAG
ttattcaaacctgcttctca

SEQ ID NO: 112333 - DNA, 20 bp, Artificial Sequence
  Description of Artificial Sequence: Synthetic oligonucleotide
  Target: ATXN1; (+) strand; PAM type: NRG; PAM sequence: CAG
acttgtactcactgcttcat

SEQ ID NO: 112334 - DNA, 20 bp, Artificial Sequence
  Description of Artificial Sequence: Synthetic oligonucleotide
  Target: ATXN1; (+) strand; PAM type: NRG; PAM sequence: CAG
caacaaaaaaacgctaaacc

SEQ ID NO: 112335 - DNA, 20 bp, Artificial Sequence
  Description of Artificial Sequence: Synthetic oligonucleotide
  Target: ATXN1; (+) strand; PAM type: NRG; PAM sequence: TAG
caaaaaaacgctaaacccag

SEQ ID NO: 112336 - DNA, 20 bp, Artificial Sequence
  Description of Artificial Sequence: Synthetic oligonucleotide
  Target: ATXN1; (+) strand; PAM type: NRG; PAM sequence: GAG
aaaaaacgctaaacccagta

SEQ ID NO: 112337 - DNA, 20 bp, Artificial Sequence
  Description of Artificial Sequence: Synthetic oligonucleotide
  Target: ATXN1; (+) strand; PAM type: NRG; PAM sequence: CAG
cccagtagagcctcttcact

SEQ ID NO: 112338 - DNA, 20 bp, Artificial Sequence
  Description of Artificial Sequence: Synthetic oligonucleotide
  Target: ATXN1; (+) strand; PAM type: NRG; PAM sequence: AGG
ccagtagagcctcttcactc

SEQ ID NO: 112339 - DNA, 20 bp, Artificial Sequence
  Description of Artificial Sequence: Synthetic oligonucleotide
  Target: ATXN1; (+) strand; PAM type: NRG; PAM sequence: GAG
tcactcaggcctttttattt

SEQ ID NO: 112340 - DNA, 20 bp, Artificial Sequence
  Description of Artificial Sequence: Synthetic oligonucleotide
  Target: ATXN1; (+) strand; PAM type: NRG; PAM sequence: CAG
tgagtttatctatccgaatg

SEQ ID NO: 112341 - DNA, 20 bp, Artificial Sequence
  Description of Artificial Sequence: Synthetic oligonucleotide
  Target: ATXN1; (+) strand; PAM type: NRG; PAM sequence: AAG
gaatgcagtaatgcctcctt

SEQ ID NO: 112342 - DNA, 20 bp, Artificial Sequence
  Description of Artificial Sequence: Synthetic oligonucleotide
  Target: ATXN1; (+) strand; PAM type: NRG; PAM sequence: CAG
tgcagtaatgcctccttaag

SEQ ID NO: 112343 - DNA, 20 bp, Artificial Sequence
  Description of Artificial Sequence: Synthetic oligonucleotide
  Target: ATXN1; (+) strand; PAM type: NRG; PAM sequence: CAG
aatgcctccttaagcagaca

SEQ ID NO: 112344 - DNA, 20 bp, Artificial Sequence
  Description of Artificial Sequence: Synthetic oligonucleotide
  Target: ATXN1; (+) strand; PAM type: NRG; PAM sequence: TAG
ctgaaaatatacacaatttg

SEQ ID NO: 112345 - DNA, 20 bp, Artificial Sequence
  Description of Artificial Sequence: Synthetic oligonucleotide
  Target: ATXN1; (+) strand; PAM type: NRG; PAM sequence: AAG
acacaatttgtagcatctga

SEQ ID NO: 112346 - DNA, 20 bp, Artificial Sequence
  Description of Artificial Sequence: Synthetic oligonucleotide
  Target: ATXN1; (+) strand; PAM type: NRG; PAM sequence: GAG
acaatttgtagcatctgaaa

SEQ ID NO: 112347 - DNA, 20 bp, Artificial Sequence
  Description of Artificial Sequence: Synthetic oligonucleotide
  Target: ATXN1; (+) strand; PAM type: NRG; PAM sequence: TGG
gtagcatctgaaagagaata

SEQ ID NO: 112348 - DNA, 20 bp, Artificial Sequence
  Description of Artificial Sequence: Synthetic oligonucleotide
  Target: ATXN1; (+) strand; PAM type: NRG; PAM sequence: TGG
cttctttctactcaatatgt

SEQ ID NO: 112349 - DNA, 20 bp, Artificial Sequence
  Description of Artificial Sequence: Synthetic oligonucleotide
  Target: ATXN1; (+) strand; PAM type: NRG; PAM sequence: TGG
ctttctactcaatatgttgg

SEQ ID NO: 112350 - DNA, 20 bp, Artificial Sequence
  Description of Artificial Sequence: Synthetic oligonucleotide
  Target: ATXN1; (+) strand; PAM type: NRG; PAM sequence: TGG
tactcaatatgttggtggac

SEQ ID NO: 112351 - DNA, 20 bp, Artificial Sequence
  Description of Artificial Sequence: Synthetic oligonucleotide
  Target: ATXN1; (+) strand; PAM type: NRG; PAM sequence: TAG
ggactggaatgtttccaatg

SEQ ID NO: 112352 - DNA, 20 bp, Artificial Sequence
  Description of Artificial Sequence: Synthetic oligonucleotide
  Target: ATXN1; (+) strand; PAM type: NRG; PAM sequence: TGG
tccaatgtagtcaatttttc

SEQ ID NO: 112353 - DNA, 20 bp, Artificial Sequence
  Description of Artificial Sequence: Synthetic oligonucleotide
  Target: ATXN1; (+) strand; PAM type: NRG; PAM sequence: AAG
ctttaaaattaaattaataa

SEQ ID NO: 112354 - DNA, 20 bp, Artificial Sequence
  Description of Artificial Sequence: Synthetic oligonucleotide
  Target: ATXN1; (+) strand; PAM type: NRG; PAM sequence: AAG
ttaataaaagtatacaattt

SEQ ID NO: 112355 - DNA, 20 bp, Artificial Sequence
  Description of Artificial Sequence: Synthetic oligonucleotide
  Target: ATXN1; (+) strand; PAM type: NRG; PAM sequence: AGG
taataaaagtatacaattta

SEQ ID NO: 112356 - DNA, 20 bp, Artificial Sequence
  Description of Artificial Sequence: Synthetic oligonucleotide
  Target: ATXN1; (+) strand; PAM type: NRG; PAM sequence: TAG
gtatacaatttaaggatcta

SEQ ID NO: 112357 - DNA, 20 bp, Artificial Sequence
  Description of Artificial Sequence: Synthetic oligonucleotide
  Target: ATXN1; (+) strand; PAM type: NRG; PAM sequence: CAG
aggatctatagatttgtgtt

SEQ ID NO: 112358 - DNA, 20 bp, Artificial Sequence
  Description of Artificial Sequence: Synthetic oligonucleotide
  Target: ATXN1; (+) strand; PAM type: NRG; PAM sequence: TGG
tagatttgtgttcagcacaa

SEQ ID NO: 112359 - DNA, 20 bp, Artificial Sequence
  Description of Artificial Sequence: Synthetic oligonucleotide
  Target: ATXN1; (+) strand; PAM type: NRG; PAM sequence: AAG
tgttcagcacaatggactaa

SEQ ID NO: 112360 - DNA, 20 bp, Artificial Sequence
  Description of Artificial Sequence: Synthetic oligonucleotide
  Target: ATXN1; (+) strand; PAM type: NRG; PAM sequence: GAG
agcacaatggactaaaagtt

SEQ ID NO: 112361 - DNA, 20 bp, Artificial Sequence
  Description of Artificial Sequence: Synthetic oligonucleotide
  Target: ATXN1; (+) strand; PAM type: NRG; PAM sequence: TGG
tggactaaaagttgagctac

SEQ ID NO: 112362 - DNA, 20 bp, Artificial Sequence
  Description of Artificial Sequence: Synthetic oligonucleotide
  Target: ATXN1; (+) strand; PAM type: NRG; PAM sequence: TAG
aaagttgagctactggattc

SEQ ID NO: 112363 - DNA, 20 bp, Artificial Sequence
  Description of Artificial Sequence: Synthetic oligonucleotide
  Target: ATXN1; (+) strand; PAM type: NRG; PAM sequence: TAG
aacaaaatgtcacttataat

SEQ ID NO: 112364 - DNA, 20 bp, Artificial Sequence
  Description of Artificial Sequence: Synthetic oligonucleotide
  Target: ATXN1; (+) strand; PAM type: NRG; PAM sequence: GAG
aatgtcacttataattagct

SEQ ID NO: 112365 - DNA, 20 bp, Artificial Sequence
  Description of Artificial Sequence: Synthetic oligonucleotide
  Target: ATXN1; (+) strand; PAM type: NRG; PAM sequence: CAG
gctgagtatatatgacatct

SEQ ID NO: 112366 - DNA, 20 bp, Artificial Sequence
  Description of Artificial Sequence: Synthetic oligonucleotide
  Target: ATXN1; (+) strand; PAM type: NRG; PAM sequence: AGG
ctgagtatatatgacatctc

SEQ ID NO: 112367 - DNA, 20 bp, Artificial Sequence
  Description of Artificial Sequence: Synthetic oligonucleotide
  Target: ATXN1; (+) strand; PAM type: NRG; PAM sequence: AAG
gacatctcaggcattgtacc

SEQ ID NO: 112368 - DNA, 20 bp, Artificial Sequence
  Description of Artificial Sequence: Synthetic oligonucleotide
  Target: ATXN1; (+) strand; PAM type: NRG; PAM sequence: AGG
acatctcaggcattgtacca

SEQ ID NO: 112369 - DNA, 20 bp, Artificial Sequence
  Description of Artificial Sequence: Synthetic oligonucleotide
  Target: ATXN1; (+) strand; PAM type: NRG; PAM sequence: GGG
catctcaggcattgtaccaa

SEQ ID NO: 112370 - DNA, 20 bp, Artificial Sequence
  Description of Artificial Sequence: Synthetic oligonucleotide
  Target: ATXN1; (+) strand; PAM type: NRG; PAM sequence: CAG
caggcattgtaccaagggcc

SEQ ID NO: 112371 - DNA, 20 bp, Artificial Sequence
  Description of Artificial Sequence: Synthetic oligonucleotide
  Target: ATXN1; (+) strand; PAM type: NRG; PAM sequence: CAG
catttcatttttataatttt

SEQ ID NO: 112372 - DNA, 20 bp, Artificial Sequence
  Description of Artificial Sequence: Synthetic oligonucleotide
  Target: ATXN1; (+) strand; PAM type: NRG; PAM sequence: AAG
ttcatttttataattttcag

SEQ ID NO: 112373 - DNA, 20 bp, Artificial Sequence
  Description of Artificial Sequence: Synthetic oligonucleotide
  Target: ATXN1; (+) strand; PAM type: NRG; PAM sequence: TAG
ttcagaagcacccactttcc

SEQ ID NO: 112374 - DNA, 20 bp, Artificial Sequence
  Description of Artificial Sequence: Synthetic oligonucleotide
  Target: ATXN1; (+) strand; PAM type: NRG; PAM sequence: TAG
gaagcacccactttcctagc

SEQ ID NO: 112375 - DNA, 20 bp, Artificial Sequence
  Description of Artificial Sequence: Synthetic oligonucleotide
  Target: ATXN1; (+) strand; PAM type: NRG; PAM sequence: AGG
aagcacccactttcctagct

SEQ ID NO: 112376 - DNA, 20 bp, Artificial Sequence
  Description of Artificial Sequence: Synthetic oligonucleotide
  Target: ATXN1; (+) strand; PAM type: NRG; PAM sequence: TGG
atacctaccaattgtgttct

SEQ ID NO: 112377 - DNA, 20 bp, Artificial Sequence
  Description of Artificial Sequence: Synthetic oligonucleotide
  Target: ATXN1; (+) strand; PAM type: NRG; PAM sequence: GGG
tacctaccaattgtgttctt

SEQ ID NO: 112378 - DNA, 20 bp, Artificial Sequence
  Description of Artificial Sequence: Synthetic oligonucleotide
  Target: ATXN1; (+) strand; PAM type: NRG; PAM sequence: TGG
gggcaaattatcttctatct

SEQ ID NO: 112379 - DNA, 20 bp, Artificial Sequence
  Description of Artificial Sequence: Synthetic oligonucleotide
  Target: ATXN1; (+) strand; PAM type: NRG; PAM sequence: CAG
ttctatcttggtttgtacaa

SEQ ID NO: 112380 - DNA, 20 bp, Artificial Sequence
  Description of Artificial Sequence: Synthetic oligonucleotide
  Target: ATXN1; (+) strand; PAM type: NRG; PAM sequence: AAG
tatcttggtttgtacaacag

SEQ ID NO: 112381 - DNA, 20 bp, Artificial Sequence
  Description of Artificial Sequence: Synthetic oligonucleotide
  Target: ATXN1; (+) strand; PAM type: NRG; PAM sequence: AAG
cttggtttgtacaacagaag

SEQ ID NO: 112382 - DNA, 20 bp, Artificial Sequence
  Description of Artificial Sequence: Synthetic oligonucleotide
  Target: ATXN1; (+) strand; PAM type: NRG; PAM sequence: TGG
agaaattattttaaaatata

SEQ ID NO: 112383 - DNA, 20 bp, Artificial Sequence
  Description of Artificial Sequence: Synthetic oligonucleotide
  Target: ATXN1; (+) strand; PAM type: NRG; PAM sequence: TAG
atatatggaatataataaaa

SEQ ID NO: 112384 - DNA, 20 bp, Artificial Sequence
  Description of Artificial Sequence: Synthetic oligonucleotide
  Target: ATXN1; (+) strand; PAM type: NRG; PAM sequence: TGG
aatataataaaatagaaatt

SEQ ID NO: 112385 - DNA, 20 bp, Artificial Sequence
  Description of Artificial Sequence: Synthetic oligonucleotide
  Target: ATXN1; (+) strand; PAM type: NRG; PAM sequence: TAG
tttggccaattaattaatat

SEQ ID NO: 112386 - DNA, 20 bp, Artificial Sequence
  Description of Artificial Sequence: Synthetic oligonucleotide
  Target: ATXN1; (+) strand; PAM type: NRG; PAM sequence: AGG
ttggccaattaattaatatt

SEQ ID NO: 112387 - DNA, 20 bp, Artificial Sequence
  Description of Artificial Sequence: Synthetic oligonucleotide
  Target: ATXN1; (+) strand; PAM type: NRG; PAM sequence: CAG
gccaattaattaatattagg

SEQ ID NO: 112388 - DNA, 20 bp, Artificial Sequence
  Description of Artificial Sequence: Synthetic oligonucleotide
  Target: ATXN1; (+) strand; PAM type: NRG; PAM sequence: AAG
atattaggcagtgaaacaat

SEQ ID NO: 112389 - DNA, 20 bp, Artificial Sequence
  Description of Artificial Sequence: Synthetic oligonucleotide
  Target: ATXN1; (+) strand; PAM type: NRG; PAM sequence: TGG
ttaggcagtgaaacaataag

SEQ ID NO: 112390 - DNA, 20 bp, Artificial Sequence
  Description of Artificial Sequence: Synthetic oligonucleotide
  Target: ATXN1; (+) strand; PAM type: NRG; PAM sequence: TGG
tttttttgtttgtttgtttt

SEQ ID NO: 112391 - DNA, 20 bp, Artificial Sequence
  Description of Artificial Sequence: Synthetic oligonucleotide
  Target: ATXN1; (+) strand; PAM type: NRG; PAM sequence: GAG
tgtttgtttttggttttttt

SEQ ID NO: 112392 - DNA, 20 bp, Artificial Sequence
  Description of Artificial Sequence: Synthetic oligonucleotide
  Target: ATXN1; (+) strand; PAM type: NRG; PAM sequence: CAG
tgtttttggtttttttgaga

SEQ ID NO: 112393 - DNA, 20 bp, Artificial Sequence
  Description of Artificial Sequence: Synthetic oligonucleotide
  Target: ATXN1; (+) strand; PAM type: NRG; PAM sequence: AGG
gtttttggtttttttgagac

SEQ ID NO: 112394 - DNA, 20 bp, Artificial Sequence
  Description of Artificial Sequence: Synthetic oligonucleotide
  Target: ATXN1; (+) strand; PAM type: NRG; PAM sequence: GGG
tttttggtttttttgagaca

SEQ ID NO: 112395 - DNA, 20 bp, Artificial Sequence
  Description of Artificial Sequence: Synthetic oligonucleotide
  Target: ATXN1; (+) strand; PAM type: NRG; PAM sequence: CAG
cagggtctcactctgtcgcc

SEQ ID NO: 112396 - DNA, 20 bp, Artificial Sequence
  Description of Artificial Sequence: Synthetic oligonucleotide
  Target: ATXN1; (+) strand; PAM type: NRG; PAM sequence: TGG
tctcactctgtcgcccagac

SEQ ID NO: 112397 - DNA, 20 bp, Artificial Sequence
  Description of Artificial Sequence: Synthetic oligonucleotide
  Target: ATXN1; (+) strand; PAM type: NRG; PAM sequence: GAG
tcactctgtcgcccagactg

SEQ ID NO: 112398 - DNA, 20 bp, Artificial Sequence
  Description of Artificial Sequence: Synthetic oligonucleotide
  Target: ATXN1; (+) strand; PAM type: NRG; PAM sequence: TGG
tcgcccagactggagtgaaa

SEQ ID NO: 112399 - DNA, 20 bp, Artificial Sequence
  Description of Artificial Sequence: Synthetic oligonucleotide
  Target: ATXN1; (+) strand; PAM type: NRG; PAM sequence: CGG
ggagtgaaatggtgcgatct

SEQ ID NO: 112400 - DNA, 20 bp, Artificial Sequence
  Description of Artificial Sequence: Synthetic oligonucleotide
  Target: ATXN1; (+) strand; PAM type: NRG; PAM sequence: TGG
tcactgcaacctctgcctcc

SEQ ID NO: 112401 - DNA, 20 bp, Artificial Sequence
  Description of Artificial Sequence: Synthetic oligonucleotide
  Target: ATXN1; (+) strand; PAM type: NRG; PAM sequence: GGG
cactgcaacctctgcctcct

SEQ ID NO: 112402 - DNA, 20 bp, Artificial Sequence
  Description of Artificial Sequence: Synthetic oligonucleotide
  Target: ATXN1; (+) strand; PAM type: NRG; PAM sequence: AAG
aacctctgcctcctgggttc

SEQ ID NO: 112403 - DNA, 20 bp, Artificial Sequence
  Description of Artificial Sequence: Synthetic oligonucleotide
  Target: ATXN1; (+) strand; PAM type: NRG; PAM sequence: GAG
cctctgcctcctgggttcaa

SEQ ID NO: 112404 - DNA, 20 bp, Artificial Sequence
  Description of Artificial Sequence: Synthetic oligonucleotide
  Target: ATXN1; (+) strand; PAM type: NRG; PAM sequence: CAG
ttcaagagattctcctgcct

SEQ ID NO: 112405 - DNA, 20 bp, Artificial Sequence
  Description of Artificial Sequence: Synthetic oligonucleotide
  Target: ATXN1; (+) strand; PAM type: NRG; PAM sequence: GAG
ttctcctgcctcagcctccc

SEQ ID NO: 112406 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcccgag

SEQ ID NO: 112407 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccgagtagc

SEQ ID NO: 112408 - DNA, 20 bp, Artificial Sequence
  Description of Artificial Sequence: Synthetic oligonucleotide
  Target: ATXN1; (+) strand; PAM type: NRG; PAM sequence: CGG
ctcccgagtagctggaacta

SEQ ID NO: 112409 - DNA, 20 bp, Artificial Sequence
  Description of Artificial Sequence: Synthetic oligonucleotide
  Target: ATXN1; (+) strand; PAM type: NRG; PAM sequence: CGG
acggcacctgccaccatgcc

SEQ ID NO: 112410 - DNA, 20 bp, Artificial Sequence
  Description of Artificial Sequence: Synthetic oligonucleotide
  Target: ATXN1; (+) strand; PAM type: NRG; PAM sequence: TAG
cggctaattttttgtatttt

SEQ ID NO: 112411 - DNA, 20 bp, Artificial Sequence
  Description of Artificial Sequence: Synthetic oligonucleotide
  Target: ATXN1; (+) strand; PAM type: NRG; PAM sequence: AGG
ggctaattttttgtattttt

SEQ ID NO: 112412 - DNA, 20 bp, Artificial Sequence
  Description of Artificial Sequence: Synthetic oligonucleotide
  Target: ATXN1; (+) strand; PAM type: NRG; PAM sequence: GAG
ctaattttttgtatttttag

SEQ ID NO: 112413 - DNA, 20 bp, Artificial Sequence
  Description of Artificial Sequence: Synthetic oligonucleotide
  Target: ATXN1; (+) strand; PAM type: NRG; PAM sequence: GAG
aattttttgtatttttagga

SEQ ID NO: 112414 - DNA, 20 bp, Artificial Sequence
  Description of Artificial Sequence: Synthetic oligonucleotide
  Target: ATXN1; (+) strand; PAM type: NRG; PAM sequence: TGG
ttttgtatttttaggagaga

SEQ ID NO: 112415 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttaggagagat

SEQ ID NO: 112416 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttaggagagatg

SEQ ID NO: 112417 - DNA, 20 bp, Artificial Sequence
  Description of Artificial Sequence: Synthetic oligonucleotide
  Target: ATXN1; (+) strand; PAM type: NRG; PAM sequence: TGG
tttttaggagagatggggtt

SEQ ID NO: 112418 - DNA, 20 bp, Artificial Sequence
  Description of Artificial Sequence: Synthetic oligonucleotide
  Target: ATXN1; (+) strand; PAM type: NRG; PAM sequence: TGG
gagatggggtttggccatgt

SEQ ID NO: 112419 - DNA, 20 bp, Artificial Sequence
  Description of Artificial Sequence: Synthetic oligonucleotide
  Target: ATXN1; (+) strand; PAM type: NRG; PAM sequence: CAG
tggggtttggccatgttggc

SEQ ID NO: 112420 - DNA, 20 bp, Artificial Sequence
  Description of Artificial Sequence: Synthetic oligonucleotide
  Target: ATXN1; (+) strand; PAM type: NRG; PAM sequence: AGG
ggggtttggccatgttggcc

SEQ ID NO: 112421 - DNA, 20 bp, Artificial Sequence
  Description of Artificial Sequence: Synthetic oligonucleotide
  Target: ATXN1; (+) strand; PAM type: NRG; PAM sequence: TGG
tttggccatgttggccagga

SEQ ID NO: 112422 - DNA, 20 bp, Artificial Sequence
  Description of Artificial Sequence: Synthetic oligonucleotide
  Target: ATXN1; (+) strand; PAM type: NRG; PAM sequence: CAG
tggtctcgaactcctgacct

SEQ ID NO: 112423 - DNA, 20 bp, Artificial Sequence
  Description of Artificial Sequence: Synthetic oligonucleotide
  Target: ATXN1; (+) strand; PAM type: NRG; PAM sequence: TGG
ctcagatgctccaccctcct

SEQ ID NO: 112424 - DNA, 20 bp, Artificial Sequence
  Description of Artificial Sequence: Synthetic oligonucleotide
  Target: ATXN1; (+) strand; PAM type: NRG; PAM sequence: AAG
ccaccctccttggcctccca

SEQ ID NO: 112425 - DNA, 20 bp, Artificial Sequence
  Description of Artificial Sequence: Synthetic oligonucleotide
  Target: ATXN1; (+) strand; PAM type: NRG; PAM sequence: TGG
tccttggcctcccaaagtgc

SEQ ID NO: 112426 - DNA, 20 bp, Artificial Sequence
  Description of Artificial Sequence: Synthetic oligonucleotide
  Target: ATXN1; (+) strand; PAM type: NRG; PAM sequence: GGG
ccttggcctcccaaagtgct

SEQ ID NO: 112427 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 112428 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 112429 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggcgt

SEQ ID NO: 112430 - DNA, 20 bp, Artificial Sequence
  Description of Artificial Sequence: Synthetic oligonucleotide
  Target: ATXN1; (+) strand; PAM type: NRG; PAM sequence: CAG
caggcgtgagccaccgcgcc

SEQ ID NO: 112431 - DNA, 20 bp, Artificial Sequence
  Description of Artificial Sequence: Synthetic oligonucleotide
  Target: ATXN1; (+) strand; PAM type: NRG; PAM sequence: AAG
tgagccaccgcgcccagccc

SEQ ID NO: 112432 - DNA, 20 bp, Artificial Sequence
  Description of Artificial Sequence: Synthetic oligonucleotide
  Target: ATXN1; (+) strand; PAM type: NRG; PAM sequence: TGG
gccaccgcgcccagcccaag

SEQ ID NO: 112433 - DNA, 20 bp, Artificial Sequence
  Description of Artificial Sequence: Synthetic oligonucleotide
  Target: ATXN1; (+) strand; PAM type: NRG; PAM sequence: CAG
aagtggttattatttcaaca

SEQ ID NO: 112434 - DNA, 20 bp, Artificial Sequence
  Description of Artificial Sequence: Synthetic oligonucleotide
  Target: ATXN1; (+) strand; PAM type: NRG; PAM sequence: AAG
tggttattatttcaacacag

SEQ ID NO: 112435 - DNA, 20 bp, Artificial Sequence
  Description of Artificial Sequence: Synthetic oligonucleotide
  Target: ATXN1; (+) strand; PAM type: NRG; PAM sequence: AAG
cagaagtccttgtttacccg

SEQ ID NO: 112436 - DNA, 20 bp, Artificial Sequence
  Description of Artificial Sequence: Synthetic oligonucleotide
  Target: ATXN1; (+) strand; PAM type: NRG; PAM sequence: CAG
aagtccttgtttacccgaag

SEQ ID NO: 112437 - DNA, 20 bp, Artificial Sequence
  Description of Artificial Sequence: Synthetic oligonucleotide
  Target: ATXN1; (+) strand; PAM type: NRG; PAM sequence: TGG
ccttgtttacccgaagcagc

SEQ ID NO: 112438 - DNA, 20 bp, Artificial Sequence
  Description of Artificial Sequence: Synthetic oligonucleotide
  Target: ATXN1; (+) strand; PAM type: NRG; PAM sequence: GGG
cttgtttacccgaagcagct

SEQ ID NO: 112439 - DNA, 20 bp, Artificial Sequence
  Description of Artificial Sequence: Synthetic oligonucleotide
  Target: ATXN1; (+) strand; PAM type: NRG; PAM sequence: TAG
tacccgaagcagctgggaaa

SEQ ID NO: 112440 - DNA, 20 bp, Artificial Sequence
  Description of Artificial Sequence: Synthetic oligonucleotide
  Target: ATXN1; (+) strand; PAM type: NRG; PAM sequence: AGG
acccgaagcagctgggaaat

SEQ ID NO: 112441 - DNA, 20 bp, Artificial Sequence
  Description of Artificial Sequence: Synthetic oligonucleotide
  Target: ATXN1; (+) strand; PAM type: NRG; PAM sequence: GGG
cccgaagcagctgggaaata

SEQ ID NO: 112442 - DNA, 20 bp, Artificial Sequence
  Description of Artificial Sequence: Synthetic oligonucleotide
  Target: ATXN1; (+) strand; PAM type: NRG; PAM sequence: CAG
aatagggcttcgcataaaac

SEQ ID NO: 112443 - DNA, 20 bp, Artificial Sequence
  Description of Artificial Sequence: Synthetic oligonucleotide
  Target: ATXN1; (+) strand; PAM type: NRG; PAM sequence: GAG
tagggcttcgcataaaacca

SEQ ID NO: 112444 - DNA, 20 bp, Artificial Sequence
  Description of Artificial Sequence: Synthetic oligonucleotide
  Target: ATXN1; (+) strand; PAM type: NRG; PAM sequence: CAG
ggcttcgcataaaaccagag

SEQ ID NO: 112445 - DNA, 20 bp, Artificial Sequence
  Description of Artificial Sequence: Synthetic oligonucleotide
  Target: ATXN1; (+) strand; PAM type: NRG; PAM sequence: AAG
ttcgcataaaaccagagcag

SEQ ID NO: 112446 - DNA, 20 bp, Artificial Sequence
  Description of Artificial Sequence: Synthetic oligonucleotide
  Target: ATXN1; (+) strand; PAM type: NRG; PAM sequence: TAG
gcataaaaccagagcagaag

SEQ ID NO: 112447 - DNA, 20 bp, Artificial Sequence
  Description of Artificial Sequence: Synthetic oligonucleotide
  Target: ATXN1; (+) strand; PAM type: NRG; PAM sequence: CAG
taaaaccagagcagaagtag

SEQ ID NO: 112448 - DNA, 20 bp, Artificial Sequence
  Description of Artificial Sequence: Synthetic oligonucleotide
  Target: ATXN1; (+) strand; PAM type: NRG; PAM sequence: GAG
aaaccagagcagaagtagca

SEQ ID NO: 112449 - DNA, 20 bp, Artificial Sequence
  Description of Artificial Sequence: Synthetic oligonucleotide
  Target: ATXN1; (+) strand; PAM type: NRG; PAM sequence: AAG
cagagcagaagtagcagaga

SEQ ID NO: 112450 - DNA, 20 bp, Artificial Sequence
  Description of Artificial Sequence: Synthetic oligonucleotide
  Target: ATXN1; (+) strand; PAM type: NRG; PAM sequence: AGG
agagcagaagtagcagagaa

SEQ ID NO: 112451 - DNA, 20 bp, Artificial Sequence
  Description of Artificial Sequence: Synthetic oligonucleotide
  Target: ATXN1; (+) strand; PAM type: NRG; PAM sequence: GGG
gagcagaagtagcagagaaa

SEQ ID NO: 112452 - DNA, 20 bp, Artificial Sequence
  Description of Artificial Sequence: Synthetic oligonucleotide
  Target: ATXN1; (+) strand; PAM type: NRG; PAM sequence: GAG
tagcagagaaagggacctgt

SEQ ID NO: 112453 - DNA, 20 bp, Artificial Sequence
  Description of Artificial Sequence: Synthetic oligonucleotide
  Target: ATXN1; (+) strand; PAM type: NRG; PAM sequence: GAG
agagaaagggacctgtgagt

SEQ ID NO: 112454 - DNA, 20 bp, Artificial Sequence
  Description of Artificial Sequence: Synthetic oligonucleotide
  Target: ATXN1; (+) strand; PAM type: NRG; PAM sequence: TGG
acctgtgagtgagtcctgcc

SEQ ID NO: 112455 - DNA, 20 bp, Artificial Sequence
  Description of Artificial Sequence: Synthetic oligonucleotide
  Target: ATXN1; (+) strand; PAM type: NRG; PAM sequence: CGG
agtgagtcctgcctggttct

SEQ ID NO: 112456 - DNA, 20 bp, Artificial Sequence
  Description of Artificial Sequence: Synthetic oligonucleotide
  Target: ATXN1; (+) strand; PAM type: NRG; PAM sequence: TAG
gcctggttctcggctcacac

SEQ ID NO: 112457 - DNA, 20 bp, Artificial Sequence
  Description of Artificial Sequence: Synthetic oligonucleotide
  Target: ATXN1; (+) strand; PAM type: NRG; PAM sequence: CAG
gttctcggctcacactagtc

SEQ ID NO: 112458 - DNA, 20 bp, Artificial Sequence
  Description of Artificial Sequence: Synthetic oligonucleotide
  Target: ATXN1; (+) strand; PAM type: NRG; PAM sequence: TGG
ggctcacactagtccagcct

SEQ ID NO: 112459 - DNA, 20 bp, Artificial Sequence
  Description of Artificial Sequence: Synthetic oligonucleotide
  Target: ATXN1; (+) strand; PAM type: NRG; PAM sequence: GGG
gctcacactagtccagcctt

SEQ ID NO: 112460 - DNA, 20 bp, Artificial Sequence
  Description of Artificial Sequence: Synthetic oligonucleotide
  Target: ATXN1; (+) strand; PAM type: NRG; PAM sequence: AAG
acactagtccagccttggga

SEQ ID NO: 112461 - DNA, 20 bp, Artificial Sequence
  Description of Artificial Sequence: Synthetic oligonucleotide
  Target: ATXN1; (+) strand; PAM type: NRG; PAM sequence: GAG
actagtccagccttgggaaa

SEQ ID NO: 112462 - DNA, 20 bp, Artificial Sequence
  Description of Artificial Sequence: Synthetic oligonucleotide
  Target: ATXN1; (+) strand; PAM type: NRG; PAM sequence: TGG
gtccagccttgggaaagagc

SEQ ID NO: 112463 - DNA, 20 bp, Artificial Sequence
  Description of Artificial Sequence: Synthetic oligonucleotide
  Target: ATXN1; (+) strand; PAM type: NRG; PAM sequence: GGG
tccagccttgggaaagagct

SEQ ID NO: 112464 - DNA, 20 bp, Artificial Sequence
  Description of Artificial Sequence: Synthetic oligonucleotide
  Target: ATXN1; (+) strand; PAM type: NRG; PAM sequence: CAG
gggaaagagctgggacacca

SEQ ID NO: 112465 - DNA, 20 bp, Artificial Sequence
  Description of Artificial Sequence: Synthetic oligonucleotide
  Target: ATXN1; (+) strand; PAM type: NRG; PAM sequence: AGG
ggaaagagctgggacaccac

SEQ ID NO: 112466 - DNA, 20 bp, Artificial Sequence
  Description of Artificial Sequence: Synthetic oligonucleotide
  Target: ATXN1; (+) strand; PAM type: NRG; PAM sequence: TGG
taatttaccctttgcctgtc

SEQ ID NO: 112467 - DNA, 20 bp, Artificial Sequence
  Description of Artificial Sequence: Synthetic oligonucleotide
  Target: ATXN1; (+) strand; PAM type: NRG; PAM sequence: AAG
taccctttgcctgtctggcg

SEQ ID NO: 112468 - DNA, 20 bp, Artificial Sequence
  Description of Artificial Sequence: Synthetic oligonucleotide
  Target: ATXN1; (+) strand; PAM type: NRG; PAM sequence: AAG
ttgcctgtctggcgaagaca

SEQ ID NO: 112469 - DNA, 20 bp, Artificial Sequence
  Description of Artificial Sequence: Synthetic oligonucleotide
  Target: ATXN1; (+) strand; PAM type: NRG; PAM sequence: GAG
tggcgaagacaaagtaaact

SEQ ID NO: 112470 - DNA, 20 bp, Artificial Sequence
  Description of Artificial Sequence: Synthetic oligonucleotide
  Target: ATXN1; (+) strand; PAM type: NRG; PAM sequence: TGG
ctgagtgccacttttattaa

SEQ ID NO: 112471 - DNA, 20 bp, Artificial Sequence
  Description of Artificial Sequence: Synthetic oligonucleotide
  Target: ATXN1; (+) strand; PAM type: NRG; PAM sequence: GGG
tgagtgccacttttattaat

SEQ ID NO: 112472 - DNA, 20 bp, Artificial Sequence
  Description of Artificial Sequence: Synthetic oligonucleotide
  Target: ATXN1; (+) strand; PAM type: NRG; PAM sequence: TAG
atgggaaaccatcttactta

SEQ ID NO: 112473 - DNA, 20 bp, Artificial Sequence
  Description of Artificial Sequence: Synthetic oligonucleotide
  Target: ATXN1; (+) strand; PAM type: NRG; PAM sequence: CGG
ctcaaacctcattcattctg

SEQ ID NO: 112474 - DNA, 20 bp, Artificial Sequence
  Description of Artificial Sequence: Synthetic oligonucleotide
  Target: ATXN1; (+) strand; PAM type: NRG; PAM sequence: TGG
tcattcattctgcggttatc

SEQ ID NO: 112475 - DNA, 20 bp, Artificial Sequence
  Description of Artificial Sequence: Synthetic oligonucleotide
  Target: ATXN1; (+) strand; PAM type: NRG; PAM sequence: TAG
tatctggatccttcatgctg

SEQ ID NO: 112476 - DNA, 20 bp, Artificial Sequence
  Description of Artificial Sequence: Synthetic oligonucleotide
  Target: ATXN1; (+) strand; PAM type: NRG; PAM sequence: AGG
atctggatccttcatgctgt

SEQ ID NO: 112477 - DNA, 20 bp, Artificial Sequence
  Description of Artificial Sequence: Synthetic oligonucleotide
  Target: ATXN1; (+) strand; PAM type: NRG; PAM sequence: TAG
tggatccttcatgctgtagg

SEQ ID NO: 112478 - DNA, 20 bp, Artificial Sequence
  Description of Artificial Sequence: Synthetic oligonucleotide
  Target: ATXN1; (+) strand; PAM type: NRG; PAM sequence: AGG
ggatccttcatgctgtaggt

SEQ ID NO: 112479 - DNA, 20 bp, Artificial Sequence
  Description of Artificial Sequence: Synthetic oligonucleotide
  Target: ATXN1; (+) strand; PAM type: NRG; PAM sequence: GGG
gatccttcatgctgtaggta

SEQ ID NO: 112480 - DNA, 20 bp, Artificial Sequence
  Description of Artificial Sequence: Synthetic oligonucleotide
  Target: ATXN1; (+) strand; PAM type: NRG; PAM sequence: CAG
ttcatgctgtaggtagggaa

SEQ ID NO: 112481 - DNA, 20 bp, Artificial Sequence
  Description of Artificial Sequence: Synthetic oligonucleotide
  Target: ATXN1; (+) strand; PAM type: NRG; PAM sequence: TGG
gctgtaggtagggaacagaa

SEQ ID NO: 112482 - DNA, 20 bp, Artificial Sequence
  Description of Artificial Sequence: Synthetic oligonucleotide
  Target: ATXN1; (+) strand; PAM type: NRG; PAM sequence: GGG
ctgtaggtagggaacagaat

SEQ ID NO: 112483 - DNA, 20 bp, Artificial Sequence
  Description of Artificial Sequence: Synthetic oligonucleotide
  Target: ATXN1; (+) strand; PAM type: NRG; PAM sequence: GGG
tgtaggtagggaacagaatg

SEQ ID NO: 112484 - DNA, 20 bp, Artificial Sequence
  Description of Artificial Sequence: Synthetic oligonucleotide
  Target: ATXN1; (+) strand; PAM type: NRG; PAM sequence: GAG
agggaacagaatggggctct

SEQ ID NO: 112485 - DNA, 20 bp, Artificial Sequence
  Description of Artificial Sequence: Synthetic oligonucleotide
  Target: ATXN1; (+) strand; PAM type: NRG; PAM sequence: GAG
ggaacagaatggggctctga

SEQ ID NO: 112486 - DNA, 20 bp, Artificial Sequence
  Description of Artificial Sequence: Synthetic oligonucleotide
  Target: ATXN1; (+) strand; PAM type: NRG; PAM sequence: TGG
tccctcctccgcgcctctgc

SEQ ID NO: 112487 - DNA, 20 bp, Artificial Sequence
  Description of Artificial Sequence: Synthetic oligonucleotide
  Target: ATXN1; (+) strand; PAM type: NRG; PAM sequence: GGG
ccctcctccgcgcctctgct

SEQ ID NO: 112488 - DNA, 20 bp, Artificial Sequence
  Description of Artificial Sequence: Synthetic oligonucleotide
  Target: ATXN1; (+) strand; PAM type: NRG; PAM sequence: GAG
ctcctccgcgcctctgctgg

SEQ ID NO: 112489 - DNA, 20 bp, Artificial Sequence
  Description of Artificial Sequence: Synthetic oligonucleotide
  Target: ATXN1; (+) strand; PAM type: NRG; PAM sequence: CAG
gagcaaaaataatctcaaaa

SEQ ID NO: 112490 - DNA, 20 bp, Artificial Sequence
  Description of Artificial Sequence: Synthetic oligonucleotide
  Target: ATXN1; (+) strand; PAM type: NRG; PAM sequence: AGG
agcaaaaataatctcaaaac

SEQ ID NO: 112491 - DNA, 20 bp, Artificial Sequence
  Description of Artificial Sequence: Synthetic oligonucleotide
  Target: ATXN1; (+) strand; PAM type: NRG; PAM sequence: AAG
aataatctcaaaacaggaaa

SEQ ID NO: 112492 - DNA, 20 bp, Artificial Sequence
  Description of Artificial Sequence: Synthetic oligonucleotide
  Target: ATXN1; (+) strand; PAM type: NRG; PAM sequence: AAG
aatctcaaaacaggaaaaag

SEQ ID NO: 112493 - DNA, 20 bp, Artificial Sequence
  Description of Artificial Sequence: Synthetic oligonucleotide
  Target: ATXN1; (+) strand; PAM type: NRG; PAM sequence: AGG
atctcaaaacaggaaaaaga

SEQ ID NO: 112494 - DNA, 20 bp, Artificial Sequence
  Description of Artificial Sequence: Synthetic oligonucleotide
  Target: ATXN1; (+) strand; PAM type: NRG; PAM sequence: GAG
ctcaaaacaggaaaaagaag

SEQ ID NO: 112495 - DNA, 20 bp, Artificial Sequence
  Description of Artificial Sequence: Synthetic oligonucleotide
  Target: ATXN1; (+) strand; PAM type: NRG; PAM sequence: AGG
tcaaaacaggaaaaagaagg

SEQ ID NO: 112496 - DNA, 20 bp, Artificial Sequence
  Description of Artificial Sequence: Synthetic oligonucleotide
  Target: ATXN1; (+) strand; PAM type: NRG; PAM sequence: GGG
caaaacaggaaaaagaagga

SEQ ID NO: 112497 - DNA, 20 bp, Artificial Sequence
  Description of Artificial Sequence: Synthetic oligonucleotide
  Target: ATXN1; (+) strand; PAM type: NRG; PAM sequence: GGG
aaaacaggaaaaagaaggag

SEQ ID NO: 112498 - DNA, 20 bp, Artificial Sequence
  Description of Artificial Sequence: Synthetic oligonucleotide
  Target: ATXN1; (+) strand; PAM type: NRG; PAM sequence: CAG
atcgtttttttccctccctt

SEQ ID NO: 112499 - DNA, 20 bp, Artificial Sequence
  Description of Artificial Sequence: Synthetic oligonucleotide
  Target: ATXN1; (+) strand; PAM type: NRG; PAM sequence: GAG
tttttccctcccttcagaat

SEQ ID NO: 112500 - DNA, 20 bp, Artificial Sequence
  Description of Artificial Sequence: Synthetic oligonucleotide
  Target: ATXN1; (+) strand; PAM type: NRG; PAM sequence: TGG
ttccctcccttcagaatgag

SEQ ID NO: 112501 - DNA, 20 bp, Artificial Sequence
  Description of Artificial Sequence: Synthetic oligonucleotide
  Target: ATXN1; (+) strand; PAM type: NRG; PAM sequence: GGG
tccctcccttcagaatgagt

SEQ ID NO: 112502 - DNA, 20 bp, Artificial Sequence
  Description of Artificial Sequence: Synthetic oligonucleotide
  Target: ATXN1; (+) strand; PAM type: NRG; PAM sequence: GGG
ccctcccttcagaatgagtg

SEQ ID NO: 112503 - DNA, 20 bp, Artificial Sequence
  Description of Artificial Sequence: Synthetic oligonucleotide
  Target: ATXN1; (+) strand; PAM type: NRG; PAM sequence: GAG
ctcccttcagaatgagtggg

SEQ ID NO: 112504 - DNA, 20 bp, Artificial Sequence
  Description of Artificial Sequence: Synthetic oligonucleotide
  Target: ATXN1; (+) strand; PAM type: NRG; PAM sequence: TGG
tgagtggggagaattataca

SEQ ID NO: 112505 - DNA, 20 bp, Artificial Sequence
  Description of Artificial Sequence: Synthetic oligonucleotide
  Target: ATXN1; (+) strand; PAM type: NRG; PAM sequence: GGG
gagtggggagaattatacat

SEQ ID NO: 112506 - DNA, 20 bp, Artificial Sequence
  Description of Artificial Sequence: Synthetic oligonucleotide
  Target: ATXN1; (+) strand; PAM type: NRG; PAM sequence: CAG
tggggagaattatacatggg

SEQ ID NO: 112507 - DNA, 20 bp, Artificial Sequence
  Description of Artificial Sequence: Synthetic oligonucleotide
  Target: ATXN1; (+) strand; PAM type: NRG; PAM sequence: GAG
atacatgggcagctacatat

SEQ ID NO: 112508 - DNA, 20 bp, Artificial Sequence
  Description of Artificial Sequence: Synthetic oligonucleotide
  Target: ATXN1; (+) strand; PAM type: NRG; PAM sequence: CAG
atgggcagctacatatgagc

SEQ ID NO: 112509 - DNA, 20 bp, Artificial Sequence
  Description of Artificial Sequence: Synthetic oligonucleotide
  Target: ATXN1; (+) strand; PAM type: NRG; PAM sequence: AAG
acatatgagccagtacatat

SEQ ID NO: 112510 - DNA, 20 bp, Artificial Sequence
  Description of Artificial Sequence: Synthetic oligonucleotide
  Target: ATXN1; (+) strand; PAM type: NRG; PAM sequence: CAG
atataagtcaataatgcaaa

SEQ ID NO: 112511 - DNA, 20 bp, Artificial Sequence
  Description of Artificial Sequence: Synthetic oligonucleotide
  Target: ATXN1; (+) strand; PAM type: NRG; PAM sequence: AGG
tataagtcaataatgcaaac

SEQ ID NO: 112512 - DNA, 20 bp, Artificial Sequence
  Description of Artificial Sequence: Synthetic oligonucleotide
  Target: ATXN1; (+) strand; PAM type: NRG; PAM sequence: CAG
aataatgcaaacaggatcgt

SEQ ID NO: 112513 - DNA, 20 bp, Artificial Sequence
  Description of Artificial Sequence: Synthetic oligonucleotide
  Target: ATXN1; (+) strand; PAM type: NRG; PAM sequence: AGG
ataatgcaaacaggatcgtc

SEQ ID NO: 112514 - DNA, 20 bp, Artificial Sequence
  Description of Artificial Sequence: Synthetic oligonucleotide
  Target: ATXN1; (+) strand; PAM type: NRG; PAM sequence: AAG
tgcaaacaggatcgtcagga

SEQ ID NO: 112515 - DNA, 20 bp, Artificial Sequence
  Description of Artificial Sequence: Synthetic oligonucleotide
  Target: ATXN1; (+) strand; PAM type: NRG; PAM sequence: AAG
aaagtgtttaatttattcac

SEQ ID NO: 112516 - DNA, 20 bp, Artificial Sequence
  Description of Artificial Sequence: Synthetic oligonucleotide
  Target: ATXN1; (+) strand; PAM type: NRG; PAM sequence: AAG
gtgtttaatttattcacaag

SEQ ID NO: 112517 - DNA, 20 bp, Artificial Sequence
  Description of Artificial Sequence: Synthetic oligonucleotide
  Target: ATXN1; (+) strand; PAM type: NRG; PAM sequence: AAG
tattcacaagaagaactacc

SEQ ID NO: 112518 - DNA, 20 bp, Artificial Sequence
  Description of Artificial Sequence: Synthetic oligonucleotide
  Target: ATXN1; (+) strand; PAM type: NRG; PAM sequence: CAG
aaaaaaaaaaaaaaaaaacc

SEQ ID NO: 112519 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaaaaaaaaaaccc

SEQ ID NO: 112520 - DNA, 20 bp, Artificial Sequence
  Description of Artificial Sequence: Synthetic oligonucleotide
  Target: ATXN1; (+) strand; PAM type: NRG; PAM sequence: CAG
tttcttcatcatccattttg

SEQ ID NO: 112521 - DNA, 20 bp, Artificial Sequence
  Description of Artificial Sequence: Synthetic oligonucleotide
  Target: ATXN1; (+) strand; PAM type: NRG; PAM sequence: CAG
ttcatcatccattttgcagt

SEQ ID NO: 112522 - DNA, 20 bp, Artificial Sequence
  Description of Artificial Sequence: Synthetic oligonucleotide
  Target: ATXN1; (+) strand; PAM type: NRG; PAM sequence: TGG
gtcagtgtgctgataacaaa

SEQ ID NO: 112523 - DNA, 20 bp, Artificial Sequence
  Description of Artificial Sequence: Synthetic oligonucleotide
  Target: ATXN1; (+) strand; PAM type: NRG; PAM sequence: TAG
gataacaaatggtcattatc

SEQ ID NO: 112524 - DNA, 20 bp, Artificial Sequence
  Description of Artificial Sequence: Synthetic oligonucleotide
  Target: ATXN1; (+) strand; PAM type: NRG; PAM sequence: TGG
aatggtcattatctagtttc

SEQ ID NO: 112525 - DNA, 20 bp, Artificial Sequence
  Description of Artificial Sequence: Synthetic oligonucleotide
  Target: ATXN1; (+) strand; PAM type: NRG; PAM sequence: AAG
gtcattatctagtttctgga

SEQ ID NO: 112526 - DNA, 20 bp, Artificial Sequence
  Description of Artificial Sequence: Synthetic oligonucleotide
  Target: ATXN1; (+) strand; PAM type: NRG; PAM sequence: TGG
ggaaagtaatgtctatgaat

SEQ ID NO: 112527 - DNA, 20 bp, Artificial Sequence
  Description of Artificial Sequence: Synthetic oligonucleotide
  Target: ATXN1; (+) strand; PAM type: NRG; PAM sequence: TGG
atgaattggaaaaaaaaaat

SEQ ID NO: 112528 - DNA, 20 bp, Artificial Sequence
  Description of Artificial Sequence: Synthetic oligonucleotide
  Target: ATXN1; (+) strand; PAM type: NRG; PAM sequence: TGG
aaattggtcaataatttata

SEQ ID NO: 112529 - DNA, 20 bp, Artificial Sequence
  Description of Artificial Sequence: Synthetic oligonucleotide
  Target: ATXN1; (+) strand; PAM type: NRG; PAM sequence: AAG
tatatggctatgtatacttg

SEQ ID NO: 112530 - DNA, 20 bp, Artificial Sequence
  Description of Artificial Sequence: Synthetic oligonucleotide
  Target: ATXN1; (+) strand; PAM type: NRG; PAM sequence: TAG
agtaatgcaacttattttct

SEQ ID NO: 112531 - DNA, 20 bp, Artificial Sequence
  Description of Artificial Sequence: Synthetic oligonucleotide
  Target: ATXN1; (+) strand; PAM type: NRG; PAM sequence: AAG
aatgcaacttattttcttag

SEQ ID NO: 112532 - DNA, 20 bp, Artificial Sequence
  Description of Artificial Sequence: Synthetic oligonucleotide
  Target: ATXN1; (+) strand; PAM type: NRG; PAM sequence: AGG
atgcaacttattttcttaga

SEQ ID NO: 112533 - DNA, 20 bp, Artificial Sequence
  Description of Artificial Sequence: Synthetic oligonucleotide
  Target: ATXN1; (+) strand; PAM type: NRG; PAM sequence: TAG
cttagaaggatctctcaata

SEQ ID NO: 112534 - DNA, 20 bp, Artificial Sequence
  Description of Artificial Sequence: Synthetic oligonucleotide
  Target: ATXN1; (+) strand; PAM type: NRG; PAM sequence: TAG
tcctcctaaaaaatctaaat

SEQ ID NO: 112535 - DNA, 20 bp, Artificial Sequence
  Description of Artificial Sequence: Synthetic oligonucleotide
  Target: ATXN1; (+) strand; PAM type: NRG; PAM sequence: GAG
ctcctaaaaaatctaaatta

SEQ ID NO: 112536 - DNA, 20 bp, Artificial Sequence
  Description of Artificial Sequence: Synthetic oligonucleotide
  Target: ATXN1; (+) strand; PAM type: NRG; PAM sequence: GAG
cctaaaaaatctaaattaga

SEQ ID NO: 112537 - DNA, 20 bp, Artificial Sequence
  Description of Artificial Sequence: Synthetic oligonucleotide
  Target: ATXN1; (+) strand; PAM type: NRG; PAM sequence: TGG
ctaaattagagagattttat

SEQ ID NO: 112538 - DNA, 20 bp, Artificial Sequence
  Description of Artificial Sequence: Synthetic oligonucleotide
  Target: ATXN1; (+) strand; PAM type: NRG; PAM sequence: TGG
ctctctgccttctatccctg

SEQ ID NO: 112539 - DNA, 20 bp, Artificial Sequence
  Description of Artificial Sequence: Synthetic oligonucleotide
  Target: ATXN1; (+) strand; PAM type: NRG; PAM sequence: CAG
tctatccctgtggcctttta

SEQ ID NO: 112540 - DNA, 20 bp, Artificial Sequence
  Description of Artificial Sequence: Synthetic oligonucleotide
  Target: ATXN1; (+) strand; PAM type: NRG; PAM sequence: AAG
cctgtggccttttacagaca

SEQ ID NO: 112541 - DNA, 20 bp, Artificial Sequence
  Description of Artificial Sequence: Synthetic oligonucleotide
  Target: ATXN1; (+) strand; PAM type: NRG; PAM sequence: TGG
caaagcttttgctataacca

SEQ ID NO: 112542 - DNA, 20 bp, Artificial Sequence
  Description of Artificial Sequence: Synthetic oligonucleotide
  Target: ATXN1; (+) strand; PAM type: NRG; PAM sequence: GAG
aagcttttgctataaccatg

SEQ ID NO: 112543 - DNA, 20 bp, Artificial Sequence
  Description of Artificial Sequence: Synthetic oligonucleotide
  Target: ATXN1; (+) strand; PAM type: NRG; PAM sequence: TAG
tataaccatggagcacacaa

SEQ ID NO: 112544 - DNA, 20 bp, Artificial Sequence
  Description of Artificial Sequence: Synthetic oligonucleotide
  Target: ATXN1; (+) strand; PAM type: NRG; PAM sequence: AAG
tagtgcaaactataaaatat

SEQ ID NO: 112545 - DNA, 20 bp, Artificial Sequence
  Description of Artificial Sequence: Synthetic oligonucleotide
  Target: ATXN1; (+) strand; PAM type: NRG; PAM sequence: AAG
gcaaactataaaatataaga

SEQ ID NO: 112546 - DNA, 20 bp, Artificial Sequence
  Description of Artificial Sequence: Synthetic oligonucleotide
  Target: ATXN1; (+) strand; PAM type: NRG; PAM sequence: CAG
aaagtacaatacctgcctta

SEQ ID NO: 112547 - DNA, 20 bp, Artificial Sequence
  Description of Artificial Sequence: Synthetic oligonucleotide
  Target: ATXN1; (+) strand; PAM type: NRG; PAM sequence: AGG
aagtacaatacctgccttac

SEQ ID NO: 112548 - DNA, 20 bp, Artificial Sequence
  Description of Artificial Sequence: Synthetic oligonucleotide
  Target: ATXN1; (+) strand; PAM type: NRG; PAM sequence: GGG
agtacaatacctgccttaca

SEQ ID NO: 112549 - DNA, 20 bp, Artificial Sequence
  Description of Artificial Sequence: Synthetic oligonucleotide
  Target: ATXN1; (+) strand; PAM type: NRG; PAM sequence: GAG
ctgccttacagggctgttgt

SEQ ID NO: 112550 - DNA, 20 bp, Artificial Sequence
  Description of Artificial Sequence: Synthetic oligonucleotide
  Target: ATXN1; (+) strand; PAM type: NRG; PAM sequence: AGG
tgccttacagggctgttgtg

SEQ ID NO: 112551 - DNA, 20 bp, Artificial Sequence
  Description of Artificial Sequence: Synthetic oligonucleotide
  Target: ATXN1; (+) strand; PAM type: NRG; PAM sequence: CAG
ggctgttgtgaggacctaat

SEQ ID NO: 112552 - DNA, 20 bp, Artificial Sequence
  Description of Artificial Sequence: Synthetic oligonucleotide
  Target: ATXN1; (+) strand; PAM type: NRG; PAM sequence: AAG
ctaatcagacaatgcatgaa

SEQ ID NO: 112553 - DNA, 20 bp, Artificial Sequence
  Description of Artificial Sequence: Synthetic oligonucleotide
  Target: ATXN1; (+) strand; PAM type: NRG; PAM sequence: AAG
gacaatgcatgaaaagtact

SEQ ID NO: 112554 - DNA, 20 bp, Artificial Sequence
  Description of Artificial Sequence: Synthetic oligonucleotide
  Target: ATXN1; (+) strand; PAM type: NRG; PAM sequence: TAG
tgcatgaaaagtactaagta

SEQ ID NO: 112555 - DNA, 20 bp, Artificial Sequence
  Description of Artificial Sequence: Synthetic oligonucleotide
  Target: ATXN1; (+) strand; PAM type: NRG; PAM sequence: TGG
aaagtactaagtatagtccc

SEQ ID NO: 112556 - DNA, 20 bp, Artificial Sequence
  Description of Artificial Sequence: Synthetic oligonucleotide
  Target: ATXN1; (+) strand; PAM type: NRG; PAM sequence: CAG
actaagtatagtccctggcc

SEQ ID NO: 112557 - DNA, 20 bp, Artificial Sequence
  Description of Artificial Sequence: Synthetic oligonucleotide
  Target: ATXN1; (+) strand; PAM type: NRG; PAM sequence: AAG
tatagtccctggcccagatt

SEQ ID NO: 112558 - DNA, 20 bp, Artificial Sequence
  Description of Artificial Sequence: Synthetic oligonucleotide
  Target: ATXN1; (+) strand; PAM type: NRG; PAM sequence: TAG
ttatataaacttttatttca

SEQ ID NO: 112559 - DNA, 20 bp, Artificial Sequence
  Description of Artificial Sequence: Synthetic oligonucleotide
  Target: ATXN1; (+) strand; PAM type: NRG; PAM sequence: AGG
tatataaacttttatttcat

SEQ ID NO: 112560 - DNA, 20 bp, Artificial Sequence
  Description of Artificial Sequence: Synthetic oligonucleotide
  Target: ATXN1; (+) strand; PAM type: NRG; PAM sequence: GGG
atataaacttttatttcata

SEQ ID NO: 112561 - DNA, 20 bp, Artificial Sequence
  Description of Artificial Sequence: Synthetic oligonucleotide
  Target: ATXN1; (+) strand; PAM type: NRG; PAM sequence: GAG
ataaacttttatttcatagg

SEQ ID NO: 112562 - DNA, 20 bp, Artificial Sequence
  Description of Artificial Sequence: Synthetic oligonucleotide
  Target: ATXN1; (+) strand; PAM type: NRG; PAM sequence: AAG
tcatagggagatgtttccta

SEQ ID NO: 112563 - DNA, 20 bp, Artificial Sequence
  Description of Artificial Sequence: Synthetic oligonucleotide
  Target: ATXN1; (+) strand; PAM type: NRG; PAM sequence: TAG
cccatcacattttcaccgct

SEQ ID NO: 112564 - DNA, 20 bp, Artificial Sequence
  Description of Artificial Sequence: Synthetic oligonucleotide
  Target: ATXN1; (+) strand; PAM type: NRG; PAM sequence: TGG
cattttcaccgcttagttca

SEQ ID NO: 112565 - DNA, 20 bp, Artificial Sequence
  Description of Artificial Sequence: Synthetic oligonucleotide
  Target: ATXN1; (+) strand; PAM type: NRG; PAM sequence: CAG
atctcttcctcactgtgtta

SEQ ID NO: 112566 - DNA, 20 bp, Artificial Sequence
  Description of Artificial Sequence: Synthetic oligonucleotide
  Target: ATXN1; (+) strand; PAM type: NRG; PAM sequence: GAG
ttcctcactgtgttacagcc

SEQ ID NO: 112567 - DNA, 20 bp, Artificial Sequence
  Description of Artificial Sequence: Synthetic oligonucleotide
  Target: ATXN1; (+) strand; PAM type: NRG; PAM sequence: TGG
tcactgtgttacagccgagc

SEQ ID NO: 112568 - DNA, 20 bp, Artificial Sequence
  Description of Artificial Sequence: Synthetic oligonucleotide
  Target: ATXN1; (+) strand; PAM type: NRG; PAM sequence: TGG
acagccgagctggtacacac

SEQ ID NO: 112569 - DNA, 20 bp, Artificial Sequence
  Description of Artificial Sequence: Synthetic oligonucleotide
  Target: ATXN1; (+) strand; PAM type: NRG; PAM sequence: TAG
ctggaattcctgaattcctc

SEQ ID NO: 112570 - DNA, 20 bp, Artificial Sequence
  Description of Artificial Sequence: Synthetic oligonucleotide
  Target: ATXN1; (+) strand; PAM type: NRG; PAM sequence: TAG
gaattcctgaattcctctag

SEQ ID NO: 112571 - DNA, 20 bp, Artificial Sequence
  Description of Artificial Sequence: Synthetic oligonucleotide
  Target: ATXN1; (+) strand; PAM type: NRG; PAM sequence: AGG
aattcctgaattcctctagt

SEQ ID NO: 112572 - DNA, 20 bp, Artificial Sequence
  Description of Artificial Sequence: Synthetic oligonucleotide
  Target: ATXN1; (+) strand; PAM type: NRG; PAM sequence: TAG
gaattcctctagtaggcctt

SEQ ID NO: 112573 - DNA, 20 bp, Artificial Sequence
  Description of Artificial Sequence: Synthetic oligonucleotide
  Target: ATXN1; (+) strand; PAM type: NRG; PAM sequence: AAG
gtaggcctttagtttccata

SEQ ID NO: 112574 - DNA, 20 bp, Artificial Sequence
  Description of Artificial Sequence: Synthetic oligonucleotide
  Target: ATXN1; (+) strand; PAM type: NRG; PAM sequence: CAG
ggcctttagtttccataaag

SEQ ID NO: 112575 - DNA, 20 bp, Artificial Sequence
  Description of Artificial Sequence: Synthetic oligonucleotide
  Target: ATXN1; (+) strand; PAM type: NRG; PAM sequence: CAG
accgtgtatcattgcatact

SEQ ID NO: 112576 - DNA, 20 bp, Artificial Sequence
  Description of Artificial Sequence: Synthetic oligonucleotide
  Target: ATXN1; (+) strand; PAM type: NRG; PAM sequence: TAG
gtgtatcattgcatactcag

SEQ ID NO: 112577 - DNA, 20 bp, Artificial Sequence
  Description of Artificial Sequence: Synthetic oligonucleotide
  Target: ATXN1; (+) strand; PAM type: NRG; PAM sequence: TGG
attgcatactcagtagaatg

SEQ ID NO: 112578 - DNA, 20 bp, Artificial Sequence
  Description of Artificial Sequence: Synthetic oligonucleotide
  Target: ATXN1; (+) strand; PAM type: NRG; PAM sequence: TGG
aatgtggcttttatcttgca

SEQ ID NO: 112579 - DNA, 20 bp, Artificial Sequence
  Description of Artificial Sequence: Synthetic oligonucleotide
  Target: ATXN1; (+) strand; PAM type: NRG; PAM sequence: TAG
ggcttttatcttgcatggtg

SEQ ID NO: 112580 - DNA, 20 bp, Artificial Sequence
  Description of Artificial Sequence: Synthetic oligonucleotide
  Target: ATXN1; (+) strand; PAM type: NRG; PAM sequence: AGG
gcttttatcttgcatggtgt

SEQ ID NO: 112581 - DNA, 20 bp, Artificial Sequence
  Description of Artificial Sequence: Synthetic oligonucleotide
  Target: ATXN1; (+) strand; PAM type: NRG; PAM sequence: AAG
gcatggtgtaggcttttaat

SEQ ID NO: 112582 - DNA, 20 bp, Artificial Sequence
  Description of Artificial Sequence: Synthetic oligonucleotide
  Target: ATXN1; (+) strand; PAM type: NRG; PAM sequence: TGG
tttaataagtatttattgaa

SEQ ID NO: 112583 - DNA, 20 bp, Artificial Sequence
  Description of Artificial Sequence: Synthetic oligonucleotide
  Target: ATXN1; (+) strand; PAM type: NRG; PAM sequence: AAG
atttattgaatggatacatg

SEQ ID NO: 112584 - DNA, 20 bp, Artificial Sequence
  Description of Artificial Sequence: Synthetic oligonucleotide
  Target: ATXN1; (+) strand; PAM type: NRG; PAM sequence: GAG
gaatggatacatgaagatat

SEQ ID NO: 112585 - DNA, 20 bp, Artificial Sequence
  Description of Artificial Sequence: Synthetic oligonucleotide
  Target: ATXN1; (+) strand; PAM type: NRG; PAM sequence: TGG
atgaagatatgagtgaataa

SEQ ID NO: 112586 - DNA, 20 bp, Artificial Sequence
  Description of Artificial Sequence: Synthetic oligonucleotide
  Target: ATXN1; (+) strand; PAM type: NRG; PAM sequence: TGG
gtgaataatggaataaatcc

SEQ ID NO: 112587 - DNA, 20 bp, Artificial Sequence
  Description of Artificial Sequence: Synthetic oligonucleotide
  Target: ATXN1; (+) strand; PAM type: NRG; PAM sequence: GGG
tgaataatggaataaatcct

SEQ ID NO: 112588 - DNA, 20 bp, Artificial Sequence
  Description of Artificial Sequence: Synthetic oligonucleotide
  Target: ATXN1; (+) strand; PAM type: NRG; PAM sequence: GGG
gaataatggaataaatcctg

SEQ ID NO: 112589 - DNA, 20 bp, Artificial Sequence
  Description of Artificial Sequence: Synthetic oligonucleotide
  Target: ATXN1; (+) strand; PAM type: NRG; PAM sequence: CAG
gaataaatcctggggctcaa

SEQ ID NO: 112590 - DNA, 20 bp, Artificial Sequence
  Description of Artificial Sequence: Synthetic oligonucleotide
  Target: ATXN1; (+) strand; PAM type: NRG; PAM sequence: AGG
aataaatcctggggctcaac

SEQ ID NO: 112591 - DNA, 20 bp, Artificial Sequence
  Description of Artificial Sequence: Synthetic oligonucleotide
  Target: ATXN1; (+) strand; PAM type: NRG; PAM sequence: AAG
atgttttgtcaacttcccct

SEQ ID NO: 112592 - DNA, 20 bp, Artificial Sequence
  Description of Artificial Sequence: Synthetic oligonucleotide
  Target: ATXN1; (+) strand; PAM type: NRG; PAM sequence: TAG
atattattttatttattttt

SEQ ID NO: 112593 - DNA, 20 bp, Artificial Sequence
  Description of Artificial Sequence: Synthetic oligonucleotide
  Target: ATXN1; (+) strand; PAM type: NRG; PAM sequence: GAG
attattttatttatttttta

SEQ ID NO: 112594 - DNA, 20 bp, Artificial Sequence
  Description of Artificial Sequence: Synthetic oligonucleotide
  Target: ATXN1; (+) strand; PAM type: NRG; PAM sequence: GAG
tttatttattttttagagat

SEQ ID NO: 112595 - DNA, 20 bp, Artificial Sequence
  Description of Artificial Sequence: Synthetic oligonucleotide
  Target: ATXN1; (+) strand; PAM type: NRG; PAM sequence: AGG
ttatttattttttagagatg

SEQ ID NO: 112596 - DNA, 20 bp, Artificial Sequence
  Description of Artificial Sequence: Synthetic oligonucleotide
  Target: ATXN1; (+) strand; PAM type: NRG; PAM sequence: GAG
tgaggttttgctctgttgcc

SEQ ID NO: 112597 - DNA, 20 bp, Artificial Sequence
  Description of Artificial Sequence: Synthetic oligonucleotide
  Target: ATXN1; (+) strand; PAM type: NRG; PAM sequence: AGG
gaggttttgctctgttgccg

SEQ ID NO: 112598 - DNA, 20 bp, Artificial Sequence
  Description of Artificial Sequence: Synthetic oligonucleotide
  Target: ATXN1; (+) strand; PAM type: NRG; PAM sequence: TGG
ttttgctctgttgccgaggc

SEQ ID NO: 112599 - DNA, 20 bp, Artificial Sequence
  Description of Artificial Sequence: Synthetic oligonucleotide
  Target: ATXN1; (+) strand; PAM type: NRG; PAM sequence: GAG
ttgctctgttgccgaggctg

SEQ ID NO: 112600 - DNA, 20 bp, Artificial Sequence
  Description of Artificial Sequence: Synthetic oligonucleotide
  Target: ATXN1; (+) strand; PAM type: NRG; PAM sequence: AGG
tgctctgttgccgaggctgg

SEQ ID NO: 112601 - DNA, 20 bp, Artificial Sequence
  Description of Artificial Sequence: Synthetic oligonucleotide
  Target: ATXN1; (+) strand; PAM type: NRG; PAM sequence: GGG
gctctgttgccgaggctgga

SEQ ID NO: 112602 - DNA, 20 bp, Artificial Sequence
  Description of Artificial Sequence: Synthetic oligonucleotide
  Target: ATXN1; (+) strand; PAM type: NRG; PAM sequence: CAG
ctgttgccgaggctggaggg

SEQ ID NO: 112603 - DNA, 20 bp, Artificial Sequence
  Description of Artificial Sequence: Synthetic oligonucleotide
  Target: ATXN1; (+) strand; PAM type: NRG; PAM sequence: TGG
ttgccgaggctggagggcag

SEQ ID NO: 112604 - DNA, 20 bp, Artificial Sequence
  Description of Artificial Sequence: Synthetic oligonucleotide
  Target: ATXN1; (+) strand; PAM type: NRG; PAM sequence: TAG
ggagggcagtggtgtaatca

SEQ ID NO: 112605 - DNA, 20 bp, Artificial Sequence
  Description of Artificial Sequence: Synthetic oligonucleotide
  Target: ATXN1; (+) strand; PAM type: NRG; PAM sequence: CAG
ggtgtaatcatagatcactg

SEQ ID NO: 112606 - DNA, 20 bp, Artificial Sequence
  Description of Artificial Sequence: Synthetic oligonucleotide
  Target: ATXN1; (+) strand; PAM type: NRG; PAM sequence: TGG
tcactgcagccttgaactgc

SEQ ID NO: 112607 - DNA, 20 bp, Artificial Sequence
  Description of Artificial Sequence: Synthetic oligonucleotide
  Target: ATXN1; (+) strand; PAM type: NRG; PAM sequence: GGG
cactgcagccttgaactgct

SEQ ID NO: 112608 - DNA, 20 bp, Artificial Sequence
  Description of Artificial Sequence: Synthetic oligonucleotide
  Target: ATXN1; (+) strand; PAM type: NRG; PAM sequence: AAG
agccttgaactgctgggctc

SEQ ID NO: 112609 - DNA, 20 bp, Artificial Sequence
  Description of Artificial Sequence: Synthetic oligonucleotide
  Target: ATXN1; (+) strand; PAM type: NRG; PAM sequence: CAG
ctcaagtgattctcccacct

SEQ ID NO: 112610 - DNA, 20 bp, Artificial Sequence
  Description of Artificial Sequence: Synthetic oligonucleotide
  Target: ATXN1; (+) strand; PAM type: NRG; PAM sequence: CAG
ttctcccacctcagcttccc

SEQ ID NO: 112611 - DNA, 20 bp, Artificial Sequence
  Description of Artificial Sequence: Synthetic oligonucleotide
  Target: ATXN1; (+) strand; PAM type: NRG; PAM sequence: TGG
acctcagcttccccagtacc

SEQ ID NO: 112612 - DNA, 20 bp, Artificial Sequence
  Description of Artificial Sequence: Synthetic oligonucleotide
  Target: ATXN1; (+) strand; PAM type: NRG; PAM sequence: GGG
cctcagcttccccagtacct

SEQ ID NO: 112613 - DNA, 20 bp, Artificial Sequence
  Description of Artificial Sequence: Synthetic oligonucleotide
  Target: ATXN1; (+) strand; PAM type: NRG; PAM sequence: CAG
ttccccagtacctgggacta

SEQ ID NO: 112614 - DNA, 20 bp, Artificial Sequence
  Description of Artificial Sequence: Synthetic oligonucleotide
  Target: ATXN1; (+) strand; PAM type: NRG; PAM sequence: AGG
tccccagtacctgggactac

SEQ ID NO: 112615 - DNA, 20 bp, Artificial Sequence
  Description of Artificial Sequence: Synthetic oligonucleotide
  Target: ATXN1; (+) strand; PAM type: NRG; PAM sequence: TAG
acaggtatgcatcaccatgc

SEQ ID NO: 112616 - DNA, 20 bp, Artificial Sequence
  Description of Artificial Sequence: Synthetic oligonucleotide
  Target: ATXN1; (+) strand; PAM type: NRG; PAM sequence: AGG
caggtatgcatcaccatgct

SEQ ID NO: 112617 - DNA, 20 bp, Artificial Sequence
  Description of Artificial Sequence: Synthetic oligonucleotide
  Target: ATXN1; (+) strand; PAM type: NRG; PAM sequence: GAG
ttaaaaaaaaattttctttt

SEQ ID NO: 112618 - DNA, 20 bp, Artificial Sequence
  Description of Artificial Sequence: Synthetic oligonucleotide
  Target: ATXN1; (+) strand; PAM type: NRG; PAM sequence: CAG
aaaaaaattttcttttgaga

SEQ ID NO: 112619 - DNA, 20 bp, Artificial Sequence
  Description of Artificial Sequence: Synthetic oligonucleotide
  Target: ATXN1; (+) strand; PAM type: NRG; PAM sequence: AGG
aaaaaattttcttttgagac

SEQ ID NO: 112620 - DNA, 20 bp, Artificial Sequence
  Description of Artificial Sequence: Synthetic oligonucleotide
  Target: ATXN1; (+) strand; PAM type: NRG; PAM sequence: GGG
aaaaattttcttttgagaca

SEQ ID NO: 112621 - DNA, 20 bp, Artificial Sequence
  Description of Artificial Sequence: Synthetic oligonucleotide
  Target: ATXN1; (+) strand; PAM type: NRG; PAM sequence: CAG
cagggtctcactatgttgcc

SEQ ID NO: 112622 - DNA, 20 bp, Artificial Sequence
  Description of Artificial Sequence: Synthetic oligonucleotide
  Target: ATXN1; (+) strand; PAM type: NRG; PAM sequence: AGG
agggtctcactatgttgccc

SEQ ID NO: 112623 - DNA, 20 bp, Artificial Sequence
  Description of Artificial Sequence: Synthetic oligonucleotide
  Target: ATXN1; (+) strand; PAM type: NRG; PAM sequence: TGG
tctcactatgttgcccaggc

SEQ ID NO: 112624 - DNA, 20 bp, Artificial Sequence
  Description of Artificial Sequence: Synthetic oligonucleotide
  Target: ATXN1; (+) strand; PAM type: NRG; PAM sequence: TAG
tggtctttaacttctgacct

SEQ ID NO: 112625 - DNA, 20 bp, Artificial Sequence
  Description of Artificial Sequence: Synthetic oligonucleotide
  Target: ATXN1; (+) strand; PAM type: NRG; PAM sequence: AGG
ggtctttaacttctgacctt

SEQ ID NO: 112626 - DNA, 20 bp, Artificial Sequence
  Description of Artificial Sequence: Synthetic oligonucleotide
  Target: ATXN1; (+) strand; PAM type: NRG; PAM sequence: CAG
cttaggcaatcctcctgcct

SEQ ID NO: 112627 - DNA, 20 bp, Artificial Sequence
  Description of Artificial Sequence: Synthetic oligonucleotide
  Target: ATXN1; (+) strand; PAM type: NRG; PAM sequence: AAG
tcctcctgcctcagcctccc

SEQ ID NO: 112628 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaagtcac

SEQ ID NO: 112629 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaagtcact

SEQ ID NO: 112630 - DNA, 20 bp, Artificial Sequence
  Description of Artificial Sequence: Synthetic oligonucleotide
  Target: ATXN1; (+) strand; PAM type: NRG; PAM sequence: CAG
ctcccaagtcactgggatta

SEQ ID NO: 112631 - DNA, 20 bp, Artificial Sequence
  Description of Artificial Sequence: Synthetic oligonucleotide
  Target: ATXN1; (+) strand; PAM type: NRG; PAM sequence: AGG
tcccaagtcactgggattac

SEQ ID NO: 112632 - DNA, 20 bp, Artificial Sequence
  Description of Artificial Sequence: Synthetic oligonucleotide
  Target: ATXN1; (+) strand; PAM type: NRG; PAM sequence: AAG
gtcactgggattacaggcgc

SEQ ID NO: 112633 - DNA, 20 bp, Artificial Sequence
  Description of Artificial Sequence: Synthetic oligonucleotide
  Target: ATXN1; (+) strand; PAM type: NRG; PAM sequence: AAG
caggcgcaagccaccacacc

SEQ ID NO: 112634 - DNA, 20 bp, Artificial Sequence
  Description of Artificial Sequence: Synthetic oligonucleotide
  Target: ATXN1; (+) strand; PAM type: NRG; PAM sequence: AAG
cccaatcaataataatttcc

SEQ ID NO: 112635 - DNA, 20 bp, Artificial Sequence
  Description of Artificial Sequence: Synthetic oligonucleotide
  Target: ATXN1; (+) strand; PAM type: NRG; PAM sequence: TGG
caataataatttccaagtta

SEQ ID NO: 112636 - DNA, 20 bp, Artificial Sequence
  Description of Artificial Sequence: Synthetic oligonucleotide
  Target: ATXN1; (+) strand; PAM type: NRG; PAM sequence: TGG
ttccaagttatggcttttaa

SEQ ID NO: 112637 - DNA, 20 bp, Artificial Sequence
  Description of Artificial Sequence: Synthetic oligonucleotide
  Target: ATXN1; (+) strand; PAM type: NRG; PAM sequence: AAG
aagttatggcttttaatgga

SEQ ID NO: 112638 - DNA, 20 bp, Artificial Sequence
  Description of Artificial Sequence: Synthetic oligonucleotide
  Target: ATXN1; (+) strand; PAM type: NRG; PAM sequence: CAG
ttatggcttttaatggaaag

SEQ ID NO: 112639 - DNA, 20 bp, Artificial Sequence
  Description of Artificial Sequence: Synthetic oligonucleotide
  Target: ATXN1; (+) strand; PAM type: NRG; PAM sequence: AAG
cttttaatggaaagcagaat

SEQ ID NO: 112640 - DNA, 20 bp, Artificial Sequence
  Description of Artificial Sequence: Synthetic oligonucleotide
  Target: ATXN1; (+) strand; PAM type: NRG; PAM sequence: AAG
taatggaaagcagaataaga

SEQ ID NO: 112641 - DNA, 20 bp, Artificial Sequence
  Description of Artificial Sequence: Synthetic oligonucleotide
  Target: ATXN1; (+) strand; PAM type: NRG; PAM sequence: AAG
ttcctgatgtctacttcatc

SEQ ID NO: 112642 - DNA, 20 bp, Artificial Sequence
  Description of Artificial Sequence: Synthetic oligonucleotide
  Target: ATXN1; (+) strand; PAM type: NRG; PAM sequence: TAG
ctgatgtctacttcatcaag

SEQ ID NO: 112643 - DNA, 20 bp, Artificial Sequence
  Description of Artificial Sequence: Synthetic oligonucleotide
  Target: ATXN1; (+) strand; PAM type: NRG; PAM sequence: GAG
gatgtctacttcatcaagta

SEQ ID NO: 112644 - DNA, 20 bp, Artificial Sequence
  Description of Artificial Sequence: Synthetic oligonucleotide
  Target: ATXN1; (+) strand; PAM type: NRG; PAM sequence: GAG
tgtctacttcatcaagtaga

SEQ ID NO: 112645 - DNA, 20 bp, Artificial Sequence
  Description of Artificial Sequence: Synthetic oligonucleotide
  Target: ATXN1; (+) strand; PAM type: NRG; PAM sequence: GAG
tctacttcatcaagtagaga

SEQ ID NO: 112646 - DNA, 20 bp, Artificial Sequence
  Description of Artificial Sequence: Synthetic oligonucleotide
  Target: ATXN1; (+) strand; PAM type: NRG; PAM sequence: AGG
ctacttcatcaagtagagag

SEQ ID NO: 112647 - DNA, 20 bp, Artificial Sequence
  Description of Artificial Sequence: Synthetic oligonucleotide
  Target: ATXN1; (+) strand; PAM type: NRG; PAM sequence: GGG
tacttcatcaagtagagaga

SEQ ID NO: 112648 - DNA, 20 bp, Artificial Sequence
  Description of Artificial Sequence: Synthetic oligonucleotide
  Target: ATXN1; (+) strand; PAM type: NRG; PAM sequence: GAG
cttcatcaagtagagagagg

SEQ ID NO: 112649 - DNA, 20 bp, Artificial Sequence
  Description of Artificial Sequence: Synthetic oligonucleotide
  Target: ATXN1; (+) strand; PAM type: NRG; PAM sequence: AAG
aagtagagagagggagttac

SEQ ID NO: 112650 - DNA, 20 bp, Artificial Sequence
  Description of Artificial Sequence: Synthetic oligonucleotide
  Target: ATXN1; (+) strand; PAM type: NRG; PAM sequence: GAG
tcttattttttttttttctt

SEQ ID NO: 112651 - DNA, 20 bp, Artificial Sequence
  Description of Artificial Sequence: Synthetic oligonucleotide
  Target: ATXN1; (+) strand; PAM type: NRG; PAM sequence: CGG
attttttttttttcttgaga

SEQ ID NO: 112652 - DNA, 20 bp, Artificial Sequence
  Description of Artificial Sequence: Synthetic oligonucleotide
  Target: ATXN1; (+) strand; PAM type: NRG; PAM sequence: GAG
tttttttttttcttgagacg

SEQ ID NO: 112653 - DNA, 20 bp, Artificial Sequence
  Description of Artificial Sequence: Synthetic oligonucleotide
  Target: ATXN1; (+) strand; PAM type: NRG; PAM sequence: CAG
cggagtcttgctctgtcacc

SEQ ID NO: 112654 - DNA, 20 bp, Artificial Sequence
  Description of Artificial Sequence: Synthetic oligonucleotide
  Target: ATXN1; (+) strand; PAM type: NRG; PAM sequence: AGG
ggagtcttgctctgtcaccc

SEQ ID NO: 112655 - DNA, 20 bp, Artificial Sequence
  Description of Artificial Sequence: Synthetic oligonucleotide
  Target: ATXN1; (+) strand; PAM type: NRG; PAM sequence: TGG
tcttgctctgtcacccaggc

SEQ ID NO: 112656 - DNA, 20 bp, Artificial Sequence
  Description of Artificial Sequence: Synthetic oligonucleotide
  Target: ATXN1; (+) strand; PAM type: NRG; PAM sequence: GAG
ttgctctgtcacccaggctg

SEQ ID NO: 112657 - DNA, 20 bp, Artificial Sequence
  Description of Artificial Sequence: Synthetic oligonucleotide
  Target: ATXN1; (+) strand; PAM type: NRG; PAM sequence: GAG
gctctgtcacccaggctgga

SEQ ID NO: 112658 - DNA, 20 bp, Artificial Sequence
  Description of Artificial Sequence: Synthetic oligonucleotide
  Target: ATXN1; (+) strand; PAM type: NRG; PAM sequence: CAG
ctgtcacccaggctggagag

SEQ ID NO: 112659 - DNA, 20 bp, Artificial Sequence
  Description of Artificial Sequence: Synthetic oligonucleotide
  Target: ATXN1; (+) strand; PAM type: NRG; PAM sequence: TGG
tcacccaggctggagagcag

SEQ ID NO: 112660 - DNA, 20 bp, Artificial Sequence
  Description of Artificial Sequence: Synthetic oligonucleotide
  Target: ATXN1; (+) strand; PAM type: NRG; PAM sequence: CGG
ggagagcagtggcacgatct

SEQ ID NO: 112661 - DNA, 20 bp, Artificial Sequence
  Description of Artificial Sequence: Synthetic oligonucleotide
  Target: ATXN1; (+) strand; PAM type: NRG; PAM sequence: AAG
gcacgatctcggctcactgc

SEQ ID NO: 112662 - DNA, 20 bp, Artificial Sequence
  Description of Artificial Sequence: Synthetic oligonucleotide
  Target: ATXN1; (+) strand; PAM type: NRG; PAM sequence: CAG
tcactgcaagctccgcctcc

SEQ ID NO: 112663 - DNA, 20 bp, Artificial Sequence
  Description of Artificial Sequence: Synthetic oligonucleotide
  Target: ATXN1; (+) strand; PAM type: NRG; PAM sequence: AGG
cactgcaagctccgcctccc

SEQ ID NO: 112664 - DNA, 20 bp, Artificial Sequence
  Description of Artificial Sequence: Synthetic oligonucleotide
  Target: ATXN1; (+) strand; PAM type: NRG; PAM sequence: AAG
aagctccgcctcccaggttc

SEQ ID NO: 112665 - DNA, 20 bp, Artificial Sequence
  Description of Artificial Sequence: Synthetic oligonucleotide
  Target: ATXN1; (+) strand; PAM type: NRG; PAM sequence: CAG
ttcaagcgattgtcctgcct

SEQ ID NO: 112666 - DNA, 20 bp, Artificial Sequence
  Description of Artificial Sequence: Synthetic oligonucleotide
  Target: ATXN1; (+) strand; PAM type: NRG; PAM sequence: GAG
ttgtcctgcctcagcctccc

SEQ ID NO: 112667 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcccgag

SEQ ID NO: 112668 - DNA, 20 bp, Artificial Sequence
  Description of Artificial Sequence: Synthetic oligonucleotide
  Target: ATXN1; (+) strand; PAM type: NRG; PAM sequence: TAG
gcctcagcctcccgagtagc

SEQ ID NO: 112669 - DNA, 20 bp, Artificial Sequence
  Description of Artificial Sequence: Synthetic oligonucleotide
  Target: ATXN1; (+) strand; PAM type: NRG; PAM sequence: AGG
cctcagcctcccgagtagct

SEQ ID NO: 112670 - DNA, 20 bp, Artificial Sequence
  Description of Artificial Sequence: Synthetic oligonucleotide
  Target: ATXN1; (+) strand; PAM type: NRG; PAM sequence: CAG
ctcccgagtagctaggacta

SEQ ID NO: 112671 - DNA, 20 bp, Artificial Sequence
  Description of Artificial Sequence: Synthetic oligonucleotide
  Target: ATXN1; (+) strand; PAM type: NRG; PAM sequence: AGG
tcccgagtagctaggactac

SEQ ID NO: 112672 - DNA, 20 bp, Artificial Sequence
  Description of Artificial Sequence: Synthetic oligonucleotide
  Target: ATXN1; (+) strand; PAM type: NRG; PAM sequence: TGG
caggcgcccaccaccatacc

SEQ ID NO: 112673 - DNA, 20 bp, Artificial Sequence
  Description of Artificial Sequence: Synthetic oligonucleotide
  Target: ATXN1; (+) strand; PAM type: NRG; PAM sequence: TAG
ctaattttttgtatatttac

SEQ ID NO: 112674 - DNA, 20 bp, Artificial Sequence
  Description of Artificial Sequence: Synthetic oligonucleotide
  Target: ATXN1; (+) strand; PAM type: NRG; PAM sequence: GAG
aattttttgtatatttacta

SEQ ID NO: 112675 - DNA, 20 bp, Artificial Sequence
  Description of Artificial Sequence: Synthetic oligonucleotide
  Target: ATXN1; (+) strand; PAM type: NRG; PAM sequence: CGG
ttttgtatatttactagaga

SEQ ID NO: 112676 - DNA, 20 bp, Artificial Sequence
  Description of Artificial Sequence: Synthetic oligonucleotide
  Target: ATXN1; (+) strand; PAM type: NRG; PAM sequence: GGG
tttgtatatttactagagac

SEQ ID NO: 112677 - DNA, 20 bp, Artificial Sequence
  Description of Artificial Sequence: Synthetic oligonucleotide
  Target: ATXN1; (+) strand; PAM type: NRG; PAM sequence: GGG
ttgtatatttactagagacg

SEQ ID NO: 112678 - DNA, 20 bp, Artificial Sequence
  Description of Artificial Sequence: Synthetic oligonucleotide
  Target: ATXN1; (+) strand; PAM type: NRG; PAM sequence: TAG
gagacggggtttcgccatat

SEQ ID NO: 112679 - DNA, 20 bp, Artificial Sequence
  Description of Artificial Sequence: Synthetic oligonucleotide
  Target: ATXN1; (+) strand; PAM type: NRG; PAM sequence: CAG
cggggtttcgccatattagc

SEQ ID NO: 112680 - DNA, 20 bp, Artificial Sequence
  Description of Artificial Sequence: Synthetic oligonucleotide
  Target: ATXN1; (+) strand; PAM type: NRG; PAM sequence: AGG
ggggtttcgccatattagcc

SEQ ID NO: 112681 - DNA, 20 bp, Artificial Sequence
  Description of Artificial Sequence: Synthetic oligonucleotide
  Target: ATXN1; (+) strand; PAM type: NRG; PAM sequence: TGG
tttcgccatattagccagga

SEQ ID NO: 112682 - DNA, 20 bp, Artificial Sequence
  Description of Artificial Sequence: Synthetic oligonucleotide
  Target: ATXN1; (+) strand; PAM type: NRG; PAM sequence: CGG
acctcgtgatccccctgcct

SEQ ID NO: 112683 - DNA, 20 bp, Artificial Sequence
  Description of Artificial Sequence: Synthetic oligonucleotide
  Target: ATXN1; (+) strand; PAM type: NRG; PAM sequence: AAG
ccccctgcctcggcctccca

SEQ ID NO: 112684 - DNA, 20 bp, Artificial Sequence
  Description of Artificial Sequence: Synthetic oligonucleotide
  Target: ATXN1; (+) strand; PAM type: NRG; PAM sequence: TGG
gcctcggcctcccaaagtgc

SEQ ID NO: 112685 - DNA, 20 bp, Artificial Sequence
  Description of Artificial Sequence: Synthetic oligonucleotide
  Target: ATXN1; (+) strand; PAM type: NRG; PAM sequence: GGG
cctcggcctcccaaagtgct

SEQ ID NO: 112686 - DNA, 20 bp, Artificial Sequence
  Description of Artificial Sequence: Synthetic oligonucleotide
  Target: ATXN1; (+) strand; PAM type: NRG; PAM sequence: TAG
ctcccaaagtgctgggacta

SEQ ID NO: 112687 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggactat

SEQ ID NO: 112688 - DNA, 20 bp, Artificial Sequence
  Description of Artificial Sequence: Synthetic oligonucleotide
  Target: ATXN1; (+) strand; PAM type: NRG; PAM sequence: GAG
agtgctgggactataggcgt

SEQ ID NO: 112689 - DNA, 20 bp, Artificial Sequence
  Description of Artificial Sequence: Synthetic oligonucleotide
  Target: ATXN1; (+) strand; PAM type: NRG; PAM sequence: TGG
taggcgtgagccaccacacg

SEQ ID NO: 112690 - DNA, 20 bp, Artificial Sequence
  Description of Artificial Sequence: Synthetic oligonucleotide
  Target: ATXN1; (+) strand; PAM type: NRG; PAM sequence: TGG
ggccacaactttttttttaa

SEQ ID NO: 112691 - DNA, 20 bp, Artificial Sequence
  Description of Artificial Sequence: Synthetic oligonucleotide
  Target: ATXN1; (+) strand; PAM type: NRG; PAM sequence: CAG
taatggcctaatctgtttct

SEQ ID NO: 112692 - DNA, 20 bp, Artificial Sequence
  Description of Artificial Sequence: Synthetic oligonucleotide
  Target: ATXN1; (+) strand; PAM type: NRG; PAM sequence: CAG
cgaacactgtatctcactcc

SEQ ID NO: 112693 - DNA, 20 bp, Artificial Sequence
  Description of Artificial Sequence: Synthetic oligonucleotide
  Target: ATXN1; (+) strand; PAM type: NRG; PAM sequence: AAG
actgatgccattcatgcttg

SEQ ID NO: 112694 - DNA, 20 bp, Artificial Sequence
  Description of Artificial Sequence: Synthetic oligonucleotide
  Target: ATXN1; (+) strand; PAM type: NRG; PAM sequence: AAG
gatgccattcatgcttgaag

SEQ ID NO: 112695 - DNA, 20 bp, Artificial Sequence
  Description of Artificial Sequence: Synthetic oligonucleotide
  Target: ATXN1; (+) strand; PAM type: NRG; PAM sequence: CAG
ttgaagaagaaatccatgac

SEQ ID NO: 112696 - DNA, 20 bp, Artificial Sequence
  Description of Artificial Sequence: Synthetic oligonucleotide
  Target: ATXN1; (+) strand; PAM type: NRG; PAM sequence: AGG
tgaagaagaaatccatgacc

SEQ ID NO: 112697 - DNA, 20 bp, Artificial Sequence
  Description of Artificial Sequence: Synthetic oligonucleotide
  Target: ATXN1; (+) strand; PAM type: NRG; PAM sequence: AAG
aaatccatgaccaggtacca

SEQ ID NO: 112698 - DNA, 20 bp, Artificial Sequence
  Description of Artificial Sequence: Synthetic oligonucleotide
  Target: ATXN1; (+) strand; PAM type: NRG; PAM sequence: AAG
tccatgaccaggtaccaaag

SEQ ID NO: 112699 - DNA, 20 bp, Artificial Sequence
  Description of Artificial Sequence: Synthetic oligonucleotide
  Target: ATXN1; (+) strand; PAM type: NRG; PAM sequence: AGG
ccatgaccaggtaccaaaga

SEQ ID NO: 112700 - DNA, 20 bp, Artificial Sequence
  Description of Artificial Sequence: Synthetic oligonucleotide
  Target: ATXN1; (+) strand; PAM type: NRG; PAM sequence: AAG
accaaagaaggctaaatata

SEQ ID NO: 112701 - DNA, 20 bp, Artificial Sequence
  Description of Artificial Sequence: Synthetic oligonucleotide
  Target: ATXN1; (+) strand; PAM type: NRG; PAM sequence: AGG
ccaaagaaggctaaatataa

SEQ ID NO: 112702 - DNA, 20 bp, Artificial Sequence
  Description of Artificial Sequence: Synthetic oligonucleotide
  Target: ATXN1; (+) strand; PAM type: NRG; PAM sequence: CAG
aagaaggctaaatataaagg

SEQ ID NO: 112703 - DNA, 20 bp, Artificial Sequence
  Description of Artificial Sequence: Synthetic oligonucleotide
  Target: ATXN1; (+) strand; PAM type: NRG; PAM sequence: TAG
ttttctacctgccactaccc

SEQ ID NO: 112704 - DNA, 20 bp, Artificial Sequence
  Description of Artificial Sequence: Synthetic oligonucleotide
  Target: ATXN1; (+) strand; PAM type: NRG; PAM sequence: AAG
actaccctagttcatcctcg

SEQ ID NO: 112705 - DNA, 20 bp, Artificial Sequence
  Description of Artificial Sequence: Synthetic oligonucleotide
  Target: ATXN1; (+) strand; PAM type: NRG; PAM sequence: TGG
ctagttcatcctcgaagatt

SEQ ID NO: 112706 - DNA, 20 bp, Artificial Sequence
  Description of Artificial Sequence: Synthetic oligonucleotide
  Target: ATXN1; (+) strand; PAM type: NRG; PAM sequence: AAG
tcctcgaagatttggttcaa

SEQ ID NO: 112707 - DNA, 20 bp, Artificial Sequence
  Description of Artificial Sequence: Synthetic oligonucleotide
  Target: ATXN1; (+) strand; PAM type: NRG; PAM sequence: TAG
cgaagatttggttcaaaagt

SEQ ID NO: 112708 - DNA, 20 bp, Artificial Sequence
  Description of Artificial Sequence: Synthetic oligonucleotide
  Target: ATXN1; (+) strand; PAM type: NRG; PAM sequence: AAG
gttcaaaagttagcctctca

SEQ ID NO: 112709 - DNA, 20 bp, Artificial Sequence
  Description of Artificial Sequence: Synthetic oligonucleotide
  Target: ATXN1; (+) strand; PAM type: NRG; PAM sequence: AGG
ttcaaaagttagcctctcaa

SEQ ID NO: 112710 - DNA, 20 bp, Artificial Sequence
  Description of Artificial Sequence: Synthetic oligonucleotide
  Target: ATXN1; (+) strand; PAM type: NRG; PAM sequence: CAG
tattattccaccctgaacct

SEQ ID NO: 112711 - DNA, 20 bp, Artificial Sequence
  Description of Artificial Sequence: Synthetic oligonucleotide
  Target: ATXN1; (+) strand; PAM type: NRG; PAM sequence: GAG
ttattccaccctgaacctca

SEQ ID NO: 112712 - DNA, 20 bp, Artificial Sequence
  Description of Artificial Sequence: Synthetic oligonucleotide
  Target: ATXN1; (+) strand; PAM type: NRG; PAM sequence: GAG
ccctgaacctcagagctctt

SEQ ID NO: 112713 - DNA, 20 bp, Artificial Sequence
  Description of Artificial Sequence: Synthetic oligonucleotide
  Target: ATXN1; (+) strand; PAM type: NRG; PAM sequence: AGG
cctgaacctcagagctcttg

SEQ ID NO: 112714 - DNA, 20 bp, Artificial Sequence
  Description of Artificial Sequence: Synthetic oligonucleotide
  Target: ATXN1; (+) strand; PAM type: NRG; PAM sequence: GAG
ctcttgaggttaaaaactat

SEQ ID NO: 112715 - DNA, 20 bp, Artificial Sequence
  Description of Artificial Sequence: Synthetic oligonucleotide
  Target: ATXN1; (+) strand; PAM type: NRG; PAM sequence: AAG
ttgaggttaaaaactatgag

SEQ ID NO: 112716 - DNA, 20 bp, Artificial Sequence
  Description of Artificial Sequence: Synthetic oligonucleotide
  Target: ATXN1; (+) strand; PAM type: NRG; PAM sequence: AGG
tgaggttaaaaactatgaga

SEQ ID NO: 112717 - DNA, 20 bp, Artificial Sequence
  Description of Artificial Sequence: Synthetic oligonucleotide
  Target: ATXN1; (+) strand; PAM type: NRG; PAM sequence: TGG
ttaaaaactatgagaaggaa

SEQ ID NO: 112718 - DNA, 20 bp, Artificial Sequence
  Description of Artificial Sequence: Synthetic oligonucleotide
  Target: ATXN1; (+) strand; PAM type: NRG; PAM sequence: GAG
aactatgagaaggaatggat

SEQ ID NO: 112719 - DNA, 20 bp, Artificial Sequence
  Description of Artificial Sequence: Synthetic oligonucleotide
  Target: ATXN1; (+) strand; PAM type: NRG; PAM sequence: AAG
gatgagtaaatcaacgaatg

SEQ ID NO: 112720 - DNA, 20 bp, Artificial Sequence
  Description of Artificial Sequence: Synthetic oligonucleotide
  Target: ATXN1; (+) strand; PAM type: NRG; PAM sequence: AGG
atgagtaaatcaacgaatga

SEQ ID NO: 112721 - DNA, 20 bp, Artificial Sequence
  Description of Artificial Sequence: Synthetic oligonucleotide
  Target: ATXN1; (+) strand; PAM type: NRG; PAM sequence: AAG
taaatcaacgaatgaaggta

SEQ ID NO: 112722 - DNA, 20 bp, Artificial Sequence
  Description of Artificial Sequence: Synthetic oligonucleotide
  Target: ATXN1; (+) strand; PAM type: NRG; PAM sequence: GAG
gaaggtaaagcatgttgttt

SEQ ID NO: 112723 - DNA, 20 bp, Artificial Sequence
  Description of Artificial Sequence: Synthetic oligonucleotide
  Target: ATXN1; (+) strand; PAM type: NRG; PAM sequence: CAG
gtaaagcatgttgtttgaga

SEQ ID NO: 112724 - DNA, 20 bp, Artificial Sequence
  Description of Artificial Sequence: Synthetic oligonucleotide
  Target: ATXN1; (+) strand; PAM type: NRG; PAM sequence: AGG
taaagcatgttgtttgagac

SEQ ID NO: 112725 - DNA, 20 bp, Artificial Sequence
  Description of Artificial Sequence: Synthetic oligonucleotide
  Target: ATXN1; (+) strand; PAM type: NRG; PAM sequence: GGG
aaagcatgttgtttgagaca

SEQ ID NO: 112726 - DNA, 20 bp, Artificial Sequence
  Description of Artificial Sequence: Synthetic oligonucleotide
  Target: ATXN1; (+) strand; PAM type: NRG; PAM sequence: TGG
gtttgagacagggtgattaa

SEQ ID NO: 112727 - DNA, 20 bp, Artificial Sequence
  Description of Artificial Sequence: Synthetic oligonucleotide
  Target: ATXN1; (+) strand; PAM type: NRG; PAM sequence: GGG
tttgagacagggtgattaat

SEQ ID NO: 112728 - DNA, 20 bp, Artificial Sequence
  Description of Artificial Sequence: Synthetic oligonucleotide
  Target: ATXN1; (+) strand; PAM type: NRG; PAM sequence: GAG
tgagacagggtgattaatgg

SEQ ID NO: 112729 - DNA, 20 bp, Artificial Sequence
  Description of Artificial Sequence: Synthetic oligonucleotide
  Target: ATXN1; (+) strand; PAM type: NRG; PAM sequence: TGG
cagggtgattaatgggagca

SEQ ID NO: 112730 - DNA, 20 bp, Artificial Sequence
  Description of Artificial Sequence: Synthetic oligonucleotide
  Target: ATXN1; (+) strand; PAM type: NRG; PAM sequence: TGG
ggagcatggtcccaacgctc

SEQ ID NO: 112731 - DNA, 20 bp, Artificial Sequence
  Description of Artificial Sequence: Synthetic oligonucleotide
  Target: ATXN1; (+) strand; PAM type: NRG; PAM sequence: TAG
atggtcccaacgctctggtg

SEQ ID NO: 112732 - DNA, 20 bp, Artificial Sequence
  Description of Artificial Sequence: Synthetic oligonucleotide
  Target: ATXN1; (+) strand; PAM type: NRG; PAM sequence: AAG
ccaacgctctggtgtagcaa

SEQ ID NO: 112733 - DNA, 20 bp, Artificial Sequence
  Description of Artificial Sequence: Synthetic oligonucleotide
  Target: ATXN1; (+) strand; PAM type: NRG; PAM sequence: GAG
ctctggtgtagcaaaagatt

SEQ ID NO: 112734 - DNA, 20 bp, Artificial Sequence
  Description of Artificial Sequence: Synthetic oligonucleotide
  Target: ATXN1; (+) strand; PAM type: NRG; PAM sequence: AAG
tggtgtagcaaaagattgag

SEQ ID NO: 112735 - DNA, 20 bp, Artificial Sequence
  Description of Artificial Sequence: Synthetic oligonucleotide
  Target: ATXN1; (+) strand; PAM type: NRG; PAM sequence: TAG
ttgagaagtgaacactgttg

SEQ ID NO: 112736 - DNA, 20 bp, Artificial Sequence
  Description of Artificial Sequence: Synthetic oligonucleotide
  Target: ATXN1; (+) strand; PAM type: NRG; PAM sequence: GAG
gagaagtgaacactgttgta

SEQ ID NO: 112737 - DNA, 20 bp, Artificial Sequence
  Description of Artificial Sequence: Synthetic oligonucleotide
  Target: ATXN1; (+) strand; PAM type: NRG; PAM sequence: AAG
cactgttgtagagctacgaa

SEQ ID NO: 112738 - DNA, 20 bp, Artificial Sequence
  Description of Artificial Sequence: Synthetic oligonucleotide
  Target: ATXN1; (+) strand; PAM type: NRG; PAM sequence: TGG
tagagctacgaaaagatatt

SEQ ID NO: 112739 - DNA, 20 bp, Artificial Sequence
  Description of Artificial Sequence: Synthetic oligonucleotide
  Target: ATXN1; (+) strand; PAM type: NRG; PAM sequence: TAG
aaaagatatttggcacataa

SEQ ID NO: 112740 - DNA, 20 bp, Artificial Sequence
  Description of Artificial Sequence: Synthetic oligonucleotide
  Target: ATXN1; (+) strand; PAM type: NRG; PAM sequence: AGG
aaagatatttggcacataat

SEQ ID NO: 112741 - DNA, 20 bp, Artificial Sequence
  Description of Artificial Sequence: Synthetic oligonucleotide
  Target: ATXN1; (+) strand; PAM type: NRG; PAM sequence: AAG
ttaaaatgctcattaaatga

SEQ ID NO: 112742 - DNA, 20 bp, Artificial Sequence
  Description of Artificial Sequence: Synthetic oligonucleotide
  Target: ATXN1; (+) strand; PAM type: NRG; PAM sequence: TAG
tcctactgaatgtttgtgtc

SEQ ID NO: 112743 - DNA, 20 bp, Artificial Sequence
  Description of Artificial Sequence: Synthetic oligonucleotide
  Target: ATXN1; (+) strand; PAM type: NRG; PAM sequence: AAG
tactgaatgtttgtgtctag

SEQ ID NO: 112744 - DNA, 20 bp, Artificial Sequence
  Description of Artificial Sequence: Synthetic oligonucleotide
  Target: ATXN1; (+) strand; PAM type: NRG; PAM sequence: AAG
tcaaactattcccattataa

SEQ ID NO: 112745 - DNA, 20 bp, Artificial Sequence
  Description of Artificial Sequence: Synthetic oligonucleotide
  Target: ATXN1; (+) strand; PAM type: NRG; PAM sequence: TAG
atattgttcctgtgtacaat

SEQ ID NO: 112746 - DNA, 20 bp, Artificial Sequence
  Description of Artificial Sequence: Synthetic oligonucleotide
  Target: ATXN1; (+) strand; PAM type: NRG; PAM sequence: TAG
gtacaattagtcccttcctc

SEQ ID NO: 112747 - DNA, 20 bp, Artificial Sequence
  Description of Artificial Sequence: Synthetic oligonucleotide
  Target: ATXN1; (+) strand; PAM type: NRG; PAM sequence: TGG
tcctctagactattaatccc

SEQ ID NO: 112748 - DNA, 20 bp, Artificial Sequence
  Description of Artificial Sequence: Synthetic oligonucleotide
  Target: ATXN1; (+) strand; PAM type: NRG; PAM sequence: TGG
gactattaatccctggctcc

SEQ ID NO: 112749 - DNA, 20 bp, Artificial Sequence
  Description of Artificial Sequence: Synthetic oligonucleotide
  Target: ATXN1; (+) strand; PAM type: NRG; PAM sequence: CAG
aaaaactccttgcatttgta

SEQ ID NO: 112750 - DNA, 20 bp, Artificial Sequence
  Description of Artificial Sequence: Synthetic oligonucleotide
  Target: ATXN1; (+) strand; PAM type: NRG; PAM sequence: TGG
tccttgcatttgtacagaaa

SEQ ID NO: 112751 - DNA, 20 bp, Artificial Sequence
  Description of Artificial Sequence: Synthetic oligonucleotide
  Target: ATXN1; (+) strand; PAM type: NRG; PAM sequence: CGG
catttgtacagaaatggaat

SEQ ID NO: 112752 - DNA, 20 bp, Artificial Sequence
  Description of Artificial Sequence: Synthetic oligonucleotide
  Target: ATXN1; (+) strand; PAM type: NRG; PAM sequence: TGG
acagaaatggaatcggtttt

SEQ ID NO: 112753 - DNA, 20 bp, Artificial Sequence
  Description of Artificial Sequence: Synthetic oligonucleotide
  Target: ATXN1; (+) strand; PAM type: NRG; PAM sequence: AAG
aatcggtttttggccacatt

SEQ ID NO: 112754 - DNA, 20 bp, Artificial Sequence
  Description of Artificial Sequence: Synthetic oligonucleotide
  Target: ATXN1; (+) strand; PAM type: NRG; PAM sequence: AAG
taagcgatacttctttcctt

SEQ ID NO: 112755 - DNA, 20 bp, Artificial Sequence
  Description of Artificial Sequence: Synthetic oligonucleotide
  Target: ATXN1; (+) strand; PAM type: NRG; PAM sequence: TGG
aagcacatcaactccctctg

SEQ ID NO: 112756 - DNA, 20 bp, Artificial Sequence
  Description of Artificial Sequence: Synthetic oligonucleotide
  Target: ATXN1; (+) strand; PAM type: NRG; PAM sequence: CAG
tcaactccctctgtggcttt

SEQ ID NO: 112757 - DNA, 20 bp, Artificial Sequence
  Description of Artificial Sequence: Synthetic oligonucleotide
  Target: ATXN1; (+) strand; PAM type: NRG; PAM sequence: AGG
caactccctctgtggctttc

SEQ ID NO: 112758 - DNA, 20 bp, Artificial Sequence
  Description of Artificial Sequence: Synthetic oligonucleotide
  Target: ATXN1; (+) strand; PAM type: NRG; PAM sequence: TAG
ctgtggctttcaggaatgct

SEQ ID NO: 112759 - DNA, 20 bp, Artificial Sequence
  Description of Artificial Sequence: Synthetic oligonucleotide
  Target: ATXN1; (+) strand; PAM type: NRG; PAM sequence: TGG
tttcaggaatgcttagcctt

SEQ ID NO: 112760 - DNA, 20 bp, Artificial Sequence
  Description of Artificial Sequence: Synthetic oligonucleotide
  Target: ATXN1; (+) strand; PAM type: NRG; PAM sequence: AAG
aatgcttagcctttggaata

SEQ ID NO: 112761 - DNA, 20 bp, Artificial Sequence
  Description of Artificial Sequence: Synthetic oligonucleotide
  Target: ATXN1; (+) strand; PAM type: NRG; PAM sequence: TAG
gcttagcctttggaataaag

SEQ ID NO: 112762 - DNA, 20 bp, Artificial Sequence
  Description of Artificial Sequence: Synthetic oligonucleotide
  Target: ATXN1; (+) strand; PAM type: NRG; PAM sequence: AAG
agcctttggaataaagtaga

SEQ ID NO: 112763 - DNA, 20 bp, Artificial Sequence
  Description of Artificial Sequence: Synthetic oligonucleotide
  Target: ATXN1; (+) strand; PAM type: NRG; PAM sequence: CAG
ttggaataaagtagaaagta

SEQ ID NO: 112764 - DNA, 20 bp, Artificial Sequence
  Description of Artificial Sequence: Synthetic oligonucleotide
  Target: ATXN1; (+) strand; PAM type: NRG; PAM sequence: TGG
tagaaagtacagaaatccac

SEQ ID NO: 112765 - DNA, 20 bp, Artificial Sequence
  Description of Artificial Sequence: Synthetic oligonucleotide
  Target: ATXN1; (+) strand; PAM type: NRG; PAM sequence: TGG
cagaaatccactggaataca

SEQ ID NO: 112766 - DNA, 20 bp, Artificial Sequence
  Description of Artificial Sequence: Synthetic oligonucleotide
  Target: ATXN1; (+) strand; PAM type: NRG; PAM sequence: TGG
atccactggaatacatggcc

SEQ ID NO: 112767 - DNA, 20 bp, Artificial Sequence
  Description of Artificial Sequence: Synthetic oligonucleotide
  Target: ATXN1; (+) strand; PAM type: NRG; PAM sequence: AAG
gcctggcacatgtcaaatca

SEQ ID NO: 112768 - DNA, 20 bp, Artificial Sequence
  Description of Artificial Sequence: Synthetic oligonucleotide
  Target: ATXN1; (+) strand; PAM type: NRG; PAM sequence: AAG
tggcacatgtcaaatcaaag

SEQ ID NO: 112769 - DNA, 20 bp, Artificial Sequence
  Description of Artificial Sequence: Synthetic oligonucleotide
  Target: ATXN1; (+) strand; PAM type: NRG; PAM sequence: AGG
ggcacatgtcaaatcaaaga

SEQ ID NO: 112770 - DNA, 20 bp, Artificial Sequence
  Description of Artificial Sequence: Synthetic oligonucleotide
  Target: ATXN1; (+) strand; PAM type: NRG; PAM sequence: TAG
atgtcaaatcaaagaaggaa

SEQ ID NO: 112771 - DNA, 20 bp, Artificial Sequence
  Description of Artificial Sequence: Synthetic oligonucleotide
  Target: ATXN1; (+) strand; PAM type: NRG; PAM sequence: GAG
gtcaaatcaaagaaggaata

SEQ ID NO: 112772 - DNA, 20 bp, Artificial Sequence
  Description of Artificial Sequence: Synthetic oligonucleotide
  Target: ATXN1; (+) strand; PAM type: NRG; PAM sequence: AAG
aaatcaaagaaggaatagag

SEQ ID NO: 112773 - DNA, 20 bp, Artificial Sequence
  Description of Artificial Sequence: Synthetic oligonucleotide
  Target: ATXN1; (+) strand; PAM type: NRG; PAM sequence: CAG
tcaaagaaggaatagagaag

SEQ ID NO: 112774 - DNA, 20 bp, Artificial Sequence
  Description of Artificial Sequence: Synthetic oligonucleotide
  Target: ATXN1; (+) strand; PAM type: NRG; PAM sequence: AGG
caaagaaggaatagagaagc

SEQ ID NO: 112775 - DNA, 20 bp, Artificial Sequence
  Description of Artificial Sequence: Synthetic oligonucleotide
  Target: ATXN1; (+) strand; PAM type: NRG; PAM sequence: GGG
aaagaaggaatagagaagca

SEQ ID NO: 112776 - DNA, 20 bp, Artificial Sequence
  Description of Artificial Sequence: Synthetic oligonucleotide
  Target: ATXN1; (+) strand; PAM type: NRG; PAM sequence: GAG
agaaggaatagagaagcagg

SEQ ID NO: 112777 - DNA, 20 bp, Artificial Sequence
  Description of Artificial Sequence: Synthetic oligonucleotide
  Target: ATXN1; (+) strand; PAM type: NRG; PAM sequence: GAG
gagaagcagggagcattcat

SEQ ID NO: 112778 - DNA, 20 bp, Artificial Sequence
  Description of Artificial Sequence: Synthetic oligonucleotide
  Target: ATXN1; (+) strand; PAM type: NRG; PAM sequence: CAG
gagcattcatgagatctgaa

SEQ ID NO: 112779 - DNA, 20 bp, Artificial Sequence
  Description of Artificial Sequence: Synthetic oligonucleotide
  Target: ATXN1; (+) strand; PAM type: NRG; PAM sequence: AAG
ttttattattattatacttt

SEQ ID NO: 112780 - DNA, 20 bp, Artificial Sequence
  Description of Artificial Sequence: Synthetic oligonucleotide
  Target: ATXN1; (+) strand; PAM type: NRG; PAM sequence: TAG
tattattatactttaagttt

SEQ ID NO: 112781 - DNA, 20 bp, Artificial Sequence
  Description of Artificial Sequence: Synthetic oligonucleotide
  Target: ATXN1; (+) strand; PAM type: NRG; PAM sequence: AGG
attattatactttaagtttt

SEQ ID NO: 112782 - DNA, 20 bp, Artificial Sequence
  Description of Artificial Sequence: Synthetic oligonucleotide
  Target: ATXN1; (+) strand; PAM type: NRG; PAM sequence: CAG
ggttacatgtgcacaatgtg

SEQ ID NO: 112783 - DNA, 20 bp, Artificial Sequence
  Description of Artificial Sequence: Synthetic oligonucleotide
  Target: ATXN1; (+) strand; PAM type: NRG; PAM sequence: AGG
gttacatgtgcacaatgtgc

SEQ ID NO: 112784 - DNA, 20 bp, Artificial Sequence
  Description of Artificial Sequence: Synthetic oligonucleotide
  Target: ATXN1; (+) strand; PAM type: NRG; PAM sequence: TAG
catgtgcacaatgtgcaggt

SEQ ID NO: 112785 - DNA, 20 bp, Artificial Sequence
  Description of Artificial Sequence: Synthetic oligonucleotide
  Target: ATXN1; (+) strand; PAM type: NRG; PAM sequence: TGG
tatgtatacatgtgccatgc

SEQ ID NO: 112786 - DNA, 20 bp, Artificial Sequence
  Description of Artificial Sequence: Synthetic oligonucleotide
  Target: ATXN1; (+) strand; PAM type: NRG; PAM sequence: TAG
gcacccattaactcgtcatt

SEQ ID NO: 112787 - DNA, 20 bp, Artificial Sequence
  Description of Artificial Sequence: Synthetic oligonucleotide
  Target: ATXN1; (+) strand; PAM type: NRG; PAM sequence: TAG
attaactcgtcatttagcat

SEQ ID NO: 112788 - DNA, 20 bp, Artificial Sequence
  Description of Artificial Sequence: Synthetic oligonucleotide
  Target: ATXN1; (+) strand; PAM type: NRG; PAM sequence: AGG
ttaactcgtcatttagcatt

SEQ ID NO: 112789 - DNA, 20 bp, Artificial Sequence
  Description of Artificial Sequence: Synthetic oligonucleotide
  Target: ATXN1; (+) strand; PAM type: NRG; PAM sequence: CAG
cccctccccccaccccacaa

SEQ ID NO: 112790 - DNA, 20 bp, Artificial Sequence
  Description of Artificial Sequence: Synthetic oligonucleotide
  Target: ATXN1; (+) strand; PAM type: NRG; PAM sequence: CAG
ccccaccccacaacagtccc

SEQ ID NO: 112791 - DNA, 20 bp, Artificial Sequence
  Description of Artificial Sequence: Synthetic oligonucleotide
  Target: ATXN1; (+) strand; PAM type: NRG; PAM sequence: GAG
ccaccccacaacagtcccca

SEQ ID NO: 112792 - DNA, 20 bp, Artificial Sequence
  Description of Artificial Sequence: Synthetic oligonucleotide
  Target: ATXN1; (+) strand; PAM type: NRG; PAM sequence: TAG
actcctaacgctaataattg

SEQ ID NO: 112793 - DNA, 20 bp, Artificial Sequence
  Description of Artificial Sequence: Synthetic oligonucleotide
  Target: ATXN1; (+) strand; PAM type: NRG; PAM sequence: AGG
ctcctaacgctaataattgt

SEQ ID NO: 112794 - DNA, 20 bp, Artificial Sequence
  Description of Artificial Sequence: Synthetic oligonucleotide
  Target: ATXN1; (+) strand; PAM type: NRG; PAM sequence: TGG
ctaataattgtaggtgttaa

SEQ ID NO: 112795 - DNA, 20 bp, Artificial Sequence
  Description of Artificial Sequence: Synthetic oligonucleotide
  Target: ATXN1; (+) strand; PAM type: NRG; PAM sequence: TAG
acatatttctatttgttcct

SEQ ID NO: 112796 - DNA, 20 bp, Artificial Sequence
  Description of Artificial Sequence: Synthetic oligonucleotide
  Target: ATXN1; (+) strand; PAM type: NRG; PAM sequence: AAG
ctatttgttccttagctttc

SEQ ID NO: 112797 - DNA, 20 bp, Artificial Sequence
  Description of Artificial Sequence: Synthetic oligonucleotide
  Target: ATXN1; (+) strand; PAM type: NRG; PAM sequence: TGG
caagcattcgcttgatgtca

SEQ ID NO: 112798 - DNA, 20 bp, Artificial Sequence
  Description of Artificial Sequence: Synthetic oligonucleotide
  Target: ATXN1; (+) strand; PAM type: NRG; PAM sequence: TGG
tgatgtcatggtctgaaatt

SEQ ID NO: 112799 - DNA, 20 bp, Artificial Sequence
  Description of Artificial Sequence: Synthetic oligonucleotide
  Target: ATXN1; (+) strand; PAM type: NRG; PAM sequence: AAG
tcatggtctgaaatttggcc

SEQ ID NO: 112800 - DNA, 20 bp, Artificial Sequence
  Description of Artificial Sequence: Synthetic oligonucleotide
  Target: ATXN1; (+) strand; PAM type: NRG; PAM sequence: AGG
catggtctgaaatttggcca

SEQ ID NO: 112801 - DNA, 20 bp, Artificial Sequence
  Description of Artificial Sequence: Synthetic oligonucleotide
  Target: ATXN1; (+) strand; PAM type: NRG; PAM sequence: CAG
ggccaaggtgttcctatttt

SEQ ID NO: 112802 - DNA, 20 bp, Artificial Sequence
  Description of Artificial Sequence: Synthetic oligonucleotide
  Target: ATXN1; (+) strand; PAM type: NRG; PAM sequence: AGG
gccaaggtgttcctattttc

SEQ ID NO: 112803 - DNA, 20 bp, Artificial Sequence
  Description of Artificial Sequence: Synthetic oligonucleotide
  Target: ATXN1; (+) strand; PAM type: NRG; PAM sequence: CAG
ttcaggcctcgatatgccca

SEQ ID NO: 112804 - DNA, 20 bp, Artificial Sequence
  Description of Artificial Sequence: Synthetic oligonucleotide
  Target: ATXN1; (+) strand; PAM type: NRG; PAM sequence: TGG
tatgcccacagatgcttccc

SEQ ID NO: 112805 - DNA, 20 bp, Artificial Sequence
  Description of Artificial Sequence: Synthetic oligonucleotide
  Target: ATXN1; (+) strand; PAM type: NRG; PAM sequence: TAG
gaaccaactcctccacttac

SEQ ID NO: 112806 - DNA, 20 bp, Artificial Sequence
  Description of Artificial Sequence: Synthetic oligonucleotide
  Target: ATXN1; (+) strand; PAM type: NRG; PAM sequence: AAG
ctagctgtgtgactttgtac

SEQ ID NO: 112807 - DNA, 20 bp, Artificial Sequence
  Description of Artificial Sequence: Synthetic oligonucleotide
  Target: ATXN1; (+) strand; PAM type: NRG; PAM sequence: AAG
ctgtgtgactttgtacaagt

SEQ ID NO: 112808 - DNA, 20 bp, Artificial Sequence
  Description of Artificial Sequence: Synthetic oligonucleotide
  Target: ATXN1; (+) strand; PAM type: NRG; PAM sequence: AGG
tgtgtgactttgtacaagta

SEQ ID NO: 112809 - DNA, 20 bp, Artificial Sequence
  Description of Artificial Sequence: Synthetic oligonucleotide
  Target: ATXN1; (+) strand; PAM type: NRG; PAM sequence: AAG
gtaaggtaaccacccaccct

SEQ ID NO: 112810 - DNA, 20 bp, Artificial Sequence
  Description of Artificial Sequence: Synthetic oligonucleotide
  Target: ATXN1; (+) strand; PAM type: NRG; PAM sequence: AAG
aatttccttttctgttgaat

SEQ ID NO: 112811 - DNA, 20 bp, Artificial Sequence
  Description of Artificial Sequence: Synthetic oligonucleotide
  Target: ATXN1; (+) strand; PAM type: NRG; PAM sequence: AGG
atttccttttctgttgaata

SEQ ID NO: 112812 - DNA, 20 bp, Artificial Sequence
  Description of Artificial Sequence: Synthetic oligonucleotide
  Target: ATXN1; (+) strand; PAM type: NRG; PAM sequence: GGG
tttccttttctgttgaataa

SEQ ID NO: 112813 - DNA, 20 bp, Artificial Sequence
  Description of Artificial Sequence: Synthetic oligonucleotide
  Target: ATXN1; (+) strand; PAM type: NRG; PAM sequence: TGG
ctgttgaataagggtaatga

SEQ ID NO: 112814 - DNA, 20 bp, Artificial Sequence
  Description of Artificial Sequence: Synthetic oligonucleotide
  Target: ATXN1; (+) strand; PAM type: NRG; PAM sequence: GAG
atatgtcttacaactgtcat

SEQ ID NO: 112815 - DNA, 20 bp, Artificial Sequence
  Description of Artificial Sequence: Synthetic oligonucleotide
  Target: ATXN1; (+) strand; PAM type: NRG; PAM sequence: GAG
tttgtattgttttcttcttt

SEQ ID NO: 112816 - DNA, 20 bp, Artificial Sequence
  Description of Artificial Sequence: Synthetic oligonucleotide
  Target: ATXN1; (+) strand; PAM type: NRG; PAM sequence: TGG
tattgttttcttctttgaga

SEQ ID NO: 112817 - DNA, 20 bp, Artificial Sequence
  Description of Artificial Sequence: Synthetic oligonucleotide
  Target: ATXN1; (+) strand; PAM type: NRG; PAM sequence: GGG
attgttttcttctttgagat

SEQ ID NO: 112818 - DNA, 20 bp, Artificial Sequence
  Description of Artificial Sequence: Synthetic oligonucleotide
  Target: ATXN1; (+) strand; PAM type: NRG; PAM sequence: TAG
tgggttcttgctatgttgcc

SEQ ID NO: 112819 - DNA, 20 bp, Artificial Sequence
  Description of Artificial Sequence: Synthetic oligonucleotide
  Target: ATXN1; (+) strand; PAM type: NRG; PAM sequence: AGG
gggttcttgctatgttgcct

SEQ ID NO: 112820 - DNA, 20 bp, Artificial Sequence
  Description of Artificial Sequence: Synthetic oligonucleotide
  Target: ATXN1; (+) strand; PAM type: NRG; PAM sequence: TAG
tcttgctatgttgcctaggc

SEQ ID NO: 112821 - DNA, 20 bp, Artificial Sequence
  Description of Artificial Sequence: Synthetic oligonucleotide
  Target: ATXN1; (+) strand; PAM type: NRG; PAM sequence: AGG
cttgctatgttgcctaggct

SEQ ID NO: 112822 - DNA, 20 bp, Artificial Sequence
  Description of Artificial Sequence: Synthetic oligonucleotide
  Target: ATXN1; (+) strand; PAM type: NRG; PAM sequence: TGG
cctaggctaggctcaaactc

SEQ ID NO: 112823 - DNA, 20 bp, Artificial Sequence
  Description of Artificial Sequence: Synthetic oligonucleotide
  Target: ATXN1; (+) strand; PAM type: NRG; PAM sequence: GGG
ctaggctaggctcaaactct

SEQ ID NO: 112824 - DNA, 20 bp, Artificial Sequence
  Description of Artificial Sequence: Synthetic oligonucleotide
  Target: ATXN1; (+) strand; PAM type: NRG; PAM sequence: GGG
taggctaggctcaaactctg

SEQ ID NO: 112825 - DNA, 20 bp, Artificial Sequence
  Description of Artificial Sequence: Synthetic oligonucleotide
  Target: ATXN1; (+) strand; PAM type: NRG; PAM sequence: AAG
aggctcaaactctggggctc

SEQ ID NO: 112826 - DNA, 20 bp, Artificial Sequence
  Description of Artificial Sequence: Synthetic oligonucleotide
  Target: ATXN1; (+) strand; PAM type: NRG; PAM sequence: CAG
ctcaagtgatcctcctgcct

SEQ ID NO: 112827 - DNA, 20 bp, Artificial Sequence
  Description of Artificial Sequence: Synthetic oligonucleotide
  Target: ATXN1; (+) strand; PAM type: NRG; PAM sequence: AAG
tcctcctgcctcagccaccc

SEQ ID NO: 112828 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagccacccaag

SEQ ID NO: 112829 - DNA, 20 bp, Artificial Sequence
  Description of Artificial Sequence: Synthetic oligonucleotide
  Target: ATXN1; (+) strand; PAM type: NRG; PAM sequence: TGG
gcctcagccacccaagtagc

SEQ ID NO: 112830 - DNA, 20 bp, Artificial Sequence
  Description of Artificial Sequence: Synthetic oligonucleotide
  Target: ATXN1; (+) strand; PAM type: NRG; PAM sequence: GGG
cctcagccacccaagtagct

SEQ ID NO: 112831 - DNA, 20 bp, Artificial Sequence
  Description of Artificial Sequence: Synthetic oligonucleotide
  Target: ATXN1; (+) strand; PAM type: NRG; PAM sequence: GAG
tcagccacccaagtagctgg

SEQ ID NO: 112832 - DNA, 20 bp, Artificial Sequence
  Description of Artificial Sequence: Synthetic oligonucleotide
  Target: ATXN1; (+) strand; PAM type: NRG; PAM sequence: CAG
cacccaagtagctgggagta

SEQ ID NO: 112833 - DNA, 20 bp, Artificial Sequence
  Description of Artificial Sequence: Synthetic oligonucleotide
  Target: ATXN1; (+) strand; PAM type: NRG; PAM sequence: AGG
acccaagtagctgggagtac

SEQ ID NO: 112834 - DNA, 20 bp, Artificial Sequence
  Description of Artificial Sequence: Synthetic oligonucleotide
  Target: ATXN1; (+) strand; PAM type: NRG; PAM sequence: TGG
caggtgcatgacactgcaca

SEQ ID NO: 112835 - DNA, 20 bp, Artificial Sequence
  Description of Artificial Sequence: Synthetic oligonucleotide
  Target: ATXN1; (+) strand; PAM type: NRG; PAM sequence: GAG
cactgcacatggcttcccat

SEQ ID NO: 112836 - DNA, 20 bp, Artificial Sequence
  Description of Artificial Sequence: Synthetic oligonucleotide
  Target: ATXN1; (+) strand; PAM type: NRG; PAM sequence: TAG
actgctgcatgtaaatattt

SEQ ID NO: 112837 - DNA, 20 bp, Artificial Sequence
  Description of Artificial Sequence: Synthetic oligonucleotide
  Target: ATXN1; (+) strand; PAM type: NRG; PAM sequence: CAG
tgcatgtaaatattttagca

SEQ ID NO: 112838 - DNA, 20 bp, Artificial Sequence
  Description of Artificial Sequence: Synthetic oligonucleotide
  Target: ATXN1; (+) strand; PAM type: NRG; PAM sequence: TGG
aaatattttagcacagtgct

SEQ ID NO: 112839 - DNA, 20 bp, Artificial Sequence
  Description of Artificial Sequence: Synthetic oligonucleotide
  Target: ATXN1; (+) strand; PAM type: NRG; PAM sequence: TAG
ccaatcattattataattaa

SEQ ID NO: 112840 - DNA, 20 bp, Artificial Sequence
  Description of Artificial Sequence: Synthetic oligonucleotide
  Target: ATXN1; (+) strand; PAM type: NRG; PAM sequence: TAG
agccaatcctattcttatga

SEQ ID NO: 112841 - DNA, 20 bp, Artificial Sequence
  Description of Artificial Sequence: Synthetic oligonucleotide
  Target: ATXN1; (+) strand; PAM type: NRG; PAM sequence: TGG
tcactgtctactcatttgcc

SEQ ID NO: 112842 - DNA, 20 bp, Artificial Sequence
  Description of Artificial Sequence: Synthetic oligonucleotide
  Target: ATXN1; (+) strand; PAM type: NRG; PAM sequence: GAG
aaatatttttataatatttt

SEQ ID NO: 112843 - DNA, 20 bp, Artificial Sequence
  Description of Artificial Sequence: Synthetic oligonucleotide
  Target: ATXN1; (+) strand; PAM type: NRG; PAM sequence: TGG
agtaatttaaaatgcccaaa

SEQ ID NO: 112844 - DNA, 20 bp, Artificial Sequence
  Description of Artificial Sequence: Synthetic oligonucleotide
  Target: ATXN1; (+) strand; PAM type: NRG; PAM sequence: TGG
gttttcttgtgatacaacca

SEQ ID NO: 112845 - DNA, 20 bp, Artificial Sequence
  Description of Artificial Sequence: Synthetic oligonucleotide
  Target: ATXN1; (+) strand; PAM type: NRG; PAM sequence: GAG
tttcttgtgatacaaccatg

SEQ ID NO: 112846 - DNA, 20 bp, Artificial Sequence
  Description of Artificial Sequence: Synthetic oligonucleotide
  Target: ATXN1; (+) strand; PAM type: NRG; PAM sequence: CAG
tacaaccatggagtactttc

SEQ ID NO: 112847 - DNA, 20 bp, Artificial Sequence
  Description of Artificial Sequence: Synthetic oligonucleotide
  Target: ATXN1; (+) strand; PAM type: NRG; PAM sequence: AGG
acaaccatggagtactttcc

SEQ ID NO: 112848 - DNA, 20 bp, Artificial Sequence
  Description of Artificial Sequence: Synthetic oligonucleotide
  Target: ATXN1; (+) strand; PAM type: NRG; PAM sequence: GGG
caaccatggagtactttcca

SEQ ID NO: 112849 - DNA, 20 bp, Artificial Sequence
  Description of Artificial Sequence: Synthetic oligonucleotide
  Target: ATXN1; (+) strand; PAM type: NRG; PAM sequence: TGG
ccatggagtactttccaggg

SEQ ID NO: 112850 - DNA, 20 bp, Artificial Sequence
  Description of Artificial Sequence: Synthetic oligonucleotide
  Target: ATXN1; (+) strand; PAM type: NRG; PAM sequence: GGG
catggagtactttccagggt

SEQ ID NO: 112851 - DNA, 20 bp, Artificial Sequence
  Description of Artificial Sequence: Synthetic oligonucleotide
  Target: ATXN1; (+) strand; PAM type: NRG; PAM sequence: TGG
agtactttccagggtgggta

SEQ ID NO: 112852 - DNA, 20 bp, Artificial Sequence
  Description of Artificial Sequence: Synthetic oligonucleotide
  Target: ATXN1; (+) strand; PAM type: NRG; PAM sequence: CAG
actttccagggtgggtatgg

SEQ ID NO: 112853 - DNA, 20 bp, Artificial Sequence
  Description of Artificial Sequence: Synthetic oligonucleotide
  Target: ATXN1; (+) strand; PAM type: NRG; PAM sequence: AAG
ggtgggtatggcagtgtgca

SEQ ID NO: 112854 - DNA, 20 bp, Artificial Sequence
  Description of Artificial Sequence: Synthetic oligonucleotide
  Target: ATXN1; (+) strand; PAM type: NRG; PAM sequence: AGG
gtgggtatggcagtgtgcaa

SEQ ID NO: 112855 - DNA, 20 bp, Artificial Sequence
  Description of Artificial Sequence: Synthetic oligonucleotide
  Target: ATXN1; (+) strand; PAM type: NRG; PAM sequence: AAG
tatggcagtgtgcaaaggaa

SEQ ID NO: 112856 - DNA, 20 bp, Artificial Sequence
  Description of Artificial Sequence: Synthetic oligonucleotide
  Target: ATXN1; (+) strand; PAM type: NRG; PAM sequence: AGG
atggcagtgtgcaaaggaaa

SEQ ID NO: 112857 - DNA, 20 bp, Artificial Sequence
  Description of Artificial Sequence: Synthetic oligonucleotide
  Target: ATXN1; (+) strand; PAM type: NRG; PAM sequence: TGG
agtgtgcaaaggaaaaggcc

SEQ ID NO: 112858 - DNA, 20 bp, Artificial Sequence
  Description of Artificial Sequence: Synthetic oligonucleotide
  Target: ATXN1; (+) strand; PAM type: NRG; PAM sequence: TGG
caaaggaaaaggcctggccc

SEQ ID NO: 112859 - DNA, 20 bp, Artificial Sequence
  Description of Artificial Sequence: Synthetic oligonucleotide
  Target: ATXN1; (+) strand; PAM type: NRG; PAM sequence: GGG
aaaggaaaaggcctggccct

SEQ ID NO: 112860 - DNA, 20 bp, Artificial Sequence
  Description of Artificial Sequence: Synthetic oligonucleotide
  Target: ATXN1; (+) strand; PAM type: NRG; PAM sequence: CAG
ggaaaaggcctggccctggg

SEQ ID NO: 112861 - DNA, 20 bp, Artificial Sequence
  Description of Artificial Sequence: Synthetic oligonucleotide
  Target: ATXN1; (+) strand; PAM type: NRG; PAM sequence: CAG
gccctgggcagtgctatttt

SEQ ID NO: 112862 - DNA, 20 bp, Artificial Sequence
  Description of Artificial Sequence: Synthetic oligonucleotide
  Target: ATXN1; (+) strand; PAM type: NRG; PAM sequence: GAG
cctgggcagtgctattttca

SEQ ID NO: 112863 - DNA, 20 bp, Artificial Sequence
  Description of Artificial Sequence: Synthetic oligonucleotide
  Target: ATXN1; (+) strand; PAM type: NRG; PAM sequence: GAG
gtgctattttcagagtgtgt

SEQ ID NO: 112864 - DNA, 20 bp, Artificial Sequence
  Description of Artificial Sequence: Synthetic oligonucleotide
  Target: ATXN1; (+) strand; PAM type: NRG; PAM sequence: AGG
tgctattttcagagtgtgtg

SEQ ID NO: 112865 - DNA, 20 bp, Artificial Sequence
  Description of Artificial Sequence: Synthetic oligonucleotide
  Target: ATXN1; (+) strand; PAM type: NRG; PAM sequence: GGG
gctattttcagagtgtgtga

SEQ ID NO: 112866 - DNA, 20 bp, Artificial Sequence
  Description of Artificial Sequence: Synthetic oligonucleotide
  Target: ATXN1; (+) strand; PAM type: NRG; PAM sequence: CAG
ttttcagagtgtgtgagggc

SEQ ID NO: 112867 - DNA, 20 bp, Artificial Sequence
  Description of Artificial Sequence: Synthetic oligonucleotide
  Target: ATXN1; (+) strand; PAM type: NRG; PAM sequence: AGG
tttcagagtgtgtgagggcc

SEQ ID NO: 112868 - DNA, 20 bp, Artificial Sequence
  Description of Artificial Sequence: Synthetic oligonucleotide
  Target: ATXN1; (+) strand; PAM type: NRG; PAM sequence: AAG
acatcccatatttccctttg

SEQ ID NO: 112869 - DNA, 20 bp, Artificial Sequence
  Description of Artificial Sequence: Synthetic oligonucleotide
  Target: ATXN1; (+) strand; PAM type: NRG; PAM sequence: CAG
atatttccctttgaagaaat

SEQ ID NO: 112870 - DNA, 20 bp, Artificial Sequence
  Description of Artificial Sequence: Synthetic oligonucleotide
  Target: ATXN1; (+) strand; PAM type: NRG; PAM sequence: AAG
aagaaatcagccaacgtaac

SEQ ID NO: 112871 - DNA, 20 bp, Artificial Sequence
  Description of Artificial Sequence: Synthetic oligonucleotide
  Target: ATXN1; (+) strand; PAM type: NRG; PAM sequence: AAG
atcagccaacgtaacaagca

SEQ ID NO: 112872 - DNA, 20 bp, Artificial Sequence
  Description of Artificial Sequence: Synthetic oligonucleotide
  Target: ATXN1; (+) strand; PAM type: NRG; PAM sequence: AGG
tcagccaacgtaacaagcaa

SEQ ID NO: 112873 - DNA, 20 bp, Artificial Sequence
  Description of Artificial Sequence: Synthetic oligonucleotide
  Target: ATXN1; (+) strand; PAM type: NRG; PAM sequence: CAG
aacgtaacaagcaaaggtgc

SEQ ID NO: 112874 - DNA, 20 bp, Artificial Sequence
  Description of Artificial Sequence: Synthetic oligonucleotide
  Target: ATXN1; (+) strand; PAM type: NRG; PAM sequence: AGG
acgtaacaagcaaaggtgcc

SEQ ID NO: 112875 - DNA, 20 bp, Artificial Sequence
  Description of Artificial Sequence: Synthetic oligonucleotide
  Target: ATXN1; (+) strand; PAM type: NRG; PAM sequence: GGG
cgtaacaagcaaaggtgcca

SEQ ID NO: 112876 - DNA, 20 bp, Artificial Sequence
  Description of Artificial Sequence: Synthetic oligonucleotide
  Target: ATXN1; (+) strand; PAM type: NRG; PAM sequence: GAG
taacaagcaaaggtgccagg

SEQ ID NO: 112877 - DNA, 20 bp, Artificial Sequence
  Description of Artificial Sequence: Synthetic oligonucleotide
  Target: ATXN1; (+) strand; PAM type: NRG; PAM sequence: AGG
aacaagcaaaggtgccaggg

SEQ ID NO: 112878 - DNA, 20 bp, Artificial Sequence
  Description of Artificial Sequence: Synthetic oligonucleotide
  Target: ATXN1; (+) strand; PAM type: NRG; PAM sequence: GAG
aaaggtgccagggaggcctt

SEQ ID NO: 112879 - DNA, 20 bp, Artificial Sequence
  Description of Artificial Sequence: Synthetic oligonucleotide
  Target: ATXN1; (+) strand; PAM type: NRG; PAM sequence: AGG
aaggtgccagggaggccttg

SEQ ID NO: 112880 - DNA, 20 bp, Artificial Sequence
  Description of Artificial Sequence: Synthetic oligonucleotide
  Target: ATXN1; (+) strand; PAM type: NRG; PAM sequence: GGG
aggtgccagggaggccttga

SEQ ID NO: 112881 - DNA, 20 bp, Artificial Sequence
  Description of Artificial Sequence: Synthetic oligonucleotide
  Target: ATXN1; (+) strand; PAM type: NRG; PAM sequence: CAG
cagggaggccttgagggtac

SEQ ID NO: 112882 - DNA, 20 bp, Artificial Sequence
  Description of Artificial Sequence: Synthetic oligonucleotide
  Target: ATXN1; (+) strand; PAM type: NRG; PAM sequence: CAG
gccttgagggtaccagtgta

SEQ ID NO: 112883 - DNA, 20 bp, Artificial Sequence
  Description of Artificial Sequence: Synthetic oligonucleotide
  Target: ATXN1; (+) strand; PAM type: NRG; PAM sequence: AGG
ccttgagggtaccagtgtac

SEQ ID NO: 112884 - DNA, 20 bp, Artificial Sequence
  Description of Artificial Sequence: Synthetic oligonucleotide
  Target: ATXN1; (+) strand; PAM type: NRG; PAM sequence: GGG
cttgagggtaccagtgtaca

SEQ ID NO: 112885 - DNA, 20 bp, Artificial Sequence
  Description of Artificial Sequence: Synthetic oligonucleotide
  Target: ATXN1; (+) strand; PAM type: NRG; PAM sequence: GGG
ttgagggtaccagtgtacag

SEQ ID NO: 112886 - DNA, 20 bp, Artificial Sequence
  Description of Artificial Sequence: Synthetic oligonucleotide
  Target: ATXN1; (+) strand; PAM type: NRG; PAM sequence: GAG
cactgctacatgtgcatgct

SEQ ID NO: 112887 - DNA, 20 bp, Artificial Sequence
  Description of Artificial Sequence: Synthetic oligonucleotide
  Target: ATXN1; (+) strand; PAM type: NRG; PAM sequence: TGG
tgctacatgtgcatgctgag

SEQ ID NO: 112888 - DNA, 20 bp, Artificial Sequence
  Description of Artificial Sequence: Synthetic oligonucleotide
  Target: ATXN1; (+) strand; PAM type: NRG; PAM sequence: CGG
gtgcatgctgagtggctgcc

SEQ ID NO: 112889 - DNA, 20 bp, Artificial Sequence
  Description of Artificial Sequence: Synthetic oligonucleotide
  Target: ATXN1; (+) strand; PAM type: NRG; PAM sequence: GGG
tgcatgctgagtggctgccc

SEQ ID NO: 112890 - DNA, 20 bp, Artificial Sequence
  Description of Artificial Sequence: Synthetic oligonucleotide
  Target: ATXN1; (+) strand; PAM type: NRG; PAM sequence: TAG
ccgggtctgcctttgtgtac

SEQ ID NO: 112891 - DNA, 20 bp, Artificial Sequence
  Description of Artificial Sequence: Synthetic oligonucleotide
  Target: ATXN1; (+) strand; PAM type: NRG; PAM sequence: AGG
cgggtctgcctttgtgtact

SEQ ID NO: 112892 - DNA, 20 bp, Artificial Sequence
  Description of Artificial Sequence: Synthetic oligonucleotide
  Target: ATXN1; (+) strand; PAM type: NRG; PAM sequence: GGG
gggtctgcctttgtgtacta

SEQ ID NO: 112893 - DNA, 20 bp, Artificial Sequence
  Description of Artificial Sequence: Synthetic oligonucleotide
  Target: ATXN1; (+) strand; PAM type: NRG; PAM sequence: GGG
ggtctgcctttgtgtactag

SEQ ID NO: 112894 - DNA, 20 bp, Artificial Sequence
  Description of Artificial Sequence: Synthetic oligonucleotide
  Target: ATXN1; (+) strand; PAM type: NRG; PAM sequence: TGG
ttgtgtactaggggaatgtg

SEQ ID NO: 112895 - DNA, 20 bp, Artificial Sequence
  Description of Artificial Sequence: Synthetic oligonucleotide
  Target: ATXN1; (+) strand; PAM type: NRG; PAM sequence: GAG
gtactaggggaatgtgtggt

SEQ ID NO: 112896 - DNA, 20 bp, Artificial Sequence
  Description of Artificial Sequence: Synthetic oligonucleotide
  Target: ATXN1; (+) strand; PAM type: NRG; PAM sequence: AGG
tactaggggaatgtgtggtg

SEQ ID NO: 112897 - DNA, 20 bp, Artificial Sequence
  Description of Artificial Sequence: Synthetic oligonucleotide
  Target: ATXN1; (+) strand; PAM type: NRG; PAM sequence: TGG
aggggaatgtgtggtgaggc

SEQ ID NO: 112898 - DNA, 20 bp, Artificial Sequence
  Description of Artificial Sequence: Synthetic oligonucleotide
  Target: ATXN1; (+) strand; PAM type: NRG; PAM sequence: GAG
gggaatgtgtggtgaggctg

SEQ ID NO: 112899 - DNA, 20 bp, Artificial Sequence
  Description of Artificial Sequence: Synthetic oligonucleotide
  Target: ATXN1; (+) strand; PAM type: NRG; PAM sequence: AGG
ggaatgtgtggtgaggctgg

SEQ ID NO: 112900 - DNA, 20 bp, Artificial Sequence
  Description of Artificial Sequence: Synthetic oligonucleotide
  Target: ATXN1; (+) strand; PAM type: NRG; PAM sequence: GGG
gaatgtgtggtgaggctgga

SEQ ID NO: 112901 - DNA, 20 bp, Artificial Sequence
  Description of Artificial Sequence: Synthetic oligonucleotide
  Target: ATXN1; (+) strand; PAM type: NRG; PAM sequence: GGG
aatgtgtggtgaggctggag

SEQ ID NO: 112902 - DNA, 20 bp, Artificial Sequence
  Description of Artificial Sequence: Synthetic oligonucleotide
  Target: ATXN1; (+) strand; PAM type: NRG; PAM sequence: CAG
tgtggtgaggctggagggga

SEQ ID NO: 112903 - DNA, 20 bp, Artificial Sequence
  Description of Artificial Sequence: Synthetic oligonucleotide
  Target: ATXN1; (+) strand; PAM type: NRG; PAM sequence: GAG
tggtgaggctggaggggaca

SEQ ID NO: 112904 - DNA, 20 bp, Artificial Sequence
  Description of Artificial Sequence: Synthetic oligonucleotide
  Target: ATXN1; (+) strand; PAM type: NRG; PAM sequence: TGG
gaggctggaggggacagagc

SEQ ID NO: 112905 - DNA, 20 bp, Artificial Sequence
  Description of Artificial Sequence: Synthetic oligonucleotide
  Target: ATXN1; (+) strand; PAM type: NRG; PAM sequence: GAG
ggacagagctggccacctgt

SEQ ID NO: 112906 - DNA, 20 bp, Artificial Sequence
  Description of Artificial Sequence: Synthetic oligonucleotide
  Target: ATXN1; (+) strand; PAM type: NRG; PAM sequence: AAG
cagagctggccacctgtgag

SEQ ID NO: 112907 - DNA, 20 bp, Artificial Sequence
  Description of Artificial Sequence: Synthetic oligonucleotide
  Target: ATXN1; (+) strand; PAM type: NRG; PAM sequence: AGG
agagctggccacctgtgaga

SEQ ID NO: 112908 - DNA, 20 bp, Artificial Sequence
  Description of Artificial Sequence: Synthetic oligonucleotide
  Target: ATXN1; (+) strand; PAM type: NRG; PAM sequence: CAG
ccacctgtgagaaggactct

SEQ ID NO: 112909 - DNA, 20 bp, Artificial Sequence
  Description of Artificial Sequence: Synthetic oligonucleotide
  Target: ATXN1; (+) strand; PAM type: NRG; PAM sequence: AGG
cacctgtgagaaggactctc

SEQ ID NO: 112910 - DNA, 20 bp, Artificial Sequence
  Description of Artificial Sequence: Synthetic oligonucleotide
  Target: ATXN1; (+) strand; PAM type: NRG; PAM sequence: GGG
acctgtgagaaggactctca

SEQ ID NO: 112911 - DNA, 20 bp, Artificial Sequence
  Description of Artificial Sequence: Synthetic oligonucleotide
  Target: ATXN1; (+) strand; PAM type: NRG; PAM sequence: TGG
tcagggctgctgtcatcatt

SEQ ID NO: 112912 - DNA, 20 bp, Artificial Sequence
  Description of Artificial Sequence: Synthetic oligonucleotide
  Target: ATXN1; (+) strand; PAM type: NRG; PAM sequence: CAG
gggctgctgtcatcatttgg

SEQ ID NO: 112913 - DNA, 20 bp, Artificial Sequence
  Description of Artificial Sequence: Synthetic oligonucleotide
  Target: ATXN1; (+) strand; PAM type: NRG; PAM sequence: GAG
gctgctgtcatcatttggca

SEQ ID NO: 112914 - DNA, 20 bp, Artificial Sequence
  Description of Artificial Sequence: Synthetic oligonucleotide
  Target: ATXN1; (+) strand; PAM type: NRG; PAM sequence: CAG
ctccaacccaacctcactct

SEQ ID NO: 112915 - DNA, 20 bp, Artificial Sequence
  Description of Artificial Sequence: Synthetic oligonucleotide
  Target: ATXN1; (+) strand; PAM type: NRG; PAM sequence: AGG
tccaacccaacctcactctc

SEQ ID NO: 112916 - DNA, 20 bp, Artificial Sequence
  Description of Artificial Sequence: Synthetic oligonucleotide
  Target: ATXN1; (+) strand; PAM type: NRG; PAM sequence: GGG
ccaacccaacctcactctca

SEQ ID NO: 112917 - DNA, 20 bp, Artificial Sequence
  Description of Artificial Sequence: Synthetic oligonucleotide
  Target: ATXN1; (+) strand; PAM type: NRG; PAM sequence: GAG
aacccaacctcactctcagg

SEQ ID NO: 112918 - DNA, 20 bp, Artificial Sequence
  Description of Artificial Sequence: Synthetic oligonucleotide
  Target: ATXN1; (+) strand; PAM type: NRG; PAM sequence: AGG
acccaacctcactctcaggg

SEQ ID NO: 112919 - DNA, 20 bp, Artificial Sequence
  Description of Artificial Sequence: Synthetic oligonucleotide
  Target: ATXN1; (+) strand; PAM type: NRG; PAM sequence: GGG
cccaacctcactctcaggga

SEQ ID NO: 112920 - DNA, 20 bp, Artificial Sequence
  Description of Artificial Sequence: Synthetic oligonucleotide
  Target: ATXN1; (+) strand; PAM type: NRG; PAM sequence: GGG
ccaacctcactctcagggag

SEQ ID NO: 112921 - DNA, 20 bp, Artificial Sequence
  Description of Artificial Sequence: Synthetic oligonucleotide
  Target: ATXN1; (+) strand; PAM type: NRG; PAM sequence: CGG
cctcactctcagggagggga

SEQ ID NO: 112922 - DNA, 20 bp, Artificial Sequence
  Description of Artificial Sequence: Synthetic oligonucleotide
  Target: ATXN1; (+) strand; PAM type: NRG; PAM sequence: GAG
ctctcagggaggggacggat

SEQ ID NO: 112923 - DNA, 20 bp, Artificial Sequence
  Description of Artificial Sequence: Synthetic oligonucleotide
  Target: ATXN1; (+) strand; PAM type: NRG; PAM sequence: AGG
tctcagggaggggacggatg

SEQ ID NO: 112924 - DNA, 20 bp, Artificial Sequence
  Description of Artificial Sequence: Synthetic oligonucleotide
  Target: ATXN1; (+) strand; PAM type: NRG; PAM sequence: CAG
accgctcatcctatcatcta

SEQ ID NO: 112925 - DNA, 20 bp, Artificial Sequence
  Description of Artificial Sequence: Synthetic oligonucleotide
  Target: ATXN1; (+) strand; PAM type: NRG; PAM sequence: AGG
ccgctcatcctatcatctac

SEQ ID NO: 112926 - DNA, 20 bp, Artificial Sequence
  Description of Artificial Sequence: Synthetic oligonucleotide
  Target: ATXN1; (+) strand; PAM type: NRG; PAM sequence: GGG
cgctcatcctatcatctaca

SEQ ID NO: 112927 - DNA, 20 bp, Artificial Sequence
  Description of Artificial Sequence: Synthetic oligonucleotide
  Target: ATXN1; (+) strand; PAM type: NRG; PAM sequence: AAG
tatcatctacagggttttta

SEQ ID NO: 112928 - DNA, 20 bp, Artificial Sequence
  Description of Artificial Sequence: Synthetic oligonucleotide
  Target: ATXN1; (+) strand; PAM type: NRG; PAM sequence: TGG
tctacagggtttttaaagtg

SEQ ID NO: 112929 - DNA, 20 bp, Artificial Sequence
  Description of Artificial Sequence: Synthetic oligonucleotide
  Target: ATXN1; (+) strand; PAM type: NRG; PAM sequence: GGG
ctacagggtttttaaagtgt

SEQ ID NO: 112930 - DNA, 20 bp, Artificial Sequence
  Description of Artificial Sequence: Synthetic oligonucleotide
  Target: ATXN1; (+) strand; PAM type: NRG; PAM sequence: TGG
aagtgtgggtcctcattctc

SEQ ID NO: 112931 - DNA, 20 bp, Artificial Sequence
  Description of Artificial Sequence: Synthetic oligonucleotide
  Target: ATXN1; (+) strand; PAM type: NRG; PAM sequence: TGG
tgggtcctcattctctggcc

SEQ ID NO: 112932 - DNA, 20 bp, Artificial Sequence
  Description of Artificial Sequence: Synthetic oligonucleotide
  Target: ATXN1; (+) strand; PAM type: NRG; PAM sequence: GGG
gggtcctcattctctggcct

SEQ ID NO: 112933 - DNA, 20 bp, Artificial Sequence
  Description of Artificial Sequence: Synthetic oligonucleotide
  Target: ATXN1; (+) strand; PAM type: NRG; PAM sequence: TGG
tcctcattctctggcctggg

SEQ ID NO: 112934 - DNA, 20 bp, Artificial Sequence
  Description of Artificial Sequence: Synthetic oligonucleotide
  Target: ATXN1; (+) strand; PAM type: NRG; PAM sequence: GAG
ggcctgggtggccatgatcc

SEQ ID NO: 112935 - DNA, 20 bp, Artificial Sequence
  Description of Artificial Sequence: Synthetic oligonucleotide
  Target: ATXN1; (+) strand; PAM type: NRG; PAM sequence: AGG
gcctgggtggccatgatccg

SEQ ID NO: 112936 - DNA, 20 bp, Artificial Sequence
  Description of Artificial Sequence: Synthetic oligonucleotide
  Target: ATXN1; (+) strand; PAM type: NRG; PAM sequence: GGG
cctgggtggccatgatccga

SEQ ID NO: 112937 - DNA, 20 bp, Artificial Sequence
  Description of Artificial Sequence: Synthetic oligonucleotide
  Target: ATXN1; (+) strand; PAM type: NRG; PAM sequence: TGG
gatccgagggcattttgttc

SEQ ID NO: 112938 - DNA, 20 bp, Artificial Sequence
  Description of Artificial Sequence: Synthetic oligonucleotide
  Target: ATXN1; (+) strand; PAM type: NRG; PAM sequence: CAG
gggcattttgttctggtgca

SEQ ID NO: 112939 - DNA, 20 bp, Artificial Sequence
  Description of Artificial Sequence: Synthetic oligonucleotide
  Target: ATXN1; (+) strand; PAM type: NRG; PAM sequence: AAG
tgttctggtgcacagataca

SEQ ID NO: 112940 - DNA, 20 bp, Artificial Sequence
  Description of Artificial Sequence: Synthetic oligonucleotide
  Target: ATXN1; (+) strand; PAM type: NRG; PAM sequence: TGG
tggtgcacagatacaaagac

SEQ ID NO: 112941 - DNA, 20 bp, Artificial Sequence
  Description of Artificial Sequence: Synthetic oligonucleotide
  Target: ATXN1; (+) strand; PAM type: NRG; PAM sequence: GGG
ggtgcacagatacaaagact

SEQ ID NO: 112942 - DNA, 20 bp, Artificial Sequence
  Description of Artificial Sequence: Synthetic oligonucleotide
  Target: ATXN1; (+) strand; PAM type: NRG; PAM sequence: GGG
gtgcacagatacaaagactg

SEQ ID NO: 112943 - DNA, 20 bp, Artificial Sequence
  Description of Artificial Sequence: Synthetic oligonucleotide
  Target: ATXN1; (+) strand; PAM type: NRG; PAM sequence: TGG
acagatacaaagactgggga

SEQ ID NO: 112944 - DNA, 20 bp, Artificial Sequence
  Description of Artificial Sequence: Synthetic oligonucleotide
  Target: ATXN1; (+) strand; PAM type: NRG; PAM sequence: GGG
cagatacaaagactggggat

SEQ ID NO: 112945 - DNA, 20 bp, Artificial Sequence
  Description of Artificial Sequence: Synthetic oligonucleotide
  Target: ATXN1; (+) strand; PAM type: NRG; PAM sequence: GGG
agatacaaagactggggatg

SEQ ID NO: 112946 - DNA, 20 bp, Artificial Sequence
  Description of Artificial Sequence: Synthetic oligonucleotide
  Target: ATXN1; (+) strand; PAM type: NRG; PAM sequence: GAG
atacaaagactggggatggg

SEQ ID NO: 112947 - DNA, 20 bp, Artificial Sequence
  Description of Artificial Sequence: Synthetic oligonucleotide
  Target: ATXN1; (+) strand; PAM type: NRG; PAM sequence: AGG
tacaaagactggggatgggg

SEQ ID NO: 112948 - DNA, 20 bp, Artificial Sequence
  Description of Artificial Sequence: Synthetic oligonucleotide
  Target: ATXN1; (+) strand; PAM type: NRG; PAM sequence: CAG
aagactggggatggggagga

SEQ ID NO: 112949 - DNA, 20 bp, Artificial Sequence
  Description of Artificial Sequence: Synthetic oligonucleotide
  Target: ATXN1; (+) strand; PAM type: NRG; PAM sequence: AAG
aggacagtaatcttttatac

SEQ ID NO: 112950 - DNA, 20 bp, Artificial Sequence
  Description of Artificial Sequence: Synthetic oligonucleotide
  Target: ATXN1; (+) strand; PAM type: NRG; PAM sequence: AGG
ggacagtaatcttttataca

SEQ ID NO: 112951 - DNA, 20 bp, Artificial Sequence
  Description of Artificial Sequence: Synthetic oligonucleotide
  Target: ATXN1; (+) strand; PAM type: NRG; PAM sequence: TGG
ggacacatgaaccaccacac

SEQ ID NO: 112952 - DNA, 20 bp, Artificial Sequence
  Description of Artificial Sequence: Synthetic oligonucleotide
  Target: ATXN1; (+) strand; PAM type: NRG; PAM sequence: TAG
gaaccaccacactggtgcct

SEQ ID NO: 112953 - DNA, 20 bp, Artificial Sequence
  Description of Artificial Sequence: Synthetic oligonucleotide
  Target: ATXN1; (+) strand; PAM type: NRG; PAM sequence: GAG
accaccacactggtgcctta

SEQ ID NO: 112954 - DNA, 20 bp, Artificial Sequence
  Description of Artificial Sequence: Synthetic oligonucleotide
  Target: ATXN1; (+) strand; PAM type: NRG; PAM sequence: TAG
cactggtgccttagagaaca

SEQ ID NO: 112955 - DNA, 20 bp, Artificial Sequence
  Description of Artificial Sequence: Synthetic oligonucleotide
  Target: ATXN1; (+) strand; PAM type: NRG; PAM sequence: AGG
actggtgccttagagaacat

SEQ ID NO: 112956 - DNA, 20 bp, Artificial Sequence
  Description of Artificial Sequence: Synthetic oligonucleotide
  Target: ATXN1; (+) strand; PAM type: NRG; PAM sequence: CAG
aggcaacgaatactctgctg

SEQ ID NO: 112957 - DNA, 20 bp, Artificial Sequence
  Description of Artificial Sequence: Synthetic oligonucleotide
  Target: ATXN1; (+) strand; PAM type: NRG; PAM sequence: AAG
cgaatactctgctgcagcat

SEQ ID NO: 112958 - DNA, 20 bp, Artificial Sequence
  Description of Artificial Sequence: Synthetic oligonucleotide
  Target: ATXN1; (+) strand; PAM type: NRG; PAM sequence: AAG
gctgcagcataagtgatcga

SEQ ID NO: 112959 - DNA, 20 bp, Artificial Sequence
  Description of Artificial Sequence: Synthetic oligonucleotide
  Target: ATXN1; (+) strand; PAM type: NRG; PAM sequence: TAG
tcctcactaaatgatttgaa

SEQ ID NO: 112960 - DNA, 20 bp, Artificial Sequence
  Description of Artificial Sequence: Synthetic oligonucleotide
  Target: ATXN1; (+) strand; PAM type: NRG; PAM sequence: AAG
cactaaatgatttgaataga

SEQ ID NO: 112961 - DNA, 20 bp, Artificial Sequence
  Description of Artificial Sequence: Synthetic oligonucleotide
  Target: ATXN1; (+) strand; PAM type: NRG; PAM sequence: AGG
actaaatgatttgaatagaa

SEQ ID NO: 112962 - DNA, 20 bp, Artificial Sequence
  Description of Artificial Sequence: Synthetic oligonucleotide
  Target: ATXN1; (+) strand; PAM type: NRG; PAM sequence: TAG
gaatagaaaggaaatcacca

SEQ ID NO: 112963 - DNA, 20 bp, Artificial Sequence
  Description of Artificial Sequence: Synthetic oligonucleotide
  Target: ATXN1; (+) strand; PAM type: NRG; PAM sequence: GAG
accactgttctccataacgt

SEQ ID NO: 112964 - DNA, 20 bp, Artificial Sequence
  Description of Artificial Sequence: Synthetic oligonucleotide
  Target: ATXN1; (+) strand; PAM type: NRG; PAM sequence: CAG
gttctccataacgtgagctg

SEQ ID NO: 112965 - DNA, 20 bp, Artificial Sequence
  Description of Artificial Sequence: Synthetic oligonucleotide
  Target: ATXN1; (+) strand; PAM type: NRG; PAM sequence: CGG
tatgctgcattttacttccc

SEQ ID NO: 112966 - DNA, 20 bp, Artificial Sequence
  Description of Artificial Sequence: Synthetic oligonucleotide
  Target: ATXN1; (+) strand; PAM type: NRG; PAM sequence: GAG
gcattttacttccccggtat

SEQ ID NO: 112967 - DNA, 20 bp, Artificial Sequence
  Description of Artificial Sequence: Synthetic oligonucleotide
  Target: ATXN1; (+) strand; PAM type: NRG; PAM sequence: AGG
cattttacttccccggtatg

SEQ ID NO: 112968 - DNA, 20 bp, Artificial Sequence
  Description of Artificial Sequence: Synthetic oligonucleotide
  Target: ATXN1; (+) strand; PAM type: NRG; PAM sequence: GGG
attttacttccccggtatga

SEQ ID NO: 112969 - DNA, 20 bp, Artificial Sequence
  Description of Artificial Sequence: Synthetic oligonucleotide
  Target: ATXN1; (+) strand; PAM type: NRG; PAM sequence: CAG
ttacttccccggtatgaggg

SEQ ID NO: 112970 - DNA, 20 bp, Artificial Sequence
  Description of Artificial Sequence: Synthetic oligonucleotide
  Target: ATXN1; (+) strand; PAM type: NRG; PAM sequence: TAG
ttccccggtatgagggcagc

SEQ ID NO: 112971 - DNA, 20 bp, Artificial Sequence
  Description of Artificial Sequence: Synthetic oligonucleotide
  Target: ATXN1; (+) strand; PAM type: NRG; PAM sequence: GAG
ccccggtatgagggcagcta

SEQ ID NO: 112972 - DNA, 20 bp, Artificial Sequence
  Description of Artificial Sequence: Synthetic oligonucleotide
  Target: ATXN1; (+) strand; PAM type: NRG; PAM sequence: GAG
ccggtatgagggcagctaga

SEQ ID NO: 112973 - DNA, 20 bp, Artificial Sequence
  Description of Artificial Sequence: Synthetic oligonucleotide
  Target: ATXN1; (+) strand; PAM type: NRG; PAM sequence: TGG
tatgagggcagctagagaga

SEQ ID NO: 112974 - DNA, 20 bp, Artificial Sequence
  Description of Artificial Sequence: Synthetic oligonucleotide
  Target: ATXN1; (+) strand; PAM type: NRG; PAM sequence: TGG
gagggcagctagagagatgg

SEQ ID NO: 112975 - DNA, 20 bp, Artificial Sequence
  Description of Artificial Sequence: Synthetic oligonucleotide
  Target: ATXN1; (+) strand; PAM type: NRG; PAM sequence: GGG
agggcagctagagagatggt

SEQ ID NO: 112976 - DNA, 20 bp, Artificial Sequence
  Description of Artificial Sequence: Synthetic oligonucleotide
  Target: ATXN1; (+) strand; PAM type: NRG; PAM sequence: TGG
gggatgactttcactgtctc

SEQ ID NO: 112977 - DNA, 20 bp, Artificial Sequence
  Description of Artificial Sequence: Synthetic oligonucleotide
  Target: ATXN1; (+) strand; PAM type: NRG; PAM sequence: GGG
ggatgactttcactgtctct

SEQ ID NO: 112978 - DNA, 20 bp, Artificial Sequence
  Description of Artificial Sequence: Synthetic oligonucleotide
  Target: ATXN1; (+) strand; PAM type: NRG; PAM sequence: GGG
gatgactttcactgtctctg

SEQ ID NO: 112979 - DNA, 20 bp, Artificial Sequence
  Description of Artificial Sequence: Synthetic oligonucleotide
  Target: ATXN1; (+) strand; PAM type: NRG; PAM sequence: CAG
tcactgtctctggggacctt

SEQ ID NO: 112980 - DNA, 20 bp, Artificial Sequence
  Description of Artificial Sequence: Synthetic oligonucleotide
  Target: ATXN1; (+) strand; PAM type: NRG; PAM sequence: TAG
ctggggaccttcagacaaat

SEQ ID NO: 112981 - DNA, 20 bp, Artificial Sequence
  Description of Artificial Sequence: Synthetic oligonucleotide
  Target: ATXN1; (+) strand; PAM type: NRG; PAM sequence: CAG
caaattagctatcttgtgaa

SEQ ID NO: 112982 - DNA, 20 bp, Artificial Sequence
  Description of Artificial Sequence: Synthetic oligonucleotide
  Target: ATXN1; (+) strand; PAM type: NRG; PAM sequence: CAG
agctatcttgtgaacagtcc

SEQ ID NO: 112983 - DNA, 20 bp, Artificial Sequence
  Description of Artificial Sequence: Synthetic oligonucleotide
  Target: ATXN1; (+) strand; PAM type: NRG; PAM sequence: AGG
gctatcttgtgaacagtccc

SEQ ID NO: 112984 - DNA, 20 bp, Artificial Sequence
  Description of Artificial Sequence: Synthetic oligonucleotide
  Target: ATXN1; (+) strand; PAM type: NRG; PAM sequence: AAG
atttactgtctgtatcactt

SEQ ID NO: 112985 - DNA, 20 bp, Artificial Sequence
  Description of Artificial Sequence: Synthetic oligonucleotide
  Target: ATXN1; (+) strand; PAM type: NRG; PAM sequence: GAG
ttactgtctgtatcacttaa

SEQ ID NO: 112986 - DNA, 20 bp, Artificial Sequence
  Description of Artificial Sequence: Synthetic oligonucleotide
  Target: ATXN1; (+) strand; PAM type: NRG; PAM sequence: AGG
tactgtctgtatcacttaag

SEQ ID NO: 112987 - DNA, 20 bp, Artificial Sequence
  Description of Artificial Sequence: Synthetic oligonucleotide
  Target: ATXN1; (+) strand; PAM type: NRG; PAM sequence: GAG
tctgtatcacttaagaggtt

SEQ ID NO: 112988 - DNA, 20 bp, Artificial Sequence
  Description of Artificial Sequence: Synthetic oligonucleotide
  Target: ATXN1; (+) strand; PAM type: NRG; PAM sequence: TGG
atcacttaagaggttgagaa

SEQ ID NO: 112989 - DNA, 20 bp, Artificial Sequence
  Description of Artificial Sequence: Synthetic oligonucleotide
  Target: ATXN1; (+) strand; PAM type: NRG; PAM sequence: GAG
cacttaagaggttgagaatg

SEQ ID NO: 112990 - DNA, 20 bp, Artificial Sequence
  Description of Artificial Sequence: Synthetic oligonucleotide
  Target: ATXN1; (+) strand; PAM type: NRG; PAM sequence: AGG
acttaagaggttgagaatgg

SEQ ID NO: 112991 - DNA, 20 bp, Artificial Sequence
  Description of Artificial Sequence: Synthetic oligonucleotide
  Target: ATXN1; (+) strand; PAM type: NRG; PAM sequence: GGG
cttaagaggttgagaatgga

SEQ ID NO: 112992 - DNA, 20 bp, Artificial Sequence
  Description of Artificial Sequence: Synthetic oligonucleotide
  Target: ATXN1; (+) strand; PAM type: NRG; PAM sequence: GGG
ttaagaggttgagaatggag

SEQ ID NO: 112993 - DNA, 20 bp, Artificial Sequence
  Description of Artificial Sequence: Synthetic oligonucleotide
  Target: ATXN1; (+) strand; PAM type: NRG; PAM sequence: GGG
taagaggttgagaatggagg

SEQ ID NO: 112994 - DNA, 20 bp, Artificial Sequence
  Description of Artificial Sequence: Synthetic oligonucleotide
  Target: ATXN1; (+) strand; PAM type: NRG; PAM sequence: GGG
aagaggttgagaatggaggg

SEQ ID NO: 112995 - DNA, 20 bp, Artificial Sequence
  Description of Artificial Sequence: Synthetic oligonucleotide
  Target: ATXN1; (+) strand; PAM type: NRG; PAM sequence: GAG
gaggttgagaatggaggggg

SEQ ID NO: 112996 - DNA, 20 bp, Artificial Sequence
  Description of Artificial Sequence: Synthetic oligonucleotide
  Target: ATXN1; (+) strand; PAM type: NRG; PAM sequence: TAG
tgcgtgtttttatttaacaa

SEQ ID NO: 112997 - DNA, 20 bp, Artificial Sequence
  Description of Artificial Sequence: Synthetic oligonucleotide
  Target: ATXN1; (+) strand; PAM type: NRG; PAM sequence: TAG
gtttttatttaacaatagct

SEQ ID NO: 112998 - DNA, 20 bp, Artificial Sequence
  Description of Artificial Sequence: Synthetic oligonucleotide
  Target: ATXN1; (+) strand; PAM type: NRG; PAM sequence: TAG
tttaacaatagcttagctat

SEQ ID NO: 112999 - DNA, 20 bp, Artificial Sequence
  Description of Artificial Sequence: Synthetic oligonucleotide
  Target: ATXN1; (+) strand; PAM type: NRG; PAM sequence: TAG
agcttagctattagacaata

SEQ ID NO: 113000 - DNA, 20 bp, Artificial Sequence
  Description of Artificial Sequence: Synthetic oligonucleotide
  Target: ATXN1; (+) strand; PAM type: NRG; PAM sequence: GAG
cttagctattagacaatata

SEQ ID NO: 113001 - DNA, 20 bp, Artificial Sequence
  Description of Artificial Sequence: Synthetic oligonucleotide
  Target: ATXN1; (+) strand; PAM type: NRG; PAM sequence: TAG
tattagacaatatagagtat

SEQ ID NO: 113002 - DNA, 20 bp, Artificial Sequence
  Description of Artificial Sequence: Synthetic oligonucleotide
  Target: ATXN1; (+) strand; PAM type: NRG; PAM sequence: AAG
agacaatatagagtattaga

SEQ ID NO: 113003 - DNA, 20 bp, Artificial Sequence
  Description of Artificial Sequence: Synthetic oligonucleotide
  Target: ATXN1; (+) strand; PAM type: NRG; PAM sequence: TAG
gagtattagaaagactgtct

SEQ ID NO: 113004 - DNA, 20 bp, Artificial Sequence
  Description of Artificial Sequence: Synthetic oligonucleotide
  Target: ATXN1; (+) strand; PAM type: NRG; PAM sequence: AAG
tattagaaagactgtcttag

SEQ ID NO: 113005 - DNA, 20 bp, Artificial Sequence
  Description of Artificial Sequence: Synthetic oligonucleotide
  Target: ATXN1; (+) strand; PAM type: NRG; PAM sequence: AAG
aagactgtcttagaagactg

SEQ ID NO: 113006 - DNA, 20 bp, Artificial Sequence
  Description of Artificial Sequence: Synthetic oligonucleotide
  Target: ATXN1; (+) strand; PAM type: NRG; PAM sequence: GAG
gactgtcttagaagactgaa

SEQ ID NO: 113007 - DNA, 20 bp, Artificial Sequence
  Description of Artificial Sequence: Synthetic oligonucleotide
  Target: ATXN1; (+) strand; PAM type: NRG; PAM sequence: AGG
actgtcttagaagactgaag

SEQ ID NO: 113008 - DNA, 20 bp, Artificial Sequence
  Description of Artificial Sequence: Synthetic oligonucleotide
  Target: ATXN1; (+) strand; PAM type: NRG; PAM sequence: AAG
cttagaagactgaagaggtg

SEQ ID NO: 113009 - DNA, 20 bp, Artificial Sequence
  Description of Artificial Sequence: Synthetic oligonucleotide
  Target: ATXN1; (+) strand; PAM type: NRG; PAM sequence: TGG
gaagactgaagaggtgaagc

SEQ ID NO: 113010 - DNA, 20 bp, Artificial Sequence
  Description of Artificial Sequence: Synthetic oligonucleotide
  Target: ATXN1; (+) strand; PAM type: NRG; PAM sequence: GAG
agaggtgaagctggtgttct

SEQ ID NO: 113011 - DNA, 20 bp, Artificial Sequence
  Description of Artificial Sequence: Synthetic oligonucleotide
  Target: ATXN1; (+) strand; PAM type: NRG; PAM sequence: CAG
gtgttctgagtatgtctaca

SEQ ID NO: 113012 - DNA, 20 bp, Artificial Sequence
  Description of Artificial Sequence: Synthetic oligonucleotide
  Target: ATXN1; (+) strand; PAM type: NRG; PAM sequence: TAG
gtatgtctacacagcctgca

SEQ ID NO: 113013 - DNA, 20 bp, Artificial Sequence
  Description of Artificial Sequence: Synthetic oligonucleotide
  Target: ATXN1; (+) strand; PAM type: NRG; PAM sequence: GAG
atgtctacacagcctgcata

SEQ ID NO: 113014 - DNA, 20 bp, Artificial Sequence
  Description of Artificial Sequence: Synthetic oligonucleotide
  Target: ATXN1; (+) strand; PAM type: NRG; PAM sequence: AGG
tgtctacacagcctgcatag

SEQ ID NO: 113015 - DNA, 20 bp, Artificial Sequence
  Description of Artificial Sequence: Synthetic oligonucleotide
  Target: ATXN1; (+) strand; PAM type: NRG; PAM sequence: CAG
ctacacagcctgcatagagg

SEQ ID NO: 113016 - DNA, 20 bp, Artificial Sequence
  Description of Artificial Sequence: Synthetic oligonucleotide
  Target: ATXN1; (+) strand; PAM type: NRG; PAM sequence: TGG
tcatgttactctgcctaaaa

SEQ ID NO: 113017 - DNA, 20 bp, Artificial Sequence
  Description of Artificial Sequence: Synthetic oligonucleotide
  Target: ATXN1; (+) strand; PAM type: NRG; PAM sequence: CGG
tgcctaaaatggataaaact

SEQ ID NO: 113018 - DNA, 20 bp, Artificial Sequence
  Description of Artificial Sequence: Synthetic oligonucleotide
  Target: ATXN1; (+) strand; PAM type: NRG; PAM sequence: TAG
ggaacaaaacaatccacatt

SEQ ID NO: 113019 - DNA, 20 bp, Artificial Sequence
  Description of Artificial Sequence: Synthetic oligonucleotide
  Target: ATXN1; (+) strand; PAM type: NRG; PAM sequence: AAG
ccacatttagtaataccctg

SEQ ID NO: 113020 - DNA, 20 bp, Artificial Sequence
  Description of Artificial Sequence: Synthetic oligonucleotide
  Target: ATXN1; (+) strand; PAM type: NRG; PAM sequence: AAG
actccttactttcaaatctg

SEQ ID NO: 113021 - DNA, 20 bp, Artificial Sequence
  Description of Artificial Sequence: Synthetic oligonucleotide
  Target: ATXN1; (+) strand; PAM type: NRG; PAM sequence: TAG
ttcaaatctgaagtaattat

SEQ ID NO: 113022 - DNA, 20 bp, Artificial Sequence
  Description of Artificial Sequence: Synthetic oligonucleotide
  Target: ATXN1; (+) strand; PAM type: NRG; PAM sequence: AAG
aatctgaagtaattattaga

SEQ ID NO: 113023 - DNA, 20 bp, Artificial Sequence
  Description of Artificial Sequence: Synthetic oligonucleotide
  Target: ATXN1; (+) strand; PAM type: NRG; PAM sequence: GAG
tgaagtaattattagaaagt

SEQ ID NO: 113024 - DNA, 20 bp, Artificial Sequence
  Description of Artificial Sequence: Synthetic oligonucleotide
  Target: ATXN1; (+) strand; PAM type: NRG; PAM sequence: CAG
attattagaaagtgagaaaa

SEQ ID NO: 113025 - DNA, 20 bp, Artificial Sequence
  Description of Artificial Sequence: Synthetic oligonucleotide
  Target: ATXN1; (+) strand; PAM type: NRG; PAM sequence: TGG
gagaaaacagacattacttt

SEQ ID NO: 113026 - DNA, 20 bp, Artificial Sequence
  Description of Artificial Sequence: Synthetic oligonucleotide
  Target: ATXN1; (+) strand; PAM type: NRG; PAM sequence: GGG
agaaaacagacattactttt

SEQ ID NO: 113027 - DNA, 20 bp, Artificial Sequence
  Description of Artificial Sequence: Synthetic oligonucleotide
  Target: ATXN1; (+) strand; PAM type: NRG; PAM sequence: AAG
aaacagacattacttttggg

SEQ ID NO: 113028 - DNA, 20 bp, Artificial Sequence
  Description of Artificial Sequence: Synthetic oligonucleotide
  Target: ATXN1; (+) strand; PAM type: NRG; PAM sequence: TGG
agacattacttttgggaagc

SEQ ID NO: 113029 - DNA, 20 bp, Artificial Sequence
  Description of Artificial Sequence: Synthetic oligonucleotide
  Target: ATXN1; (+) strand; PAM type: NRG; PAM sequence: GGG
gacattacttttgggaagct

SEQ ID NO: 113030 - DNA, 20 bp, Artificial Sequence
  Description of Artificial Sequence: Synthetic oligonucleotide
  Target: ATXN1; (+) strand; PAM type: NRG; PAM sequence: GAG
cattacttttgggaagctgg

SEQ ID NO: 113031 - DNA, 20 bp, Artificial Sequence
  Description of Artificial Sequence: Synthetic oligonucleotide
  Target: ATXN1; (+) strand; PAM type: NRG; PAM sequence: TGG
acttttgggaagctgggaga

SEQ ID NO: 113032 - DNA, 20 bp, Artificial Sequence
  Description of Artificial Sequence: Synthetic oligonucleotide
  Target: ATXN1; (+) strand; PAM type: NRG; PAM sequence: TAG
gaagctgggagatggcttta

SEQ ID NO: 113033 - DNA, 20 bp, Artificial Sequence
  Description of Artificial Sequence: Synthetic oligonucleotide
  Target: ATXN1; (+) strand; PAM type: NRG; PAM sequence: AAG
gggagatggctttatagtct

SEQ ID NO: 113034 - DNA, 20 bp, Artificial Sequence
  Description of Artificial Sequence: Synthetic oligonucleotide
  Target: ATXN1; (+) strand; PAM type: NRG; PAM sequence: TAG
tttatagtctaagttgccac

SEQ ID NO: 113035 - DNA, 20 bp, Artificial Sequence
  Description of Artificial Sequence: Synthetic oligonucleotide
  Target: ATXN1; (+) strand; PAM type: NRG; PAM sequence: TAG
tagtctaagttgccactaga

SEQ ID NO: 113036 - DNA, 20 bp, Artificial Sequence
  Description of Artificial Sequence: Synthetic oligonucleotide
  Target: ATXN1; (+) strand; PAM type: NRG; PAM sequence: TGG
aatgacccataaaaattact

SEQ ID NO: 113037 - DNA, 20 bp, Artificial Sequence
  Description of Artificial Sequence: Synthetic oligonucleotide
  Target: ATXN1; (+) strand; PAM type: NRG; PAM sequence: AAG
gacccataaaaattacttgg

SEQ ID NO: 113038 - DNA, 20 bp, Artificial Sequence
  Description of Artificial Sequence: Synthetic oligonucleotide
  Target: ATXN1; (+) strand; PAM type: NRG; PAM sequence: AGG
acccataaaaattacttgga

SEQ ID NO: 113039 - DNA, 20 bp, Artificial Sequence
  Description of Artificial Sequence: Synthetic oligonucleotide
  Target: ATXN1; (+) strand; PAM type: NRG; PAM sequence: CGG
gaaggctattatctcataac

SEQ ID NO: 113040 - DNA, 20 bp, Artificial Sequence
  Description of Artificial Sequence: Synthetic oligonucleotide
  Target: ATXN1; (+) strand; PAM type: NRG; PAM sequence: GGG
aaggctattatctcataacc

SEQ ID NO: 113041 - DNA, 20 bp, Artificial Sequence
  Description of Artificial Sequence: Synthetic oligonucleotide
  Target: ATXN1; (+) strand; PAM type: NRG; PAM sequence: GGG
aggctattatctcataaccg

SEQ ID NO: 113042 - DNA, 20 bp, Artificial Sequence
  Description of Artificial Sequence: Synthetic oligonucleotide
  Target: ATXN1; (+) strand; PAM type: NRG; PAM sequence: CAG
ccggggcctataaaatctaa

SEQ ID NO: 113043 - DNA, 20 bp, Artificial Sequence
  Description of Artificial Sequence: Synthetic oligonucleotide
  Target: ATXN1; (+) strand; PAM type: NRG; PAM sequence: CAG
cctataaaatctaacagtta

SEQ ID NO: 113044 - DNA, 20 bp, Artificial Sequence
  Description of Artificial Sequence: Synthetic oligonucleotide
  Target: ATXN1; (+) strand; PAM type: NRG; PAM sequence: AAG
tctcgtgtgtattttaatta

SEQ ID NO: 113045 - DNA, 20 bp, Artificial Sequence
  Description of Artificial Sequence: Synthetic oligonucleotide
  Target: ATXN1; (+) strand; PAM type: NRG; PAM sequence: AAG
aattaaagacttaaactgct

SEQ ID NO: 113046 - DNA, 20 bp, Artificial Sequence
  Description of Artificial Sequence: Synthetic oligonucleotide
  Target: ATXN1; (+) strand; PAM type: NRG; PAM sequence: GAG
ttaaagacttaaactgctaa

SEQ ID NO: 113047 - DNA, 20 bp, Artificial Sequence
  Description of Artificial Sequence: Synthetic oligonucleotide
  Target: ATXN1; (+) strand; PAM type: NRG; PAM sequence: CGG
aattttgcataatgtctctg

SEQ ID NO: 113048 - DNA, 20 bp, Artificial Sequence
  Description of Artificial Sequence: Synthetic oligonucleotide
  Target: ATXN1; (+) strand; PAM type: NRG; PAM sequence: TAG
ataatgtctctgcggttttg

SEQ ID NO: 113049 - DNA, 20 bp, Artificial Sequence
  Description of Artificial Sequence: Synthetic oligonucleotide
  Target: ATXN1; (+) strand; PAM type: NRG; PAM sequence: TGG
tgtgatacacacacatttac

SEQ ID NO: 113050 - DNA, 20 bp, Artificial Sequence
  Description of Artificial Sequence: Synthetic oligonucleotide
  Target: ATXN1; (+) strand; PAM type: NRG; PAM sequence: TGG
cacacacatttactggttta

SEQ ID NO: 113051 - DNA, 20 bp, Artificial Sequence
  Description of Artificial Sequence: Synthetic oligonucleotide
  Target: ATXN1; (+) strand; PAM type: NRG; PAM sequence: TAG
acacatttactggtttatgg

SEQ ID NO: 113052 - DNA, 20 bp, Artificial Sequence
  Description of Artificial Sequence: Synthetic oligonucleotide
  Target: ATXN1; (+) strand; PAM type: NRG; PAM sequence: AGG
cacatttactggtttatggt

SEQ ID NO: 113053 - DNA, 20 bp, Artificial Sequence
  Description of Artificial Sequence: Synthetic oligonucleotide
  Target: ATXN1; (+) strand; PAM type: NRG; PAM sequence: TGG
ttatggtaggaaaactgctc

SEQ ID NO: 113054 - DNA, 20 bp, Artificial Sequence
  Description of Artificial Sequence: Synthetic oligonucleotide
  Target: ATXN1; (+) strand; PAM type: NRG; PAM sequence: TGG
ggtaggaaaactgctctggc

SEQ ID NO: 113055 - DNA, 20 bp, Artificial Sequence
  Description of Artificial Sequence: Synthetic oligonucleotide
  Target: ATXN1; (+) strand; PAM type: NRG; PAM sequence: GGG
gtaggaaaactgctctggct

SEQ ID NO: 113056 - DNA, 20 bp, Artificial Sequence
  Description of Artificial Sequence: Synthetic oligonucleotide
  Target: ATXN1; (+) strand; PAM type: NRG; PAM sequence: TGG
aaactgctctggctgggtac

SEQ ID NO: 113057 - DNA, 20 bp, Artificial Sequence
  Description of Artificial Sequence: Synthetic oligonucleotide
  Target: ATXN1; (+) strand; PAM type: NRG; PAM sequence: CAG
tggcactcgcctttgtgatt

SEQ ID NO: 113058 - DNA, 20 bp, Artificial Sequence
  Description of Artificial Sequence: Synthetic oligonucleotide
  Target: ATXN1; (+) strand; PAM type: NRG; PAM sequence: AGG
ggcactcgcctttgtgattc

SEQ ID NO: 113059 - DNA, 20 bp, Artificial Sequence
  Description of Artificial Sequence: Synthetic oligonucleotide
  Target: ATXN1; (+) strand; PAM type: NRG; PAM sequence: GAG
tgattcaggcatgaaaccat

SEQ ID NO: 113060 - DNA, 20 bp, Artificial Sequence
  Description of Artificial Sequence: Synthetic oligonucleotide
  Target: ATXN1; (+) strand; PAM type: NRG; PAM sequence: AGG
gattcaggcatgaaaccatg

SEQ ID NO: 113061 - DNA, 20 bp, Artificial Sequence
  Description of Artificial Sequence: Synthetic oligonucleotide
  Target: ATXN1; (+) strand; PAM type: NRG; PAM sequence: CAG
gcatgaaaccatgaggtgcc

SEQ ID NO: 113062 - DNA, 20 bp, Artificial Sequence
  Description of Artificial Sequence: Synthetic oligonucleotide
  Target: ATXN1; (+) strand; PAM type: NRG; PAM sequence: TGG
gaaaccatgaggtgcccagc

SEQ ID NO: 113063 - DNA, 20 bp, Artificial Sequence
  Description of Artificial Sequence: Synthetic oligonucleotide
  Target: ATXN1; (+) strand; PAM type: NRG; PAM sequence: CAG
tgaggtgcccagctggaatt

SEQ ID NO: 113064 - DNA, 20 bp, Artificial Sequence
  Description of Artificial Sequence: Synthetic oligonucleotide
  Target: ATXN1; (+) strand; PAM type: NRG; PAM sequence: AAG
ggtgcccagctggaattcag

SEQ ID NO: 113065 - DNA, 20 bp, Artificial Sequence
  Description of Artificial Sequence: Synthetic oligonucleotide
  Target: ATXN1; (+) strand; PAM type: NRG; PAM sequence: AAG
gcccagctggaattcagaag

SEQ ID NO: 113066 - DNA, 20 bp, Artificial Sequence
  Description of Artificial Sequence: Synthetic oligonucleotide
  Target: ATXN1; (+) strand; PAM type: NRG; PAM sequence: TAG
ggaattcagaagaagtacat

SEQ ID NO: 113067 - DNA, 20 bp, Artificial Sequence
  Description of Artificial Sequence: Synthetic oligonucleotide
  Target: ATXN1; (+) strand; PAM type: NRG; PAM sequence: AGG
gaattcagaagaagtacatt

SEQ ID NO: 113068 - DNA, 20 bp, Artificial Sequence
  Description of Artificial Sequence: Synthetic oligonucleotide
  Target: ATXN1; (+) strand; PAM type: NRG; PAM sequence: CAG
tcagaagaagtacattagga

SEQ ID NO: 113069 - DNA, 20 bp, Artificial Sequence
  Description of Artificial Sequence: Synthetic oligonucleotide
  Target: ATXN1; (+) strand; PAM type: NRG; PAM sequence: GAG
agaagaagtacattaggaca

SEQ ID NO: 113070 - DNA, 20 bp, Artificial Sequence
  Description of Artificial Sequence: Synthetic oligonucleotide
  Target: ATXN1; (+) strand; PAM type: NRG; PAM sequence: AGG
gaagaagtacattaggacag

SEQ ID NO: 113071 - DNA, 20 bp, Artificial Sequence
  Description of Artificial Sequence: Synthetic oligonucleotide
  Target: ATXN1; (+) strand; PAM type: NRG; PAM sequence: GGG
aagaagtacattaggacaga

SEQ ID NO: 113072 - DNA, 20 bp, Artificial Sequence
  Description of Artificial Sequence: Synthetic oligonucleotide
  Target: ATXN1; (+) strand; PAM type: NRG; PAM sequence: GGG
agaagtacattaggacagag

SEQ ID NO: 113073 - DNA, 20 bp, Artificial Sequence
  Description of Artificial Sequence: Synthetic oligonucleotide
  Target: ATXN1; (+) strand; PAM type: NRG; PAM sequence: CAG
agtacattaggacagagggg

SEQ ID NO: 113074 - DNA, 20 bp, Artificial Sequence
  Description of Artificial Sequence: Synthetic oligonucleotide
  Target: ATXN1; (+) strand; PAM type: NRG; PAM sequence: TAG
gcagctttgtatttatttat

SEQ ID NO: 113075 - DNA, 20 bp, Artificial Sequence
  Description of Artificial Sequence: Synthetic oligonucleotide
  Target: ATXN1; (+) strand; PAM type: NRG; PAM sequence: AGG
cagctttgtatttatttatt

SEQ ID NO: 113076 - DNA, 20 bp, Artificial Sequence
  Description of Artificial Sequence: Synthetic oligonucleotide
  Target: ATXN1; (+) strand; PAM type: NRG; PAM sequence: AAG
ttattaggttcttccaactt

SEQ ID NO: 113077 - DNA, 20 bp, Artificial Sequence
  Description of Artificial Sequence: Synthetic oligonucleotide
  Target: ATXN1; (+) strand; PAM type: NRG; PAM sequence: CAG
gttcttccaacttaagttgc

SEQ ID NO: 113078 - DNA, 20 bp, Artificial Sequence
  Description of Artificial Sequence: Synthetic oligonucleotide
  Target: ATXN1; (+) strand; PAM type: NRG; PAM sequence: AGG
ttcttccaacttaagttgcc

SEQ ID NO: 113079 - DNA, 20 bp, Artificial Sequence
  Description of Artificial Sequence: Synthetic oligonucleotide
  Target: ATXN1; (+) strand; PAM type: NRG; PAM sequence: GGG
tcttccaacttaagttgcca

SEQ ID NO: 113080 - DNA, 20 bp, Artificial Sequence
  Description of Artificial Sequence: Synthetic oligonucleotide
  Target: ATXN1; (+) strand; PAM type: NRG; PAM sequence: TAG
tccaacttaagttgccaggg

SEQ ID NO: 113081 - DNA, 20 bp, Artificial Sequence
  Description of Artificial Sequence: Synthetic oligonucleotide
  Target: ATXN1; (+) strand; PAM type: NRG; PAM sequence: GAG
ttaagttgccagggtagcat

SEQ ID NO: 113082 - DNA, 20 bp, Artificial Sequence
  Description of Artificial Sequence: Synthetic oligonucleotide
  Target: ATXN1; (+) strand; PAM type: NRG; PAM sequence: CAG
tagcatgagctttttaaaaa

SEQ ID NO: 113083 - DNA, 20 bp, Artificial Sequence
  Description of Artificial Sequence: Synthetic oligonucleotide
  Target: ATXN1; (+) strand; PAM type: NRG; PAM sequence: TGG
tttttaaaaacagttgtttc

SEQ ID NO: 113084 - DNA, 20 bp, Artificial Sequence
  Description of Artificial Sequence: Synthetic oligonucleotide
  Target: ATXN1; (+) strand; PAM type: NRG; PAM sequence: TAG
tgtttctggccttcctgttt

SEQ ID NO: 113085 - DNA, 20 bp, Artificial Sequence
  Description of Artificial Sequence: Synthetic oligonucleotide
  Target: ATXN1; (+) strand; PAM type: NRG; PAM sequence: AGG
gtttctggccttcctgtttt

SEQ ID NO: 113086 - DNA, 20 bp, Artificial Sequence
  Description of Artificial Sequence: Synthetic oligonucleotide
  Target: ATXN1; (+) strand; PAM type: NRG; PAM sequence: TAG
tgttttaggcttttatctaa

SEQ ID NO: 113087 - DNA, 20 bp, Artificial Sequence
  Description of Artificial Sequence: Synthetic oligonucleotide
  Target: ATXN1; (+) strand; PAM type: NRG; PAM sequence: GAG
ttttaggcttttatctaata

SEQ ID NO: 113088 - DNA, 20 bp, Artificial Sequence
  Description of Artificial Sequence: Synthetic oligonucleotide
  Target: ATXN1; (+) strand; PAM type: NRG; PAM sequence: GAG
gcttttatctaatagagtgt

SEQ ID NO: 113089 - DNA, 20 bp, Artificial Sequence
  Description of Artificial Sequence: Synthetic oligonucleotide
  Target: ATXN1; (+) strand; PAM type: NRG; PAM sequence: AAG
tttatctaatagagtgtgag

SEQ ID NO: 113090 - DNA, 20 bp, Artificial Sequence
  Description of Artificial Sequence: Synthetic oligonucleotide
  Target: ATXN1; (+) strand; PAM type: NRG; PAM sequence: GAG
aatagagtgtgagaagacat

SEQ ID NO: 113091 - DNA, 20 bp, Artificial Sequence
  Description of Artificial Sequence: Synthetic oligonucleotide
  Target: ATXN1; (+) strand; PAM type: NRG; PAM sequence: CAG
agaagacatgagttcacatg

SEQ ID NO: 113092 - DNA, 20 bp, Artificial Sequence
  Description of Artificial Sequence: Synthetic oligonucleotide
  Target: ATXN1; (+) strand; PAM type: NRG; PAM sequence: AAG
acatgagttcacatgcagct

SEQ ID NO: 113093 - DNA, 20 bp, Artificial Sequence
  Description of Artificial Sequence: Synthetic oligonucleotide
  Target: ATXN1; (+) strand; PAM type: NRG; PAM sequence: AGG
catgagttcacatgcagcta

SEQ ID NO: 113094 - DNA, 20 bp, Artificial Sequence
  Description of Artificial Sequence: Synthetic oligonucleotide
  Target: ATXN1; (+) strand; PAM type: NRG; PAM sequence: GAG
gttcacatgcagctaaggat

SEQ ID NO: 113095 - DNA, 20 bp, Artificial Sequence
  Description of Artificial Sequence: Synthetic oligonucleotide
  Target: ATXN1; (+) strand; PAM type: NRG; PAM sequence: TGG
caaccccacatatcaaaccg

SEQ ID NO: 113096 - DNA, 20 bp, Artificial Sequence
  Description of Artificial Sequence: Synthetic oligonucleotide
  Target: ATXN1; (+) strand; PAM type: NRG; PAM sequence: CAG
tgtcattttcgtcactttaa

SEQ ID NO: 113097 - DNA, 20 bp, Artificial Sequence
  Description of Artificial Sequence: Synthetic oligonucleotide
  Target: ATXN1; (+) strand; PAM type: NRG; PAM sequence: TAG
cattttcgtcactttaacag

SEQ ID NO: 113098 - DNA, 20 bp, Artificial Sequence
  Description of Artificial Sequence: Synthetic oligonucleotide
  Target: ATXN1; (+) strand; PAM type: NRG; PAM sequence: AAG
ttcgtcactttaacagtaga

SEQ ID NO: 113099 - DNA, 20 bp, Artificial Sequence
  Description of Artificial Sequence: Synthetic oligonucleotide
  Target: ATXN1; (+) strand; PAM type: NRG; PAM sequence: AGG
tcgtcactttaacagtagaa

SEQ ID NO: 113100 - DNA, 20 bp, Artificial Sequence
  Description of Artificial Sequence: Synthetic oligonucleotide
  Target: ATXN1; (+) strand; PAM type: NRG; PAM sequence: CAG
ctttaacagtagaaaggaca

SEQ ID NO: 113101 - DNA, 20 bp, Artificial Sequence
  Description of Artificial Sequence: Synthetic oligonucleotide
  Target: ATXN1; (+) strand; PAM type: NRG; PAM sequence: AGG
tttaacagtagaaaggacac

SEQ ID NO: 113102 - DNA, 20 bp, Artificial Sequence
  Description of Artificial Sequence: Synthetic oligonucleotide
  Target: ATXN1; (+) strand; PAM type: NRG; PAM sequence: AAG
aaaggacacaggaaaaaaaa

SEQ ID NO: 113103 - DNA, 20 bp, Artificial Sequence
  Description of Artificial Sequence: Synthetic oligonucleotide
  Target: ATXN1; (+) strand; PAM type: NRG; PAM sequence: CAG
gaaatcatttactgaactaa

SEQ ID NO: 113104 - DNA, 20 bp, Artificial Sequence
  Description of Artificial Sequence: Synthetic oligonucleotide
  Target: ATXN1; (+) strand; PAM type: NRG; PAM sequence: TGG
acatttgtcccctcctgcct

SEQ ID NO: 113105 - DNA, 20 bp, Artificial Sequence
  Description of Artificial Sequence: Synthetic oligonucleotide
  Target: ATXN1; (+) strand; PAM type: NRG; PAM sequence: CAG
aatgactaatttttaaataa

SEQ ID NO: 113106 - DNA, 20 bp, Artificial Sequence
  Description of Artificial Sequence: Synthetic oligonucleotide
  Target: ATXN1; (+) strand; PAM type: NRG; PAM sequence: TGG
ctaatttttaaataacagat

SEQ ID NO: 113107 - DNA, 20 bp, Artificial Sequence
  Description of Artificial Sequence: Synthetic oligonucleotide
  Target: ATXN1; (+) strand; PAM type: NRG; PAM sequence: CAG
ttttaaataacagattggta

SEQ ID NO: 113108 - DNA, 20 bp, Artificial Sequence
  Description of Artificial Sequence: Synthetic oligonucleotide
  Target: ATXN1; (+) strand; PAM type: NRG; PAM sequence: GAG
taacagattggtacagctct

SEQ ID NO: 113109 - DNA, 20 bp, Artificial Sequence
  Description of Artificial Sequence: Synthetic oligonucleotide
  Target: ATXN1; (+) strand; PAM type: NRG; PAM sequence: TAG
gattggtacagctctgagat

SEQ ID NO: 113110 - DNA, 20 bp, Artificial Sequence
  Description of Artificial Sequence: Synthetic oligonucleotide
  Target: ATXN1; (+) strand; PAM type: NRG; PAM sequence: AGG
attggtacagctctgagatt

SEQ ID NO: 113111 - DNA, 20 bp, Artificial Sequence
  Description of Artificial Sequence: Synthetic oligonucleotide
  Target: ATXN1; (+) strand; PAM type: NRG; PAM sequence: GAG
tggtacagctctgagattag

SEQ ID NO: 113112 - DNA, 20 bp, Artificial Sequence
  Description of Artificial Sequence: Synthetic oligonucleotide
  Target: ATXN1; (+) strand; PAM type: NRG; PAM sequence: CAG
acagctctgagattaggaga

SEQ ID NO: 113113 - DNA, 20 bp, Artificial Sequence
  Description of Artificial Sequence: Synthetic oligonucleotide
  Target: ATXN1; (+) strand; PAM type: NRG; PAM sequence: AAG
ctctgagattaggagacaga

SEQ ID NO: 113114 - DNA, 20 bp, Artificial Sequence
  Description of Artificial Sequence: Synthetic oligonucleotide
  Target: ATXN1; (+) strand; PAM type: NRG; PAM sequence: TGG
agattaggagacagaaagca

SEQ ID NO: 113115 - DNA, 20 bp, Artificial Sequence
  Description of Artificial Sequence: Synthetic oligonucleotide
  Target: ATXN1; (+) strand; PAM type: NRG; PAM sequence: AAG
taggagacagaaagcatgga

SEQ ID NO: 113116 - DNA, 20 bp, Artificial Sequence
  Description of Artificial Sequence: Synthetic oligonucleotide
  Target: ATXN1; (+) strand; PAM type: NRG; PAM sequence: AGG
aggagacagaaagcatggaa

SEQ ID NO: 113117 - DNA, 20 bp, Artificial Sequence
  Description of Artificial Sequence: Synthetic oligonucleotide
  Target: ATXN1; (+) strand; PAM type: NRG; PAM sequence: CAG
agaaagcatggaaaggtcct

SEQ ID NO: 113118 - DNA, 20 bp, Artificial Sequence
  Description of Artificial Sequence: Synthetic oligonucleotide
  Target: ATXN1; (+) strand; PAM type: NRG; PAM sequence: TAG
ggaaaggtcctcagaccttt

SEQ ID NO: 113119 - DNA, 20 bp, Artificial Sequence
  Description of Artificial Sequence: Synthetic oligonucleotide
  Target: ATXN1; (+) strand; PAM type: NRG; PAM sequence: AGG
gaaaggtcctcagacctttt

SEQ ID NO: 113120 - DNA, 20 bp, Artificial Sequence
  Description of Artificial Sequence: Synthetic oligonucleotide
  Target: ATXN1; (+) strand; PAM type: NRG; PAM sequence: TGG
gtcctcagaccttttaggtt

SEQ ID NO: 113121 - DNA, 20 bp, Artificial Sequence
  Description of Artificial Sequence: Synthetic oligonucleotide
  Target: ATXN1; (+) strand; PAM type: NRG; PAM sequence: TGG
tgctttcctgttcctctgaa

SEQ ID NO: 113122 - DNA, 20 bp, Artificial Sequence
  Description of Artificial Sequence: Synthetic oligonucleotide
  Target: ATXN1; (+) strand; PAM type: NRG; PAM sequence: GGG
gctttcctgttcctctgaat

SEQ ID NO: 113123 - DNA, 20 bp, Artificial Sequence
  Description of Artificial Sequence: Synthetic oligonucleotide
  Target: ATXN1; (+) strand; PAM type: NRG; PAM sequence: AAG
caaaaccattttgaatgtaa

SEQ ID NO: 113124 - DNA, 20 bp, Artificial Sequence
  Description of Artificial Sequence: Synthetic oligonucleotide
  Target: ATXN1; (+) strand; PAM type: NRG; PAM sequence: AGG
aaaaccattttgaatgtaaa

SEQ ID NO: 113125 - DNA, 20 bp, Artificial Sequence
  Description of Artificial Sequence: Synthetic oligonucleotide
  Target: ATXN1; (+) strand; PAM type: NRG; PAM sequence: TAG
attttgaatgtaaaaggctg

SEQ ID NO: 113126 - DNA, 20 bp, Artificial Sequence
  Description of Artificial Sequence: Synthetic oligonucleotide
  Target: ATXN1; (+) strand; PAM type: NRG; PAM sequence: GAG
tttgaatgtaaaaggctgta

SEQ ID NO: 113127 - DNA, 20 bp, Artificial Sequence
  Description of Artificial Sequence: Synthetic oligonucleotide
  Target: ATXN1; (+) strand; PAM type: NRG; PAM sequence: TGG
aaggctgtagagttcaacac

SEQ ID NO: 113128 - DNA, 20 bp, Artificial Sequence
  Description of Artificial Sequence: Synthetic oligonucleotide
  Target: ATXN1; (+) strand; PAM type: NRG; PAM sequence: GGG
aggctgtagagttcaacact

SEQ ID NO: 113129 - DNA, 20 bp, Artificial Sequence
  Description of Artificial Sequence: Synthetic oligonucleotide
  Target: ATXN1; (+) strand; PAM type: NRG; PAM sequence: GAG
tgggcttcttcctactttat

SEQ ID NO: 113130 - DNA, 20 bp, Artificial Sequence
  Description of Artificial Sequence: Synthetic oligonucleotide
  Target: ATXN1; (+) strand; PAM type: NRG; PAM sequence: AGG
gggcttcttcctactttatg

SEQ ID NO: 113131 - DNA, 20 bp, Artificial Sequence
  Description of Artificial Sequence: Synthetic oligonucleotide
  Target: ATXN1; (+) strand; PAM type: NRG; PAM sequence: CAG
ctactttatgaggttataca

SEQ ID NO: 113132 - DNA, 20 bp, Artificial Sequence
  Description of Artificial Sequence: Synthetic oligonucleotide
  Target: ATXN1; (+) strand; PAM type: NRG; PAM sequence: AGG
tactttatgaggttatacac

SEQ ID NO: 113133 - DNA, 20 bp, Artificial Sequence
  Description of Artificial Sequence: Synthetic oligonucleotide
  Target: ATXN1; (+) strand; PAM type: NRG; PAM sequence: AAG
atgaggttatacacaggttc

SEQ ID NO: 113134 - DNA, 20 bp, Artificial Sequence
  Description of Artificial Sequence: Synthetic oligonucleotide
  Target: ATXN1; (+) strand; PAM type: NRG; PAM sequence: AGG
tgaggttatacacaggttca

SEQ ID NO: 113135 - DNA, 20 bp, Artificial Sequence
  Description of Artificial Sequence: Synthetic oligonucleotide
  Target: ATXN1; (+) strand; PAM type: NRG; PAM sequence: GGG
gaggttatacacaggttcaa

SEQ ID NO: 113136 - DNA, 20 bp, Artificial Sequence
  Description of Artificial Sequence: Synthetic oligonucleotide
  Target: ATXN1; (+) strand; PAM type: NRG; PAM sequence: GAG
ttatacacaggttcaagggt

SEQ ID NO: 113137 - DNA, 20 bp, Artificial Sequence
  Description of Artificial Sequence: Synthetic oligonucleotide
  Target: ATXN1; (+) strand; PAM type: NRG; PAM sequence: AGG
tatacacaggttcaagggtg

SEQ ID NO: 113138 - DNA, 20 bp, Artificial Sequence
  Description of Artificial Sequence: Synthetic oligonucleotide
  Target: ATXN1; (+) strand; PAM type: NRG; PAM sequence: GGG
atacacaggttcaagggtga

SEQ ID NO: 113139 - DNA, 20 bp, Artificial Sequence
  Description of Artificial Sequence: Synthetic oligonucleotide
  Target: ATXN1; (+) strand; PAM type: NRG; PAM sequence: AAG
caggttcaagggtgagggta

SEQ ID NO: 113140 - DNA, 20 bp, Artificial Sequence
  Description of Artificial Sequence: Synthetic oligonucleotide
  Target: ATXN1; (+) strand; PAM type: NRG; PAM sequence: AAG
tcaagggtgagggtaaagac

SEQ ID NO: 113141 - DNA, 20 bp, Artificial Sequence
  Description of Artificial Sequence: Synthetic oligonucleotide
  Target: ATXN1; (+) strand; PAM type: NRG; PAM sequence: CAG
agggtgagggtaaagacaag

SEQ ID NO: 113142 - DNA, 20 bp, Artificial Sequence
  Description of Artificial Sequence: Synthetic oligonucleotide
  Target: ATXN1; (+) strand; PAM type: NRG; PAM sequence: AGG
gggtgagggtaaagacaagc

SEQ ID NO: 113143 - DNA, 20 bp, Artificial Sequence
  Description of Artificial Sequence: Synthetic oligonucleotide
  Target: ATXN1; (+) strand; PAM type: NRG; PAM sequence: CAG
agggtaaagacaagcaggtg

SEQ ID NO: 113144 - DNA, 20 bp, Artificial Sequence
  Description of Artificial Sequence: Synthetic oligonucleotide
  Target: ATXN1; (+) strand; PAM type: NRG; PAM sequence: GAG
ggtaaagacaagcaggtgca

SEQ ID NO: 113145 - DNA, 20 bp, Artificial Sequence
  Description of Artificial Sequence: Synthetic oligonucleotide
  Target: ATXN1; (+) strand; PAM type: NRG; PAM sequence: CGG
agcaggtgcagagtttcaca

SEQ ID NO: 113146 - DNA, 20 bp, Artificial Sequence
  Description of Artificial Sequence: Synthetic oligonucleotide
  Target: ATXN1; (+) strand; PAM type: NRG; PAM sequence: GGG
gcaggtgcagagtttcacac

SEQ ID NO: 113147 - DNA, 20 bp, Artificial Sequence
  Description of Artificial Sequence: Synthetic oligonucleotide
  Target: ATXN1; (+) strand; PAM type: NRG; PAM sequence: GAG
aggtgcagagtttcacacgg

SEQ ID NO: 113148 - DNA, 20 bp, Artificial Sequence
  Description of Artificial Sequence: Synthetic oligonucleotide
  Target: ATXN1; (+) strand; PAM type: NRG; PAM sequence: AGG
ggtgcagagtttcacacggg

SEQ ID NO: 113149 - DNA, 20 bp, Artificial Sequence
  Description of Artificial Sequence: Synthetic oligonucleotide
  Target: ATXN1; (+) strand; PAM type: NRG; PAM sequence: GGG
gtgcagagtttcacacggga

SEQ ID NO: 113150 - DNA, 20 bp, Artificial Sequence
  Description of Artificial Sequence: Synthetic oligonucleotide
  Target: ATXN1; (+) strand; PAM type: NRG; PAM sequence: TGG
cagagtttcacacgggaggg

SEQ ID NO: 113151 - DNA, 20 bp, Artificial Sequence
  Description of Artificial Sequence: Synthetic oligonucleotide
  Target: ATXN1; (+) strand; PAM type: NRG; PAM sequence: GGG
agagtttcacacgggagggt

SEQ ID NO: 113152 - DNA, 20 bp, Artificial Sequence
  Description of Artificial Sequence: Synthetic oligonucleotide
  Target: ATXN1; (+) strand; PAM type: NRG; PAM sequence: GGG
gagtttcacacgggagggtg

SEQ ID NO: 113153 - DNA, 20 bp, Artificial Sequence
  Description of Artificial Sequence: Synthetic oligonucleotide
  Target: ATXN1; (+) strand; PAM type: NRG; PAM sequence: GGG
agtttcacacgggagggtgg

SEQ ID NO: 113154 - DNA, 20 bp, Artificial Sequence
  Description of Artificial Sequence: Synthetic oligonucleotide
  Target: ATXN1; (+) strand; PAM type: NRG; PAM sequence: GGG
gtttcacacgggagggtggg

SEQ ID NO: 113155 - DNA, 20 bp, Artificial Sequence
  Description of Artificial Sequence: Synthetic oligonucleotide
  Target: ATXN1; (+) strand; PAM type: NRG; PAM sequence: GGG
tttcacacgggagggtgggg

SEQ ID NO: 113156 - DNA, 20 bp, Artificial Sequence
  Description of Artificial Sequence: Synthetic oligonucleotide
  Target: ATXN1; (+) strand; PAM type: NRG; PAM sequence: GGG
ttcacacgggagggtggggg

SEQ ID NO: 113157 - DNA, 20 bp, Artificial Sequence
  Description of Artificial Sequence: Synthetic oligonucleotide
  Target: ATXN1; (+) strand; PAM type: NRG; PAM sequence: GAG
cgggagggtggggggggcgt

SEQ ID NO: 113158 - DNA, 20 bp, Artificial Sequence
  Description of Artificial Sequence: Synthetic oligonucleotide
  Target: ATXN1; (+) strand; PAM type: NRG; PAM sequence: TGG
tgtgcatgcatacatatttg

SEQ ID NO: 113159 - DNA, 20 bp, Artificial Sequence
  Description of Artificial Sequence: Synthetic oligonucleotide
  Target: ATXN1; (+) strand; PAM type: NRG; PAM sequence: GGG
gtgcatgcatacatatttgt

SEQ ID NO: 113160 - DNA, 20 bp, Artificial Sequence
  Description of Artificial Sequence: Synthetic oligonucleotide
  Target: ATXN1; (+) strand; PAM type: NRG; PAM sequence: GAG
gcatgcatacatatttgtgg

SEQ ID NO: 113161 - DNA, 20 bp, Artificial Sequence
  Description of Artificial Sequence: Synthetic oligonucleotide
  Target: ATXN1; (+) strand; PAM type: NRG; PAM sequence: GAG
catacatatttgtgggagat

SEQ ID NO: 113162 - DNA, 20 bp, Artificial Sequence
  Description of Artificial Sequence: Synthetic oligonucleotide
  Target: ATXN1; (+) strand; PAM type: NRG; PAM sequence: TAG
gagatgagcgtgcatgcaaa

SEQ ID NO: 113163 - DNA, 20 bp, Artificial Sequence
  Description of Artificial Sequence: Synthetic oligonucleotide
  Target: ATXN1; (+) strand; PAM type: NRG; PAM sequence: AGG
agatgagcgtgcatgcaaat

SEQ ID NO: 113164 - DNA, 20 bp, Artificial Sequence
  Description of Artificial Sequence: Synthetic oligonucleotide
  Target: ATXN1; (+) strand; PAM type: NRG; PAM sequence: CAG
cgtgcatgcaaataggtgtg

SEQ ID NO: 113165 - DNA, 20 bp, Artificial Sequence
  Description of Artificial Sequence: Synthetic oligonucleotide
  Target: ATXN1; (+) strand; PAM type: NRG; PAM sequence: AAG
gcatgcaaataggtgtgcag

SEQ ID NO: 113166 - DNA, 20 bp, Artificial Sequence
  Description of Artificial Sequence: Synthetic oligonucleotide
  Target: ATXN1; (+) strand; PAM type: NRG; PAM sequence: GAG
gcaaataggtgtgcagaagt

SEQ ID NO: 113167 - DNA, 20 bp, Artificial Sequence
  Description of Artificial Sequence: Synthetic oligonucleotide
  Target: ATXN1; (+) strand; PAM type: NRG; PAM sequence: TGG
tgcacacaaatgcacatgtg

SEQ ID NO: 113168 - DNA, 20 bp, Artificial Sequence
  Description of Artificial Sequence: Synthetic oligonucleotide
  Target: ATXN1; (+) strand; PAM type: NRG; PAM sequence: GGG
gcacacaaatgcacatgtgt

SEQ ID NO: 113169 - DNA, 20 bp, Artificial Sequence
  Description of Artificial Sequence: Synthetic oligonucleotide
  Target: ATXN1; (+) strand; PAM type: NRG; PAM sequence: GAG
acaaatgcacatgtgtgggt

SEQ ID NO: 113170 - DNA, 20 bp, Artificial Sequence
  Description of Artificial Sequence: Synthetic oligonucleotide
  Target: ATXN1; (+) strand; PAM type: NRG; PAM sequence: AAG
gtgtgggtgagtgtgcatac

SEQ ID NO: 113171 - DNA, 20 bp, Artificial Sequence
  Description of Artificial Sequence: Synthetic oligonucleotide
  Target: ATXN1; (+) strand; PAM type: NRG; PAM sequence: CAG
tgtgcatacaagtacatgtg

SEQ ID NO: 113172 - DNA, 20 bp, Artificial Sequence
  Description of Artificial Sequence: Synthetic oligonucleotide
  Target: ATXN1; (+) strand; PAM type: NRG; PAM sequence: AGG
gtgcatacaagtacatgtgc

SEQ ID NO: 113173 - DNA, 20 bp, Artificial Sequence
  Description of Artificial Sequence: Synthetic oligonucleotide
  Target: ATXN1; (+) strand; PAM type: NRG; PAM sequence: CAG
ttgatatgcatacatgtgtg

SEQ ID NO: 113174 - DNA, 20 bp, Artificial Sequence
  Description of Artificial Sequence: Synthetic oligonucleotide
  Target: ATXN1; (+) strand; PAM type: NRG; PAM sequence: AGG
tgatatgcatacatgtgtgc

SEQ ID NO: 113175 - DNA, 20 bp, Artificial Sequence
  Description of Artificial Sequence: Synthetic oligonucleotide
  Target: ATXN1; (+) strand; PAM type: NRG; PAM sequence: GAG
gcatacatgtgtgcaggcgt

SEQ ID NO: 113176 - DNA, 20 bp, Artificial Sequence
  Description of Artificial Sequence: Synthetic oligonucleotide
  Target: ATXN1; (+) strand; PAM type: NRG; PAM sequence: CAG
tgcaggcgtgagtgtgtaca

SEQ ID NO: 113177 - DNA, 20 bp, Artificial Sequence
  Description of Artificial Sequence: Synthetic oligonucleotide
  Target: ATXN1; (+) strand; PAM type: NRG; PAM sequence: CAG
gtgagtgtgtacacagtgtg

SEQ ID NO: 113178 - DNA, 20 bp, Artificial Sequence
  Description of Artificial Sequence: Synthetic oligonucleotide
  Target: ATXN1; (+) strand; PAM type: NRG; PAM sequence: AGG
tgagtgtgtacacagtgtgc

SEQ ID NO: 113179 - DNA, 20 bp, Artificial Sequence
  Description of Artificial Sequence: Synthetic oligonucleotide
  Target: ATXN1; (+) strand; PAM type: NRG; PAM sequence: GGG
gagtgtgtacacagtgtgca

SEQ ID NO: 113180 - DNA, 20 bp, Artificial Sequence
  Description of Artificial Sequence: Synthetic oligonucleotide
  Target: ATXN1; (+) strand; PAM type: NRG; PAM sequence: GGG
agtgtgtacacagtgtgcag

SEQ ID NO: 113181 - DNA, 20 bp, Artificial Sequence
  Description of Artificial Sequence: Synthetic oligonucleotide
  Target: ATXN1; (+) strand; PAM type: NRG; PAM sequence: CAG
gtgcatgtatatgtacactg

SEQ ID NO: 113182 - DNA, 20 bp, Artificial Sequence
  Description of Artificial Sequence: Synthetic oligonucleotide
  Target: ATXN1; (+) strand; PAM type: NRG; PAM sequence: AGG
tgcatgtatatgtacactgc

SEQ ID NO: 113183 - DNA, 20 bp, Artificial Sequence
  Description of Artificial Sequence: Synthetic oligonucleotide
  Target: ATXN1; (+) strand; PAM type: NRG; PAM sequence: GGG
gcatgtatatgtacactgca

SEQ ID NO: 113184 - DNA, 20 bp, Artificial Sequence
  Description of Artificial Sequence: Synthetic oligonucleotide
  Target: ATXN1; (+) strand; PAM type: NRG; PAM sequence: GGG
catgtatatgtacactgcag

SEQ ID NO: 113185 - DNA, 20 bp, Artificial Sequence
  Description of Artificial Sequence: Synthetic oligonucleotide
  Target: ATXN1; (+) strand; PAM type: NRG; PAM sequence: TGG
tgtacactgcaggggcaata

SEQ ID NO: 113186 - DNA, 20 bp, Artificial Sequence
  Description of Artificial Sequence: Synthetic oligonucleotide
  Target: ATXN1; (+) strand; PAM type: NRG; PAM sequence: TGG
gggcaatatggaaaaaaaca

SEQ ID NO: 113187 - DNA, 20 bp, Artificial Sequence
  Description of Artificial Sequence: Synthetic oligonucleotide
  Target: ATXN1; (+) strand; PAM type: NRG; PAM sequence: CAG
aaaaaacatggaatacaatg

SEQ ID NO: 113188 - DNA, 20 bp, Artificial Sequence
  Description of Artificial Sequence: Synthetic oligonucleotide
  Target: ATXN1; (+) strand; PAM type: NRG; PAM sequence: TAG
acatggaatacaatgcagtt

SEQ ID NO: 113189 - DNA, 20 bp, Artificial Sequence
  Description of Artificial Sequence: Synthetic oligonucleotide
  Target: ATXN1; (+) strand; PAM type: NRG; PAM sequence: TGG
caatgcagtttagccacgac

SEQ ID NO: 113190 - DNA, 20 bp, Artificial Sequence
  Description of Artificial Sequence: Synthetic oligonucleotide
  Target: ATXN1; (+) strand; PAM type: NRG; PAM sequence: CAG
tgcagtttagccacgactgg

SEQ ID NO: 113191 - DNA, 20 bp, Artificial Sequence
  Description of Artificial Sequence: Synthetic oligonucleotide
  Target: ATXN1; (+) strand; PAM type: NRG; PAM sequence: AAG
tttagccacgactggcagcc

SEQ ID NO: 113192 - DNA, 20 bp, Artificial Sequence
  Description of Artificial Sequence: Synthetic oligonucleotide
  Target: ATXN1; (+) strand; PAM type: NRG; PAM sequence: AAG
ggcagccaagattgaccttt

SEQ ID NO: 113193 - DNA, 20 bp, Artificial Sequence
  Description of Artificial Sequence: Synthetic oligonucleotide
  Target: ATXN1; (+) strand; PAM type: NRG; PAM sequence: TGG
tgacctttaagcccatttca

SEQ ID NO: 113194 - DNA, 20 bp, Artificial Sequence
  Description of Artificial Sequence: Synthetic oligonucleotide
  Target: ATXN1; (+) strand; PAM type: NRG; PAM sequence: CAG
tttttattatatgccaatcc

SEQ ID NO: 113195 - DNA, 20 bp, Artificial Sequence
  Description of Artificial Sequence: Synthetic oligonucleotide
  Target: ATXN1; (+) strand; PAM type: NRG; PAM sequence: AGG
ttttattatatgccaatccc

SEQ ID NO: 113196 - DNA, 20 bp, Artificial Sequence
  Description of Artificial Sequence: Synthetic oligonucleotide
  Target: ATXN1; (+) strand; PAM type: NRG; PAM sequence: TGG
tatatgccaatcccaggacc

SEQ ID NO: 113197 - DNA, 20 bp, Artificial Sequence
  Description of Artificial Sequence: Synthetic oligonucleotide
  Target: ATXN1; (+) strand; PAM type: NRG; PAM sequence: AAG
caatcccaggacctggtgca

SEQ ID NO: 113198 - DNA, 20 bp, Artificial Sequence
  Description of Artificial Sequence: Synthetic oligonucleotide
  Target: ATXN1; (+) strand; PAM type: NRG; PAM sequence: TAG
cccaggacctggtgcaaaga

SEQ ID NO: 113199 - DNA, 20 bp, Artificial Sequence
  Description of Artificial Sequence: Synthetic oligonucleotide
  Target: ATXN1; (+) strand; PAM type: NRG; PAM sequence: CAG
ggacctggtgcaaagatagc

SEQ ID NO: 113200 - DNA, 20 bp, Artificial Sequence
  Description of Artificial Sequence: Synthetic oligonucleotide
  Target: ATXN1; (+) strand; PAM type: NRG; PAM sequence: AAG
ctggtgcaaagatagccagt

SEQ ID NO: 113201 - DNA, 20 bp, Artificial Sequence
  Description of Artificial Sequence: Synthetic oligonucleotide
  Target: ATXN1; (+) strand; PAM type: NRG; PAM sequence: AAG
gtgcaaagatagccagtaag

SEQ ID NO: 113202 - DNA, 20 bp, Artificial Sequence
  Description of Artificial Sequence: Synthetic oligonucleotide
  Target: ATXN1; (+) strand; PAM type: NRG; PAM sequence: AAG
aaagatagccagtaagaagt

SEQ ID NO: 113203 - DNA, 20 bp, Artificial Sequence
  Description of Artificial Sequence: Synthetic oligonucleotide
  Target: ATXN1; (+) strand; PAM type: NRG; PAM sequence: AAG
agtaagatcttcatcttttg

SEQ ID NO: 113204 - DNA, 20 bp, Artificial Sequence
  Description of Artificial Sequence: Synthetic oligonucleotide
  Target: ATXN1; (+) strand; PAM type: NRG; PAM sequence: AAG
cttcatcttttgaagtatat

SEQ ID NO: 113205 - DNA, 20 bp, Artificial Sequence
  Description of Artificial Sequence: Synthetic oligonucleotide
  Target: ATXN1; (+) strand; PAM type: NRG; PAM sequence: AGG
ttcatcttttgaagtatata

SEQ ID NO: 113206 - DNA, 20 bp, Artificial Sequence
  Description of Artificial Sequence: Synthetic oligonucleotide
  Target: ATXN1; (+) strand; PAM type: NRG; PAM sequence: GGG
tcatcttttgaagtatataa

SEQ ID NO: 113207 - DNA, 20 bp, Artificial Sequence
  Description of Artificial Sequence: Synthetic oligonucleotide
  Target: ATXN1; (+) strand; PAM type: NRG; PAM sequence: AAG
tttttatttgcctctgtgct

SEQ ID NO: 113208 - DNA, 20 bp, Artificial Sequence
  Description of Artificial Sequence: Synthetic oligonucleotide
  Target: ATXN1; (+) strand; PAM type: NRG; PAM sequence: AAG
ttatttgcctctgtgctaag

SEQ ID NO: 113209 - DNA, 20 bp, Artificial Sequence
  Description of Artificial Sequence: Synthetic oligonucleotide
  Target: ATXN1; (+) strand; PAM type: NRG; PAM sequence: TGG
tgcctctgtgctaagaagaa

SEQ ID NO: 113210 - DNA, 20 bp, Artificial Sequence
  Description of Artificial Sequence: Synthetic oligonucleotide
  Target: ATXN1; (+) strand; PAM type: NRG; PAM sequence: AAG
atcatattcctcttcattcc

SEQ ID NO: 113211 - DNA, 20 bp, Artificial Sequence
  Description of Artificial Sequence: Synthetic oligonucleotide
  Target: ATXN1; (+) strand; PAM type: NRG; PAM sequence: TGG
tattcctcttcattccaagt

SEQ ID NO: 113212 - DNA, 20 bp, Artificial Sequence
  Description of Artificial Sequence: Synthetic oligonucleotide
  Target: ATXN1; (+) strand; PAM type: NRG; PAM sequence: GAG
ttcctcttcattccaagttg

SEQ ID NO: 113213 - DNA, 20 bp, Artificial Sequence
  Description of Artificial Sequence: Synthetic oligonucleotide
  Target: ATXN1; (+) strand; PAM type: NRG; PAM sequence: CAG
ctcttcattccaagttggag

SEQ ID NO: 113214 - DNA, 20 bp, Artificial Sequence
  Description of Artificial Sequence: Synthetic oligonucleotide
  Target: ATXN1; (+) strand; PAM type: NRG; PAM sequence: CAG
cattccaagttggagcagaa

SEQ ID NO: 113215 - DNA, 20 bp, Artificial Sequence
  Description of Artificial Sequence: Synthetic oligonucleotide
  Target: ATXN1; (+) strand; PAM type: NRG; PAM sequence: TAG
aagttggagcagaacagcct

SEQ ID NO: 113216 - DNA, 20 bp, Artificial Sequence
  Description of Artificial Sequence: Synthetic oligonucleotide
  Target: ATXN1; (+) strand; PAM type: NRG; PAM sequence: AGG
agttggagcagaacagcctt

SEQ ID NO: 113217 - DNA, 20 bp, Artificial Sequence
  Description of Artificial Sequence: Synthetic oligonucleotide
  Target: ATXN1; (+) strand; PAM type: NRG; PAM sequence: GAG
gctgccaactgttatccttc

SEQ ID NO: 113218 - DNA, 20 bp, Artificial Sequence
  Description of Artificial Sequence: Synthetic oligonucleotide
  Target: ATXN1; (+) strand; PAM type: NRG; PAM sequence: GAG
tgccaactgttatccttcga

SEQ ID NO: 113219 - DNA, 20 bp, Artificial Sequence
  Description of Artificial Sequence: Synthetic oligonucleotide
  Target: ATXN1; (+) strand; PAM type: NRG; PAM sequence: AGG
gccaactgttatccttcgag

SEQ ID NO: 113220 - DNA, 20 bp, Artificial Sequence
  Description of Artificial Sequence: Synthetic oligonucleotide
  Target: ATXN1; (+) strand; PAM type: NRG; PAM sequence: GGG
ccaactgttatccttcgaga

SEQ ID NO: 113221 - DNA, 20 bp, Artificial Sequence
  Description of Artificial Sequence: Synthetic oligonucleotide
  Target: ATXN1; (+) strand; PAM type: NRG; PAM sequence: GAG
tcgagagggccacatatttt

SEQ ID NO: 113222 - DNA, 20 bp, Artificial Sequence
  Description of Artificial Sequence: Synthetic oligonucleotide
  Target: ATXN1; (+) strand; PAM type: NRG; PAM sequence: AGG
cgagagggccacatattttg

SEQ ID NO: 113223 - DNA, 20 bp, Artificial Sequence
  Description of Artificial Sequence: Synthetic oligonucleotide
  Target: ATXN1; (+) strand; PAM type: NRG; PAM sequence: CAG
ggccacatattttgaggttt

SEQ ID NO: 113224 - DNA, 20 bp, Artificial Sequence
  Description of Artificial Sequence: Synthetic oligonucleotide
  Target: ATXN1; (+) strand; PAM type: NRG; PAM sequence: GAG
ccacatattttgaggtttca

SEQ ID NO: 113225 - DNA, 20 bp, Artificial Sequence
  Description of Artificial Sequence: Synthetic oligonucleotide
  Target: ATXN1; (+) strand; PAM type: NRG; PAM sequence: CAG
atattttgaggtttcagaga

SEQ ID NO: 113226 - DNA, 20 bp, Artificial Sequence
  Description of Artificial Sequence: Synthetic oligonucleotide
  Target: ATXN1; (+) strand; PAM type: NRG; PAM sequence: GAG
tttgaggtttcagagacagt

SEQ ID NO: 113227 - DNA, 20 bp, Artificial Sequence
  Description of Artificial Sequence: Synthetic oligonucleotide
  Target: ATXN1; (+) strand; PAM type: NRG; PAM sequence: AGG
ttgaggtttcagagacagtg

SEQ ID NO: 113228 - DNA, 20 bp, Artificial Sequence
  Description of Artificial Sequence: Synthetic oligonucleotide
  Target: ATXN1; (+) strand; PAM type: NRG; PAM sequence: TAG
aggtttcagagacagtgagg

SEQ ID NO: 113229 - DNA, 20 bp, Artificial Sequence
  Description of Artificial Sequence: Synthetic oligonucleotide
  Target: ATXN1; (+) strand; PAM type: NRG; PAM sequence: GAG
agtgaggtagattctgcctt

SEQ ID NO: 113230 - DNA, 20 bp, Artificial Sequence
  Description of Artificial Sequence: Synthetic oligonucleotide
  Target: ATXN1; (+) strand; PAM type: NRG; PAM sequence: CAG
gattctgccttgagaaatat

SEQ ID NO: 113231 - DNA, 20 bp, Artificial Sequence
  Description of Artificial Sequence: Synthetic oligonucleotide
  Target: ATXN1; (+) strand; PAM type: NRG; PAM sequence: AAG
ttgagaaatatcagacactc

SEQ ID NO: 113232 - DNA, 20 bp, Artificial Sequence
  Description of Artificial Sequence: Synthetic oligonucleotide
  Target: ATXN1; (+) strand; PAM type: NRG; PAM sequence: CGG
tatcagacactcaagtactc

SEQ ID NO: 113233 - DNA, 20 bp, Artificial Sequence
  Description of Artificial Sequence: Synthetic oligonucleotide
  Target: ATXN1; (+) strand; PAM type: NRG; PAM sequence: GAG
aagtactccggcgacacact

SEQ ID NO: 113234 - DNA, 20 bp, Artificial Sequence
  Description of Artificial Sequence: Synthetic oligonucleotide
  Target: ATXN1; (+) strand; PAM type: NRG; PAM sequence: CAG
cactgagcaaatgtttttgc

SEQ ID NO: 113235 - DNA, 20 bp, Artificial Sequence
  Description of Artificial Sequence: Synthetic oligonucleotide
  Target: ATXN1; (+) strand; PAM type: NRG; PAM sequence: CAG
tgagcaaatgtttttgccag

SEQ ID NO: 113236 - DNA, 20 bp, Artificial Sequence
  Description of Artificial Sequence: Synthetic oligonucleotide
  Target: ATXN1; (+) strand; PAM type: NRG; PAM sequence: AAG
caaatgtttttgccagcaga

SEQ ID NO: 113237 - DNA, 20 bp, Artificial Sequence
  Description of Artificial Sequence: Synthetic oligonucleotide
  Target: ATXN1; (+) strand; PAM type: NRG; PAM sequence: TAG
tttttgccagcagaaagata

SEQ ID NO: 113238 - DNA, 20 bp, Artificial Sequence
  Description of Artificial Sequence: Synthetic oligonucleotide
  Target: ATXN1; (+) strand; PAM type: NRG; PAM sequence: AGG
ttttgccagcagaaagatat

SEQ ID NO: 113239 - DNA, 20 bp, Artificial Sequence
  Description of Artificial Sequence: Synthetic oligonucleotide
  Target: ATXN1; (+) strand; PAM type: NRG; PAM sequence: TGG
tgccagcagaaagatatagg

SEQ ID NO: 113240 - DNA, 20 bp, Artificial Sequence
  Description of Artificial Sequence: Synthetic oligonucleotide
  Target: ATXN1; (+) strand; PAM type: NRG; PAM sequence: GGG
gccagcagaaagatataggt

SEQ ID NO: 113241 - DNA, 20 bp, Artificial Sequence
  Description of Artificial Sequence: Synthetic oligonucleotide
  Target: ATXN1; (+) strand; PAM type: NRG; PAM sequence: TGG
agatataggtgggttcaccg

SEQ ID NO: 113242 - DNA, 20 bp, Artificial Sequence
  Description of Artificial Sequence: Synthetic oligonucleotide
  Target: ATXN1; (+) strand; PAM type: NRG; PAM sequence: CAG
taggtgggttcaccgtggcg

SEQ ID NO: 113243 - DNA, 20 bp, Artificial Sequence
  Description of Artificial Sequence: Synthetic oligonucleotide
  Target: ATXN1; (+) strand; PAM type: NRG; PAM sequence: AGG
aggtgggttcaccgtggcgc

SEQ ID NO: 113244 - DNA, 20 bp, Artificial Sequence
  Description of Artificial Sequence: Synthetic oligonucleotide
  Target: ATXN1; (+) strand; PAM type: NRG; PAM sequence: GAG
gggttcaccgtggcgcaggt

SEQ ID NO: 113245 - DNA, 20 bp, Artificial Sequence
  Description of Artificial Sequence: Synthetic oligonucleotide
  Target: ATXN1; (+) strand; PAM type: NRG; PAM sequence: AGG
ggttcaccgtggcgcaggtg

SEQ ID NO: 113246 - DNA, 20 bp, Artificial Sequence
  Description of Artificial Sequence: Synthetic oligonucleotide
  Target: ATXN1; (+) strand; PAM type: NRG; PAM sequence: GGG
gttcaccgtggcgcaggtga

SEQ ID NO: 113247 - DNA, 20 bp, Artificial Sequence
  Description of Artificial Sequence: Synthetic oligonucleotide
  Target: ATXN1; (+) strand; PAM type: NRG; PAM sequence: GAG
tcaccgtggcgcaggtgagg

SEQ ID NO: 113248 - DNA, 20 bp, Artificial Sequence
  Description of Artificial Sequence: Synthetic oligonucleotide
  Target: ATXN1; (+) strand; PAM type: NRG; PAM sequence: GAG
accgtggcgcaggtgaggga

SEQ ID NO: 113249 - DNA, 20 bp, Artificial Sequence
  Description of Artificial Sequence: Synthetic oligonucleotide
  Target: ATXN1; (+) strand; PAM type: NRG; PAM sequence: AGG
ccgtggcgcaggtgagggag

SEQ ID NO: 113250 - DNA, 20 bp, Artificial Sequence
  Description of Artificial Sequence: Synthetic oligonucleotide
  Target: ATXN1; (+) strand; PAM type: NRG; PAM sequence: AAG
tggcgcaggtgagggagagg

SEQ ID NO: 113251 - DNA, 20 bp, Artificial Sequence
  Description of Artificial Sequence: Synthetic oligonucleotide
  Target: ATXN1; (+) strand; PAM type: NRG; PAM sequence: CAG
gagggagaggaagctgtgca

SEQ ID NO: 113252 - DNA, 20 bp, Artificial Sequence
  Description of Artificial Sequence: Synthetic oligonucleotide
  Target: ATXN1; (+) strand; PAM type: NRG; PAM sequence: AAG
gagaggaagctgtgcacagt

SEQ ID NO: 113253 - DNA, 20 bp, Artificial Sequence
  Description of Artificial Sequence: Synthetic oligonucleotide
  Target: ATXN1; (+) strand; PAM type: NRG; PAM sequence: CAG
taagcgcactttctcttctc

SEQ ID NO: 113254 - DNA, 20 bp, Artificial Sequence
  Description of Artificial Sequence: Synthetic oligonucleotide
  Target: ATXN1; (+) strand; PAM type: NRG; PAM sequence: TGG
tttctcttctccagacatcc

SEQ ID NO: 113255 - DNA, 20 bp, Artificial Sequence
  Description of Artificial Sequence: Synthetic oligonucleotide
  Target: ATXN1; (+) strand; PAM type: NRG; PAM sequence: CAG
ctccagacatcctggtgcca

SEQ ID NO: 113256 - DNA, 20 bp, Artificial Sequence
  Description of Artificial Sequence: Synthetic oligonucleotide
  Target: ATXN1; (+) strand; PAM type: NRG; PAM sequence: TAG
cagacatcctggtgccacag

SEQ ID NO: 113257 - DNA, 20 bp, Artificial Sequence
  Description of Artificial Sequence: Synthetic oligonucleotide
  Target: ATXN1; (+) strand; PAM type: NRG; PAM sequence: AAG
tctcctcttctgtaacttct

SEQ ID NO: 113258 - DNA, 20 bp, Artificial Sequence
  Description of Artificial Sequence: Synthetic oligonucleotide
  Target: ATXN1; (+) strand; PAM type: NRG; PAM sequence: AAG
acttctaagacctttgcctt

SEQ ID NO: 113259 - DNA, 20 bp, Artificial Sequence
  Description of Artificial Sequence: Synthetic oligonucleotide
  Target: ATXN1; (+) strand; PAM type: NRG; PAM sequence: TGG
agacctttgccttaagtgaa

SEQ ID NO: 113260 - DNA, 20 bp, Artificial Sequence
  Description of Artificial Sequence: Synthetic oligonucleotide
  Target: ATXN1; (+) strand; PAM type: NRG; PAM sequence: AAG
ttaagtgaatggatcctcct

SEQ ID NO: 113261 - DNA, 20 bp, Artificial Sequence
  Description of Artificial Sequence: Synthetic oligonucleotide
  Target: ATXN1; (+) strand; PAM type: NRG; PAM sequence: CAG
gtgaatggatcctcctaaga

SEQ ID NO: 113262 - DNA, 20 bp, Artificial Sequence
  Description of Artificial Sequence: Synthetic oligonucleotide
  Target: ATXN1; (+) strand; PAM type: NRG; PAM sequence: AAG
tccctgctctttgacttgaa

SEQ ID NO: 113263 - DNA, 20 bp, Artificial Sequence
  Description of Artificial Sequence: Synthetic oligonucleotide
  Target: ATXN1; (+) strand; PAM type: NRG; PAM sequence: TGG
ttgaaaagttcaccctttct

SEQ ID NO: 113264 - DNA, 20 bp, Artificial Sequence
  Description of Artificial Sequence: Synthetic oligonucleotide
  Target: ATXN1; (+) strand; PAM type: NRG; PAM sequence: GAG
gaaaagttcaccctttcttg

SEQ ID NO: 113265 - DNA, 20 bp, Artificial Sequence
  Description of Artificial Sequence: Synthetic oligonucleotide
  Target: ATXN1; (+) strand; PAM type: NRG; PAM sequence: GAG
aaagttcaccctttcttgga

SEQ ID NO: 113266 - DNA, 20 bp, Artificial Sequence
  Description of Artificial Sequence: Synthetic oligonucleotide
  Target: ATXN1; (+) strand; PAM type: NRG; PAM sequence: GAG
agttcaccctttcttggaga

SEQ ID NO: 113267 - DNA, 20 bp, Artificial Sequence
  Description of Artificial Sequence: Synthetic oligonucleotide
  Target: ATXN1; (+) strand; PAM type: NRG; PAM sequence: GAG
ttcaccctttcttggagaga

SEQ ID NO: 113268 - DNA, 20 bp, Artificial Sequence
  Description of Artificial Sequence: Synthetic oligonucleotide
  Target: ATXN1; (+) strand; PAM type: NRG; PAM sequence: TGG
ctttcttggagagagagact

SEQ ID NO: 113269 - DNA, 20 bp, Artificial Sequence
  Description of Artificial Sequence: Synthetic oligonucleotide
  Target: ATXN1; (+) strand; PAM type: NRG; PAM sequence: AAG
ttggagagagagacttggaa

SEQ ID NO: 113270 - DNA, 20 bp, Artificial Sequence
  Description of Artificial Sequence: Synthetic oligonucleotide
  Target: ATXN1; (+) strand; PAM type: NRG; PAM sequence: GAG
ggagagagagacttggaaaa

SEQ ID NO: 113271 - DNA, 20 bp, Artificial Sequence
  Description of Artificial Sequence: Synthetic oligonucleotide
  Target: ATXN1; (+) strand; PAM type: NRG; PAM sequence: GAG
agagagagacttggaaaaga

SEQ ID NO: 113272 - DNA, 20 bp, Artificial Sequence
  Description of Artificial Sequence: Synthetic oligonucleotide
  Target: ATXN1; (+) strand; PAM type: NRG; PAM sequence: AGG
gagagagacttggaaaagag

SEQ ID NO: 113273 - DNA, 20 bp, Artificial Sequence
  Description of Artificial Sequence: Synthetic oligonucleotide
  Target: ATXN1; (+) strand; PAM type: NRG; PAM sequence: AAG
acttggaaaagagaggcatg

SEQ ID NO: 113274 - DNA, 20 bp, Artificial Sequence
  Description of Artificial Sequence: Synthetic oligonucleotide
  Target: ATXN1; (+) strand; PAM type: NRG; PAM sequence: AGG
cttggaaaagagaggcatga

SEQ ID NO: 113275 - DNA, 20 bp, Artificial Sequence
  Description of Artificial Sequence: Synthetic oligonucleotide
  Target: ATXN1; (+) strand; PAM type: NRG; PAM sequence: GGG
ttggaaaagagaggcatgaa

SEQ ID NO: 113276 - DNA, 20 bp, Artificial Sequence
  Description of Artificial Sequence: Synthetic oligonucleotide
  Target: ATXN1; (+) strand; PAM type: NRG; PAM sequence: AAG
agagaggcatgaagggtctc

SEQ ID NO: 113277 - DNA, 20 bp, Artificial Sequence
  Description of Artificial Sequence: Synthetic oligonucleotide
  Target: ATXN1; (+) strand; PAM type: NRG; PAM sequence: TGG
gcatgaagggtctcaagccc

SEQ ID NO: 113278 - DNA, 20 bp, Artificial Sequence
  Description of Artificial Sequence: Synthetic oligonucleotide
  Target: ATXN1; (+) strand; PAM type: NRG; PAM sequence: CAG
aagccctggcaattctgcct

SEQ ID NO: 113279 - DNA, 20 bp, Artificial Sequence
  Description of Artificial Sequence: Synthetic oligonucleotide
  Target: ATXN1; (+) strand; PAM type: NRG; PAM sequence: CAG
gaatccgacttctacctcca

SEQ ID NO: 113280 - DNA, 20 bp, Artificial Sequence
  Description of Artificial Sequence: Synthetic oligonucleotide
  Target: ATXN1; (+) strand; PAM type: NRG; PAM sequence: TAG
cctccacagtgaaatctccc

SEQ ID NO: 113281 - DNA, 20 bp, Artificial Sequence
  Description of Artificial Sequence: Synthetic oligonucleotide
  Target: ATXN1; (+) strand; PAM type: NRG; PAM sequence: TAG
cacagtgaaatctccctagc

SEQ ID NO: 113282 - DNA, 20 bp, Artificial Sequence
  Description of Artificial Sequence: Synthetic oligonucleotide
  Target: ATXN1; (+) strand; PAM type: NRG; PAM sequence: GAG
tgaaatctccctagctagtt

SEQ ID NO: 113283 - DNA, 20 bp, Artificial Sequence
  Description of Artificial Sequence: Synthetic oligonucleotide
  Target: ATXN1; (+) strand; PAM type: NRG; PAM sequence: AGG
gaaatctccctagctagttg

SEQ ID NO: 113284 - DNA, 20 bp, Artificial Sequence
  Description of Artificial Sequence: Synthetic oligonucleotide
  Target: ATXN1; (+) strand; PAM type: NRG; PAM sequence: GGG
aaatctccctagctagttga

SEQ ID NO: 113285 - DNA, 20 bp, Artificial Sequence
  Description of Artificial Sequence: Synthetic oligonucleotide
  Target: ATXN1; (+) strand; PAM type: NRG; PAM sequence: GGG
aatctccctagctagttgag

SEQ ID NO: 113286 - DNA, 20 bp, Artificial Sequence
  Description of Artificial Sequence: Synthetic oligonucleotide
  Target: ATXN1; (+) strand; PAM type: NRG; PAM sequence: CAG
ctccctagctagttgagggg

SEQ ID NO: 113287 - DNA, 20 bp, Artificial Sequence
  Description of Artificial Sequence: Synthetic oligonucleotide
  Target: ATXN1; (+) strand; PAM type: NRG; PAM sequence: CAG
cctagctagttgaggggcag

SEQ ID NO: 113288 - DNA, 20 bp, Artificial Sequence
  Description of Artificial Sequence: Synthetic oligonucleotide
  Target: ATXN1; (+) strand; PAM type: NRG; PAM sequence: AAG
agtattaattgttccttcct

SEQ ID NO: 113289 - DNA, 20 bp, Artificial Sequence
  Description of Artificial Sequence: Synthetic oligonucleotide
  Target: ATXN1; (+) strand; PAM type: NRG; PAM sequence: GAG
tattaattgttccttcctaa

SEQ ID NO: 113290 - DNA, 20 bp, Artificial Sequence
  Description of Artificial Sequence: Synthetic oligonucleotide
  Target: ATXN1; (+) strand; PAM type: NRG; PAM sequence: AAG
gttccttcctaagagttgtc

SEQ ID NO: 113291 - DNA, 20 bp, Artificial Sequence
  Description of Artificial Sequence: Synthetic oligonucleotide
  Target: ATXN1; (+) strand; PAM type: NRG; PAM sequence: GAG
gttgtcaagcaaatcaacct

SEQ ID NO: 113292 - DNA, 20 bp, Artificial Sequence
  Description of Artificial Sequence: Synthetic oligonucleotide
  Target: ATXN1; (+) strand; PAM type: NRG; PAM sequence: TGG
aagcaaatcaacctgagaac

SEQ ID NO: 113293 - DNA, 20 bp, Artificial Sequence
  Description of Artificial Sequence: Synthetic oligonucleotide
  Target: ATXN1; (+) strand; PAM type: NRG; PAM sequence: AAG
ctgagaactggaatccaccc

SEQ ID NO: 113294 - DNA, 20 bp, Artificial Sequence
  Description of Artificial Sequence: Synthetic oligonucleotide
  Target: ATXN1; (+) strand; PAM type: NRG; PAM sequence: AAG
cacctatgccttttacaata

SEQ ID NO: 113295 - DNA, 20 bp, Artificial Sequence
  Description of Artificial Sequence: Synthetic oligonucleotide
  Target: ATXN1; (+) strand; PAM type: NRG; PAM sequence: CAG
tgccttttacaataaagatt

SEQ ID NO: 113296 - DNA, 20 bp, Artificial Sequence
  Description of Artificial Sequence: Synthetic oligonucleotide
  Target: ATXN1; (+) strand; PAM type: NRG; PAM sequence: AAG
tttacaataaagattcagtg

SEQ ID NO: 113297 - DNA, 20 bp, Artificial Sequence
  Description of Artificial Sequence: Synthetic oligonucleotide
  Target: ATXN1; (+) strand; PAM type: NRG; PAM sequence: CAG
aagaatcctgcccttcacaa

SEQ ID NO: 113298 - DNA, 20 bp, Artificial Sequence
  Description of Artificial Sequence: Synthetic oligonucleotide
  Target: ATXN1; (+) strand; PAM type: NRG; PAM sequence: AAG
cccttcacaacagcctcctc

SEQ ID NO: 113299 - DNA, 20 bp, Artificial Sequence
  Description of Artificial Sequence: Synthetic oligonucleotide
  Target: ATXN1; (+) strand; PAM type: NRG; PAM sequence: TAG
ttcacaacagcctcctcaag

SEQ ID NO: 113300 - DNA, 20 bp, Artificial Sequence
  Description of Artificial Sequence: Synthetic oligonucleotide
  Target: ATXN1; (+) strand; PAM type: NRG; PAM sequence: AGG
tcacaacagcctcctcaagt

SEQ ID NO: 113301 - DNA, 20 bp, Artificial Sequence
  Description of Artificial Sequence: Synthetic oligonucleotide
  Target: ATXN1; (+) strand; PAM type: NRG; PAM sequence: GGG
cacaacagcctcctcaagta

SEQ ID NO: 113302 - DNA, 20 bp, Artificial Sequence
  Description of Artificial Sequence: Synthetic oligonucleotide
  Target: ATXN1; (+) strand; PAM type: NRG; PAM sequence: TGG
agggaaaacgctacaaaaaa

SEQ ID NO: 113303 - DNA, 20 bp, Artificial Sequence
  Description of Artificial Sequence: Synthetic oligonucleotide
  Target: ATXN1; (+) strand; PAM type: NRG; PAM sequence: CAG
aaaaatggatacatgacaac

SEQ ID NO: 113304 - DNA, 20 bp, Artificial Sequence
  Description of Artificial Sequence: Synthetic oligonucleotide
  Target: ATXN1; (+) strand; PAM type: NRG; PAM sequence: AGG
aaaatggatacatgacaacc

SEQ ID NO: 113305 - DNA, 20 bp, Artificial Sequence
  Description of Artificial Sequence: Synthetic oligonucleotide
  Target: ATXN1; (+) strand; PAM type: NRG; PAM sequence: CAG
accaggaactccttcaccca

SEQ ID NO: 113306 - DNA, 20 bp, Artificial Sequence
  Description of Artificial Sequence: Synthetic oligonucleotide
  Target: ATXN1; (+) strand; PAM type: NRG; PAM sequence: GAG
caggaactccttcacccaca

SEQ ID NO: 113307 - DNA, 20 bp, Artificial Sequence
  Description of Artificial Sequence: Synthetic oligonucleotide
  Target: ATXN1; (+) strand; PAM type: NRG; PAM sequence: GAG
ggaactccttcacccacaga

SEQ ID NO: 113308 - DNA, 20 bp, Artificial Sequence
  Description of Artificial Sequence: Synthetic oligonucleotide
  Target: ATXN1; (+) strand; PAM type: NRG; PAM sequence: TGG
tgccatctgttttcccaacc

SEQ ID NO: 113309 - DNA, 20 bp, Artificial Sequence
  Description of Artificial Sequence: Synthetic oligonucleotide
  Target: ATXN1; (+) strand; PAM type: NRG; PAM sequence: GGG
gccatctgttttcccaacct

SEQ ID NO: 113310 - DNA, 20 bp, Artificial Sequence
  Description of Artificial Sequence: Synthetic oligonucleotide
  Target: ATXN1; (+) strand; PAM type: NRG; PAM sequence: TGG
tttcccaacctgggccaatg

SEQ ID NO: 113311 - DNA, 20 bp, Artificial Sequence
  Description of Artificial Sequence: Synthetic oligonucleotide
  Target: ATXN1; (+) strand; PAM type: NRG; PAM sequence: CAG
gggccaatgtggtctaattt

SEQ ID NO: 113312 - DNA, 20 bp, Artificial Sequence
  Description of Artificial Sequence: Synthetic oligonucleotide
  Target: ATXN1; (+) strand; PAM type: NRG; PAM sequence: AAG
cagttctttcatattttcac

SEQ ID NO: 113313 - DNA, 20 bp, Artificial Sequence
  Description of Artificial Sequence: Synthetic oligonucleotide
  Target: ATXN1; (+) strand; PAM type: NRG; PAM sequence: CAG
tctttcatattttcacaagt

SEQ ID NO: 113314 - DNA, 20 bp, Artificial Sequence
  Description of Artificial Sequence: Synthetic oligonucleotide
  Target: ATXN1; (+) strand; PAM type: NRG; PAM sequence: GAG
tttcatattttcacaagtca

SEQ ID NO: 113315 - DNA, 20 bp, Artificial Sequence
  Description of Artificial Sequence: Synthetic oligonucleotide
  Target: ATXN1; (+) strand; PAM type: NRG; PAM sequence: AGG
ttcatattttcacaagtcag

SEQ ID NO: 113316 - DNA, 20 bp, Artificial Sequence
  Description of Artificial Sequence: Synthetic oligonucleotide
  Target: ATXN1; (+) strand; PAM type: NRG; PAM sequence: GGG
tcatattttcacaagtcaga

SEQ ID NO: 113317 - DNA, 20 bp, Artificial Sequence
  Description of Artificial Sequence: Synthetic oligonucleotide
  Target: ATXN1; (+) strand; PAM type: NRG; PAM sequence: CAG
ttcacaagtcagagggaaac

SEQ ID NO: 113318 - DNA, 20 bp, Artificial Sequence
  Description of Artificial Sequence: Synthetic oligonucleotide
  Target: ATXN1; (+) strand; PAM type: NRG; PAM sequence: AGG
tcacaagtcagagggaaacc

SEQ ID NO: 113319 - DNA, 20 bp, Artificial Sequence
  Description of Artificial Sequence: Synthetic oligonucleotide
  Target: ATXN1; (+) strand; PAM type: NRG; PAM sequence: AAG
gagggaaaccaggaatctta

SEQ ID NO: 113320 - DNA, 20 bp, Artificial Sequence
  Description of Artificial Sequence: Synthetic oligonucleotide
  Target: ATXN1; (+) strand; PAM type: NRG; PAM sequence: AGG
agggaaaccaggaatcttaa

SEQ ID NO: 113321 - DNA, 20 bp, Artificial Sequence
  Description of Artificial Sequence: Synthetic oligonucleotide
  Target: ATXN1; (+) strand; PAM type: NRG; PAM sequence: AAG
cttaaaggtttactactgaa

SEQ ID NO: 113322 - DNA, 20 bp, Artificial Sequence
  Description of Artificial Sequence: Synthetic oligonucleotide
  Target: ATXN1; (+) strand; PAM type: NRG; PAM sequence: CAG
actgaaaagcactttatttt

SEQ ID NO: 113323 - DNA, 20 bp, Artificial Sequence
  Description of Artificial Sequence: Synthetic oligonucleotide
  Target: ATXN1; (+) strand; PAM type: NRG; PAM sequence: AAG
aaaagcactttattttcagt

SEQ ID NO: 113324 - DNA, 20 bp, Artificial Sequence
  Description of Artificial Sequence: Synthetic oligonucleotide
  Target: ATXN1; (+) strand; PAM type: NRG; PAM sequence: AGG
aaagcactttattttcagta

SEQ ID NO: 113325 - DNA, 20 bp, Artificial Sequence
  Description of Artificial Sequence: Synthetic oligonucleotide
  Target: ATXN1; (+) strand; PAM type: NRG; PAM sequence: TAG
cagtaaggtgctttaaaaaa

SEQ ID NO: 113326 - DNA, 20 bp, Artificial Sequence
  Description of Artificial Sequence: Synthetic oligonucleotide
  Target: ATXN1; (+) strand; PAM type: NRG; PAM sequence: CAG
ttgtcatatctgatctgatt

SEQ ID NO: 113327 - DNA, 20 bp, Artificial Sequence
  Description of Artificial Sequence: Synthetic oligonucleotide
  Target: ATXN1; (+) strand; PAM type: NRG; PAM sequence: AGG
tgtcatatctgatctgattc

SEQ ID NO: 113328 - DNA, 20 bp, Artificial Sequence
  Description of Artificial Sequence: Synthetic oligonucleotide
  Target: ATXN1; (+) strand; PAM type: NRG; PAM sequence: AAG
atatctgatctgattcaggt

SEQ ID NO: 113329 - DNA, 20 bp, Artificial Sequence
  Description of Artificial Sequence: Synthetic oligonucleotide
  Target: ATXN1; (+) strand; PAM type: NRG; PAM sequence: CAG
ctgattcaggtaagaaattt

SEQ ID NO: 113330 - DNA, 20 bp, Artificial Sequence
  Description of Artificial Sequence: Synthetic oligonucleotide
  Target: ATXN1; (+) strand; PAM type: NRG; PAM sequence: AAG
ttcaggtaagaaatttcaga

SEQ ID NO: 113331 - DNA, 20 bp, Artificial Sequence
  Description of Artificial Sequence: Synthetic oligonucleotide
  Target: ATXN1; (+) strand; PAM type: NRG; PAM sequence: AGG
tcaggtaagaaatttcagaa

SEQ ID NO: 113332 - DNA, 20 bp, Artificial Sequence
  Description of Artificial Sequence: Synthetic oligonucleotide
  Target: ATXN1; (+) strand; PAM type: NRG; PAM sequence: GGG
caggtaagaaatttcagaaa

SEQ ID NO: 113333 - DNA, 20 bp, Artificial Sequence
  Description of Artificial Sequence: Synthetic oligonucleotide
  Target: ATXN1; (+) strand; PAM type: NRG; PAM sequence: TAG
aaatttcagaaagggaactc

SEQ ID NO: 113334 - DNA, 20 bp, Artificial Sequence
  Description of Artificial Sequence: Synthetic oligonucleotide
  Target: ATXN1; (+) strand; PAM type: NRG; PAM sequence: AAG
tctagaattcatttttcata

SEQ ID NO: 113335 - DNA, 20 bp, Artificial Sequence
  Description of Artificial Sequence: Synthetic oligonucleotide
  Target: ATXN1; (+) strand; PAM type: NRG; PAM sequence: AGG
ctagaattcatttttcataa

SEQ ID NO: 113336 - DNA, 20 bp, Artificial Sequence
  Description of Artificial Sequence: Synthetic oligonucleotide
  Target: ATXN1; (+) strand; PAM type: NRG; PAM sequence: GGG
tagaattcatttttcataaa

SEQ ID NO: 113337 - DNA, 20 bp, Artificial Sequence
  Description of Artificial Sequence: Synthetic oligonucleotide
  Target: ATXN1; (+) strand; PAM type: NRG; PAM sequence: CAG
attcatttttcataaaggga

SEQ ID NO: 113338 - DNA, 20 bp, Artificial Sequence
  Description of Artificial Sequence: Synthetic oligonucleotide
  Target: ATXN1; (+) strand; PAM type: NRG; PAM sequence: CAG
atttttcataaagggacagt

SEQ ID NO: 113339 - DNA, 20 bp, Artificial Sequence
  Description of Artificial Sequence: Synthetic oligonucleotide
  Target: ATXN1; (+) strand; PAM type: NRG; PAM sequence: TGG
tttcataaagggacagtcag

SEQ ID NO: 113340 - DNA, 20 bp, Artificial Sequence
  Description of Artificial Sequence: Synthetic oligonucleotide
  Target: ATXN1; (+) strand; PAM type: NRG; PAM sequence: TAG
taaagggacagtcagtggaa

SEQ ID NO: 113341 - DNA, 20 bp, Artificial Sequence
  Description of Artificial Sequence: Synthetic oligonucleotide
  Target: ATXN1; (+) strand; PAM type: NRG; PAM sequence: GAG
aagggacagtcagtggaata

SEQ ID NO: 113342 - DNA, 20 bp, Artificial Sequence
  Description of Artificial Sequence: Synthetic oligonucleotide
  Target: ATXN1; (+) strand; PAM type: NRG; PAM sequence: CAG
cagtcagtggaatagagcac

SEQ ID NO: 113343 - DNA, 20 bp, Artificial Sequence
  Description of Artificial Sequence: Synthetic oligonucleotide
  Target: ATXN1; (+) strand; PAM type: NRG; PAM sequence: AGG
agtcagtggaatagagcacc

SEQ ID NO: 113344 - DNA, 20 bp, Artificial Sequence
  Description of Artificial Sequence: Synthetic oligonucleotide
  Target: ATXN1; (+) strand; PAM type: NRG; PAM sequence: GGG
gtcagtggaatagagcacca

SEQ ID NO: 113345 - DNA, 20 bp, Artificial Sequence
  Description of Artificial Sequence: Synthetic oligonucleotide
  Target: ATXN1; (+) strand; PAM type: NRG; PAM sequence: GGG
tcagtggaatagagcaccag

SEQ ID NO: 113346 - DNA, 20 bp, Artificial Sequence
  Description of Artificial Sequence: Synthetic oligonucleotide
  Target: ATXN1; (+) strand; PAM type: NRG; PAM sequence: TAG
gtggaatagagcaccagggg

SEQ ID NO: 113347 - DNA, 20 bp, Artificial Sequence
  Description of Artificial Sequence: Synthetic oligonucleotide
  Target: ATXN1; (+) strand; PAM type: NRG; PAM sequence: AGG
tggaatagagcaccaggggt

SEQ ID NO: 113348 - DNA, 20 bp, Artificial Sequence
  Description of Artificial Sequence: Synthetic oligonucleotide
  Target: ATXN1; (+) strand; PAM type: NRG; PAM sequence: GGG
ggaatagagcaccaggggta

SEQ ID NO: 113349 - DNA, 20 bp, Artificial Sequence
  Description of Artificial Sequence: Synthetic oligonucleotide
  Target: ATXN1; (+) strand; PAM type: NRG; PAM sequence: GGG
gaatagagcaccaggggtag

SEQ ID NO: 113350 - DNA, 20 bp, Artificial Sequence
  Description of Artificial Sequence: Synthetic oligonucleotide
  Target: ATXN1; (+) strand; PAM type: NRG; PAM sequence: GGG
aatagagcaccaggggtagg

SEQ ID NO: 113351 - DNA, 20 bp, Artificial Sequence
  Description of Artificial Sequence: Synthetic oligonucleotide
  Target: ATXN1; (+) strand; PAM type: NRG; PAM sequence: GAG
tagagcaccaggggtagggg

SEQ ID NO: 113352 - DNA, 20 bp, Artificial Sequence
  Description of Artificial Sequence: Synthetic oligonucleotide
  Target: ATXN1; (+) strand; PAM type: NRG; PAM sequence: TAG
tctgaatacatttcacttgt

SEQ ID NO: 113353 - DNA, 20 bp, Artificial Sequence
  Description of Artificial Sequence: Synthetic oligonucleotide
  Target: ATXN1; (+) strand; PAM type: NRG; PAM sequence: CAG
acatttcacttgttagccat

SEQ ID NO: 113354 - DNA, 20 bp, Artificial Sequence
  Description of Artificial Sequence: Synthetic oligonucleotide
  Target: ATXN1; (+) strand; PAM type: NRG; PAM sequence: AGG
catttcacttgttagccatc

SEQ ID NO: 113355 - DNA, 20 bp, Artificial Sequence
  Description of Artificial Sequence: Synthetic oligonucleotide
  Target: ATXN1; (+) strand; PAM type: NRG; PAM sequence: TAG
gccatcaggtctgaaaactg

SEQ ID NO: 113356 - DNA, 20 bp, Artificial Sequence
  Description of Artificial Sequence: Synthetic oligonucleotide
  Target: ATXN1; (+) strand; PAM type: NRG; PAM sequence: TGG
aggtctgaaaactgtagtgc

SEQ ID NO: 113357 - DNA, 20 bp, Artificial Sequence
  Description of Artificial Sequence: Synthetic oligonucleotide
  Target: ATXN1; (+) strand; PAM type: NRG; PAM sequence: CAG
actgtagtgctggctctgtt

SEQ ID NO: 113358 - DNA, 20 bp, Artificial Sequence
  Description of Artificial Sequence: Synthetic oligonucleotide
  Target: ATXN1; (+) strand; PAM type: NRG; PAM sequence: AAG
gctctgttcagttattgttc

SEQ ID NO: 113359 - DNA, 20 bp, Artificial Sequence
  Description of Artificial Sequence: Synthetic oligonucleotide
  Target: ATXN1; (+) strand; PAM type: NRG; PAM sequence: CAG
tcttctttgtcattttgcat

SEQ ID NO: 113360 - DNA, 20 bp, Artificial Sequence
  Description of Artificial Sequence: Synthetic oligonucleotide
  Target: ATXN1; (+) strand; PAM type: NRG; PAM sequence: AGG
cttctttgtcattttgcatc

SEQ ID NO: 113361 - DNA, 20 bp, Artificial Sequence
  Description of Artificial Sequence: Synthetic oligonucleotide
  Target: ATXN1; (+) strand; PAM type: NRG; PAM sequence: CGG
tcactttgttcccatcctca

SEQ ID NO: 113362 - DNA, 20 bp, Artificial Sequence
  Description of Artificial Sequence: Synthetic oligonucleotide
  Target: ATXN1; (+) strand; PAM type: NRG; PAM sequence: AAG
ctcacggccttctactacgc

SEQ ID NO: 113363 - DNA, 20 bp, Artificial Sequence
  Description of Artificial Sequence: Synthetic oligonucleotide
  Target: ATXN1; (+) strand; PAM type: NRG; PAM sequence: AGG
tcacggccttctactacgca

SEQ ID NO: 113364 - DNA, 20 bp, Artificial Sequence
  Description of Artificial Sequence: Synthetic oligonucleotide
  Target: ATXN1; (+) strand; PAM type: NRG; PAM sequence: AAG
aaggtctcatgatataaatg

SEQ ID NO: 113365 - DNA, 20 bp, Artificial Sequence
  Description of Artificial Sequence: Synthetic oligonucleotide
  Target: ATXN1; (+) strand; PAM type: NRG; PAM sequence: AGG
aggtctcatgatataaatga

SEQ ID NO: 113366 - DNA, 20 bp, Artificial Sequence
  Description of Artificial Sequence: Synthetic oligonucleotide
  Target: ATXN1; (+) strand; PAM type: NRG; PAM sequence: CAG
aggttatcttcttttccttc

SEQ ID NO: 113367 - DNA, 20 bp, Artificial Sequence
  Description of Artificial Sequence: Synthetic oligonucleotide
  Target: ATXN1; (+) strand; PAM type: NRG; PAM sequence: CAG
cttccagtcactcctcttta

SEQ ID NO: 113368 - DNA, 20 bp, Artificial Sequence
  Description of Artificial Sequence: Synthetic oligonucleotide
  Target: ATXN1; (+) strand; PAM type: NRG; PAM sequence: GAG
cagaaatctcctacataatt

SEQ ID NO: 113369 - DNA, 20 bp, Artificial Sequence
  Description of Artificial Sequence: Synthetic oligonucleotide
  Target: ATXN1; (+) strand; PAM type: NRG; PAM sequence: CAG
attgagatgctgtcatcaat

SEQ ID NO: 113370 - DNA, 20 bp, Artificial Sequence
  Description of Artificial Sequence: Synthetic oligonucleotide
  Target: ATXN1; (+) strand; PAM type: NRG; PAM sequence: AAG
catcaatcagtcaaccaacc

SEQ ID NO: 113371 - DNA, 20 bp, Artificial Sequence
  Description of Artificial Sequence: Synthetic oligonucleotide
  Target: ATXN1; (+) strand; PAM type: NRG; PAM sequence: TGG
accaaccaagccccctgaac

SEQ ID NO: 113372 - DNA, 20 bp, Artificial Sequence
  Description of Artificial Sequence: Synthetic oligonucleotide
  Target: ATXN1; (+) strand; PAM type: NRG; PAM sequence: GGG
ccaaccaagccccctgaact

SEQ ID NO: 113373 - DNA, 20 bp, Artificial Sequence
  Description of Artificial Sequence: Synthetic oligonucleotide
  Target: ATXN1; (+) strand; PAM type: NRG; PAM sequence: CAG
actgggtccttgtgatgttc

SEQ ID NO: 113374 - DNA, 20 bp, Artificial Sequence
  Description of Artificial Sequence: Synthetic oligonucleotide
  Target: ATXN1; (+) strand; PAM type: NRG; PAM sequence: AGG
ctgggtccttgtgatgttcc

SEQ ID NO: 113375 - DNA, 20 bp, Artificial Sequence
  Description of Artificial Sequence: Synthetic oligonucleotide
  Target: ATXN1; (+) strand; PAM type: NRG; PAM sequence: GGG
tgggtccttgtgatgttcca

SEQ ID NO: 113376 - DNA, 20 bp, Artificial Sequence
  Description of Artificial Sequence: Synthetic oligonucleotide
  Target: ATXN1; (+) strand; PAM type: NRG; PAM sequence: GGG
gggtccttgtgatgttccag

SEQ ID NO: 113377 - DNA, 20 bp, Artificial Sequence
  Description of Artificial Sequence: Synthetic oligonucleotide
  Target: ATXN1; (+) strand; PAM type: NRG; PAM sequence: AAG
tgttccaggggtttaattac

SEQ ID NO: 113378 - DNA, 20 bp, Artificial Sequence
  Description of Artificial Sequence: Synthetic oligonucleotide
  Target: ATXN1; (+) strand; PAM type: NRG; PAM sequence: AGG
gttccaggggtttaattaca

SEQ ID NO: 113379 - DNA, 20 bp, Artificial Sequence
  Description of Artificial Sequence: Synthetic oligonucleotide
  Target: ATXN1; (+) strand; PAM type: NRG; PAM sequence: TAG
ggtttaattacaaggaatgc

SEQ ID NO: 113380 - DNA, 20 bp, Artificial Sequence
  Description of Artificial Sequence: Synthetic oligonucleotide
  Target: ATXN1; (+) strand; PAM type: NRG; PAM sequence: CAG
aatgctagctcctaacatct

SEQ ID NO: 113381 - DNA, 20 bp, Artificial Sequence
  Description of Artificial Sequence: Synthetic oligonucleotide
  Target: ATXN1; (+) strand; PAM type: NRG; PAM sequence: TGG
tcctaacatctcagatacca

SEQ ID NO: 113382 - DNA, 20 bp, Artificial Sequence
  Description of Artificial Sequence: Synthetic oligonucleotide
  Target: ATXN1; (+) strand; PAM type: NRG; PAM sequence: GGG
cctaacatctcagataccat

SEQ ID NO: 113383 - DNA, 20 bp, Artificial Sequence
  Description of Artificial Sequence: Synthetic oligonucleotide
  Target: ATXN1; (+) strand; PAM type: NRG; PAM sequence: AAG
tctcagataccatgggctcg

SEQ ID NO: 113384 - DNA, 20 bp, Artificial Sequence
  Description of Artificial Sequence: Synthetic oligonucleotide
  Target: ATXN1; (+) strand; PAM type: NRG; PAM sequence: TAG
agacttgtaacatgtgatat

SEQ ID NO: 113385 - DNA, 20 bp, Artificial Sequence
  Description of Artificial Sequence: Synthetic oligonucleotide
  Target: ATXN1; (+) strand; PAM type: NRG; PAM sequence: AGG
gacttgtaacatgtgatatt

SEQ ID NO: 113386 - DNA, 20 bp, Artificial Sequence
  Description of Artificial Sequence: Synthetic oligonucleotide
  Target: ATXN1; (+) strand; PAM type: NRG; PAM sequence: GGG
acttgtaacatgtgatatta

SEQ ID NO: 113387 - DNA, 20 bp, Artificial Sequence
  Description of Artificial Sequence: Synthetic oligonucleotide
  Target: ATXN1; (+) strand; PAM type: NRG; PAM sequence: CAG
tgtaacatgtgatattaggg

SEQ ID NO: 113388 - DNA, 20 bp, Artificial Sequence
  Description of Artificial Sequence: Synthetic oligonucleotide
  Target: ATXN1; (+) strand; PAM type: NRG; PAM sequence: TGG
atgtgatattagggcagcaa

SEQ ID NO: 113389 - DNA, 20 bp, Artificial Sequence
  Description of Artificial Sequence: Synthetic oligonucleotide
  Target: ATXN1; (+) strand; PAM type: NRG; PAM sequence: TGG
gcagcaatggtttcctctac

SEQ ID NO: 113390 - DNA, 20 bp, Artificial Sequence
  Description of Artificial Sequence: Synthetic oligonucleotide
  Target: ATXN1; (+) strand; PAM type: NRG; PAM sequence: CGG
aatggtttcctctactggtc

SEQ ID NO: 113391 - DNA, 20 bp, Artificial Sequence
  Description of Artificial Sequence: Synthetic oligonucleotide
  Target: ATXN1; (+) strand; PAM type: NRG; PAM sequence: GGG
atggtttcctctactggtcc

SEQ ID NO: 113392 - DNA, 20 bp, Artificial Sequence
  Description of Artificial Sequence: Synthetic oligonucleotide
  Target: ATXN1; (+) strand; PAM type: NRG; PAM sequence: TGG
tcctctactggtccgggatt

SEQ ID NO: 113393 - DNA, 20 bp, Artificial Sequence
  Description of Artificial Sequence: Synthetic oligonucleotide
  Target: ATXN1; (+) strand; PAM type: NRG; PAM sequence: GGG
cctctactggtccgggattt

SEQ ID NO: 113394 - DNA, 20 bp, Artificial Sequence
  Description of Artificial Sequence: Synthetic oligonucleotide
  Target: ATXN1; (+) strand; PAM type: NRG; PAM sequence: GGG
ctctactggtccgggatttg

SEQ ID NO: 113395 - DNA, 20 bp, Artificial Sequence
  Description of Artificial Sequence: Synthetic oligonucleotide
  Target: ATXN1; (+) strand; PAM type: NRG; PAM sequence: TAG
tggtccgggatttggggttt

SEQ ID NO: 113396 - DNA, 20 bp, Artificial Sequence
  Description of Artificial Sequence: Synthetic oligonucleotide
  Target: ATXN1; (+) strand; PAM type: NRG; PAM sequence: AGG
ggtccgggatttggggtttt

SEQ ID NO: 113397 - DNA, 20 bp, Artificial Sequence
  Description of Artificial Sequence: Synthetic oligonucleotide
  Target: ATXN1; (+) strand; PAM type: NRG; PAM sequence: GGG
gtccgggatttggggtttta

SEQ ID NO: 113398 - DNA, 20 bp, Artificial Sequence
  Description of Artificial Sequence: Synthetic oligonucleotide
  Target: ATXN1; (+) strand; PAM type: NRG; PAM sequence: GGG
tccgggatttggggttttag

SEQ ID NO: 113399 - DNA, 20 bp, Artificial Sequence
  Description of Artificial Sequence: Synthetic oligonucleotide
  Target: ATXN1; (+) strand; PAM type: NRG; PAM sequence: CAG
ggttttaggggctctcttca

SEQ ID NO: 113400 - DNA, 20 bp, Artificial Sequence
  Description of Artificial Sequence: Synthetic oligonucleotide
  Target: ATXN1; (+) strand; PAM type: NRG; PAM sequence: GAG
taggggctctcttcacagat

SEQ ID NO: 113401 - DNA, 20 bp, Artificial Sequence
  Description of Artificial Sequence: Synthetic oligonucleotide
  Target: ATXN1; (+) strand; PAM type: NRG; PAM sequence: GAG
ggggctctcttcacagatga

SEQ ID NO: 113402 - DNA, 20 bp, Artificial Sequence
  Description of Artificial Sequence: Synthetic oligonucleotide
  Target: ATXN1; (+) strand; PAM type: NRG; PAM sequence: CAG
tcacagatgagagaattttg

SEQ ID NO: 113403 - DNA, 20 bp, Artificial Sequence
  Description of Artificial Sequence: Synthetic oligonucleotide
  Target: ATXN1; (+) strand; PAM type: NRG; PAM sequence: TGG
attttgcagcttcttgccac

SEQ ID NO: 113404 - DNA, 20 bp, Artificial Sequence
  Description of Artificial Sequence: Synthetic oligonucleotide
  Target: ATXN1; (+) strand; PAM type: NRG; PAM sequence: CAG
ctggctgcaatgacgctccc

SEQ ID NO: 113405 - DNA, 20 bp, Artificial Sequence
  Description of Artificial Sequence: Synthetic oligonucleotide
  Target: ATXN1; (+) strand; PAM type: NRG; PAM sequence: GAG
ctgcaatgacgctccccagt

SEQ ID NO: 113406 - DNA, 20 bp, Artificial Sequence
  Description of Artificial Sequence: Synthetic oligonucleotide
  Target: ATXN1; (+) strand; PAM type: NRG; PAM sequence: AGG
tgcaatgacgctccccagtg

SEQ ID NO: 113407 - DNA, 20 bp, Artificial Sequence
  Description of Artificial Sequence: Synthetic oligonucleotide
  Target: ATXN1; (+) strand; PAM type: NRG; PAM sequence: TGG
aatgacgctccccagtgagg

SEQ ID NO: 113408 - DNA, 20 bp, Artificial Sequence
  Description of Artificial Sequence: Synthetic oligonucleotide
  Target: ATXN1; (+) strand; PAM type: NRG; PAM sequence: GAG
tgacgctccccagtgaggtg

SEQ ID NO: 113409 - DNA, 20 bp, Artificial Sequence
  Description of Artificial Sequence: Synthetic oligonucleotide
  Target: ATXN1; (+) strand; PAM type: NRG; PAM sequence: AGG
gacgctccccagtgaggtgg

SEQ ID NO: 113410 - DNA, 20 bp, Artificial Sequence
  Description of Artificial Sequence: Synthetic oligonucleotide
  Target: ATXN1; (+) strand; PAM type: NRG; PAM sequence: TAG
tccccagtgaggtggaggcc

SEQ ID NO: 113411 - DNA, 20 bp, Artificial Sequence
  Description of Artificial Sequence: Synthetic oligonucleotide
  Target: ATXN1; (+) strand; PAM type: NRG; PAM sequence: GAG
cccagtgaggtggaggccta

SEQ ID NO: 113412 - DNA, 20 bp, Artificial Sequence
  Description of Artificial Sequence: Synthetic oligonucleotide
  Target: ATXN1; (+) strand; PAM type: NRG; PAM sequence: GAG
cagtgaggtggaggcctaga

SEQ ID NO: 113413 - DNA, 20 bp, Artificial Sequence
  Description of Artificial Sequence: Synthetic oligonucleotide
  Target: ATXN1; (+) strand; PAM type: NRG; PAM sequence: GAG
gtgaggtggaggcctagaga

SEQ ID NO: 113414 - DNA, 20 bp, Artificial Sequence
  Description of Artificial Sequence: Synthetic oligonucleotide
  Target: ATXN1; (+) strand; PAM type: NRG; PAM sequence: AGG
tgaggtggaggcctagagag

SEQ ID NO: 113415 - DNA, 20 bp, Artificial Sequence
  Description of Artificial Sequence: Synthetic oligonucleotide
  Target: ATXN1; (+) strand; PAM type: NRG; PAM sequence: GGG
gaggtggaggcctagagaga

SEQ ID NO: 113416 - DNA, 20 bp, Artificial Sequence
  Description of Artificial Sequence: Synthetic oligonucleotide
  Target: ATXN1; (+) strand; PAM type: NRG; PAM sequence: GGG
aggtggaggcctagagagag

SEQ ID NO: 113417 - DNA, 20 bp, Artificial Sequence
  Description of Artificial Sequence: Synthetic oligonucleotide
  Target: ATXN1; (+) strand; PAM type: NRG; PAM sequence: GAG
gtggaggcctagagagaggg

SEQ ID NO: 113418 - DNA, 20 bp, Artificial Sequence
  Description of Artificial Sequence: Synthetic oligonucleotide
  Target: ATXN1; (+) strand; PAM type: NRG; PAM sequence: AGG
tggaggcctagagagagggg

SEQ ID NO: 113419 - DNA, 20 bp, Artificial Sequence
  Description of Artificial Sequence: Synthetic oligonucleotide
  Target: ATXN1; (+) strand; PAM type: NRG; PAM sequence: GGG
ggaggcctagagagagggga

SEQ ID NO: 113420 - DNA, 20 bp, Artificial Sequence
  Description of Artificial Sequence: Synthetic oligonucleotide
  Target: ATXN1; (+) strand; PAM type: NRG; PAM sequence: AAG
gagagaggggagggtgactt

SEQ ID NO: 113421 - DNA, 20 bp, Artificial Sequence
  Description of Artificial Sequence: Synthetic oligonucleotide
  Target: ATXN1; (+) strand; PAM type: NRG; PAM sequence: AGG
agagaggggagggtgactta

SEQ ID NO: 113422 - DNA, 20 bp, Artificial Sequence
  Description of Artificial Sequence: Synthetic oligonucleotide
  Target: ATXN1; (+) strand; PAM type: NRG; PAM sequence: TGG
gaggggagggtgacttaagg

SEQ ID NO: 113423 - DNA, 20 bp, Artificial Sequence
  Description of Artificial Sequence: Synthetic oligonucleotide
  Target: ATXN1; (+) strand; PAM type: NRG; PAM sequence: GGG
aggggagggtgacttaaggt

SEQ ID NO: 113424 - DNA, 20 bp, Artificial Sequence
  Description of Artificial Sequence: Synthetic oligonucleotide
  Target: ATXN1; (+) strand; PAM type: NRG; PAM sequence: CAG
ggagggtgacttaaggtggg

SEQ ID NO: 113425 - DNA, 20 bp, Artificial Sequence
  Description of Artificial Sequence: Synthetic oligonucleotide
  Target: ATXN1; (+) strand; PAM type: NRG; PAM sequence: AGG
gagggtgacttaaggtgggc

SEQ ID NO: 113426 - DNA, 20 bp, Artificial Sequence
  Description of Artificial Sequence: Synthetic oligonucleotide
  Target: ATXN1; (+) strand; PAM type: NRG; PAM sequence: GGG
agggtgacttaaggtgggca

SEQ ID NO: 113427 - DNA, 20 bp, Artificial Sequence
  Description of Artificial Sequence: Synthetic oligonucleotide
  Target: ATXN1; (+) strand; PAM type: NRG; PAM sequence: TAG
gacttaaggtgggcagggcc

SEQ ID NO: 113428 - DNA, 20 bp, Artificial Sequence
  Description of Artificial Sequence: Synthetic oligonucleotide
  Target: ATXN1; (+) strand; PAM type: NRG; PAM sequence: CAG
gcagggcctagccttgatta

SEQ ID NO: 113429 - DNA, 20 bp, Artificial Sequence
  Description of Artificial Sequence: Synthetic oligonucleotide
  Target: ATXN1; (+) strand; PAM type: NRG; PAM sequence: AGG
cagggcctagccttgattac

SEQ ID NO: 113430 - DNA, 20 bp, Artificial Sequence
  Description of Artificial Sequence: Synthetic oligonucleotide
  Target: ATXN1; (+) strand; PAM type: NRG; PAM sequence: AAG
agccttgattacaggctctc

SEQ ID NO: 113431 - DNA, 20 bp, Artificial Sequence
  Description of Artificial Sequence: Synthetic oligonucleotide
  Target: ATXN1; (+) strand; PAM type: NRG; PAM sequence: AGG
gccttgattacaggctctca

SEQ ID NO: 113432 - DNA, 20 bp, Artificial Sequence
  Description of Artificial Sequence: Synthetic oligonucleotide
  Target: ATXN1; (+) strand; PAM type: NRG; PAM sequence: CGG
aggctctcaaggattaacct

SEQ ID NO: 113433 - DNA, 20 bp, Artificial Sequence
  Description of Artificial Sequence: Synthetic oligonucleotide
  Target: ATXN1; (+) strand; PAM type: NRG; PAM sequence: GGG
ggctctcaaggattaacctc

SEQ ID NO: 113434 - DNA, 20 bp, Artificial Sequence
  Description of Artificial Sequence: Synthetic oligonucleotide
  Target: ATXN1; (+) strand; PAM type: NRG; PAM sequence: GAG
ctctcaaggattaacctcgg

SEQ ID NO: 113435 - DNA, 20 bp, Artificial Sequence
  Description of Artificial Sequence: Synthetic oligonucleotide
  Target: ATXN1; (+) strand; PAM type: NRG; PAM sequence: AGG
tctcaaggattaacctcggg

SEQ ID NO: 113436 - DNA, 20 bp, Artificial Sequence
  Description of Artificial Sequence: Synthetic oligonucleotide
  Target: ATXN1; (+) strand; PAM type: NRG; PAM sequence: CAG
aaggattaacctcgggagga

SEQ ID NO: 113437 - DNA, 20 bp, Artificial Sequence
  Description of Artificial Sequence: Synthetic oligonucleotide
  Target: ATXN1; (+) strand; PAM type: NRG; PAM sequence: GAG
ggattaacctcgggaggaca

SEQ ID NO: 113438 - DNA, 20 bp, Artificial Sequence
  Description of Artificial Sequence: Synthetic oligonucleotide
  Target: ATXN1; (+) strand; PAM type: NRG; PAM sequence: GAG
attaacctcgggaggacaga

SEQ ID NO: 113439 - DNA, 20 bp, Artificial Sequence
  Description of Artificial Sequence: Synthetic oligonucleotide
  Target: ATXN1; (+) strand; PAM type: NRG; PAM sequence: AGG
ttaacctcgggaggacagag

SEQ ID NO: 113440 - DNA, 20 bp, Artificial Sequence
  Description of Artificial Sequence: Synthetic oligonucleotide
  Target: ATXN1; (+) strand; PAM type: NRG; PAM sequence: GAG
aacctcgggaggacagagag

SEQ ID NO: 113441 - DNA, 20 bp, Artificial Sequence
  Description of Artificial Sequence: Synthetic oligonucleotide
  Target: ATXN1; (+) strand; PAM type: NRG; PAM sequence: GAG
cctcgggaggacagagagga

SEQ ID NO: 113442 - DNA, 20 bp, Artificial Sequence
  Description of Artificial Sequence: Synthetic oligonucleotide
  Target: ATXN1; (+) strand; PAM type: NRG; PAM sequence: AAG
cgggaggacagagaggagag

SEQ ID NO: 113443 - DNA, 20 bp, Artificial Sequence
  Description of Artificial Sequence: Synthetic oligonucleotide
  Target: ATXN1; (+) strand; PAM type: NRG; PAM sequence: AAG
ggacagagaggagagaagac

SEQ ID NO: 113444 - DNA, 20 bp, Artificial Sequence
  Description of Artificial Sequence: Synthetic oligonucleotide
  Target: ATXN1; (+) strand; PAM type: NRG; PAM sequence: AGG
gacagagaggagagaagaca

SEQ ID NO: 113445 - DNA, 20 bp, Artificial Sequence
  Description of Artificial Sequence: Synthetic oligonucleotide
  Target: ATXN1; (+) strand; PAM type: NRG; PAM sequence: AAG
agaggagagaagacaaggtg

SEQ ID NO: 113446 - DNA, 20 bp, Artificial Sequence
  Description of Artificial Sequence: Synthetic oligonucleotide
  Target: ATXN1; (+) strand; PAM type: NRG; PAM sequence: GAG
aagacaaggtgaagctttgt

SEQ ID NO: 113447 - DNA, 20 bp, Artificial Sequence
  Description of Artificial Sequence: Synthetic oligonucleotide
  Target: ATXN1; (+) strand; PAM type: NRG; PAM sequence: TGG
acaaggtgaagctttgtgag

SEQ ID NO: 113448 - DNA, 20 bp, Artificial Sequence
  Description of Artificial Sequence: Synthetic oligonucleotide
  Target: ATXN1; (+) strand; PAM type: NRG; PAM sequence: CAG
ggtgaagctttgtgagtgga

SEQ ID NO: 113449 - DNA, 20 bp, Artificial Sequence
  Description of Artificial Sequence: Synthetic oligonucleotide
  Target: ATXN1; (+) strand; PAM type: NRG; PAM sequence: AAG
gagtggacagaaattaaata

SEQ ID NO: 113450 - DNA, 20 bp, Artificial Sequence
  Description of Artificial Sequence: Synthetic oligonucleotide
  Target: ATXN1; (+) strand; PAM type: NRG; PAM sequence: AGG
agtggacagaaattaaataa

SEQ ID NO: 113451 - DNA, 20 bp, Artificial Sequence
  Description of Artificial Sequence: Synthetic oligonucleotide
  Target: ATXN1; (+) strand; PAM type: NRG; PAM sequence: GGG
gtggacagaaattaaataaa

SEQ ID NO: 113452 - DNA, 20 bp, Artificial Sequence
  Description of Artificial Sequence: Synthetic oligonucleotide
  Target: ATXN1; (+) strand; PAM type: NRG; PAM sequence: GGG
tggacagaaattaaataaag

SEQ ID NO: 113453 - DNA, 20 bp, Artificial Sequence
  Description of Artificial Sequence: Synthetic oligonucleotide
  Target: ATXN1; (+) strand; PAM type: NRG; PAM sequence: AAG
aattaaataaaggggtttcc

SEQ ID NO: 113454 - DNA, 20 bp, Artificial Sequence
  Description of Artificial Sequence: Synthetic oligonucleotide
  Target: ATXN1; (+) strand; PAM type: NRG; PAM sequence: AAG
aataaaggggtttccaagtt

SEQ ID NO: 113455 - DNA, 20 bp, Artificial Sequence
  Description of Artificial Sequence: Synthetic oligonucleotide
  Target: ATXN1; (+) strand; PAM type: NRG; PAM sequence: CAG
aggggtttccaagttaagta

SEQ ID NO: 113456 - DNA, 20 bp, Artificial Sequence
  Description of Artificial Sequence: Synthetic oligonucleotide
  Target: ATXN1; (+) strand; PAM type: NRG; PAM sequence: TGG
caagttaagtacagtgctcc

SEQ ID NO: 113457 - DNA, 20 bp, Artificial Sequence
  Description of Artificial Sequence: Synthetic oligonucleotide
  Target: ATXN1; (+) strand; PAM type: NRG; PAM sequence: GAG
agttaagtacagtgctcctg

SEQ ID NO: 113458 - DNA, 20 bp, Artificial Sequence
  Description of Artificial Sequence: Synthetic oligonucleotide
  Target: ATXN1; (+) strand; PAM type: NRG; PAM sequence: AAG
taagtacagtgctcctggag

SEQ ID NO: 113459 - DNA, 20 bp, Artificial Sequence
  Description of Artificial Sequence: Synthetic oligonucleotide
  Target: ATXN1; (+) strand; PAM type: NRG; PAM sequence: AAG
tacagtgctcctggagaagc

SEQ ID NO: 113460 - DNA, 20 bp, Artificial Sequence
  Description of Artificial Sequence: Synthetic oligonucleotide
  Target: ATXN1; (+) strand; PAM type: NRG; PAM sequence: TGG
gtgctcctggagaagcaagt

SEQ ID NO: 113461 - DNA, 20 bp, Artificial Sequence
  Description of Artificial Sequence: Synthetic oligonucleotide
  Target: ATXN1; (+) strand; PAM type: NRG; PAM sequence: GAG
gctcctggagaagcaagttg

SEQ ID NO: 113462 - DNA, 20 bp, Artificial Sequence
  Description of Artificial Sequence: Synthetic oligonucleotide
  Target: ATXN1; (+) strand; PAM type: NRG; PAM sequence: AGG
ctcctggagaagcaagttgg

SEQ ID NO: 113463 - DNA, 20 bp, Artificial Sequence
  Description of Artificial Sequence: Synthetic oligonucleotide
  Target: ATXN1; (+) strand; PAM type: NRG; PAM sequence: TGG
agaagcaagttggaggctgc

SEQ ID NO: 113464 - DNA, 20 bp, Artificial Sequence
  Description of Artificial Sequence: Synthetic oligonucleotide
  Target: ATXN1; (+) strand; PAM type: NRG; PAM sequence: CAG
tggtatcatgcatacacatg

SEQ ID NO: 113465 - DNA, 20 bp, Artificial Sequence
  Description of Artificial Sequence: Synthetic oligonucleotide
  Target: ATXN1; (+) strand; PAM type: NRG; PAM sequence: AGG
ggtatcatgcatacacatgc

SEQ ID NO: 113466 - DNA, 20 bp, Artificial Sequence
  Description of Artificial Sequence: Synthetic oligonucleotide
  Target: ATXN1; (+) strand; PAM type: NRG; PAM sequence: TAG
catacacatgcaggactatt

SEQ ID NO: 113467 - DNA, 20 bp, Artificial Sequence
  Description of Artificial Sequence: Synthetic oligonucleotide
  Target: ATXN1; (+) strand; PAM type: NRG; PAM sequence: TGG
acacatgcaggactatttag

SEQ ID NO: 113468 - DNA, 20 bp, Artificial Sequence
  Description of Artificial Sequence: Synthetic oligonucleotide
  Target: ATXN1; (+) strand; PAM type: NRG; PAM sequence: TGG
attattctgatcacaaacaa

SEQ ID NO: 113469 - DNA, 20 bp, Artificial Sequence
  Description of Artificial Sequence: Synthetic oligonucleotide
  Target: ATXN1; (+) strand; PAM type: NRG; PAM sequence: CAG
ttttatgcatcatttatctt

SEQ ID NO: 113470 - DNA, 20 bp, Artificial Sequence
  Description of Artificial Sequence: Synthetic oligonucleotide
  Target: ATXN1; (+) strand; PAM type: NRG; PAM sequence: GAG
ttatgcatcatttatcttca

SEQ ID NO: 113471 - DNA, 20 bp, Artificial Sequence
  Description of Artificial Sequence: Synthetic oligonucleotide
  Target: ATXN1; (+) strand; PAM type: NRG; PAM sequence: GAG
atgcatcatttatcttcaga

SEQ ID NO: 113472 - DNA, 20 bp, Artificial Sequence
  Description of Artificial Sequence: Synthetic oligonucleotide
  Target: ATXN1; (+) strand; PAM type: NRG; PAM sequence: GAG
tcttcagagagtgtctatct

SEQ ID NO: 113473 - DNA, 20 bp, Artificial Sequence
  Description of Artificial Sequence: Synthetic oligonucleotide
  Target: ATXN1; (+) strand; PAM type: NRG; PAM sequence: AAG
gtgtctatctgagctgcttg

SEQ ID NO: 113474 - DNA, 20 bp, Artificial Sequence
  Description of Artificial Sequence: Synthetic oligonucleotide
  Target: ATXN1; (+) strand; PAM type: NRG; PAM sequence: TGG
cttgaagcaaacgaaactta

SEQ ID NO: 113475 - DNA, 20 bp, Artificial Sequence
  Description of Artificial Sequence: Synthetic oligonucleotide
  Target: ATXN1; (+) strand; PAM type: NRG; PAM sequence: TGG
agcaaacgaaacttatggat

SEQ ID NO: 113476 - DNA, 20 bp, Artificial Sequence
  Description of Artificial Sequence: Synthetic oligonucleotide
  Target: ATXN1; (+) strand; PAM type: NRG; PAM sequence: TAG
acgaaacttatggattggac

SEQ ID NO: 113477 - DNA, 20 bp, Artificial Sequence
  Description of Artificial Sequence: Synthetic oligonucleotide
  Target: ATXN1; (+) strand; PAM type: NRG; PAM sequence: GAG
atggattggactagccttac

SEQ ID NO: 113478 - DNA, 20 bp, Artificial Sequence
  Description of Artificial Sequence: Synthetic oligonucleotide
  Target: ATXN1; (+) strand; PAM type: NRG; PAM sequence: TAG
gactagccttacgagaatgc

SEQ ID NO: 113479 - DNA, 20 bp, Artificial Sequence
  Description of Artificial Sequence: Synthetic oligonucleotide
  Target: ATXN1; (+) strand; PAM type: NRG; PAM sequence: CAG
ccttacgagaatgctagttt

SEQ ID NO: 113480 - DNA, 20 bp, Artificial Sequence
  Description of Artificial Sequence: Synthetic oligonucleotide
  Target: ATXN1; (+) strand; PAM type: NRG; PAM sequence: GAG
ttacgagaatgctagtttca

SEQ ID NO: 113481 - DNA, 20 bp, Artificial Sequence
  Description of Artificial Sequence: Synthetic oligonucleotide
  Target: ATXN1; (+) strand; PAM type: NRG; PAM sequence: TGG
gaatgctagtttcagagcta

SEQ ID NO: 113482 - DNA, 20 bp, Artificial Sequence
  Description of Artificial Sequence: Synthetic oligonucleotide
  Target: ATXN1; (+) strand; PAM type: NRG; PAM sequence: TAG
cagagctatggctgtgccta

SEQ ID NO: 113483 - DNA, 20 bp, Artificial Sequence
  Description of Artificial Sequence: Synthetic oligonucleotide
  Target: ATXN1; (+) strand; PAM type: NRG; PAM sequence: CAG
agctatggctgtgcctatag

SEQ ID NO: 113484 - DNA, 20 bp, Artificial Sequence
  Description of Artificial Sequence: Synthetic oligonucleotide
  Target: ATXN1; (+) strand; PAM type: NRG; PAM sequence: TAG
gctgtgcctatagcagtttg

SEQ ID NO: 113485 - DNA, 20 bp, Artificial Sequence
  Description of Artificial Sequence: Synthetic oligonucleotide
  Target: ATXN1; (+) strand; PAM type: NRG; PAM sequence: AGG
ctgtgcctatagcagtttgt

SEQ ID NO: 113486 - DNA, 20 bp, Artificial Sequence
  Description of Artificial Sequence: Synthetic oligonucleotide
  Target: ATXN1; (+) strand; PAM type: NRG; PAM sequence: AAG
ttgtaggaatttattatata

SEQ ID NO: 113487 - DNA, 20 bp, Artificial Sequence
  Description of Artificial Sequence: Synthetic oligonucleotide
  Target: ATXN1; (+) strand; PAM type: NRG; PAM sequence: TGG
ataaagtccttttaacccct

SEQ ID NO: 113488 - DNA, 20 bp, Artificial Sequence
  Description of Artificial Sequence: Synthetic oligonucleotide
  Target: ATXN1; (+) strand; PAM type: NRG; PAM sequence: GAG
aaagtccttttaaccccttg

SEQ ID NO: 113489 - DNA, 20 bp, Artificial Sequence
  Description of Artificial Sequence: Synthetic oligonucleotide
  Target: ATXN1; (+) strand; PAM type: NRG; PAM sequence: CAG
cttcgcatcacatgatcctc

SEQ ID NO: 113490 - DNA, 20 bp, Artificial Sequence
  Description of Artificial Sequence: Synthetic oligonucleotide
  Target: ATXN1; (+) strand; PAM type: NRG; PAM sequence: AGG
ttcgcatcacatgatcctcc

SEQ ID NO: 113491 - DNA, 20 bp, Artificial Sequence
  Description of Artificial Sequence: Synthetic oligonucleotide
  Target: ATXN1; (+) strand; PAM type: NRG; PAM sequence: AAG
gatcctccaggtaatcctat

SEQ ID NO: 113492 - DNA, 20 bp, Artificial Sequence
  Description of Artificial Sequence: Synthetic oligonucleotide
  Target: ATXN1; (+) strand; PAM type: NRG; PAM sequence: TGG
tccaggtaatcctataagac

SEQ ID NO: 113493 - DNA, 20 bp, Artificial Sequence
  Description of Artificial Sequence: Synthetic oligonucleotide
  Target: ATXN1; (+) strand; PAM type: NRG; PAM sequence: AAG
aggtaatcctataagactgg

SEQ ID NO: 113494 - DNA, 20 bp, Artificial Sequence
  Description of Artificial Sequence: Synthetic oligonucleotide
  Target: ATXN1; (+) strand; PAM type: NRG; PAM sequence: CAG
atcctataagactggaagaa

SEQ ID NO: 113495 - DNA, 20 bp, Artificial Sequence
  Description of Artificial Sequence: Synthetic oligonucleotide
  Target: ATXN1; (+) strand; PAM type: NRG; PAM sequence: AGG
tcctataagactggaagaac

SEQ ID NO: 113496 - DNA, 20 bp, Artificial Sequence
  Description of Artificial Sequence: Synthetic oligonucleotide
  Target: ATXN1; (+) strand; PAM type: NRG; PAM sequence: AAG
actggaagaacaggtgtgaa

SEQ ID NO: 113497 - DNA, 20 bp, Artificial Sequence
  Description of Artificial Sequence: Synthetic oligonucleotide
  Target: ATXN1; (+) strand; PAM type: NRG; PAM sequence: AAG
tgaaaagaccatgtcttatc

SEQ ID NO: 113498 - DNA, 20 bp, Artificial Sequence
  Description of Artificial Sequence: Synthetic oligonucleotide
  Target: ATXN1; (+) strand; PAM type: NRG; PAM sequence: CAG
gaccatgtcttatcaagacc

SEQ ID NO: 113499 - DNA, 20 bp, Artificial Sequence
  Description of Artificial Sequence: Synthetic oligonucleotide
  Target: ATXN1; (+) strand; PAM type: NRG; PAM sequence: TGG
catgtcttatcaagacccag

SEQ ID NO: 113500 - DNA, 20 bp, Artificial Sequence
  Description of Artificial Sequence: Synthetic oligonucleotide
  Target: ATXN1; (+) strand; PAM type: NRG; PAM sequence: GGG
atgtcttatcaagacccagt

SEQ ID NO: 113501 - DNA, 20 bp, Artificial Sequence
  Description of Artificial Sequence: Synthetic oligonucleotide
  Target: ATXN1; (+) strand; PAM type: NRG; PAM sequence: AAG
tatcaagacccagtgggcct

SEQ ID NO: 113502 - DNA, 20 bp, Artificial Sequence
  Description of Artificial Sequence: Synthetic oligonucleotide
  Target: ATXN1; (+) strand; PAM type: NRG; PAM sequence: AAG
tgggcctaagtgatctgtct

SEQ ID NO: 113503 - DNA, 20 bp, Artificial Sequence
  Description of Artificial Sequence: Synthetic oligonucleotide
  Target: ATXN1; (+) strand; PAM type: NRG; PAM sequence: AGG
gggcctaagtgatctgtcta

SEQ ID NO: 113504 - DNA, 20 bp, Artificial Sequence
  Description of Artificial Sequence: Synthetic oligonucleotide
  Target: ATXN1; (+) strand; PAM type: NRG; PAM sequence: TAG
cctaagtgatctgtctaagg

SEQ ID NO: 113505 - DNA, 20 bp, Artificial Sequence
  Description of Artificial Sequence: Synthetic oligonucleotide
  Target: ATXN1; (+) strand; PAM type: NRG; PAM sequence: CAG
agtgatctgtctaaggtaga

SEQ ID NO: 113506 - DNA, 20 bp, Artificial Sequence
  Description of Artificial Sequence: Synthetic oligonucleotide
  Target: ATXN1; (+) strand; PAM type: NRG; PAM sequence: GAG
tgatctgtctaaggtagaca

SEQ ID NO: 113507 - DNA, 20 bp, Artificial Sequence
  Description of Artificial Sequence: Synthetic oligonucleotide
  Target: ATXN1; (+) strand; PAM type: NRG; PAM sequence: AGG
gatctgtctaaggtagacag

SEQ ID NO: 113508 - DNA, 20 bp, Artificial Sequence
  Description of Artificial Sequence: Synthetic oligonucleotide
  Target: ATXN1; (+) strand; PAM type: NRG; PAM sequence: GGG
atctgtctaaggtagacaga

SEQ ID NO: 113509 - DNA, 20 bp, Artificial Sequence
  Description of Artificial Sequence: Synthetic oligonucleotide
  Target: ATXN1; (+) strand; PAM type: NRG; PAM sequence: CAG
tgtctaaggtagacagaggg

SEQ ID NO: 113510 - DNA, 20 bp, Artificial Sequence
  Description of Artificial Sequence: Synthetic oligonucleotide
  Target: ATXN1; (+) strand; PAM type: NRG; PAM sequence: AGG
gtctaaggtagacagagggc

SEQ ID NO: 113511 - DNA, 20 bp, Artificial Sequence
  Description of Artificial Sequence: Synthetic oligonucleotide
  Target: ATXN1; (+) strand; PAM type: NRG; PAM sequence: TGG
taaggtagacagagggcagg

SEQ ID NO: 113512 - DNA, 20 bp, Artificial Sequence
  Description of Artificial Sequence: Synthetic oligonucleotide
  Target: ATXN1; (+) strand; PAM type: NRG; PAM sequence: CAG
ggtagacagagggcaggtgg

SEQ ID NO: 113513 - DNA, 20 bp, Artificial Sequence
  Description of Artificial Sequence: Synthetic oligonucleotide
  Target: ATXN1; (+) strand; PAM type: NRG; PAM sequence: AGG
gtagacagagggcaggtggc

SEQ ID NO: 113514 - DNA, 20 bp, Artificial Sequence
  Description of Artificial Sequence: Synthetic oligonucleotide
  Target: ATXN1; (+) strand; PAM type: NRG; PAM sequence: GGG
tagacagagggcaggtggca

SEQ ID NO: 113515 - DNA, 20 bp, Artificial Sequence
  Description of Artificial Sequence: Synthetic oligonucleotide
  Target: ATXN1; (+) strand; PAM type: NRG; PAM sequence: GAG
gacagagggcaggtggcagg

SEQ ID NO: 113516 - DNA, 20 bp, Artificial Sequence
  Description of Artificial Sequence: Synthetic oligonucleotide
  Target: ATXN1; (+) strand; PAM type: NRG; PAM sequence: CGG
agagggcaggtggcagggag

SEQ ID NO: 113517 - DNA, 20 bp, Artificial Sequence
  Description of Artificial Sequence: Synthetic oligonucleotide
  Target: ATXN1; (+) strand; PAM type: NRG; PAM sequence: TGG
gcaggtggcagggagcggcc

SEQ ID NO: 113518 - DNA, 20 bp, Artificial Sequence
  Description of Artificial Sequence: Synthetic oligonucleotide
  Target: ATXN1; (+) strand; PAM type: NRG; PAM sequence: TGG
tgattttgtttcttttgtca

SEQ ID NO: 113519 - DNA, 20 bp, Artificial Sequence
  Description of Artificial Sequence: Synthetic oligonucleotide
  Target: ATXN1; (+) strand; PAM type: NRG; PAM sequence: CAG
ctacaacatcattgctccta

SEQ ID NO: 113520 - DNA, 20 bp, Artificial Sequence
  Description of Artificial Sequence: Synthetic oligonucleotide
  Target: ATXN1; (+) strand; PAM type: NRG; PAM sequence: AGG
tacaacatcattgctcctac

SEQ ID NO: 113521 - DNA, 20 bp, Artificial Sequence
  Description of Artificial Sequence: Synthetic oligonucleotide
  Target: ATXN1; (+) strand; PAM type: NRG; PAM sequence: CAG
aacatcattgctcctacagg

SEQ ID NO: 113522 - DNA, 20 bp, Artificial Sequence
  Description of Artificial Sequence: Synthetic oligonucleotide
  Target: ATXN1; (+) strand; PAM type: NRG; PAM sequence: AAG
ttgctcctacaggcagaatc

SEQ ID NO: 113523 - DNA, 20 bp, Artificial Sequence
  Description of Artificial Sequence: Synthetic oligonucleotide
  Target: ATXN1; (+) strand; PAM type: NRG; PAM sequence: GAG
gctcctacaggcagaatcaa

SEQ ID NO: 113524 - DNA, 20 bp, Artificial Sequence
  Description of Artificial Sequence: Synthetic oligonucleotide
  Target: ATXN1; (+) strand; PAM type: NRG; PAM sequence: CGG
acaggcagaatcaagagcta

SEQ ID NO: 113525 - DNA, 20 bp, Artificial Sequence
  Description of Artificial Sequence: Synthetic oligonucleotide
  Target: ATXN1; (+) strand; PAM type: NRG; PAM sequence: GGG
caggcagaatcaagagctac

SEQ ID NO: 113526 - DNA, 20 bp, Artificial Sequence
  Description of Artificial Sequence: Synthetic oligonucleotide
  Target: ATXN1; (+) strand; PAM type: NRG; PAM sequence: AAG
gaatcaagagctacgggttc

SEQ ID NO: 113527 - DNA, 20 bp, Artificial Sequence
  Description of Artificial Sequence: Synthetic oligonucleotide
  Target: ATXN1; (+) strand; PAM type: NRG; PAM sequence: AGG
aatcaagagctacgggttca

SEQ ID NO: 113528 - DNA, 20 bp, Artificial Sequence
  Description of Artificial Sequence: Synthetic oligonucleotide
  Target: ATXN1; (+) strand; PAM type: NRG; PAM sequence: GGG
atcaagagctacgggttcaa

SEQ ID NO: 113529 - DNA, 20 bp, Artificial Sequence
  Description of Artificial Sequence: Synthetic oligonucleotide
  Target: ATXN1; (+) strand; PAM type: NRG; PAM sequence: GAG
gagctacgggttcaagggac

SEQ ID NO: 113530 - DNA, 20 bp, Artificial Sequence
  Description of Artificial Sequence: Synthetic oligonucleotide
  Target: ATXN1; (+) strand; PAM type: NRG; PAM sequence: GAG
gctacgggttcaagggacga

SEQ ID NO: 113531 - DNA, 20 bp, Artificial Sequence
  Description of Artificial Sequence: Synthetic oligonucleotide
  Target: ATXN1; (+) strand; PAM type: NRG; PAM sequence: AGG
ctacgggttcaagggacgag

SEQ ID NO: 113532 - DNA, 20 bp, Artificial Sequence
  Description of Artificial Sequence: Synthetic oligonucleotide
  Target: ATXN1; (+) strand; PAM type: NRG; PAM sequence: GGG
tacgggttcaagggacgaga

SEQ ID NO: 113533 - DNA, 20 bp, Artificial Sequence
  Description of Artificial Sequence: Synthetic oligonucleotide
  Target: ATXN1; (+) strand; PAM type: NRG; PAM sequence: AAG
gggttcaagggacgagaggg

SEQ ID NO: 113534 - DNA, 20 bp, Artificial Sequence
  Description of Artificial Sequence: Synthetic oligonucleotide
  Target: ATXN1; (+) strand; PAM type: NRG; PAM sequence: AAG
ttcaagggacgagagggaag

SEQ ID NO: 113535 - DNA, 20 bp, Artificial Sequence
  Description of Artificial Sequence: Synthetic oligonucleotide
  Target: ATXN1; (+) strand; PAM type: NRG; PAM sequence: AGG
tcaagggacgagagggaaga

SEQ ID NO: 113536 - DNA, 20 bp, Artificial Sequence
  Description of Artificial Sequence: Synthetic oligonucleotide
  Target: ATXN1; (+) strand; PAM type: NRG; PAM sequence: AAG
acgagagggaagaaggacac

SEQ ID NO: 113537 - DNA, 20 bp, Artificial Sequence
  Description of Artificial Sequence: Synthetic oligonucleotide
  Target: ATXN1; (+) strand; PAM type: NRG; PAM sequence: CGG
gagggaagaaggacacaagc

SEQ ID NO: 113538 - DNA, 20 bp, Artificial Sequence
  Description of Artificial Sequence: Synthetic oligonucleotide
  Target: ATXN1; (+) strand; PAM type: NRG; PAM sequence: GGG
agggaagaaggacacaagcc

SEQ ID NO: 113539 - DNA, 20 bp, Artificial Sequence
  Description of Artificial Sequence: Synthetic oligonucleotide
  Target: ATXN1; (+) strand; PAM type: NRG; PAM sequence: TGG
ggtgtgtgcatgcgcatgaa

SEQ ID NO: 113540 - DNA, 20 bp, Artificial Sequence
  Description of Artificial Sequence: Synthetic oligonucleotide
  Target: ATXN1; (+) strand; PAM type: NRG; PAM sequence: GAG
tgtgtgcatgcgcatgaatg

SEQ ID NO: 113541 - DNA, 20 bp, Artificial Sequence
  Description of Artificial Sequence: Synthetic oligonucleotide
  Target: ATXN1; (+) strand; PAM type: NRG; PAM sequence: CGG
agcctgcgtgcacaaacatt

SEQ ID NO: 113542 - DNA, 20 bp, Artificial Sequence
  Description of Artificial Sequence: Synthetic oligonucleotide
  Target: ATXN1; (+) strand; PAM type: NRG; PAM sequence: TGG
tgcacaaacattcggtgatt

SEQ ID NO: 113543 - DNA, 20 bp, Artificial Sequence
  Description of Artificial Sequence: Synthetic oligonucleotide
  Target: ATXN1; (+) strand; PAM type: NRG; PAM sequence: GAG
cacaaacattcggtgatttg

SEQ ID NO: 113544 - DNA, 20 bp, Artificial Sequence
  Description of Artificial Sequence: Synthetic oligonucleotide
  Target: ATXN1; (+) strand; PAM type: NRG; PAM sequence: CAG
gtgatttggagccatttacg

SEQ ID NO: 113545 - DNA, 20 bp, Artificial Sequence
  Description of Artificial Sequence: Synthetic oligonucleotide
  Target: ATXN1; (+) strand; PAM type: NRG; PAM sequence: TGG
agccatttacgcagctcatc

SEQ ID NO: 113546 - DNA, 20 bp, Artificial Sequence
  Description of Artificial Sequence: Synthetic oligonucleotide
  Target: ATXN1; (+) strand; PAM type: NRG; PAM sequence: CAG
gcagctcatctggaaaatca

SEQ ID NO: 113547 - DNA, 20 bp, Artificial Sequence
  Description of Artificial Sequence: Synthetic oligonucleotide
  Target: ATXN1; (+) strand; PAM type: NRG; PAM sequence: CAG
gctcatctggaaaatcacag

SEQ ID NO: 113548 - DNA, 20 bp, Artificial Sequence
  Description of Artificial Sequence: Synthetic oligonucleotide
  Target: ATXN1; (+) strand; PAM type: NRG; PAM sequence: GAG
tcatctggaaaatcacagca

SEQ ID NO: 113549 - DNA, 20 bp, Artificial Sequence
  Description of Artificial Sequence: Synthetic oligonucleotide
  Target: ATXN1; (+) strand; PAM type: NRG; PAM sequence: AGG
catctggaaaatcacagcag

SEQ ID NO: 113550 - DNA, 20 bp, Artificial Sequence
  Description of Artificial Sequence: Synthetic oligonucleotide
  Target: ATXN1; (+) strand; PAM type: NRG; PAM sequence: GAG
tctggaaaatcacagcagag

SEQ ID NO: 113551 - DNA, 20 bp, Artificial Sequence
  Description of Artificial Sequence: Synthetic oligonucleotide
  Target: ATXN1; (+) strand; PAM type: NRG; PAM sequence: GAG
tggaaaatcacagcagagga

SEQ ID NO: 113552 - DNA, 20 bp, Artificial Sequence
  Description of Artificial Sequence: Synthetic oligonucleotide
  Target: ATXN1; (+) strand; PAM type: NRG; PAM sequence: AGG
ggaaaatcacagcagaggag

SEQ ID NO: 113553 - DNA, 20 bp, Artificial Sequence
  Description of Artificial Sequence: Synthetic oligonucleotide
  Target: ATXN1; (+) strand; PAM type: NRG; PAM sequence: TGG
agcagaggagaggtttccta

SEQ ID NO: 113554 - DNA, 20 bp, Artificial Sequence
  Description of Artificial Sequence: Synthetic oligonucleotide
  Target: ATXN1; (+) strand; PAM type: NRG; PAM sequence: GGG
gcagaggagaggtttcctat

SEQ ID NO: 113555 - DNA, 20 bp, Artificial Sequence
  Description of Artificial Sequence: Synthetic oligonucleotide
  Target: ATXN1; (+) strand; PAM type: NRG; PAM sequence: GGG
cagaggagaggtttcctatg

SEQ ID NO: 113556 - DNA, 20 bp, Artificial Sequence
  Description of Artificial Sequence: Synthetic oligonucleotide
  Target: ATXN1; (+) strand; PAM type: NRG; PAM sequence: AAG
aggagaggtttcctatgggg

SEQ ID NO: 113557 - DNA, 20 bp, Artificial Sequence
  Description of Artificial Sequence: Synthetic oligonucleotide
  Target: ATXN1; (+) strand; PAM type: NRG; PAM sequence: TGG
tttcctatggggaagtctgt

SEQ ID NO: 113558 - DNA, 20 bp, Artificial Sequence
  Description of Artificial Sequence: Synthetic oligonucleotide
  Target: ATXN1; (+) strand; PAM type: NRG; PAM sequence: GGG
ttcctatggggaagtctgtt

SEQ ID NO: 113559 - DNA, 20 bp, Artificial Sequence
  Description of Artificial Sequence: Synthetic oligonucleotide
  Target: ATXN1; (+) strand; PAM type: NRG; PAM sequence: GAG
cctatggggaagtctgttgg

SEQ ID NO: 113560 - DNA, 20 bp, Artificial Sequence
  Description of Artificial Sequence: Synthetic oligonucleotide
  Target: ATXN1; (+) strand; PAM type: NRG; PAM sequence: CAG
ttacccctctctctttgctc

SEQ ID NO: 113561 - DNA, 20 bp, Artificial Sequence
  Description of Artificial Sequence: Synthetic oligonucleotide
  Target: ATXN1; (+) strand; PAM type: NRG; PAM sequence: AGG
tacccctctctctttgctcc

SEQ ID NO: 113562 - DNA, 20 bp, Artificial Sequence
  Description of Artificial Sequence: Synthetic oligonucleotide
  Target: ATXN1; (+) strand; PAM type: NRG; PAM sequence: TGG
ctctttgctccaggctgcac

SEQ ID NO: 113563 - DNA, 20 bp, Artificial Sequence
  Description of Artificial Sequence: Synthetic oligonucleotide
  Target: ATXN1; (+) strand; PAM type: NRG; PAM sequence: CGG
aggctgcactggcaaacctt

SEQ ID NO: 113564 - DNA, 20 bp, Artificial Sequence
  Description of Artificial Sequence: Synthetic oligonucleotide
  Target: ATXN1; (+) strand; PAM type: NRG; PAM sequence: TAG
aaccttcggctatttaataa

SEQ ID NO: 113565 - DNA, 20 bp, Artificial Sequence
  Description of Artificial Sequence: Synthetic oligonucleotide
  Target: ATXN1; (+) strand; PAM type: NRG; PAM sequence: TAG
ggctatttaataatagtatc

SEQ ID NO: 113566 - DNA, 20 bp, Artificial Sequence
  Description of Artificial Sequence: Synthetic oligonucleotide
  Target: ATXN1; (+) strand; PAM type: NRG; PAM sequence: CAG
gtatctagttgatttacatc

SEQ ID NO: 113567 - DNA, 20 bp, Artificial Sequence
  Description of Artificial Sequence: Synthetic oligonucleotide
  Target: ATXN1; (+) strand; PAM type: NRG; PAM sequence: AGG
tatctagttgatttacatcc

SEQ ID NO: 113568 - DNA, 20 bp, Artificial Sequence
  Description of Artificial Sequence: Synthetic oligonucleotide
  Target: ATXN1; (+) strand; PAM type: NRG; PAM sequence: GGG
atctagttgatttacatcca

SEQ ID NO: 113569 - DNA, 20 bp, Artificial Sequence
  Description of Artificial Sequence: Synthetic oligonucleotide
  Target: ATXN1; (+) strand; PAM type: NRG; PAM sequence: CAG
gatttacatccagggttgcc

SEQ ID NO: 113570 - DNA, 20 bp, Artificial Sequence
  Description of Artificial Sequence: Synthetic oligonucleotide
  Target: ATXN1; (+) strand; PAM type: NRG; PAM sequence: AGG
atttacatccagggttgccc

SEQ ID NO: 113571 - DNA, 20 bp, Artificial Sequence
  Description of Artificial Sequence: Synthetic oligonucleotide
  Target: ATXN1; (+) strand; PAM type: NRG; PAM sequence: GGG
tttacatccagggttgccca

SEQ ID NO: 113572 - DNA, 20 bp, Artificial Sequence
  Description of Artificial Sequence: Synthetic oligonucleotide
  Target: ATXN1; (+) strand; PAM type: NRG; PAM sequence: TAG
tccagggttgcccagggttc

SEQ ID NO: 113573 - DNA, 20 bp, Artificial Sequence
  Description of Artificial Sequence: Synthetic oligonucleotide
  Target: ATXN1; (+) strand; PAM type: NRG; PAM sequence: CAG
ggttctagtgtgtgcactgc

SEQ ID NO: 113574 - DNA, 20 bp, Artificial Sequence
  Description of Artificial Sequence: Synthetic oligonucleotide
  Target: ATXN1; (+) strand; PAM type: NRG; PAM sequence: AGG
gttctagtgtgtgcactgcc

SEQ ID NO: 113575 - DNA, 20 bp, Artificial Sequence
  Description of Artificial Sequence: Synthetic oligonucleotide
  Target: ATXN1; (+) strand; PAM type: NRG; PAM sequence: AAG
gtgcactgccaggcacaaac

SEQ ID NO: 113576 - DNA, 20 bp, Artificial Sequence
  Description of Artificial Sequence: Synthetic oligonucleotide
  Target: ATXN1; (+) strand; PAM type: NRG; PAM sequence: CAG
ctgccaggcacaaacaagta

SEQ ID NO: 113577 - DNA, 20 bp, Artificial Sequence
  Description of Artificial Sequence: Synthetic oligonucleotide
  Target: ATXN1; (+) strand; PAM type: NRG; PAM sequence: CAG
aggcacaaacaagtacagac

SEQ ID NO: 113578 - DNA, 20 bp, Artificial Sequence
  Description of Artificial Sequence: Synthetic oligonucleotide
  Target: ATXN1; (+) strand; PAM type: NRG; PAM sequence: AAG
ccagctcatgccccacaaca

SEQ ID NO: 113579 - DNA, 20 bp, Artificial Sequence
  Description of Artificial Sequence: Synthetic oligonucleotide
  Target: ATXN1; (+) strand; PAM type: NRG; PAM sequence: TGG
gctcatgccccacaacaaag

SEQ ID NO: 113580 - DNA, 20 bp, Artificial Sequence
  Description of Artificial Sequence: Synthetic oligonucleotide
  Target: ATXN1; (+) strand; PAM type: NRG; PAM sequence: TGG
acaacaaagtggccatttta

SEQ ID NO: 113581 - DNA, 20 bp, Artificial Sequence
  Description of Artificial Sequence: Synthetic oligonucleotide
  Target: ATXN1; (+) strand; PAM type: NRG; PAM sequence: GGG
caacaaagtggccattttat

SEQ ID NO: 113582 - DNA, 20 bp, Artificial Sequence
  Description of Artificial Sequence: Synthetic oligonucleotide
  Target: ATXN1; (+) strand; PAM type: NRG; PAM sequence: GGG
aacaaagtggccattttatg

SEQ ID NO: 113583 - DNA, 20 bp, Artificial Sequence
  Description of Artificial Sequence: Synthetic oligonucleotide
  Target: ATXN1; (+) strand; PAM type: NRG; PAM sequence: TGG
ccattttatggggaatcaac

SEQ ID NO: 113584 - DNA, 20 bp, Artificial Sequence
  Description of Artificial Sequence: Synthetic oligonucleotide
  Target: ATXN1; (+) strand; PAM type: NRG; PAM sequence: CAG
tctctgtctgccctgctact

SEQ ID NO: 113585 - DNA, 20 bp, Artificial Sequence
  Description of Artificial Sequence: Synthetic oligonucleotide
  Target: ATXN1; (+) strand; PAM type: NRG; PAM sequence: AAG
ctgtctgccctgctactcag

SEQ ID NO: 113586 - DNA, 20 bp, Artificial Sequence
  Description of Artificial Sequence: Synthetic oligonucleotide
  Target: ATXN1; (+) strand; PAM type: NRG; PAM sequence: CGG
ctgccctgctactcagaaga

SEQ ID NO: 113587 - DNA, 20 bp, Artificial Sequence
  Description of Artificial Sequence: Synthetic oligonucleotide
  Target: ATXN1; (+) strand; PAM type: NRG; PAM sequence: TGG
ccctgctactcagaagacgg

SEQ ID NO: 113588 - DNA, 20 bp, Artificial Sequence
  Description of Artificial Sequence: Synthetic oligonucleotide
  Target: ATXN1; (+) strand; PAM type: NRG; PAM sequence: AAG
tgctactcagaagacggtgg

SEQ ID NO: 113589 - DNA, 20 bp, Artificial Sequence
  Description of Artificial Sequence: Synthetic oligonucleotide
  Target: ATXN1; (+) strand; PAM type: NRG; PAM sequence: AGG
gctactcagaagacggtgga

SEQ ID NO: 113590 - DNA, 20 bp, Artificial Sequence
  Description of Artificial Sequence: Synthetic oligonucleotide
  Target: ATXN1; (+) strand; PAM type: NRG; PAM sequence: AAG
agacggtggaaggaatgctg

SEQ ID NO: 113591 - DNA, 20 bp, Artificial Sequence
  Description of Artificial Sequence: Synthetic oligonucleotide
  Target: ATXN1; (+) strand; PAM type: NRG; PAM sequence: AAG
ggtggaaggaatgctgaagt

SEQ ID NO: 113592 - DNA, 20 bp, Artificial Sequence
  Description of Artificial Sequence: Synthetic oligonucleotide
  Target: ATXN1; (+) strand; PAM type: NRG; PAM sequence: AAG
atgctgaagtaagcttctgt

SEQ ID NO: 113593 - DNA, 20 bp, Artificial Sequence
  Description of Artificial Sequence: Synthetic oligonucleotide
  Target: ATXN1; (+) strand; PAM type: NRG; PAM sequence: GAG
gctgaagtaagcttctgtaa

SEQ ID NO: 113594 - DNA, 20 bp, Artificial Sequence
  Description of Artificial Sequence: Synthetic oligonucleotide
  Target: ATXN1; (+) strand; PAM type: NRG; PAM sequence: TGG
aagcttctgtaagagctcac

SEQ ID NO: 113595 - DNA, 20 bp, Artificial Sequence
  Description of Artificial Sequence: Synthetic oligonucleotide
  Target: ATXN1; (+) strand; PAM type: NRG; PAM sequence: TGG
tctgtaagagctcactggcc

SEQ ID NO: 113596 - DNA, 20 bp, Artificial Sequence
  Description of Artificial Sequence: Synthetic oligonucleotide
  Target: ATXN1; (+) strand; PAM type: NRG; PAM sequence: AAG
gctcactggcctggctttga

SEQ ID NO: 113597 - DNA, 20 bp, Artificial Sequence
  Description of Artificial Sequence: Synthetic oligonucleotide
  Target: ATXN1; (+) strand; PAM type: NRG; PAM sequence: GAG
tcactggcctggctttgaaa

SEQ ID NO: 113598 - DNA, 20 bp, Artificial Sequence
  Description of Artificial Sequence: Synthetic oligonucleotide
  Target: ATXN1; (+) strand; PAM type: NRG; PAM sequence: GAG
actggcctggctttgaaaga

SEQ ID NO: 113599 - DNA, 20 bp, Artificial Sequence
  Description of Artificial Sequence: Synthetic oligonucleotide
  Target: ATXN1; (+) strand; PAM type: NRG; PAM sequence: AGG
ctggcctggctttgaaagag

SEQ ID NO: 113600 - DNA, 20 bp, Artificial Sequence
  Description of Artificial Sequence: Synthetic oligonucleotide
  Target: ATXN1; (+) strand; PAM type: NRG; PAM sequence: CAG
ctggctttgaaagagaggat

SEQ ID NO: 113601 - DNA, 20 bp, Artificial Sequence
  Description of Artificial Sequence: Synthetic oligonucleotide
  Target: ATXN1; (+) strand; PAM type: NRG; PAM sequence: TGG
ctttgaaagagaggatcagc

SEQ ID NO: 113602 - DNA, 20 bp, Artificial Sequence
  Description of Artificial Sequence: Synthetic oligonucleotide
  Target: ATXN1; (+) strand; PAM type: NRG; PAM sequence: GGG
tttgaaagagaggatcagct

SEQ ID NO: 113603 - DNA, 20 bp, Artificial Sequence
  Description of Artificial Sequence: Synthetic oligonucleotide
  Target: ATXN1; (+) strand; PAM type: NRG; PAM sequence: TAG
gatcagctgggatctctgaa

SEQ ID NO: 113604 - DNA, 20 bp, Artificial Sequence
  Description of Artificial Sequence: Synthetic oligonucleotide
  Target: ATXN1; (+) strand; PAM type: NRG; PAM sequence: GAG
gctgggatctctgaatagat

SEQ ID NO: 113605 - DNA, 20 bp, Artificial Sequence
  Description of Artificial Sequence: Synthetic oligonucleotide
  Target: ATXN1; (+) strand; PAM type: NRG; PAM sequence: AGG
ctgggatctctgaatagatg

SEQ ID NO: 113606 - DNA, 20 bp, Artificial Sequence
  Description of Artificial Sequence: Synthetic oligonucleotide
  Target: ATXN1; (+) strand; PAM type: NRG; PAM sequence: GAG
gggatctctgaatagatgag

SEQ ID NO: 113607 - DNA, 20 bp, Artificial Sequence
  Description of Artificial Sequence: Synthetic oligonucleotide
  Target: ATXN1; (+) strand; PAM type: NRG; PAM sequence: CAG
tctctgaatagatgaggagt

SEQ ID NO: 113608 - DNA, 20 bp, Artificial Sequence
  Description of Artificial Sequence: Synthetic oligonucleotide
  Target: ATXN1; (+) strand; PAM type: NRG; PAM sequence: AGG
ctctgaatagatgaggagtc

SEQ ID NO: 113609 - DNA, 20 bp, Artificial Sequence
  Description of Artificial Sequence: Synthetic oligonucleotide
  Target: ATXN1; (+) strand; PAM type: NRG; PAM sequence: GGG
tctgaatagatgaggagtca

SEQ ID NO: 113610 - DNA, 20 bp, Artificial Sequence
  Description of Artificial Sequence: Synthetic oligonucleotide
  Target: ATXN1; (+) strand; PAM type: NRG; PAM sequence: AAG
atagatgaggagtcagggtg

SEQ ID NO: 113611 - DNA, 20 bp, Artificial Sequence
  Description of Artificial Sequence: Synthetic oligonucleotide
  Target: ATXN1; (+) strand; PAM type: NRG; PAM sequence: CAG
atgaggagtcagggtgaaga

SEQ ID NO: 113612 - DNA, 20 bp, Artificial Sequence
  Description of Artificial Sequence: Synthetic oligonucleotide
  Target: ATXN1; (+) strand; PAM type: NRG; PAM sequence: AAG
tcagggtgaagacagaaaca

SEQ ID NO: 113613 - DNA, 20 bp, Artificial Sequence
  Description of Artificial Sequence: Synthetic oligonucleotide
  Target: ATXN1; (+) strand; PAM type: NRG; PAM sequence: AAG
gggtgaagacagaaacaaag

SEQ ID NO: 113614 - DNA, 20 bp, Artificial Sequence
  Description of Artificial Sequence: Synthetic oligonucleotide
  Target: ATXN1; (+) strand; PAM type: NRG; PAM sequence: CAG
acagaaacaaagaagtgttt

SEQ ID NO: 113615 - DNA, 20 bp, Artificial Sequence
  Description of Artificial Sequence: Synthetic oligonucleotide
  Target: ATXN1; (+) strand; PAM type: NRG; PAM sequence: AGG
cagaaacaaagaagtgtttc

SEQ ID NO: 113616 - DNA, 20 bp, Artificial Sequence
  Description of Artificial Sequence: Synthetic oligonucleotide
  Target: ATXN1; (+) strand; PAM type: NRG; PAM sequence: AAG
aaagaagtgtttcaggtgca

SEQ ID NO: 113617 - DNA, 20 bp, Artificial Sequence
  Description of Artificial Sequence: Synthetic oligonucleotide
  Target: ATXN1; (+) strand; PAM type: NRG; PAM sequence: AGG
aagaagtgtttcaggtgcaa

SEQ ID NO: 113618 - DNA, 20 bp, Artificial Sequence
  Description of Artificial Sequence: Synthetic oligonucleotide
  Target: ATXN1; (+) strand; PAM type: NRG; PAM sequence: TGG
tttcaggtgcaaaggaaatg

SEQ ID NO: 113619 - DNA, 20 bp, Artificial Sequence
  Description of Artificial Sequence: Synthetic oligonucleotide
  Target: ATXN1; (+) strand; PAM type: NRG; PAM sequence: GGG
ttcaggtgcaaaggaaatgt

SEQ ID NO: 113620 - DNA, 20 bp, Artificial Sequence
  Description of Artificial Sequence: Synthetic oligonucleotide
  Target: ATXN1; (+) strand; PAM type: NRG; PAM sequence: AAG
gggtgctccatgactctctg

SEQ ID NO: 113621 - DNA, 20 bp, Artificial Sequence
  Description of Artificial Sequence: Synthetic oligonucleotide
  Target: ATXN1; (+) strand; PAM type: NRG; PAM sequence: AGG
ggtgctccatgactctctga

SEQ ID NO: 113622 - DNA, 20 bp, Artificial Sequence
  Description of Artificial Sequence: Synthetic oligonucleotide
  Target: ATXN1; (+) strand; PAM type: NRG; PAM sequence: GGG
gtgctccatgactctctgaa

SEQ ID NO: 113623 - DNA, 20 bp, Artificial Sequence
  Description of Artificial Sequence: Synthetic oligonucleotide
  Target: ATXN1; (+) strand; PAM type: NRG; PAM sequence: GAG
gctccatgactctctgaagg

SEQ ID NO: 113624 - DNA, 20 bp, Artificial Sequence
  Description of Artificial Sequence: Synthetic oligonucleotide
  Target: ATXN1; (+) strand; PAM type: NRG; PAM sequence: AAG
tgactctctgaagggagtcc

SEQ ID NO: 113625 - DNA, 20 bp, Artificial Sequence
  Description of Artificial Sequence: Synthetic oligonucleotide
  Target: ATXN1; (+) strand; PAM type: NRG; PAM sequence: AGG
gactctctgaagggagtcca

SEQ ID NO: 113626 - DNA, 20 bp, Artificial Sequence
  Description of Artificial Sequence: Synthetic oligonucleotide
  Target: ATXN1; (+) strand; PAM type: NRG; PAM sequence: GGG
actctctgaagggagtccaa

SEQ ID NO: 113627 - DNA, 20 bp, Artificial Sequence
  Description of Artificial Sequence: Synthetic oligonucleotide
  Target: ATXN1; (+) strand; PAM type: NRG; PAM sequence: TGG
tctgaagggagtccaagggc

SEQ ID NO: 113628 - DNA, 20 bp, Artificial Sequence
  Description of Artificial Sequence: Synthetic oligonucleotide
  Target: ATXN1; (+) strand; PAM type: NRG; PAM sequence: CAG
agtccaagggctggaccatt

SEQ ID NO: 113629 - DNA, 20 bp, Artificial Sequence
  Description of Artificial Sequence: Synthetic oligonucleotide
  Target: ATXN1; (+) strand; PAM type: NRG; PAM sequence: CAG
gctggaccattcagaacctt

SEQ ID NO: 113630 - DNA, 20 bp, Artificial Sequence
  Description of Artificial Sequence: Synthetic oligonucleotide
  Target: ATXN1; (+) strand; PAM type: NRG; PAM sequence: AGG
ctggaccattcagaaccttc

SEQ ID NO: 113631 - DNA, 20 bp, Artificial Sequence
  Description of Artificial Sequence: Synthetic oligonucleotide
  Target: ATXN1; (+) strand; PAM type: NRG; PAM sequence: AAG
gaccattcagaaccttcagg

SEQ ID NO: 113632 - DNA, 20 bp, Artificial Sequence
  Description of Artificial Sequence: Synthetic oligonucleotide
  Target: ATXN1; (+) strand; PAM type: NRG; PAM sequence: CAG
tcagaaccttcaggaagact

SEQ ID NO: 113633 - DNA, 20 bp, Artificial Sequence
  Description of Artificial Sequence: Synthetic oligonucleotide
  Target: ATXN1; (+) strand; PAM type: NRG; PAM sequence: CAG
accttcaggaagactcagaa

SEQ ID NO: 113634 - DNA, 20 bp, Artificial Sequence
  Description of Artificial Sequence: Synthetic oligonucleotide
  Target: ATXN1; (+) strand; PAM type: NRG; PAM sequence: CAG
aggaagactcagaacagctc

SEQ ID NO: 113635 - DNA, 20 bp, Artificial Sequence
  Description of Artificial Sequence: Synthetic oligonucleotide
  Target: ATXN1; (+) strand; PAM type: NRG; PAM sequence: GAG
agaacagctccagcctgcct

SEQ ID NO: 113636 - DNA, 20 bp, Artificial Sequence
  Description of Artificial Sequence: Synthetic oligonucleotide
  Target: ATXN1; (+) strand; PAM type: NRG; PAM sequence: TGG
cagctccagcctgcctgagc

SEQ ID NO: 113637 - DNA, 20 bp, Artificial Sequence
  Description of Artificial Sequence: Synthetic oligonucleotide
  Target: ATXN1; (+) strand; PAM type: NRG; PAM sequence: AAG
ctccagcctgcctgagctgg

SEQ ID NO: 113638 - DNA, 20 bp, Artificial Sequence
  Description of Artificial Sequence: Synthetic oligonucleotide
  Target: ATXN1; (+) strand; PAM type: NRG; PAM sequence: CAG
cagcctgcctgagctggaag

SEQ ID NO: 113639 - DNA, 20 bp, Artificial Sequence
  Description of Artificial Sequence: Synthetic oligonucleotide
  Target: ATXN1; (+) strand; PAM type: NRG; PAM sequence: TGG
gctggaagcagtgtcactgt

SEQ ID NO: 113640 - DNA, 20 bp, Artificial Sequence
  Description of Artificial Sequence: Synthetic oligonucleotide
  Target: ATXN1; (+) strand; PAM type: NRG; PAM sequence: GAG
gttggtgttgcgtctcctct

SEQ ID NO: 113641 - DNA, 20 bp, Artificial Sequence
  Description of Artificial Sequence: Synthetic oligonucleotide
  Target: ATXN1; (+) strand; PAM type: NRG; PAM sequence: AGG
ttggtgttgcgtctcctctg

SEQ ID NO: 113642 - DNA, 20 bp, Artificial Sequence
  Description of Artificial Sequence: Synthetic oligonucleotide
  Target: ATXN1; (+) strand; PAM type: NRG; PAM sequence: CAG
cgtctcctctgaggaccttc

SEQ ID NO: 113643 - DNA, 20 bp, Artificial Sequence
  Description of Artificial Sequence: Synthetic oligonucleotide
  Target: ATXN1; (+) strand; PAM type: NRG; PAM sequence: TGG
gaccttccagaaccatctaa

SEQ ID NO: 113644 - DNA, 20 bp, Artificial Sequence
  Description of Artificial Sequence: Synthetic oligonucleotide
  Target: ATXN1; (+) strand; PAM type: NRG; PAM sequence: TGG
tccagaaccatctaatggca

SEQ ID NO: 113645 - DNA, 20 bp, Artificial Sequence
  Description of Artificial Sequence: Synthetic oligonucleotide
  Target: ATXN1; (+) strand; PAM type: NRG; PAM sequence: GGG
ccagaaccatctaatggcat

SEQ ID NO: 113646 - DNA, 20 bp, Artificial Sequence
  Description of Artificial Sequence: Synthetic oligonucleotide
  Target: ATXN1; (+) strand; PAM type: NRG; PAM sequence: CAG
aaccatctaatggcatgggt

SEQ ID NO: 113647 - DNA, 20 bp, Artificial Sequence
  Description of Artificial Sequence: Synthetic oligonucleotide
  Target: ATXN1; (+) strand; PAM type: NRG; PAM sequence: CAG
tgactgctgcattttgcact

SEQ ID NO: 113648 - DNA, 20 bp, Artificial Sequence
  Description of Artificial Sequence: Synthetic oligonucleotide
  Target: ATXN1; (+) strand; PAM type: NRG; PAM sequence: AGG
gactgctgcattttgcactc

SEQ ID NO: 113649 - DNA, 20 bp, Artificial Sequence
  Description of Artificial Sequence: Synthetic oligonucleotide
  Target: ATXN1; (+) strand; PAM type: NRG; PAM sequence: GGG
actgctgcattttgcactca

SEQ ID NO: 113650 - DNA, 20 bp, Artificial Sequence
  Description of Artificial Sequence: Synthetic oligonucleotide
  Target: ATXN1; (+) strand; PAM type: NRG; PAM sequence: TGG
cactcagggccttccatgaa

SEQ ID NO: 113651 - DNA, 20 bp, Artificial Sequence
  Description of Artificial Sequence: Synthetic oligonucleotide
  Target: ATXN1; (+) strand; PAM type: NRG; PAM sequence: CAG
tcagggccttccatgaatgg

SEQ ID NO: 113652 - DNA, 20 bp, Artificial Sequence
  Description of Artificial Sequence: Synthetic oligonucleotide
  Target: ATXN1; (+) strand; PAM type: NRG; PAM sequence: TGG
cttccatgaatggcagtttc

SEQ ID NO: 113653 - DNA, 20 bp, Artificial Sequence
  Description of Artificial Sequence: Synthetic oligonucleotide
  Target: ATXN1; (+) strand; PAM type: NRG; PAM sequence: CAG
ggcagtttctggtacctttg

SEQ ID NO: 113654 - DNA, 20 bp, Artificial Sequence
  Description of Artificial Sequence: Synthetic oligonucleotide
  Target: ATXN1; (+) strand; PAM type: NRG; PAM sequence: CAG
atgccctttacacataaatt

SEQ ID NO: 113655 - DNA, 20 bp, Artificial Sequence
  Description of Artificial Sequence: Synthetic oligonucleotide
  Target: ATXN1; (+) strand; PAM type: NRG; PAM sequence: CAG
taaattcagccaactgaaat

SEQ ID NO: 113656 - DNA, 20 bp, Artificial Sequence
  Description of Artificial Sequence: Synthetic oligonucleotide
  Target: ATXN1; (+) strand; PAM type: NRG; PAM sequence: GAG
aattcagccaactgaaatca

SEQ ID NO: 113657 - DNA, 20 bp, Artificial Sequence
  Description of Artificial Sequence: Synthetic oligonucleotide
  Target: ATXN1; (+) strand; PAM type: NRG; PAM sequence: GAG
ctgaaatcagagcaatattt

SEQ ID NO: 113658 - DNA, 20 bp, Artificial Sequence
  Description of Artificial Sequence: Synthetic oligonucleotide
  Target: ATXN1; (+) strand; PAM type: NRG; PAM sequence: TGG
tcagagcaatatttgagcta

SEQ ID NO: 113659 - DNA, 20 bp, Artificial Sequence
  Description of Artificial Sequence: Synthetic oligonucleotide
  Target: ATXN1; (+) strand; PAM type: NRG; PAM sequence: TAG
tctaaaatgctaccaaacac

SEQ ID NO: 113660 - DNA, 20 bp, Artificial Sequence
  Description of Artificial Sequence: Synthetic oligonucleotide
  Target: ATXN1; (+) strand; PAM type: NRG; PAM sequence: TAG
ctaccaaacactagatctct

SEQ ID NO: 113661 - DNA, 20 bp, Artificial Sequence
  Description of Artificial Sequence: Synthetic oligonucleotide
  Target: ATXN1; (+) strand; PAM type: NRG; PAM sequence: AAG
cttagttctttcatatttta

SEQ ID NO: 113662 - DNA, 20 bp, Artificial Sequence
  Description of Artificial Sequence: Synthetic oligonucleotide
  Target: ATXN1; (+) strand; PAM type: NRG; PAM sequence: CAG
ctttcatattttaaagtgca

SEQ ID NO: 113663 - DNA, 20 bp, Artificial Sequence
  Description of Artificial Sequence: Synthetic oligonucleotide
  Target: ATXN1; (+) strand; PAM type: NRG; PAM sequence: CAG
agtgcacagatgcctgattt

SEQ ID NO: 113664 - DNA, 20 bp, Artificial Sequence
  Description of Artificial Sequence: Synthetic oligonucleotide
  Target: ATXN1; (+) strand; PAM type: NRG; PAM sequence: CAG
tgatttcagattctgtgaaa

SEQ ID NO: 113665 - DNA, 20 bp, Artificial Sequence
  Description of Artificial Sequence: Synthetic oligonucleotide
  Target: ATXN1; (+) strand; PAM type: NRG; PAM sequence: GAG
atttcagattctgtgaaaca

SEQ ID NO: 113666 - DNA, 20 bp, Artificial Sequence
  Description of Artificial Sequence: Synthetic oligonucleotide
  Target: ATXN1; (+) strand; PAM type: NRG; PAM sequence: CAG
tttacaaatgctttctgtct

SEQ ID NO: 113667 - DNA, 20 bp, Artificial Sequence
  Description of Artificial Sequence: Synthetic oligonucleotide
  Target: ATXN1; (+) strand; PAM type: NRG; PAM sequence: AGG
ttacaaatgctttctgtctc

SEQ ID NO: 113668 - DNA, 20 bp, Artificial Sequence
  Description of Artificial Sequence: Synthetic oligonucleotide
  Target: ATXN1; (+) strand; PAM type: NRG; PAM sequence: TAG
tctgtctcaggacccctctg

SEQ ID NO: 113669 - DNA, 20 bp, Artificial Sequence
  Description of Artificial Sequence: Synthetic oligonucleotide
  Target: ATXN1; (+) strand; PAM type: NRG; PAM sequence: TGG
gtagctactaacttcacatt

SEQ ID NO: 113670 - DNA, 20 bp, Artificial Sequence
  Description of Artificial Sequence: Synthetic oligonucleotide
  Target: ATXN1; (+) strand; PAM type: NRG; PAM sequence: GGG
tagctactaacttcacattt

SEQ ID NO: 113671 - DNA, 20 bp, Artificial Sequence
  Description of Artificial Sequence: Synthetic oligonucleotide
  Target: ATXN1; (+) strand; PAM type: NRG; PAM sequence: AAG
ctaacttcacatttgggaaa

SEQ ID NO: 113672 - DNA, 20 bp, Artificial Sequence
  Description of Artificial Sequence: Synthetic oligonucleotide
  Target: ATXN1; (+) strand; PAM type: NRG; PAM sequence: TAG
acttcacatttgggaaaaag

SEQ ID NO: 113673 - DNA, 20 bp, Artificial Sequence
  Description of Artificial Sequence: Synthetic oligonucleotide
  Target: ATXN1; (+) strand; PAM type: NRG; PAM sequence: AAG
tgtgccacgttgtttaccaa

SEQ ID NO: 113674 - DNA, 20 bp, Artificial Sequence
  Description of Artificial Sequence: Synthetic oligonucleotide
  Target: ATXN1; (+) strand; PAM type: NRG; PAM sequence: CAG
gtttaccaaaagtatcccac

SEQ ID NO: 113675 - DNA, 20 bp, Artificial Sequence
  Description of Artificial Sequence: Synthetic oligonucleotide
  Target: ATXN1; (+) strand; PAM type: NRG; PAM sequence: AGG
tttaccaaaagtatcccacc

SEQ ID NO: 113676 - DNA, 20 bp, Artificial Sequence
  Description of Artificial Sequence: Synthetic oligonucleotide
  Target: ATXN1; (+) strand; PAM type: NRG; PAM sequence: CGG
tattactttaaaatgccttt

SEQ ID NO: 113677 - DNA, 20 bp, Artificial Sequence
  Description of Artificial Sequence: Synthetic oligonucleotide
  Target: ATXN1; (+) strand; PAM type: NRG; PAM sequence: AAG
ctttaaaatgcctttcggta

SEQ ID NO: 113678 - DNA, 20 bp, Artificial Sequence
  Description of Artificial Sequence: Synthetic oligonucleotide
  Target: ATXN1; (+) strand; PAM type: NRG; PAM sequence: AGG
tttaaaatgcctttcggtaa

SEQ ID NO: 113679 - DNA, 20 bp, Artificial Sequence
  Description of Artificial Sequence: Synthetic oligonucleotide
  Target: ATXN1; (+) strand; PAM type: NRG; PAM sequence: GAG
taaaatgcctttcggtaaag

SEQ ID NO: 113680 - DNA, 20 bp, Artificial Sequence
  Description of Artificial Sequence: Synthetic oligonucleotide
  Target: ATXN1; (+) strand; PAM type: NRG; PAM sequence: TAG
tcggtaaaggagaatttgaa

SEQ ID NO: 113681 - DNA, 20 bp, Artificial Sequence
  Description of Artificial Sequence: Synthetic oligonucleotide
  Target: ATXN1; (+) strand; PAM type: NRG; PAM sequence: TGG
cattttacgcattaactgtc

SEQ ID NO: 113682 - DNA, 20 bp, Artificial Sequence
  Description of Artificial Sequence: Synthetic oligonucleotide
  Target: ATXN1; (+) strand; PAM type: NRG; PAM sequence: GGG
attttacgcattaactgtct

SEQ ID NO: 113683 - DNA, 20 bp, Artificial Sequence
  Description of Artificial Sequence: Synthetic oligonucleotide
  Target: ATXN1; (+) strand; PAM type: NRG; PAM sequence: CAG
caacataatatactgaaaca

SEQ ID NO: 113684 - DNA, 20 bp, Artificial Sequence
  Description of Artificial Sequence: Synthetic oligonucleotide
  Target: ATXN1; (+) strand; PAM type: NRG; PAM sequence: AAG
cataatatactgaaacacag

SEQ ID NO: 113685 - DNA, 20 bp, Artificial Sequence
  Description of Artificial Sequence: Synthetic oligonucleotide
  Target: ATXN1; (+) strand; PAM type: NRG; PAM sequence: TGG
tatactgaaacacagaagac

SEQ ID NO: 113686 - DNA, 20 bp, Artificial Sequence
  Description of Artificial Sequence: Synthetic oligonucleotide
  Target: ATXN1; (+) strand; PAM type: NRG; PAM sequence: TAG
gaaacacagaagactggctg

SEQ ID NO: 113687 - DNA, 20 bp, Artificial Sequence
  Description of Artificial Sequence: Synthetic oligonucleotide
  Target: ATXN1; (+) strand; PAM type: NRG; PAM sequence: AGG
aaacacagaagactggctgt

SEQ ID NO: 113688 - DNA, 20 bp, Artificial Sequence
  Description of Artificial Sequence: Synthetic oligonucleotide
  Target: ATXN1; (+) strand; PAM type: NRG; PAM sequence: CAG
cagaagactggctgtaggtc

SEQ ID NO: 113689 - DNA, 20 bp, Artificial Sequence
  Description of Artificial Sequence: Synthetic oligonucleotide
  Target: ATXN1; (+) strand; PAM type: NRG; PAM sequence: TGG
ggctgtaggtccagatcacc

SEQ ID NO: 113690 - DNA, 20 bp, Artificial Sequence
  Description of Artificial Sequence: Synthetic oligonucleotide
  Target: ATXN1; (+) strand; PAM type: NRG; PAM sequence: TAG
tgtaggtccagatcacctgg

SEQ ID NO: 113691 - DNA, 20 bp, Artificial Sequence
  Description of Artificial Sequence: Synthetic oligonucleotide
  Target: ATXN1; (+) strand; PAM type: NRG; PAM sequence: TGG
gatcacctggtagtgaacca

SEQ ID NO: 113692 - DNA, 20 bp, Artificial Sequence
  Description of Artificial Sequence: Synthetic oligonucleotide
  Target: ATXN1; (+) strand; PAM type: NRG; PAM sequence: AAG
acctggtagtgaaccatgga

SEQ ID NO: 113693 - DNA, 20 bp, Artificial Sequence
  Description of Artificial Sequence: Synthetic oligonucleotide
  Target: ATXN1; (+) strand; PAM type: NRG; PAM sequence: AGG
cctggtagtgaaccatggaa

SEQ ID NO: 113694 - DNA, 20 bp, Artificial Sequence
  Description of Artificial Sequence: Synthetic oligonucleotide
  Target: ATXN1; (+) strand; PAM type: NRG; PAM sequence: TGG
aaggtattattcacacacct

SEQ ID NO: 113695 - DNA, 20 bp, Artificial Sequence
  Description of Artificial Sequence: Synthetic oligonucleotide
  Target: ATXN1; (+) strand; PAM type: NRG; PAM sequence: GAG
ggtattattcacacaccttg

SEQ ID NO: 113696 - DNA, 20 bp, Artificial Sequence
  Description of Artificial Sequence: Synthetic oligonucleotide
  Target: ATXN1; (+) strand; PAM type: NRG; PAM sequence: CGG
ttcacacaccttggagcctg

SEQ ID NO: 113697 - DNA, 20 bp, Artificial Sequence
  Description of Artificial Sequence: Synthetic oligonucleotide
  Target: ATXN1; (+) strand; PAM type: NRG; PAM sequence: AAG
ttggagcctgcggattctct

SEQ ID NO: 113698 - DNA, 20 bp, Artificial Sequence
  Description of Artificial Sequence: Synthetic oligonucleotide
  Target: ATXN1; (+) strand; PAM type: NRG; PAM sequence: CAG
aagccttcttaatcattctt

SEQ ID NO: 113699 - DNA, 20 bp, Artificial Sequence
  Description of Artificial Sequence: Synthetic oligonucleotide
  Target: ATXN1; (+) strand; PAM type: NRG; PAM sequence: AGG
agccttcttaatcattcttc

SEQ ID NO: 113700 - DNA, 20 bp, Artificial Sequence
  Description of Artificial Sequence: Synthetic oligonucleotide
  Target: ATXN1; (+) strand; PAM type: NRG; PAM sequence: CAG
tattactttgtccttcaaaa

SEQ ID NO: 113701 - DNA, 20 bp, Artificial Sequence
  Description of Artificial Sequence: Synthetic oligonucleotide
  Target: ATXN1; (+) strand; PAM type: NRG; PAM sequence: CAG
tactttgtccttcaaaacag

SEQ ID NO: 113702 - DNA, 20 bp, Artificial Sequence
  Description of Artificial Sequence: Synthetic oligonucleotide
  Target: ATXN1; (+) strand; PAM type: NRG; PAM sequence: CAG
tccttcaaaacagcagattt

SEQ ID NO: 113703 - DNA, 20 bp, Artificial Sequence
  Description of Artificial Sequence: Synthetic oligonucleotide
  Target: ATXN1; (+) strand; PAM type: NRG; PAM sequence: CAG
gacgcatttataaaacaatt

SEQ ID NO: 113704 - DNA, 20 bp, Artificial Sequence
  Description of Artificial Sequence: Synthetic oligonucleotide
  Target: ATXN1; (+) strand; PAM type: NRG; PAM sequence: TGG
aaaacaattcagttgtaatc

SEQ ID NO: 113705 - DNA, 20 bp, Artificial Sequence
  Description of Artificial Sequence: Synthetic oligonucleotide
  Target: ATXN1; (+) strand; PAM type: NRG; PAM sequence: GGG
aaacaattcagttgtaatct

SEQ ID NO: 113706 - DNA, 20 bp, Artificial Sequence
  Description of Artificial Sequence: Synthetic oligonucleotide
  Target: ATXN1; (+) strand; PAM type: NRG; PAM sequence: AAG
agttgtaatctgggtcccta

SEQ ID NO: 113707 - DNA, 20 bp, Artificial Sequence
  Description of Artificial Sequence: Synthetic oligonucleotide
  Target: ATXN1; (+) strand; PAM type: NRG; PAM sequence: CAG
aatctgggtccctaaagctt

SEQ ID NO: 113708 - DNA, 20 bp, Artificial Sequence
  Description of Artificial Sequence: Synthetic oligonucleotide
  Target: ATXN1; (+) strand; PAM type: NRG; PAM sequence: TAG
gggtccctaaagcttcagta

SEQ ID NO: 113709 - DNA, 20 bp, Artificial Sequence
  Description of Artificial Sequence: Synthetic oligonucleotide
  Target: ATXN1; (+) strand; PAM type: NRG; PAM sequence: AAG
agtatagacatttatcttgt

SEQ ID NO: 113710 - DNA, 20 bp, Artificial Sequence
  Description of Artificial Sequence: Synthetic oligonucleotide
  Target: ATXN1; (+) strand; PAM type: NRG; PAM sequence: AAG
catttatcttgtaagtaaca

SEQ ID NO: 113711 - DNA, 20 bp, Artificial Sequence
  Description of Artificial Sequence: Synthetic oligonucleotide
  Target: ATXN1; (+) strand; PAM type: NRG; PAM sequence: GAG
tttatcttgtaagtaacaaa

SEQ ID NO: 113712 - DNA, 20 bp, Artificial Sequence
  Description of Artificial Sequence: Synthetic oligonucleotide
  Target: ATXN1; (+) strand; PAM type: NRG; PAM sequence: TGG
tcttgtaagtaacaaagaga

SEQ ID NO: 113713 - DNA, 20 bp, Artificial Sequence
  Description of Artificial Sequence: Synthetic oligonucleotide
  Target: ATXN1; (+) strand; PAM type: NRG; PAM sequence: GGG
cttgtaagtaacaaagagat

SEQ ID NO: 113714 - DNA, 20 bp, Artificial Sequence
  Description of Artificial Sequence: Synthetic oligonucleotide
  Target: ATXN1; (+) strand; PAM type: NRG; PAM sequence: AAG
gtaagtaacaaagagatggg

SEQ ID NO: 113715 - DNA, 20 bp, Artificial Sequence
  Description of Artificial Sequence: Synthetic oligonucleotide
  Target: ATXN1; (+) strand; PAM type: NRG; PAM sequence: AAG
aagagatgggaagatttcct

SEQ ID NO: 113716 - DNA, 20 bp, Artificial Sequence
  Description of Artificial Sequence: Synthetic oligonucleotide
  Target: ATXN1; (+) strand; PAM type: NRG; PAM sequence: AAG
ttactcactattcaaaattt

SEQ ID NO: 113717 - DNA, 20 bp, Artificial Sequence
  Description of Artificial Sequence: Synthetic oligonucleotide
  Target: ATXN1; (+) strand; PAM type: NRG; PAM sequence: AAG
actattcaaaatttaagaat

SEQ ID NO: 113718 - DNA, 20 bp, Artificial Sequence
  Description of Artificial Sequence: Synthetic oligonucleotide
  Target: ATXN1; (+) strand; PAM type: NRG; PAM sequence: AAG
attcaaaatttaagaataag

SEQ ID NO: 113719 - DNA, 20 bp, Artificial Sequence
  Description of Artificial Sequence: Synthetic oligonucleotide
  Target: ATXN1; (+) strand; PAM type: NRG; PAM sequence: TGG
tttaagaataagaagtcatc

SEQ ID NO: 113720 - DNA, 20 bp, Artificial Sequence
  Description of Artificial Sequence: Synthetic oligonucleotide
  Target: ATXN1; (+) strand; PAM type: NRG; PAM sequence: GGG
ttaagaataagaagtcatct

SEQ ID NO: 113721 - DNA, 20 bp, Artificial Sequence
  Description of Artificial Sequence: Synthetic oligonucleotide
  Target: ATXN1; (+) strand; PAM type: NRG; PAM sequence: GAG
aagaataagaagtcatctgg

SEQ ID NO: 113722 - DNA, 20 bp, Artificial Sequence
  Description of Artificial Sequence: Synthetic oligonucleotide
  Target: ATXN1; (+) strand; PAM type: NRG; PAM sequence: AAG
ataagaagtcatctgggaga

SEQ ID NO: 113723 - DNA, 20 bp, Artificial Sequence
  Description of Artificial Sequence: Synthetic oligonucleotide
  Target: ATXN1; (+) strand; PAM type: NRG; PAM sequence: AGG
taagaagtcatctgggagaa

SEQ ID NO: 113724 - DNA, 20 bp, Artificial Sequence
  Description of Artificial Sequence: Synthetic oligonucleotide
  Target: ATXN1; (+) strand; PAM type: NRG; PAM sequence: GGG
aagaagtcatctgggagaaa

SEQ ID NO: 113725 - DNA, 20 bp, Artificial Sequence
  Description of Artificial Sequence: Synthetic oligonucleotide
  Target: ATXN1; (+) strand; PAM type: NRG; PAM sequence: GGG
agaagtcatctgggagaaag

SEQ ID NO: 113726 - DNA, 20 bp, Artificial Sequence
  Description of Artificial Sequence: Synthetic oligonucleotide
  Target: ATXN1; (+) strand; PAM type: NRG; PAM sequence: TGG
gtcatctgggagaaagggga

SEQ ID NO: 113727 - DNA, 20 bp, Artificial Sequence
  Description of Artificial Sequence: Synthetic oligonucleotide
  Target: ATXN1; (+) strand; PAM type: NRG; PAM sequence: GGG
tcatctgggagaaaggggat

SEQ ID NO: 113728 - DNA, 20 bp, Artificial Sequence
  Description of Artificial Sequence: Synthetic oligonucleotide
  Target: ATXN1; (+) strand; PAM type: NRG; PAM sequence: GAG
gggagaaaggggatgggacc

SEQ ID NO: 113729 - DNA, 20 bp, Artificial Sequence
  Description of Artificial Sequence: Synthetic oligonucleotide
  Target: ATXN1; (+) strand; PAM type: NRG; PAM sequence: CGG
gaccgagcatccctgaaaca

SEQ ID NO: 113730 - DNA, 20 bp, Artificial Sequence
  Description of Artificial Sequence: Synthetic oligonucleotide
  Target: ATXN1; (+) strand; PAM type: NRG; PAM sequence: CAG
agcatccctgaaacacggct

SEQ ID NO: 113731 - DNA, 20 bp, Artificial Sequence
  Description of Artificial Sequence: Synthetic oligonucleotide
  Target: ATXN1; (+) strand; PAM type: NRG; PAM sequence: AGG
gcatccctgaaacacggctc

SEQ ID NO: 113732 - DNA, 20 bp, Artificial Sequence
  Description of Artificial Sequence: Synthetic oligonucleotide
  Target: ATXN1; (+) strand; PAM type: NRG; PAM sequence: GGG
catccctgaaacacggctca

SEQ ID NO: 113733 - DNA, 20 bp, Artificial Sequence
  Description of Artificial Sequence: Synthetic oligonucleotide
  Target: ATXN1; (+) strand; PAM type: NRG; PAM sequence: TGG
ctgaaacacggctcagggct

SEQ ID NO: 113734 - DNA, 20 bp, Artificial Sequence
  Description of Artificial Sequence: Synthetic oligonucleotide
  Target: ATXN1; (+) strand; PAM type: NRG; PAM sequence: CGG
ccctcactcaaccacaaaca

SEQ ID NO: 113735 - DNA, 20 bp, Artificial Sequence
  Description of Artificial Sequence: Synthetic oligonucleotide
  Target: ATXN1; (+) strand; PAM type: NRG; PAM sequence: CAG
cacaaacacggctgcaatat

SEQ ID NO: 113736 - DNA, 20 bp, Artificial Sequence
  Description of Artificial Sequence: Synthetic oligonucleotide
  Target: ATXN1; (+) strand; PAM type: NRG; PAM sequence: AGG
acaaacacggctgcaatatc

SEQ ID NO: 113737 - DNA, 20 bp, Artificial Sequence
  Description of Artificial Sequence: Synthetic oligonucleotide
  Target: ATXN1; (+) strand; PAM type: NRG; PAM sequence: GGG
caaacacggctgcaatatca

SEQ ID NO: 113738 - DNA, 20 bp, Artificial Sequence
  Description of Artificial Sequence: Synthetic oligonucleotide
  Target: ATXN1; (+) strand; PAM type: NRG; PAM sequence: CAG
cacggctgcaatatcagggt

SEQ ID NO: 113739 - DNA, 20 bp, Artificial Sequence
  Description of Artificial Sequence: Synthetic oligonucleotide
  Target: ATXN1; (+) strand; PAM type: NRG; PAM sequence: TAG
ggtcagtgttccacatcccg

SEQ ID NO: 113740 - DNA, 20 bp, Artificial Sequence
  Description of Artificial Sequence: Synthetic oligonucleotide
  Target: ATXN1; (+) strand; PAM type: NRG; PAM sequence: CAG
cagtgttccacatcccgtag

SEQ ID NO: 113741 - DNA, 20 bp, Artificial Sequence
  Description of Artificial Sequence: Synthetic oligonucleotide
  Target: ATXN1; (+) strand; PAM type: NRG; PAM sequence: CAG
tagcagatgaccctctgttc

SEQ ID NO: 113742 - DNA, 20 bp, Artificial Sequence
  Description of Artificial Sequence: Synthetic oligonucleotide
  Target: ATXN1; (+) strand; PAM type: NRG; PAM sequence: AAG
cctctgttccagaacaaaca

SEQ ID NO: 113743 - DNA, 20 bp, Artificial Sequence
  Description of Artificial Sequence: Synthetic oligonucleotide
  Target: ATXN1; (+) strand; PAM type: NRG; PAM sequence: AAG
aaacaaagtgtgcaccctat

SEQ ID NO: 113744 - DNA, 20 bp, Artificial Sequence
  Description of Artificial Sequence: Synthetic oligonucleotide
  Target: ATXN1; (+) strand; PAM type: NRG; PAM sequence: TAG
ccctataagcatgatgacat

SEQ ID NO: 113745 - DNA, 20 bp, Artificial Sequence
  Description of Artificial Sequence: Synthetic oligonucleotide
  Target: ATXN1; (+) strand; PAM type: NRG; PAM sequence: TAG
aagcatgatgacattagaat

SEQ ID NO: 113746 - DNA, 20 bp, Artificial Sequence
  Description of Artificial Sequence: Synthetic oligonucleotide
  Target: ATXN1; (+) strand; PAM type: NRG; PAM sequence: AAG
gacattagaattagacttca

SEQ ID NO: 113747 - DNA, 20 bp, Artificial Sequence
  Description of Artificial Sequence: Synthetic oligonucleotide
  Target: ATXN1; (+) strand; PAM type: NRG; PAM sequence: TAG
ttagaattagacttcaaagc

SEQ ID NO: 113748 - DNA, 20 bp, Artificial Sequence
  Description of Artificial Sequence: Synthetic oligonucleotide
  Target: ATXN1; (+) strand; PAM type: NRG; PAM sequence: AAG
tagacttcaaagctagcctc

SEQ ID NO: 113749 - DNA, 20 bp, Artificial Sequence
  Description of Artificial Sequence: Synthetic oligonucleotide
  Target: ATXN1; (+) strand; PAM type: NRG; PAM sequence: CAG
agctagcctcaagatgctca

SEQ ID NO: 113750 - DNA, 20 bp, Artificial Sequence
  Description of Artificial Sequence: Synthetic oligonucleotide
  Target: ATXN1; (+) strand; PAM type: NRG; PAM sequence: AAG
tattaaccactgtctgccac

SEQ ID NO: 113751 - DNA, 20 bp, Artificial Sequence
  Description of Artificial Sequence: Synthetic oligonucleotide
  Target: ATXN1; (+) strand; PAM type: NRG; PAM sequence: TGG
cactgtctgccacaagcata

SEQ ID NO: 113752 - DNA, 20 bp, Artificial Sequence
  Description of Artificial Sequence: Synthetic oligonucleotide
  Target: ATXN1; (+) strand; PAM type: NRG; PAM sequence: AAG
ctgccacaagcatatggcac

SEQ ID NO: 113753 - DNA, 20 bp, Artificial Sequence
  Description of Artificial Sequence: Synthetic oligonucleotide
  Target: ATXN1; (+) strand; PAM type: NRG; PAM sequence: CAG
cacaagcatatggcacaaga

SEQ ID NO: 113754 - DNA, 20 bp, Artificial Sequence
  Description of Artificial Sequence: Synthetic oligonucleotide
  Target: ATXN1; (+) strand; PAM type: NRG; PAM sequence: AGG
acaagcatatggcacaagac

SEQ ID NO: 113755 - DNA, 20 bp, Artificial Sequence
  Description of Artificial Sequence: Synthetic oligonucleotide
  Target: ATXN1; (+) strand; PAM type: NRG; PAM sequence: TGG
gcatatggcacaagacaggc

SEQ ID NO: 113756 - DNA, 20 bp, Artificial Sequence
  Description of Artificial Sequence: Synthetic oligonucleotide
  Target: ATXN1; (+) strand; PAM type: NRG; PAM sequence: GAG
atatggcacaagacaggctg

SEQ ID NO: 113757 - DNA, 20 bp, Artificial Sequence
  Description of Artificial Sequence: Synthetic oligonucleotide
  Target: ATXN1; (+) strand; PAM type: NRG; PAM sequence: CAG
tggcacaagacaggctggag

SEQ ID NO: 113758 - DNA, 20 bp, Artificial Sequence
  Description of Artificial Sequence: Synthetic oligonucleotide
  Target: ATXN1; (+) strand; PAM type: NRG; PAM sequence: AAG
gacaggctggagcagatcac

SEQ ID NO: 113759 - DNA, 20 bp, Artificial Sequence
  Description of Artificial Sequence: Synthetic oligonucleotide
  Target: ATXN1; (+) strand; PAM type: NRG; PAM sequence: AGG
acaggctggagcagatcaca

SEQ ID NO: 113760 - DNA, 20 bp, Artificial Sequence
  Description of Artificial Sequence: Synthetic oligonucleotide
  Target: ATXN1; (+) strand; PAM type: NRG; PAM sequence: AAG
gctggagcagatcacaagga

SEQ ID NO: 113761 - DNA, 20 bp, Artificial Sequence
  Description of Artificial Sequence: Synthetic oligonucleotide
  Target: ATXN1; (+) strand; PAM type: NRG; PAM sequence: TGG
gatcacaaggaaagactcgt

SEQ ID NO: 113762 - DNA, 20 bp, Artificial Sequence
  Description of Artificial Sequence: Synthetic oligonucleotide
  Target: ATXN1; (+) strand; PAM type: NRG; PAM sequence: TGG
ggaaagactcgttggcatat

SEQ ID NO: 113763 - DNA, 20 bp, Artificial Sequence
  Description of Artificial Sequence: Synthetic oligonucleotide
  Target: ATXN1; (+) strand; PAM type: NRG; PAM sequence: CAG
attggcccacaatactgcca

SEQ ID NO: 113764 - DNA, 20 bp, Artificial Sequence
  Description of Artificial Sequence: Synthetic oligonucleotide
  Target: ATXN1; (+) strand; PAM type: NRG; PAM sequence: GAG
tggcccacaatactgccaca

SEQ ID NO: 113765 - DNA, 20 bp, Artificial Sequence
  Description of Artificial Sequence: Synthetic oligonucleotide
  Target: ATXN1; (+) strand; PAM type: NRG; PAM sequence: AGG
ggcccacaatactgccacag

SEQ ID NO: 113766 - DNA, 20 bp, Artificial Sequence
  Description of Artificial Sequence: Synthetic oligonucleotide
  Target: ATXN1; (+) strand; PAM type: NRG; PAM sequence: CAG
ccacaatactgccacagagg

SEQ ID NO: 113767 - DNA, 20 bp, Artificial Sequence
  Description of Artificial Sequence: Synthetic oligonucleotide
  Target: ATXN1; (+) strand; PAM type: NRG; PAM sequence: GAG
acaatactgccacagaggca

SEQ ID NO: 113768 - DNA, 20 bp, Artificial Sequence
  Description of Artificial Sequence: Synthetic oligonucleotide
  Target: ATXN1; (+) strand; PAM type: NRG; PAM sequence: TAG
actgccacagaggcagagct

SEQ ID NO: 113769 - DNA, 20 bp, Artificial Sequence
  Description of Artificial Sequence: Synthetic oligonucleotide
  Target: ATXN1; (+) strand; PAM type: NRG; PAM sequence: GAG
tgccacagaggcagagctta

SEQ ID NO: 113770 - DNA, 20 bp, Artificial Sequence
  Description of Artificial Sequence: Synthetic oligonucleotide
  Target: ATXN1; (+) strand; PAM type: NRG; PAM sequence: GAG
ccacagaggcagagcttaga

SEQ ID NO: 113771 - DNA, 20 bp, Artificial Sequence
  Description of Artificial Sequence: Synthetic oligonucleotide
  Target: ATXN1; (+) strand; PAM type: NRG; PAM sequence: AGG
cacagaggcagagcttagag

SEQ ID NO: 113772 - DNA, 20 bp, Artificial Sequence
  Description of Artificial Sequence: Synthetic oligonucleotide
  Target: ATXN1; (+) strand; PAM type: NRG; PAM sequence: GGG
acagaggcagagcttagaga

SEQ ID NO: 113773 - DNA, 20 bp, Artificial Sequence
  Description of Artificial Sequence: Synthetic oligonucleotide
  Target: ATXN1; (+) strand; PAM type: NRG; PAM sequence: TAG
gcagagcttagagagggtgc

SEQ ID NO: 113774 - DNA, 20 bp, Artificial Sequence
  Description of Artificial Sequence: Synthetic oligonucleotide
  Target: ATXN1; (+) strand; PAM type: NRG; PAM sequence: AGG
cagagcttagagagggtgct

SEQ ID NO: 113775 - DNA, 20 bp, Artificial Sequence
  Description of Artificial Sequence: Synthetic oligonucleotide
  Target: ATXN1; (+) strand; PAM type: NRG; PAM sequence: AAG
gcttagagagggtgctaggc

SEQ ID NO: 113776 - DNA, 20 bp, Artificial Sequence
  Description of Artificial Sequence: Synthetic oligonucleotide
  Target: ATXN1; (+) strand; PAM type: NRG; PAM sequence: AGG
cttagagagggtgctaggca

SEQ ID NO: 113777 - DNA, 20 bp, Artificial Sequence
  Description of Artificial Sequence: Synthetic oligonucleotide
  Target: ATXN1; (+) strand; PAM type: NRG; PAM sequence: TGG
attcatccgctatttcactc

SEQ ID NO: 113778 - DNA, 20 bp, Artificial Sequence
  Description of Artificial Sequence: Synthetic oligonucleotide
  Target: ATXN1; (+) strand; PAM type: NRG; PAM sequence: AAG
atccgctatttcactctgga

SEQ ID NO: 113779 - DNA, 20 bp, Artificial Sequence
  Description of Artificial Sequence: Synthetic oligonucleotide
  Target: ATXN1; (+) strand; PAM type: NRG; PAM sequence: AGG
tccgctatttcactctggaa

SEQ ID NO: 113780 - DNA, 20 bp, Artificial Sequence
  Description of Artificial Sequence: Synthetic oligonucleotide
  Target: ATXN1; (+) strand; PAM type: NRG; PAM sequence: GGG
ccgctatttcactctggaaa

SEQ ID NO: 113781 - DNA, 20 bp, Artificial Sequence
  Description of Artificial Sequence: Synthetic oligonucleotide
  Target: ATXN1; (+) strand; PAM type: NRG; PAM sequence: GGG
cgctatttcactctggaaag

SEQ ID NO: 113782 - DNA, 20 bp, Artificial Sequence
  Description of Artificial Sequence: Synthetic oligonucleotide
  Target: ATXN1; (+) strand; PAM type: NRG; PAM sequence: CAG
tttcactctggaaaggggat

SEQ ID NO: 113783 - DNA, 20 bp, Artificial Sequence
  Description of Artificial Sequence: Synthetic oligonucleotide
  Target: ATXN1; (+) strand; PAM type: NRG; PAM sequence: TGG
actctggaaaggggatcagt

SEQ ID NO: 113784 - DNA, 20 bp, Artificial Sequence
  Description of Artificial Sequence: Synthetic oligonucleotide
  Target: ATXN1; (+) strand; PAM type: NRG; PAM sequence: GGG
ctctggaaaggggatcagtt

SEQ ID NO: 113785 - DNA, 20 bp, Artificial Sequence
  Description of Artificial Sequence: Synthetic oligonucleotide
  Target: ATXN1; (+) strand; PAM type: NRG; PAM sequence: GGG
tctggaaaggggatcagttg

SEQ ID NO: 113786 - DNA, 20 bp, Artificial Sequence
  Description of Artificial Sequence: Synthetic oligonucleotide
  Target: ATXN1; (+) strand; PAM type: NRG; PAM sequence: GGG
ctggaaaggggatcagttgg

SEQ ID NO: 113787 - DNA, 20 bp, Artificial Sequence
  Description of Artificial Sequence: Synthetic oligonucleotide
  Target: ATXN1; (+) strand; PAM type: NRG; PAM sequence: GAG
aaaaaatctgcaaacctttt

SEQ ID NO: 113788 - DNA, 20 bp, Artificial Sequence
  Description of Artificial Sequence: Synthetic oligonucleotide
  Target: ATXN1; (+) strand; PAM type: NRG; PAM sequence: AGG
aaaaatctgcaaaccttttg

SEQ ID NO: 113789 - DNA, 20 bp, Artificial Sequence
  Description of Artificial Sequence: Synthetic oligonucleotide
  Target: ATXN1; (+) strand; PAM type: NRG; PAM sequence: CAG
atctgcaaaccttttgagga

SEQ ID NO: 113790 - DNA, 20 bp, Artificial Sequence
  Description of Artificial Sequence: Synthetic oligonucleotide
  Target: ATXN1; (+) strand; PAM type: NRG; PAM sequence: AAG
tgcaaaccttttgaggacag

SEQ ID NO: 113791 - DNA, 20 bp, Artificial Sequence
  Description of Artificial Sequence: Synthetic oligonucleotide
  Target: ATXN1; (+) strand; PAM type: NRG; PAM sequence: AGG
gcaaaccttttgaggacaga

SEQ ID NO: 113792 - DNA, 20 bp, Artificial Sequence
  Description of Artificial Sequence: Synthetic oligonucleotide
  Target: ATXN1; (+) strand; PAM type: NRG; PAM sequence: GAG
caatattgcttgaaatttat

SEQ ID NO: 113793 - DNA, 20 bp, Artificial Sequence
  Description of Artificial Sequence: Synthetic oligonucleotide
  Target: ATXN1; (+) strand; PAM type: NRG; PAM sequence: GAG
gcttgaaatttatgagtaat

SEQ ID NO: 113794 - DNA, 20 bp, Artificial Sequence
  Description of Artificial Sequence: Synthetic oligonucleotide
  Target: ATXN1; (+) strand; PAM type: NRG; PAM sequence: TGG
ttatgagtaatgagccattt

SEQ ID NO: 113795 - DNA, 20 bp, Artificial Sequence
  Description of Artificial Sequence: Synthetic oligonucleotide
  Target: ATXN1; (+) strand; PAM type: NRG; PAM sequence: GGG
tatgagtaatgagccatttt

SEQ ID NO: 113796 - DNA, 20 bp, Artificial Sequence
  Description of Artificial Sequence: Synthetic oligonucleotide
  Target: ATXN1; (+) strand; PAM type: NRG; PAM sequence: GAG
tgagtaatgagccattttgg

SEQ ID NO: 113797 - DNA, 20 bp, Artificial Sequence
  Description of Artificial Sequence: Synthetic oligonucleotide
  Target: ATXN1; (+) strand; PAM type: NRG; PAM sequence: AAG
gtaatgagccattttgggag

SEQ ID NO: 113798 - DNA, 20 bp, Artificial Sequence
  Description of Artificial Sequence: Synthetic oligonucleotide
  Target: ATXN1; (+) strand; PAM type: NRG; PAM sequence: AGG
taatgagccattttgggaga

SEQ ID NO: 113799 - DNA, 20 bp, Artificial Sequence
  Description of Artificial Sequence: Synthetic oligonucleotide
  Target: ATXN1; (+) strand; PAM type: NRG; PAM sequence: AAG
tgagccattttgggagaagg

SEQ ID NO: 113800 - DNA, 20 bp, Artificial Sequence
  Description of Artificial Sequence: Synthetic oligonucleotide
  Target: ATXN1; (+) strand; PAM type: NRG; PAM sequence: CAG
gattctgtcattcattttga

SEQ ID NO: 113801 - DNA, 20 bp, Artificial Sequence
  Description of Artificial Sequence: Synthetic oligonucleotide
  Target: ATXN1; (+) strand; PAM type: NRG; PAM sequence: AGG
attctgtcattcattttgac

SEQ ID NO: 113802 - DNA, 20 bp, Artificial Sequence
  Description of Artificial Sequence: Synthetic oligonucleotide
  Target: ATXN1; (+) strand; PAM type: NRG; PAM sequence: GGG
ttctgtcattcattttgaca

SEQ ID NO: 113803 - DNA, 20 bp, Artificial Sequence
  Description of Artificial Sequence: Synthetic oligonucleotide
  Target: ATXN1; (+) strand; PAM type: NRG; PAM sequence: AAG
gacagggcttattaacacaa

SEQ ID NO: 113804 - DNA, 20 bp, Artificial Sequence
  Description of Artificial Sequence: Synthetic oligonucleotide
  Target: ATXN1; (+) strand; PAM type: NRG; PAM sequence: AGG
acagggcttattaacacaaa

SEQ ID NO: 113805 - DNA, 20 bp, Artificial Sequence
  Description of Artificial Sequence: Synthetic oligonucleotide
  Target: ATXN1; (+) strand; PAM type: NRG; PAM sequence: GAG
agggcttattaacacaaaag

SEQ ID NO: 113806 - DNA, 20 bp, Artificial Sequence
  Description of Artificial Sequence: Synthetic oligonucleotide
  Target: ATXN1; (+) strand; PAM type: NRG; PAM sequence: AGG
gggcttattaacacaaaagg

SEQ ID NO: 113807 - DNA, 20 bp, Artificial Sequence
  Description of Artificial Sequence: Synthetic oligonucleotide
  Target: ATXN1; (+) strand; PAM type: NRG; PAM sequence: GAG
gcttattaacacaaaaggag

SEQ ID NO: 113808 - DNA, 20 bp, Artificial Sequence
  Description of Artificial Sequence: Synthetic oligonucleotide
  Target: ATXN1; (+) strand; PAM type: NRG; PAM sequence: GAG
ttattaacacaaaaggagga

SEQ ID NO: 113809 - DNA, 20 bp, Artificial Sequence
  Description of Artificial Sequence: Synthetic oligonucleotide
  Target: ATXN1; (+) strand; PAM type: NRG; PAM sequence: AGG
tattaacacaaaaggaggag

SEQ ID NO: 113810 - DNA, 20 bp, Artificial Sequence
  Description of Artificial Sequence: Synthetic oligonucleotide
  Target: ATXN1; (+) strand; PAM type: NRG; PAM sequence: GGG
attaacacaaaaggaggaga

SEQ ID NO: 113811 - DNA, 20 bp, Artificial Sequence
  Description of Artificial Sequence: Synthetic oligonucleotide
  Target: ATXN1; (+) strand; PAM type: NRG; PAM sequence: TGG
acacaaaaggaggagagggc

SEQ ID NO: 113812 - DNA, 20 bp, Artificial Sequence
  Description of Artificial Sequence: Synthetic oligonucleotide
  Target: ATXN1; (+) strand; PAM type: NRG; PAM sequence: TGG
caaaaggaggagagggctgg

SEQ ID NO: 113813 - DNA, 20 bp, Artificial Sequence
  Description of Artificial Sequence: Synthetic oligonucleotide
  Target: ATXN1; (+) strand; PAM type: NRG; PAM sequence: GGG
aaaaggaggagagggctggt

SEQ ID NO: 113814 - DNA, 20 bp, Artificial Sequence
  Description of Artificial Sequence: Synthetic oligonucleotide
  Target: ATXN1; (+) strand; PAM type: NRG; PAM sequence: GGG
aaaggaggagagggctggtg

SEQ ID NO: 113815 - DNA, 20 bp, Artificial Sequence
  Description of Artificial Sequence: Synthetic oligonucleotide
  Target: ATXN1; (+) strand; PAM type: NRG; PAM sequence: GAG
aggaggagagggctggtggg

SEQ ID NO: 113816 - DNA, 20 bp, Artificial Sequence
  Description of Artificial Sequence: Synthetic oligonucleotide
  Target: ATXN1; (+) strand; PAM type: NRG; PAM sequence: AGG
ggaggagagggctggtgggg

SEQ ID NO: 113817 - DNA, 20 bp, Artificial Sequence
  Description of Artificial Sequence: Synthetic oligonucleotide
  Target: ATXN1; (+) strand; PAM type: NRG; PAM sequence: GGG
gaggagagggctggtgggga

SEQ ID NO: 113818 - DNA, 20 bp, Artificial Sequence
  Description of Artificial Sequence: Synthetic oligonucleotide
  Target: ATXN1; (+) strand; PAM type: NRG; PAM sequence: TGG
gagagggctggtggggaggg

SEQ ID NO: 113819 - DNA, 20 bp, Artificial Sequence
  Description of Artificial Sequence: Synthetic oligonucleotide
  Target: ATXN1; (+) strand; PAM type: NRG; PAM sequence: GGG
agagggctggtggggagggt

SEQ ID NO: 113820 - DNA, 20 bp, Artificial Sequence
  Description of Artificial Sequence: Synthetic oligonucleotide
  Target: ATXN1; (+) strand; PAM type: NRG; PAM sequence: GGG
gagggctggtggggagggtg

SEQ ID NO: 113821 - DNA, 20 bp, Artificial Sequence
  Description of Artificial Sequence: Synthetic oligonucleotide
  Target: ATXN1; (+) strand; PAM type: NRG; PAM sequence: TGG
tggggagggtggggcacttg

SEQ ID NO: 113822 - DNA, 20 bp, Artificial Sequence
  Description of Artificial Sequence: Synthetic oligonucleotide
  Target: ATXN1; (+) strand; PAM type: NRG; PAM sequence: GGG
ggggagggtggggcacttgt

SEQ ID NO: 113823 - DNA, 20 bp, Artificial Sequence
  Description of Artificial Sequence: Synthetic oligonucleotide
  Target: ATXN1; (+) strand; PAM type: NRG; PAM sequence: AAG
gagggtggggcacttgtggg

SEQ ID NO: 113824 - DNA, 20 bp, Artificial Sequence
  Description of Artificial Sequence: Synthetic oligonucleotide
  Target: ATXN1; (+) strand; PAM type: NRG; PAM sequence: AGG
agggtggggcacttgtggga

SEQ ID NO: 113825 - DNA, 20 bp, Artificial Sequence
  Description of Artificial Sequence: Synthetic oligonucleotide
  Target: ATXN1; (+) strand; PAM type: NRG; PAM sequence: CAG
ggggcacttgtgggaaggtg

SEQ ID NO: 113826 - DNA, 20 bp, Artificial Sequence
  Description of Artificial Sequence: Synthetic oligonucleotide
  Target: ATXN1; (+) strand; PAM type: NRG; PAM sequence: GAG
ggcacttgtgggaaggtgca

SEQ ID NO: 113827 - DNA, 20 bp, Artificial Sequence
  Description of Artificial Sequence: Synthetic oligonucleotide
  Target: ATXN1; (+) strand; PAM type: NRG; PAM sequence: GAG
cacttgtgggaaggtgcaga

SEQ ID NO: 113828 - DNA, 20 bp, Artificial Sequence
  Description of Artificial Sequence: Synthetic oligonucleotide
  Target: ATXN1; (+) strand; PAM type: NRG; PAM sequence: AGG
acttgtgggaaggtgcagag

SEQ ID NO: 113829 - DNA, 20 bp, Artificial Sequence
  Description of Artificial Sequence: Synthetic oligonucleotide
  Target: ATXN1; (+) strand; PAM type: NRG; PAM sequence: CAG
gtgggaaggtgcagagagga

SEQ ID NO: 113830 - DNA, 20 bp, Artificial Sequence
  Description of Artificial Sequence: Synthetic oligonucleotide
  Target: ATXN1; (+) strand; PAM type: NRG; PAM sequence: AAG
ggaaggtgcagagaggacag

SEQ ID NO: 113831 - DNA, 20 bp, Artificial Sequence
  Description of Artificial Sequence: Synthetic oligonucleotide
  Target: ATXN1; (+) strand; PAM type: NRG; PAM sequence: AGG
gaaggtgcagagaggacaga

SEQ ID NO: 113832 - DNA, 20 bp, Artificial Sequence
  Description of Artificial Sequence: Synthetic oligonucleotide
  Target: ATXN1; (+) strand; PAM type: NRG; PAM sequence: GGG
aaggtgcagagaggacagaa

SEQ ID NO: 113833 - DNA, 20 bp, Artificial Sequence
  Description of Artificial Sequence: Synthetic oligonucleotide
  Target: ATXN1; (+) strand; PAM type: NRG; PAM sequence: AAG
gcagagaggacagaagggtg

SEQ ID NO: 113834 - DNA, 20 bp, Artificial Sequence
  Description of Artificial Sequence: Synthetic oligonucleotide
  Target: ATXN1; (+) strand; PAM type: NRG; PAM sequence: CAG
agaggacagaagggtgaagc

SEQ ID NO: 113835 - DNA, 20 bp, Artificial Sequence
  Description of Artificial Sequence: Synthetic oligonucleotide
  Target: ATXN1; (+) strand; PAM type: NRG; PAM sequence: CAG
gacagaagggtgaagccagc

SEQ ID NO: 113836 - DNA, 20 bp, Artificial Sequence
  Description of Artificial Sequence: Synthetic oligonucleotide
  Target: ATXN1; (+) strand; PAM type: NRG; PAM sequence: AGG
acagaagggtgaagccagcc

SEQ ID NO: 113837 - DNA, 20 bp, Artificial Sequence
  Description of Artificial Sequence: Synthetic oligonucleotide
  Target: ATXN1; (+) strand; PAM type: NRG; PAM sequence: GAG
gtgaagccagccaggcaaat

SEQ ID NO: 113838 - DNA, 20 bp, Artificial Sequence
  Description of Artificial Sequence: Synthetic oligonucleotide
  Target: ATXN1; (+) strand; PAM type: NRG; PAM sequence: GAG
ccagccaggcaaatgagaat

SEQ ID NO: 113839 - DNA, 20 bp, Artificial Sequence
  Description of Artificial Sequence: Synthetic oligonucleotide
  Target: ATXN1; (+) strand; PAM type: NRG; PAM sequence: TGG
agaatgagaaattgcaatta

SEQ ID NO: 113840 - DNA, 20 bp, Artificial Sequence
  Description of Artificial Sequence: Synthetic oligonucleotide
  Target: ATXN1; (+) strand; PAM type: NRG; PAM sequence: TGG
aattgcaattatggacctta

SEQ ID NO: 113841 - DNA, 20 bp, Artificial Sequence
  Description of Artificial Sequence: Synthetic oligonucleotide
  Target: ATXN1; (+) strand; PAM type: NRG; PAM sequence: GAG
ttgcaattatggaccttatg

SEQ ID NO: 113842 - DNA, 20 bp, Artificial Sequence
  Description of Artificial Sequence: Synthetic oligonucleotide
  Target: ATXN1; (+) strand; PAM type: NRG; PAM sequence: AGG
tgcaattatggaccttatgg

SEQ ID NO: 113843 - DNA, 20 bp, Artificial Sequence
  Description of Artificial Sequence: Synthetic oligonucleotide
  Target: ATXN1; (+) strand; PAM type: NRG; PAM sequence: GAG
caattatggaccttatggag

SEQ ID NO: 113844 - DNA, 20 bp, Artificial Sequence
  Description of Artificial Sequence: Synthetic oligonucleotide
  Target: ATXN1; (+) strand; PAM type: NRG; PAM sequence: TGG
ggaccttatggaggagctgc

SEQ ID NO: 113845 - DNA, 20 bp, Artificial Sequence
  Description of Artificial Sequence: Synthetic oligonucleotide
  Target: ATXN1; (+) strand; PAM type: NRG; PAM sequence: AAG
cttatggaggagctgctggt

SEQ ID NO: 113846 - DNA, 20 bp, Artificial Sequence
  Description of Artificial Sequence: Synthetic oligonucleotide
  Target: ATXN1; (+) strand; PAM type: NRG; PAM sequence: TGG
gagctgctggtaagctaccc

SEQ ID NO: 113847 - DNA, 20 bp, Artificial Sequence
  Description of Artificial Sequence: Synthetic oligonucleotide
  Target: ATXN1; (+) strand; PAM type: NRG; PAM sequence: AAG
ctggtaagctaccctggcca

SEQ ID NO: 113848 - DNA, 20 bp, Artificial Sequence
  Description of Artificial Sequence: Synthetic oligonucleotide
  Target: ATXN1; (+) strand; PAM type: NRG; PAM sequence: AGG
tggtaagctaccctggccaa

SEQ ID NO: 113849 - DNA, 20 bp, Artificial Sequence
  Description of Artificial Sequence: Synthetic oligonucleotide
  Target: ATXN1; (+) strand; PAM type: NRG; PAM sequence: TGG
ggccaaaggaaaatgttgat

SEQ ID NO: 113850 - DNA, 20 bp, Artificial Sequence
  Description of Artificial Sequence: Synthetic oligonucleotide
  Target: ATXN1; (+) strand; PAM type: NRG; PAM sequence: CAG
atgttgattggaccaatttt

SEQ ID NO: 113851 - DNA, 20 bp, Artificial Sequence
  Description of Artificial Sequence: Synthetic oligonucleotide
  Target: ATXN1; (+) strand; PAM type: NRG; PAM sequence: GAG
gttgattggaccaattttca

SEQ ID NO: 113852 - DNA, 20 bp, Artificial Sequence
  Description of Artificial Sequence: Synthetic oligonucleotide
  Target: ATXN1; (+) strand; PAM type: NRG; PAM sequence: AGG
ttgattggaccaattttcag

SEQ ID NO: 113853 - DNA, 20 bp, Artificial Sequence
  Description of Artificial Sequence: Synthetic oligonucleotide
  Target: ATXN1; (+) strand; PAM type: NRG; PAM sequence: GGG
tgattggaccaattttcaga

SEQ ID NO: 113854 - DNA, 20 bp, Artificial Sequence
  Description of Artificial Sequence: Synthetic oligonucleotide
  Target: ATXN1; (+) strand; PAM type: NRG; PAM sequence: CAG
gaccaattttcagagggaaa

SEQ ID NO: 113855 - DNA, 20 bp, Artificial Sequence
  Description of Artificial Sequence: Synthetic oligonucleotide
  Target: ATXN1; (+) strand; PAM type: NRG; PAM sequence: CAG
aattttcagagggaaacaga

SEQ ID NO: 113856 - DNA, 20 bp, Artificial Sequence
  Description of Artificial Sequence: Synthetic oligonucleotide
  Target: ATXN1; (+) strand; PAM type: NRG; PAM sequence: AAG
gaaacagacagctcttctgc

SEQ ID NO: 113857 - DNA, 20 bp, Artificial Sequence
  Description of Artificial Sequence: Synthetic oligonucleotide
  Target: ATXN1; (+) strand; PAM type: NRG; PAM sequence: CAG
acagacagctcttctgcaag

SEQ ID NO: 113858 - DNA, 20 bp, Artificial Sequence
  Description of Artificial Sequence: Synthetic oligonucleotide
  Target: ATXN1; (+) strand; PAM type: NRG; PAM sequence: TGG
acagctcttctgcaagcaga

SEQ ID NO: 113859 - DNA, 20 bp, Artificial Sequence
  Description of Artificial Sequence: Synthetic oligonucleotide
  Target: ATXN1; (+) strand; PAM type: NRG; PAM sequence: TAG
gcagatggatgacaaatctc

SEQ ID NO: 113860 - DNA, 20 bp, Artificial Sequence
  Description of Artificial Sequence: Synthetic oligonucleotide
  Target: ATXN1; (+) strand; PAM type: NRG; PAM sequence: AGG
cagatggatgacaaatctct

SEQ ID NO: 113861 - DNA, 20 bp, Artificial Sequence
  Description of Artificial Sequence: Synthetic oligonucleotide
  Target: ATXN1; (+) strand; PAM type: NRG; PAM sequence: GAG
gatggatgacaaatctctag

SEQ ID NO: 113862 - DNA, 20 bp, Artificial Sequence
  Description of Artificial Sequence: Synthetic oligonucleotide
  Target: ATXN1; (+) strand; PAM type: NRG; PAM sequence: AGG
atggatgacaaatctctagg

SEQ ID NO: 113863 - DNA, 20 bp, Artificial Sequence
  Description of Artificial Sequence: Synthetic oligonucleotide
  Target: ATXN1; (+) strand; PAM type: NRG; PAM sequence: GAG
ggatgacaaatctctaggag

SEQ ID NO: 113864 - DNA, 20 bp, Artificial Sequence
  Description of Artificial Sequence: Synthetic oligonucleotide
  Target: ATXN1; (+) strand; PAM type: NRG; PAM sequence: AGG
gatgacaaatctctaggagg

SEQ ID NO: 113865 - DNA, 20 bp, Artificial Sequence
  Description of Artificial Sequence: Synthetic oligonucleotide
  Target: ATXN1; (+) strand; PAM type: NRG; PAM sequence: TGG
tgtgttgttcatgtgtgaaa

SEQ ID NO: 113866 - DNA, 20 bp, Artificial Sequence
  Description of Artificial Sequence: Synthetic oligonucleotide
  Target: ATXN1; (+) strand; PAM type: NRG; PAM sequence: TAG
gttcatgtgtgaaatggtct

SEQ ID NO: 113867 - DNA, 20 bp, Artificial Sequence
  Description of Artificial Sequence: Synthetic oligonucleotide
  Target: ATXN1; (+) strand; PAM type: NRG; PAM sequence: AAG
tgtgtgaaatggtcttagcc

SEQ ID NO: 113868 - DNA, 20 bp, Artificial Sequence
  Description of Artificial Sequence: Synthetic oligonucleotide
  Target: ATXN1; (+) strand; PAM type: NRG; PAM sequence: AGG
gtgtgaaatggtcttagcca

SEQ ID NO: 113869 - DNA, 20 bp, Artificial Sequence
  Description of Artificial Sequence: Synthetic oligonucleotide
  Target: ATXN1; (+) strand; PAM type: NRG; PAM sequence: GAG
gtgaaatggtcttagccaag

SEQ ID NO: 113870 - DNA, 20 bp, Artificial Sequence
  Description of Artificial Sequence: Synthetic oligonucleotide
  Target: ATXN1; (+) strand; PAM type: NRG; PAM sequence: AAG
tggtcttagccaaggagtaa

SEQ ID NO: 113871 - DNA, 20 bp, Artificial Sequence
  Description of Artificial Sequence: Synthetic oligonucleotide
  Target: ATXN1; (+) strand; PAM type: NRG; PAM sequence: AAG
agccaaggagtaaaagcgcc

SEQ ID NO: 113872 - DNA, 20 bp, Artificial Sequence
  Description of Artificial Sequence: Synthetic oligonucleotide
  Target: ATXN1; (+) strand; PAM type: NRG; PAM sequence: AAG
aagcgccaagccatgtatgt

SEQ ID NO: 113873 - DNA, 20 bp, Artificial Sequence
  Description of Artificial Sequence: Synthetic oligonucleotide
  Target: ATXN1; (+) strand; PAM type: NRG; PAM sequence: CAG
cgccaagccatgtatgtaag

SEQ ID NO: 113874 - DNA, 20 bp, Artificial Sequence
  Description of Artificial Sequence: Synthetic oligonucleotide
  Target: ATXN1; (+) strand; PAM type: NRG; PAM sequence: GAG
ccaagccatgtatgtaagca

SEQ ID NO: 113875 - DNA, 20 bp, Artificial Sequence
  Description of Artificial Sequence: Synthetic oligonucleotide
  Target: ATXN1; (+) strand; PAM type: NRG; PAM sequence: TGG
tgtatgtaagcagagccacc

SEQ ID NO: 113876 - DNA, 20 bp, Artificial Sequence
  Description of Artificial Sequence: Synthetic oligonucleotide
  Target: ATXN1; (+) strand; PAM type: NRG; PAM sequence: TGG
agagccacctggcctgtgtg

SEQ ID NO: 113877 - DNA, 20 bp, Artificial Sequence
  Description of Artificial Sequence: Synthetic oligonucleotide
  Target: ATXN1; (+) strand; PAM type: NRG; PAM sequence: TGG
gccacctggcctgtgtgtgg

SEQ ID NO: 113878 - DNA, 20 bp, Artificial Sequence
  Description of Artificial Sequence: Synthetic oligonucleotide
  Target: ATXN1; (+) strand; PAM type: NRG; PAM sequence: TGG
acctggcctgtgtgtggtgg

SEQ ID NO: 113879 - DNA, 20 bp, Artificial Sequence
  Description of Artificial Sequence: Synthetic oligonucleotide
  Target: ATXN1; (+) strand; PAM type: NRG; PAM sequence: GGG
cctggcctgtgtgtggtggt

SEQ ID NO: 113880 - DNA, 20 bp, Artificial Sequence
  Description of Artificial Sequence: Synthetic oligonucleotide
  Target: ATXN1; (+) strand; PAM type: NRG; PAM sequence: GGG
ctggcctgtgtgtggtggtg

SEQ ID NO: 113881 - DNA, 20 bp, Artificial Sequence
  Description of Artificial Sequence: Synthetic oligonucleotide
  Target: ATXN1; (+) strand; PAM type: NRG; PAM sequence: GAG
ctgtgtgtggtggtggggcc

SEQ ID NO: 113882 - DNA, 20 bp, Artificial Sequence
  Description of Artificial Sequence: Synthetic oligonucleotide
  Target: ATXN1; (+) strand; PAM type: NRG; PAM sequence: GAG
gtctgtatgtgtgtgtgtgt

SEQ ID NO: 113883 - DNA, 20 bp, Artificial Sequence
  Description of Artificial Sequence: Synthetic oligonucleotide
  Target: ATXN1; (+) strand; PAM type: NRG; PAM sequence: GAG
ctgtatgtgtgtgtgtgtga

SEQ ID NO: 113884 - DNA, 20 bp, Artificial Sequence
  Description of Artificial Sequence: Synthetic oligonucleotide
  Target: ATXN1; (+) strand; PAM type: NRG; PAM sequence: GAG
gtatgtgtgtgtgtgtgaga

SEQ ID NO: 113885 - DNA, 20 bp, Artificial Sequence
  Description of Artificial Sequence: Synthetic oligonucleotide
  Target: ATXN1; (+) strand; PAM type: NRG; PAM sequence: GAG
atgtgtgtgtgtgtgagaga

SEQ ID NO: 113886 - DNA, 20 bp, Artificial Sequence
  Description of Artificial Sequence: Synthetic oligonucleotide
  Target: ATXN1; (+) strand; PAM type: NRG; PAM sequence: GAG
gtgtgtgtgtgtgagagaga

SEQ ID NO: 113887 - DNA, 20 bp, Artificial Sequence
  Description of Artificial Sequence: Synthetic oligonucleotide
  Target: ATXN1; (+) strand; PAM type: NRG; PAM sequence: GAG
gtgtgtgtgtgagagagaga

SEQ ID NO: 113888 - DNA, 20 bp, Artificial Sequence
  Description of Artificial Sequence: Synthetic oligonucleotide
  Target: ATXN1; (+) strand; PAM type: NRG; PAM sequence: GAG
gtgtgtgtgagagagagaga

SEQ ID NO: 113889 - DNA, 20 bp, Artificial Sequence
  Description of Artificial Sequence: Synthetic oligonucleotide
  Target: ATXN1; (+) strand; PAM type: NRG; PAM sequence: GAG
gtgtgtgagagagagagaga

SEQ ID NO: 113890 - DNA, 20 bp, Artificial Sequence
  Description of Artificial Sequence: Synthetic oligonucleotide
  Target: ATXN1; (+) strand; PAM type: NRG; PAM sequence: AGG
tgtgtgagagagagagagag

SEQ ID NO: 113891 - DNA, 20 bp, Artificial Sequence
  Description of Artificial Sequence: Synthetic oligonucleotide
  Target: ATXN1; (+) strand; PAM type: NRG; PAM sequence: CAG
gtgagagagagagagagagg

SEQ ID NO: 113892 - DNA, 20 bp, Artificial Sequence
  Description of Artificial Sequence: Synthetic oligonucleotide
  Target: ATXN1; (+) strand; PAM type: NRG; PAM sequence: GAG
gagagagagagagagaggca

SEQ ID NO: 113893 - DNA, 20 bp, Artificial Sequence
  Description of Artificial Sequence: Synthetic oligonucleotide
  Target: ATXN1; (+) strand; PAM type: NRG; PAM sequence: GAG
gagagagagagagaggcaga

SEQ ID NO: 113894 - DNA, 20 bp, Artificial Sequence
  Description of Artificial Sequence: Synthetic oligonucleotide
  Target: ATXN1; (+) strand; PAM type: NRG; PAM sequence: AAG
agagagagagaggcagagag

SEQ ID NO: 113895 - DNA, 20 bp, Artificial Sequence
  Description of Artificial Sequence: Synthetic oligonucleotide
  Target: ATXN1; (+) strand; PAM type: NRG; PAM sequence: AGG
gagagagagaggcagagaga

SEQ ID NO: 113896 - DNA, 20 bp, Artificial Sequence
  Description of Artificial Sequence: Synthetic oligonucleotide
  Target: ATXN1; (+) strand; PAM type: NRG; PAM sequence: TGG
gagagaggcagagagaagga

SEQ ID NO: 113897 - DNA, 20 bp, Artificial Sequence
  Description of Artificial Sequence: Synthetic oligonucleotide
  Target: ATXN1; (+) strand; PAM type: NRG; PAM sequence: GAG
gagaggcagagagaaggatg

SEQ ID NO: 113898 - DNA, 20 bp, Artificial Sequence
  Description of Artificial Sequence: Synthetic oligonucleotide
  Target: ATXN1; (+) strand; PAM type: NRG; PAM sequence: GAG
gaggcagagagaaggatgga

SEQ ID NO: 113899 - DNA, 20 bp, Artificial Sequence
  Description of Artificial Sequence: Synthetic oligonucleotide
  Target: ATXN1; (+) strand; PAM type: NRG; PAM sequence: TGG
agagaaggatggagagacac

SEQ ID NO: 113900 - DNA, 20 bp, Artificial Sequence
  Description of Artificial Sequence: Synthetic oligonucleotide
  Target: ATXN1; (+) strand; PAM type: NRG; PAM sequence: CAG
gaaggatggagagacactgg

SEQ ID NO: 113901 - DNA, 20 bp, Artificial Sequence
  Description of Artificial Sequence: Synthetic oligonucleotide
  Target: ATXN1; (+) strand; PAM type: NRG; PAM sequence: CAG
aaatctcttgctgaaaactc

SEQ ID NO: 113902 - DNA, 20 bp, Artificial Sequence
  Description of Artificial Sequence: Synthetic oligonucleotide
  Target: ATXN1; (+) strand; PAM type: NRG; PAM sequence: AGG
aatctcttgctgaaaactcc

SEQ ID NO: 113903 - DNA, 20 bp, Artificial Sequence
  Description of Artificial Sequence: Synthetic oligonucleotide
  Target: ATXN1; (+) strand; PAM type: NRG; PAM sequence: AAG
aactccaggacactttaacc

SEQ ID NO: 113904 - DNA, 20 bp, Artificial Sequence
  Description of Artificial Sequence: Synthetic oligonucleotide
  Target: ATXN1; (+) strand; PAM type: NRG; PAM sequence: CAG
tccaggacactttaaccaag

SEQ ID NO: 113905 - DNA, 20 bp, Artificial Sequence
  Description of Artificial Sequence: Synthetic oligonucleotide
  Target: ATXN1; (+) strand; PAM type: NRG; PAM sequence: CAG
tgtttccctccccctctatc

SEQ ID NO: 113906 - DNA, 20 bp, Artificial Sequence
  Description of Artificial Sequence: Synthetic oligonucleotide
  Target: ATXN1; (+) strand; PAM type: NRG; PAM sequence: TAG
taaccttttcccccatctct

SEQ ID NO: 113907 - DNA, 20 bp, Artificial Sequence
  Description of Artificial Sequence: Synthetic oligonucleotide
  Target: ATXN1; (+) strand; PAM type: NRG; PAM sequence: TGG
cttagatgtatcttgtcctg

SEQ ID NO: 113908 - DNA, 20 bp, Artificial Sequence
  Description of Artificial Sequence: Synthetic oligonucleotide
  Target: ATXN1; (+) strand; PAM type: NRG; PAM sequence: AAG
atcttgtcctgtggaactat

SEQ ID NO: 113909 - DNA, 20 bp, Artificial Sequence
  Description of Artificial Sequence: Synthetic oligonucleotide
  Target: ATXN1; (+) strand; PAM type: NRG; PAM sequence: TGG
gaactataagatccaaaaac

SEQ ID NO: 113910 - DNA, 20 bp, Artificial Sequence
  Description of Artificial Sequence: Synthetic oligonucleotide
  Target: ATXN1; (+) strand; PAM type: NRG; PAM sequence: GGG
aactataagatccaaaaact

SEQ ID NO: 113911 - DNA, 20 bp, Artificial Sequence
  Description of Artificial Sequence: Synthetic oligonucleotide
  Target: ATXN1; (+) strand; PAM type: NRG; PAM sequence: GGG
actataagatccaaaaactg

SEQ ID NO: 113912 - DNA, 20 bp, Artificial Sequence
  Description of Artificial Sequence: Synthetic oligonucleotide
  Target: ATXN1; (+) strand; PAM type: NRG; PAM sequence: GGG
ctataagatccaaaaactgg

SEQ ID NO: 113913 - DNA, 20 bp, Artificial Sequence
  Description of Artificial Sequence: Synthetic oligonucleotide
  Target: ATXN1; (+) strand; PAM type: NRG; PAM sequence: AAG
aagatccaaaaactggggga

SEQ ID NO: 113914 - DNA, 20 bp, Artificial Sequence
  Description of Artificial Sequence: Synthetic oligonucleotide
  Target: ATXN1; (+) strand; PAM type: NRG; PAM sequence: AAG
gggggaaagaaaaaaaaaaa

SEQ ID NO: 113915 - DNA, 20 bp, Artificial Sequence
  Description of Artificial Sequence: Synthetic oligonucleotide
  Target: ATXN1; (+) strand; PAM type: NRG; PAM sequence: AAG
aagaaaaaaaaaaaaagacc

SEQ ID NO: 113916 - DNA, 20 bp, Artificial Sequence
  Description of Artificial Sequence: Synthetic oligonucleotide
  Target: ATXN1; (+) strand; PAM type: NRG; PAM sequence: TAG
aaaaaaaaaaaaagaccaag

SEQ ID NO: 113917 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaagaccaagta

SEQ ID NO: 113918 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaaagaccaagtag

SEQ ID NO: 113919 - DNA, 20 bp, Artificial Sequence
  Description of Artificial Sequence: Synthetic oligonucleotide
  Target: ATXN1; (+) strand; PAM type: NRG; PAM sequence: CAG
aaaaaaagaccaagtagagg

SEQ ID NO: 113920 - DNA, 20 bp, Artificial Sequence
  Description of Artificial Sequence: Synthetic oligonucleotide
  Target: ATXN1; (+) strand; PAM type: NRG; PAM sequence: AGG
aaaaaagaccaagtagaggc

SEQ ID NO: 113921 - DNA, 20 bp, Artificial Sequence
  Description of Artificial Sequence: Synthetic oligonucleotide
  Target: ATXN1; (+) strand; PAM type: NRG; PAM sequence: GAG
gaccaagtagaggcaggatc

SEQ ID NO: 113922 - DNA, 20 bp, Artificial Sequence
  Description of Artificial Sequence: Synthetic oligonucleotide
  Target: ATXN1; (+) strand; PAM type: NRG; PAM sequence: AAG
tagaggcaggatcgagatta

SEQ ID NO: 113923 - DNA, 20 bp, Artificial Sequence
  Description of Artificial Sequence: Synthetic oligonucleotide
  Target: ATXN1; (+) strand; PAM type: NRG; PAM sequence: TGG
aggcaggatcgagattaaag

SEQ ID NO: 113924 - DNA, 20 bp, Artificial Sequence
  Description of Artificial Sequence: Synthetic oligonucleotide
  Target: ATXN1; (+) strand; PAM type: NRG; PAM sequence: CAG
aggatcgagattaaagtggc

SEQ ID NO: 113925 - DNA, 20 bp, Artificial Sequence
  Description of Artificial Sequence: Synthetic oligonucleotide
  Target: ATXN1; (+) strand; PAM type: NRG; PAM sequence: CAG
gtggccagaaaataatctgc

SEQ ID NO: 113926 - DNA, 20 bp, Artificial Sequence
  Description of Artificial Sequence: Synthetic oligonucleotide
  Target: ATXN1; (+) strand; PAM type: NRG; PAM sequence: CAG
gccagaaaataatctgccag

SEQ ID NO: 113927 - DNA, 20 bp, Artificial Sequence
  Description of Artificial Sequence: Synthetic oligonucleotide
  Target: ATXN1; (+) strand; PAM type: NRG; PAM sequence: GAG
cagaaaataatctgccagca

SEQ ID NO: 113928 - DNA, 20 bp, Artificial Sequence
  Description of Artificial Sequence: Synthetic oligonucleotide
  Target: ATXN1; (+) strand; PAM type: NRG; PAM sequence: AGG
agaaaataatctgccagcag

SEQ ID NO: 113929 - DNA, 20 bp, Artificial Sequence
  Description of Artificial Sequence: Synthetic oligonucleotide
  Target: ATXN1; (+) strand; PAM type: NRG; PAM sequence: AAG
ataatctgccagcagaggcc

SEQ ID NO: 113930 - DNA, 20 bp, Artificial Sequence
  Description of Artificial Sequence: Synthetic oligonucleotide
  Target: ATXN1; (+) strand; PAM type: NRG; PAM sequence: CAG
ctgccagcagaggccaagct

SEQ ID NO: 113931 - DNA, 20 bp, Artificial Sequence
  Description of Artificial Sequence: Synthetic oligonucleotide
  Target: ATXN1; (+) strand; PAM type: NRG; PAM sequence: AAG
gcagaggccaagctcagaac

SEQ ID NO: 113932 - DNA, 20 bp, Artificial Sequence
  Description of Artificial Sequence: Synthetic oligonucleotide
  Target: ATXN1; (+) strand; PAM type: NRG; PAM sequence: AAG
ccttcaatgccgctcaccta

SEQ ID NO: 113933 - DNA, 20 bp, Artificial Sequence
  Description of Artificial Sequence: Synthetic oligonucleotide
  Target: ATXN1; (+) strand; PAM type: NRG; PAM sequence: AAG
gccccgccccctcaccaata

SEQ ID NO: 113934 - DNA, 20 bp, Artificial Sequence
  Description of Artificial Sequence: Synthetic oligonucleotide
  Target: ATXN1; (+) strand; PAM type: NRG; PAM sequence: TGG
accaataaagtctattctca

SEQ ID NO: 113935 - DNA, 20 bp, Artificial Sequence
  Description of Artificial Sequence: Synthetic oligonucleotide
  Target: ATXN1; (+) strand; PAM type: NRG; PAM sequence: CAG
taaagtctattctcatggac

SEQ ID NO: 113936 - DNA, 20 bp, Artificial Sequence
  Description of Artificial Sequence: Synthetic oligonucleotide
  Target: ATXN1; (+) strand; PAM type: NRG; PAM sequence: CGG
tcatggaccagattgtatgt

SEQ ID NO: 113937 - DNA, 20 bp, Artificial Sequence
  Description of Artificial Sequence: Synthetic oligonucleotide
  Target: ATXN1; (+) strand; PAM type: NRG; PAM sequence: GAG
atggaccagattgtatgtcg

SEQ ID NO: 113938 - DNA, 20 bp, Artificial Sequence
  Description of Artificial Sequence: Synthetic oligonucleotide
  Target: ATXN1; (+) strand; PAM type: NRG; PAM sequence: AAG
gaccagattgtatgtcggag

SEQ ID NO: 113939 - DNA, 20 bp, Artificial Sequence
  Description of Artificial Sequence: Synthetic oligonucleotide
  Target: ATXN1; (+) strand; PAM type: NRG; PAM sequence: GAG
ccagattgtatgtcggagaa

SEQ ID NO: 113940 - DNA, 20 bp, Artificial Sequence
  Description of Artificial Sequence: Synthetic oligonucleotide
  Target: ATXN1; (+) strand; PAM type: NRG; PAM sequence: CAG
gattgtatgtcggagaagag

SEQ ID NO: 113941 - DNA, 20 bp, Artificial Sequence
  Description of Artificial Sequence: Synthetic oligonucleotide
  Target: ATXN1; (+) strand; PAM type: NRG; PAM sequence: AGG
attgtatgtcggagaagagc

SEQ ID NO: 113942 - DNA, 20 bp, Artificial Sequence
  Description of Artificial Sequence: Synthetic oligonucleotide
  Target: ATXN1; (+) strand; PAM type: NRG; PAM sequence: GAG
tgtatgtcggagaagagcag

SEQ ID NO: 113943 - DNA, 20 bp, Artificial Sequence
  Description of Artificial Sequence: Synthetic oligonucleotide
  Target: ATXN1; (+) strand; PAM type: NRG; PAM sequence: AGG
gtatgtcggagaagagcagg

SEQ ID NO: 113944 - DNA, 20 bp, Artificial Sequence
  Description of Artificial Sequence: Synthetic oligonucleotide
  Target: ATXN1; (+) strand; PAM type: NRG; PAM sequence: TGG
aagagcaggaggcatctttg

SEQ ID NO: 113945 - DNA, 20 bp, Artificial Sequence
  Description of Artificial Sequence: Synthetic oligonucleotide
  Target: ATXN1; (+) strand; PAM type: NRG; PAM sequence: TGG
gcaggaggcatctttgtgga

SEQ ID NO: 113946 - DNA, 20 bp, Artificial Sequence
  Description of Artificial Sequence: Synthetic oligonucleotide
  Target: ATXN1; (+) strand; PAM type: NRG; PAM sequence: CGG
ggcatctttgtggatggaca

SEQ ID NO: 113947 - DNA, 20 bp, Artificial Sequence
  Description of Artificial Sequence: Synthetic oligonucleotide
  Target: ATXN1; (+) strand; PAM type: NRG; PAM sequence: TAG
ctttgtggatggacacggtc

SEQ ID NO: 113948 - DNA, 20 bp, Artificial Sequence
  Description of Artificial Sequence: Synthetic oligonucleotide
  Target: ATXN1; (+) strand; PAM type: NRG; PAM sequence: CAG
ggatggacacggtctagatc

SEQ ID NO: 113949 - DNA, 20 bp, Artificial Sequence
  Description of Artificial Sequence: Synthetic oligonucleotide
  Target: ATXN1; (+) strand; PAM type: NRG; PAM sequence: TGG
acacggtctagatccagaca

SEQ ID NO: 113950 - DNA, 20 bp, Artificial Sequence
  Description of Artificial Sequence: Synthetic oligonucleotide
  Target: ATXN1; (+) strand; PAM type: NRG; PAM sequence: TGG
gaactctccatgtccttgac

SEQ ID NO: 113951 - DNA, 20 bp, Artificial Sequence
  Description of Artificial Sequence: Synthetic oligonucleotide
  Target: ATXN1; (+) strand; PAM type: NRG; PAM sequence: GGG
aactctccatgtccttgact

SEQ ID NO: 113952 - DNA, 20 bp, Artificial Sequence
  Description of Artificial Sequence: Synthetic oligonucleotide
  Target: ATXN1; (+) strand; PAM type: NRG; PAM sequence: GGG
actctccatgtccttgactg

SEQ ID NO: 113953 - DNA, 20 bp, Artificial Sequence
  Description of Artificial Sequence: Synthetic oligonucleotide
  Target: ATXN1; (+) strand; PAM type: NRG; PAM sequence: GGG
ctctccatgtccttgactgg

SEQ ID NO: 113954 - DNA, 20 bp, Artificial Sequence
  Description of Artificial Sequence: Synthetic oligonucleotide
  Target: ATXN1; (+) strand; PAM type: NRG; PAM sequence: CAG
ctgggggccatgcttctctc

SEQ ID NO: 113955 - DNA, 20 bp, Artificial Sequence
  Description of Artificial Sequence: Synthetic oligonucleotide
  Target: ATXN1; (+) strand; PAM type: NRG; PAM sequence: CAG
ggccatgcttctctccagta

SEQ ID NO: 113956 - DNA, 20 bp, Artificial Sequence
  Description of Artificial Sequence: Synthetic oligonucleotide
  Target: ATXN1; (+) strand; PAM type: NRG; PAM sequence: TGG
gcttctctccagtacagatg

SEQ ID NO: 113957 - DNA, 20 bp, Artificial Sequence
  Description of Artificial Sequence: Synthetic oligonucleotide
  Target: ATXN1; (+) strand; PAM type: NRG; PAM sequence: CAG
tctctccagtacagatgtgg

SEQ ID NO: 113958 - DNA, 20 bp, Artificial Sequence
  Description of Artificial Sequence: Synthetic oligonucleotide
  Target: ATXN1; (+) strand; PAM type: NRG; PAM sequence: AAG
tgtggcagacatcccttccc

SEQ ID NO: 113959 - DNA, 20 bp, Artificial Sequence
  Description of Artificial Sequence: Synthetic oligonucleotide
  Target: ATXN1; (+) strand; PAM type: NRG; PAM sequence: AAG
agcattcgaattgttctttt

SEQ ID NO: 113960 - DNA, 20 bp, Artificial Sequence
  Description of Artificial Sequence: Synthetic oligonucleotide
  Target: ATXN1; (+) strand; PAM type: NRG; PAM sequence: AGG
gcattcgaattgttctttta

SEQ ID NO: 113961 - DNA, 20 bp, Artificial Sequence
  Description of Artificial Sequence: Synthetic oligonucleotide
  Target: ATXN1; (+) strand; PAM type: NRG; PAM sequence: AAG
cgaattgttcttttaaggtt

SEQ ID NO: 113962 - DNA, 20 bp, Artificial Sequence
  Description of Artificial Sequence: Synthetic oligonucleotide
  Target: ATXN1; (+) strand; PAM type: NRG; PAM sequence: AGG
gaattgttcttttaaggtta

SEQ ID NO: 113963 - DNA, 20 bp, Artificial Sequence
  Description of Artificial Sequence: Synthetic oligonucleotide
  Target: ATXN1; (+) strand; PAM type: NRG; PAM sequence: CAG
cttttaaggttaaggtaaac

SEQ ID NO: 113964 - DNA, 20 bp, Artificial Sequence
  Description of Artificial Sequence: Synthetic oligonucleotide
  Target: ATXN1; (+) strand; PAM type: NRG; PAM sequence: AGG
ttttaaggttaaggtaaacc

SEQ ID NO: 113965 - DNA, 20 bp, Artificial Sequence
  Description of Artificial Sequence: Synthetic oligonucleotide
  Target: ATXN1; (+) strand; PAM type: NRG; PAM sequence: GGG
tttaaggttaaggtaaacca

SEQ ID NO: 113966 - DNA, 20 bp, Artificial Sequence
  Description of Artificial Sequence: Synthetic oligonucleotide
  Target: ATXN1; (+) strand; PAM type: NRG; PAM sequence: CAG
taaggtaaaccagggtttct

SEQ ID NO: 113967 - DNA, 20 bp, Artificial Sequence
  Description of Artificial Sequence: Synthetic oligonucleotide
  Target: ATXN1; (+) strand; PAM type: NRG; PAM sequence: TGG
aaaccagggtttctcagcct

SEQ ID NO: 113968 - DNA, 20 bp, Artificial Sequence
  Description of Artificial Sequence: Synthetic oligonucleotide
  Target: ATXN1; (+) strand; PAM type: NRG; PAM sequence: TGG
gcactgttgacatcttgtgc

SEQ ID NO: 113969 - DNA, 20 bp, Artificial Sequence
  Description of Artificial Sequence: Synthetic oligonucleotide
  Target: ATXN1; (+) strand; PAM type: NRG; PAM sequence: TGG
ttgtgctggatgattctttg

SEQ ID NO: 113970 - DNA, 20 bp, Artificial Sequence
  Description of Artificial Sequence: Synthetic oligonucleotide
  Target: ATXN1; (+) strand; PAM type: NRG; PAM sequence: TGG
tgctggatgattctttgtgg

SEQ ID NO: 113971 - DNA, 20 bp, Artificial Sequence
  Description of Artificial Sequence: Synthetic oligonucleotide
  Target: ATXN1; (+) strand; PAM type: NRG; PAM sequence: GGG
gctggatgattctttgtggt

SEQ ID NO: 113972 - DNA, 20 bp, Artificial Sequence
  Description of Artificial Sequence: Synthetic oligonucleotide
  Target: ATXN1; (+) strand; PAM type: NRG; PAM sequence: GGG
ctggatgattctttgtggtg

SEQ ID NO: 113973 - DNA, 20 bp, Artificial Sequence
  Description of Artificial Sequence: Synthetic oligonucleotide
  Target: ATXN1; (+) strand; PAM type: NRG; PAM sequence: GGG
tggatgattctttgtggtgg

SEQ ID NO: 113974 - DNA, 20 bp, Artificial Sequence
  Description of Artificial Sequence: Synthetic oligonucleotide
  Target: ATXN1; (+) strand; PAM type: NRG; PAM sequence: CAG
gggggctgtcctgtgtgttg

SEQ ID NO: 113975 - DNA, 20 bp, Artificial Sequence
  Description of Artificial Sequence: Synthetic oligonucleotide
  Target: ATXN1; (+) strand; PAM type: NRG; PAM sequence: AGG
ggggctgtcctgtgtgttgc

SEQ ID NO: 113976 - DNA, 20 bp, Artificial Sequence
  Description of Artificial Sequence: Synthetic oligonucleotide
  Target: ATXN1; (+) strand; PAM type: NRG; PAM sequence: TAG
cctgtgtgttgcaggatgtt

SEQ ID NO: 113977 - DNA, 20 bp, Artificial Sequence
  Description of Artificial Sequence: Synthetic oligonucleotide
  Target: ATXN1; (+) strand; PAM type: NRG; PAM sequence: CAG
gtgtgttgcaggatgtttag

SEQ ID NO: 113978 - DNA, 20 bp, Artificial Sequence
  Description of Artificial Sequence: Synthetic oligonucleotide
  Target: ATXN1; (+) strand; PAM type: NRG; PAM sequence: TAG
cattcctcacttctactcac

SEQ ID NO: 113979 - DNA, 20 bp, Artificial Sequence
  Description of Artificial Sequence: Synthetic oligonucleotide
  Target: ATXN1; (+) strand; PAM type: NRG; PAM sequence: TGG
cacttctactcactagatgc

SEQ ID NO: 113980 - DNA, 20 bp, Artificial Sequence
  Description of Artificial Sequence: Synthetic oligonucleotide
  Target: ATXN1; (+) strand; PAM type: NRG; PAM sequence: TAG
ttctactcactagatgctgg

SEQ ID NO: 113981 - DNA, 20 bp, Artificial Sequence
  Description of Artificial Sequence: Synthetic oligonucleotide
  Target: ATXN1; (+) strand; PAM type: NRG; PAM sequence: CAG
agatgctggtagctcctccc

SEQ ID NO: 113982 - DNA, 20 bp, Artificial Sequence
  Description of Artificial Sequence: Synthetic oligonucleotide
  Target: ATXN1; (+) strand; PAM type: NRG; PAM sequence: AAG
agctcctccccagtcgtgac

SEQ ID NO: 113983 - DNA, 20 bp, Artificial Sequence
  Description of Artificial Sequence: Synthetic oligonucleotide
  Target: ATXN1; (+) strand; PAM type: NRG; PAM sequence: CAG
gtgacaagcaaaaatgactt

SEQ ID NO: 113984 - DNA, 20 bp, Artificial Sequence
  Description of Artificial Sequence: Synthetic oligonucleotide
  Target: ATXN1; (+) strand; PAM type: NRG; PAM sequence: CAG
caaaaatgacttcagacatt

SEQ ID NO: 113985 - DNA, 20 bp, Artificial Sequence
  Description of Artificial Sequence: Synthetic oligonucleotide
  Target: ATXN1; (+) strand; PAM type: NRG; PAM sequence: CGG
agacattgccaacttgccca

SEQ ID NO: 113986 - DNA, 20 bp, Artificial Sequence
  Description of Artificial Sequence: Synthetic oligonucleotide
  Target: ATXN1; (+) strand; PAM type: NRG; PAM sequence: CGG
cattgccaacttgcccacgg

SEQ ID NO: 113987 - DNA, 20 bp, Artificial Sequence
  Description of Artificial Sequence: Synthetic oligonucleotide
  Target: ATXN1; (+) strand; PAM type: NRG; PAM sequence: GAG
ttgccaacttgcccacggcg

SEQ ID NO: 113988 - DNA, 20 bp, Artificial Sequence
  Description of Artificial Sequence: Synthetic oligonucleotide
  Target: ATXN1; (+) strand; PAM type: NRG; PAM sequence: AGG
tgccaacttgcccacggcgg

SEQ ID NO: 113989 - DNA, 20 bp, Artificial Sequence
  Description of Artificial Sequence: Synthetic oligonucleotide
  Target: ATXN1; (+) strand; PAM type: NRG; PAM sequence: GGG
gccaacttgcccacggcgga

SEQ ID NO: 113990 - DNA, 20 bp, Artificial Sequence
  Description of Artificial Sequence: Synthetic oligonucleotide
  Target: ATXN1; (+) strand; PAM type: NRG; PAM sequence: GAG
caacttgcccacggcggagg

SEQ ID NO: 113991 - DNA, 20 bp, Artificial Sequence
  Description of Artificial Sequence: Synthetic oligonucleotide
  Target: ATXN1; (+) strand; PAM type: NRG; PAM sequence: TAG
cacggcggagggagcaaaat

SEQ ID NO: 113992 - DNA, 20 bp, Artificial Sequence
  Description of Artificial Sequence: Synthetic oligonucleotide
  Target: ATXN1; (+) strand; PAM type: NRG; PAM sequence: CGG
agggagcaaaattagaatca

SEQ ID NO: 113993 - DNA, 20 bp, Artificial Sequence
  Description of Artificial Sequence: Synthetic oligonucleotide
  Target: ATXN1; (+) strand; PAM type: NRG; PAM sequence: GAG
ggagcaaaattagaatcacg

SEQ ID NO: 113994 - DNA, 20 bp, Artificial Sequence
  Description of Artificial Sequence: Synthetic oligonucleotide
  Target: ATXN1; (+) strand; PAM type: NRG; PAM sequence: AGG
gagcaaaattagaatcacgg

SEQ ID NO: 113995 - DNA, 20 bp, Artificial Sequence
  Description of Artificial Sequence: Synthetic oligonucleotide
  Target: ATXN1; (+) strand; PAM type: NRG; PAM sequence: TAG
aatcacggaggtaaatttta

SEQ ID NO: 113996 - DNA, 20 bp, Artificial Sequence
  Description of Artificial Sequence: Synthetic oligonucleotide
  Target: ATXN1; (+) strand; PAM type: NRG; PAM sequence: GAG
tcacggaggtaaattttata

SEQ ID NO: 113997 - DNA, 20 bp, Artificial Sequence
  Description of Artificial Sequence: Synthetic oligonucleotide
  Target: ATXN1; (+) strand; PAM type: NRG; PAM sequence: GAG
acggaggtaaattttataga

SEQ ID NO: 113998 - DNA, 20 bp, Artificial Sequence
  Description of Artificial Sequence: Synthetic oligonucleotide
  Target: ATXN1; (+) strand; PAM type: NRG; PAM sequence: TGG
aggtaaattttatagagagt

SEQ ID NO: 113999 - DNA, 20 bp, Artificial Sequence
  Description of Artificial Sequence: Synthetic oligonucleotide
  Target: ATXN1; (+) strand; PAM type: NRG; PAM sequence: TGG
aaattttatagagagttggc

SEQ ID NO: 114000 - DNA, 20 bp, Artificial Sequence
  Description of Artificial Sequence: Synthetic oligonucleotide
  Target: ATXN1; (+) strand; PAM type: NRG; PAM sequence: AAG
atagagagttggctggttct

SEQ ID NO: 114001 - DNA, 20 bp, Artificial Sequence
  Description of Artificial Sequence: Synthetic oligonucleotide
  Target: ATXN1; (+) strand; PAM type: NRG; PAM sequence: TGG
gagagttggctggttctaag

SEQ ID NO: 114002 - DNA, 20 bp, Artificial Sequence
  Description of Artificial Sequence: Synthetic oligonucleotide
  Target: ATXN1; (+) strand; PAM type: NRG; PAM sequence: AAG
aactactctcttattgcatg

SEQ ID NO: 114003 - DNA, 20 bp, Artificial Sequence
  Description of Artificial Sequence: Synthetic oligonucleotide
  Target: ATXN1; (+) strand; PAM type: NRG; PAM sequence: AGG
actactctcttattgcatga

SEQ ID NO: 114004 - DNA, 20 bp, Artificial Sequence
  Description of Artificial Sequence: Synthetic oligonucleotide
  Target: ATXN1; (+) strand; PAM type: NRG; PAM sequence: AAG
gatacaatgacaaaatccct

SEQ ID NO: 114005 - DNA, 20 bp, Artificial Sequence
  Description of Artificial Sequence: Synthetic oligonucleotide
  Target: ATXN1; (+) strand; PAM type: NRG; PAM sequence: CAG
caatgacaaaatccctaaga

SEQ ID NO: 114006 - DNA, 20 bp, Artificial Sequence
  Description of Artificial Sequence: Synthetic oligonucleotide
  Target: ATXN1; (+) strand; PAM type: NRG; PAM sequence: GAG
atgacaaaatccctaagaca

SEQ ID NO: 114007 - DNA, 20 bp, Artificial Sequence
  Description of Artificial Sequence: Synthetic oligonucleotide
  Target: ATXN1; (+) strand; PAM type: NRG; PAM sequence: TGG
acaaaatccctaagacagag

SEQ ID NO: 114008 - DNA, 20 bp, Artificial Sequence
  Description of Artificial Sequence: Synthetic oligonucleotide
  Target: ATXN1; (+) strand; PAM type: NRG; PAM sequence: AAG
atttgttgtaaatgcctcta

SEQ ID NO: 114009 - DNA, 20 bp, Artificial Sequence
  Description of Artificial Sequence: Synthetic oligonucleotide
  Target: ATXN1; (+) strand; PAM type: NRG; PAM sequence: GAG
tgtaaatgcctctaaagttt

SEQ ID NO: 114010 - DNA, 20 bp, Artificial Sequence
  Description of Artificial Sequence: Synthetic oligonucleotide
  Target: ATXN1; (+) strand; PAM type: NRG; PAM sequence: CAG
aaatgcctctaaagtttgag

SEQ ID NO: 114011 - DNA, 20 bp, Artificial Sequence
  Description of Artificial Sequence: Synthetic oligonucleotide
  Target: ATXN1; (+) strand; PAM type: NRG; PAM sequence: AAG
taaagtttgagcagaacatc

SEQ ID NO: 114012 - DNA, 20 bp, Artificial Sequence
  Description of Artificial Sequence: Synthetic oligonucleotide
  Target: ATXN1; (+) strand; PAM type: NRG; PAM sequence: AGG
aaagtttgagcagaacatca

SEQ ID NO: 114013 - DNA, 20 bp, Artificial Sequence
  Description of Artificial Sequence: Synthetic oligonucleotide
  Target: ATXN1; (+) strand; PAM type: NRG; PAM sequence: GGG
aagtttgagcagaacatcaa

SEQ ID NO: 114014 - DNA, 20 bp, Artificial Sequence
  Description of Artificial Sequence: Synthetic oligonucleotide
  Target: ATXN1; (+) strand; PAM type: NRG; PAM sequence: AAG
catcaagggttccgttttca

SEQ ID NO: 114015 - DNA, 20 bp, Artificial Sequence
  Description of Artificial Sequence: Synthetic oligonucleotide
  Target: ATXN1; (+) strand; PAM type: NRG; PAM sequence: CAG
aaagtgacctcaactgcctc

SEQ ID NO: 114016 - DNA, 20 bp, Artificial Sequence
  Description of Artificial Sequence: Synthetic oligonucleotide
  Target: ATXN1; (+) strand; PAM type: NRG; PAM sequence: CAG
ctcaactgcctccagcgttt

SEQ ID NO: 114017 - DNA, 20 bp, Artificial Sequence
  Description of Artificial Sequence: Synthetic oligonucleotide
  Target: ATXN1; (+) strand; PAM type: NRG; PAM sequence: AGG
tcaactgcctccagcgtttc

SEQ ID NO: 114018 - DNA, 20 bp, Artificial Sequence
  Description of Artificial Sequence: Synthetic oligonucleotide
  Target: ATXN1; (+) strand; PAM type: NRG; PAM sequence: GAG
cctccagcgtttcaggtgtt

SEQ ID NO: 114019 - DNA, 20 bp, Artificial Sequence
  Description of Artificial Sequence: Synthetic oligonucleotide
  Target: ATXN1; (+) strand; PAM type: NRG; PAM sequence: TAG
gcgtttcaggtgttgagctc

SEQ ID NO: 114020 - DNA, 20 bp, Artificial Sequence
  Description of Artificial Sequence: Synthetic oligonucleotide
  Target: ATXN1; (+) strand; PAM type: NRG; PAM sequence: AAG
tttcaggtgttgagctctag

SEQ ID NO: 114021 - DNA, 20 bp, Artificial Sequence
  Description of Artificial Sequence: Synthetic oligonucleotide
  Target: ATXN1; (+) strand; PAM type: NRG; PAM sequence: CAG
aggtgttgagctctagaagc

SEQ ID NO: 114022 - DNA, 20 bp, Artificial Sequence
  Description of Artificial Sequence: Synthetic oligonucleotide
  Target: ATXN1; (+) strand; PAM type: NRG; PAM sequence: AGG
ggtgttgagctctagaagcc

SEQ ID NO: 114023 - DNA, 20 bp, Artificial Sequence
  Description of Artificial Sequence: Synthetic oligonucleotide
  Target: ATXN1; (+) strand; PAM type: NRG; PAM sequence: TGG
ttgagctctagaagccagga

SEQ ID NO: 114024 - DNA, 20 bp, Artificial Sequence
  Description of Artificial Sequence: Synthetic oligonucleotide
  Target: ATXN1; (+) strand; PAM type: NRG; PAM sequence: AAG
agctctagaagccaggatgg

SEQ ID NO: 114025 - DNA, 20 bp, Artificial Sequence
  Description of Artificial Sequence: Synthetic oligonucleotide
  Target: ATXN1; (+) strand; PAM type: NRG; PAM sequence: CAG
gaagccaggatggaagtttt

SEQ ID NO: 114026 - DNA, 20 bp, Artificial Sequence
  Description of Artificial Sequence: Synthetic oligonucleotide
  Target: ATXN1; (+) strand; PAM type: NRG; PAM sequence: AGG
aagccaggatggaagttttc

SEQ ID NO: 114027 - DNA, 20 bp, Artificial Sequence
  Description of Artificial Sequence: Synthetic oligonucleotide
  Target: ATXN1; (+) strand; PAM type: NRG; PAM sequence: CAG
ccaggatggaagttttcagg

SEQ ID NO: 114028 - DNA, 20 bp, Artificial Sequence
  Description of Artificial Sequence: Synthetic oligonucleotide
  Target: ATXN1; (+) strand; PAM type: NRG; PAM sequence: CAG
tttcaggcagatacaactcc

SEQ ID NO: 114029 - DNA, 20 bp, Artificial Sequence
  Description of Artificial Sequence: Synthetic oligonucleotide
  Target: ATXN1; (+) strand; PAM type: NRG; PAM sequence: AGG
ttcaggcagatacaactccc

SEQ ID NO: 114030 - DNA, 20 bp, Artificial Sequence
  Description of Artificial Sequence: Synthetic oligonucleotide
  Target: ATXN1; (+) strand; PAM type: NRG; PAM sequence: CAG
acaactcccaggctttcatt

SEQ ID NO: 114031 - DNA, 20 bp, Artificial Sequence
  Description of Artificial Sequence: Synthetic oligonucleotide
  Target: ATXN1; (+) strand; PAM type: NRG; PAM sequence: CAG
attcagcttctataaaacaa

SEQ ID NO: 114032 - DNA, 20 bp, Artificial Sequence
  Description of Artificial Sequence: Synthetic oligonucleotide
  Target: ATXN1; (+) strand; PAM type: NRG; PAM sequence: CAG
ctataaaacaacagtgcaca

SEQ ID NO: 114033 - DNA, 20 bp, Artificial Sequence
  Description of Artificial Sequence: Synthetic oligonucleotide
  Target: ATXN1; (+) strand; PAM type: NRG; PAM sequence: AGG
tataaaacaacagtgcacac

SEQ ID NO: 114034 - DNA, 20 bp, Artificial Sequence
  Description of Artificial Sequence: Synthetic oligonucleotide
  Target: ATXN1; (+) strand; PAM type: NRG; PAM sequence: CAG
acaggcacatgcctcatcac

SEQ ID NO: 114035 - DNA, 20 bp, Artificial Sequence
  Description of Artificial Sequence: Synthetic oligonucleotide
  Target: ATXN1; (+) strand; PAM type: NRG; PAM sequence: AAG
tctgctgtgtgcacccaaaa

SEQ ID NO: 114036 - DNA, 20 bp, Artificial Sequence
  Description of Artificial Sequence: Synthetic oligonucleotide
  Target: ATXN1; (+) strand; PAM type: NRG; PAM sequence: AAG
ctgtgtgcacccaaaaaaga

SEQ ID NO: 114037 - DNA, 20 bp, Artificial Sequence
  Description of Artificial Sequence: Synthetic oligonucleotide
  Target: ATXN1; (+) strand; PAM type: NRG; PAM sequence: CAG
tgtgcacccaaaaaagaaag

SEQ ID NO: 114038 - DNA, 20 bp, Artificial Sequence
  Description of Artificial Sequence: Synthetic oligonucleotide
  Target: ATXN1; (+) strand; PAM type: NRG; PAM sequence: CAG
cccaaaaaagaaagcagacg

SEQ ID NO: 114039 - DNA, 20 bp, Artificial Sequence
  Description of Artificial Sequence: Synthetic oligonucleotide
  Target: ATXN1; (+) strand; PAM type: NRG; PAM sequence: AAG
aaaaagaaagcagacgcaga

SEQ ID NO: 114040 - DNA, 20 bp, Artificial Sequence
  Description of Artificial Sequence: Synthetic oligonucleotide
  Target: ATXN1; (+) strand; PAM type: NRG; PAM sequence: TAG
atgattgaaaatgtattcca

SEQ ID NO: 114041 - DNA, 20 bp, Artificial Sequence
  Description of Artificial Sequence: Synthetic oligonucleotide
  Target: ATXN1; (+) strand; PAM type: NRG; PAM sequence: AGG
tgattgaaaatgtattccat

SEQ ID NO: 114042 - DNA, 20 bp, Artificial Sequence
  Description of Artificial Sequence: Synthetic oligonucleotide
  Target: ATXN1; (+) strand; PAM type: NRG; PAM sequence: GGG
gattgaaaatgtattccata

SEQ ID NO: 114043 - DNA, 20 bp, Artificial Sequence
  Description of Artificial Sequence: Synthetic oligonucleotide
  Target: ATXN1; (+) strand; PAM type: NRG; PAM sequence: TAG
aaatgtattccatagggctc

SEQ ID NO: 114044 - DNA, 20 bp, Artificial Sequence
  Description of Artificial Sequence: Synthetic oligonucleotide
  Target: ATXN1; (+) strand; PAM type: NRG; PAM sequence: AGG
aatgtattccatagggctct

SEQ ID NO: 114045 - DNA, 20 bp, Artificial Sequence
  Description of Artificial Sequence: Synthetic oligonucleotide
  Target: ATXN1; (+) strand; PAM type: NRG; PAM sequence: GGG
atgtattccatagggctcta

SEQ ID NO: 114046 - DNA, 20 bp, Artificial Sequence
  Description of Artificial Sequence: Synthetic oligonucleotide
  Target: ATXN1; (+) strand; PAM type: NRG; PAM sequence: CAG
cactctataaaaattcctca

SEQ ID NO: 114047 - DNA, 20 bp, Artificial Sequence
  Description of Artificial Sequence: Synthetic oligonucleotide
  Target: ATXN1; (+) strand; PAM type: NRG; PAM sequence: CAG
aaaaattcctcacagatttt

SEQ ID NO: 114048 - DNA, 20 bp, Artificial Sequence
  Description of Artificial Sequence: Synthetic oligonucleotide
  Target: ATXN1; (+) strand; PAM type: NRG; PAM sequence: TAG
cctcacagattttcagtgac

SEQ ID NO: 114049 - DNA, 20 bp, Artificial Sequence
  Description of Artificial Sequence: Synthetic oligonucleotide
  Target: ATXN1; (+) strand; PAM type: NRG; PAM sequence: GAG
tcacagattttcagtgacta

SEQ ID NO: 114050 - DNA, 20 bp, Artificial Sequence
  Description of Artificial Sequence: Synthetic oligonucleotide
  Target: ATXN1; (+) strand; PAM type: NRG; PAM sequence: AGG
cacagattttcagtgactag

SEQ ID NO: 114051 - DNA, 20 bp, Artificial Sequence
  Description of Artificial Sequence: Synthetic oligonucleotide
  Target: ATXN1; (+) strand; PAM type: NRG; PAM sequence: TGG
attttcagtgactagaggca

SEQ ID NO: 114052 - DNA, 20 bp, Artificial Sequence
  Description of Artificial Sequence: Synthetic oligonucleotide
  Target: ATXN1; (+) strand; PAM type: NRG; PAM sequence: GGG
ttttcagtgactagaggcat

SEQ ID NO: 114053 - DNA, 20 bp, Artificial Sequence
  Description of Artificial Sequence: Synthetic oligonucleotide
  Target: ATXN1; (+) strand; PAM type: NRG; PAM sequence: GGG
tttcagtgactagaggcatg

SEQ ID NO: 114054 - DNA, 20 bp, Artificial Sequence
  Description of Artificial Sequence: Synthetic oligonucleotide
  Target: ATXN1; (+) strand; PAM type: NRG; PAM sequence: TGG
tgactagaggcatggggctg

SEQ ID NO: 114055 - DNA, 20 bp, Artificial Sequence
  Description of Artificial Sequence: Synthetic oligonucleotide
  Target: ATXN1; (+) strand; PAM type: NRG; PAM sequence: GGG
gactagaggcatggggctgt

SEQ ID NO: 114056 - DNA, 20 bp, Artificial Sequence
  Description of Artificial Sequence: Synthetic oligonucleotide
  Target: ATXN1; (+) strand; PAM type: NRG; PAM sequence: GAG
ctagaggcatggggctgtgg

SEQ ID NO: 114057 - DNA, 20 bp, Artificial Sequence
  Description of Artificial Sequence: Synthetic oligonucleotide
  Target: ATXN1; (+) strand; PAM type: NRG; PAM sequence: AGG
tagaggcatggggctgtggg

SEQ ID NO: 114058 - DNA, 20 bp, Artificial Sequence
  Description of Artificial Sequence: Synthetic oligonucleotide
  Target: ATXN1; (+) strand; PAM type: NRG; PAM sequence: GGG
agaggcatggggctgtggga

SEQ ID NO: 114059 - DNA, 20 bp, Artificial Sequence
  Description of Artificial Sequence: Synthetic oligonucleotide
  Target: ATXN1; (+) strand; PAM type: NRG; PAM sequence: GGG
gaggcatggggctgtgggag

SEQ ID NO: 114060 - DNA, 20 bp, Artificial Sequence
  Description of Artificial Sequence: Synthetic oligonucleotide
  Target: ATXN1; (+) strand; PAM type: NRG; PAM sequence: GGG
aggcatggggctgtgggagg

SEQ ID NO: 114061 - DNA, 20 bp, Artificial Sequence
  Description of Artificial Sequence: Synthetic oligonucleotide
  Target: ATXN1; (+) strand; PAM type: NRG; PAM sequence: CAG
gggctgtgggagggggtgct

SEQ ID NO: 114062 - DNA, 20 bp, Artificial Sequence
  Description of Artificial Sequence: Synthetic oligonucleotide
  Target: ATXN1; (+) strand; PAM type: NRG; PAM sequence: GAG
agctgcactcttttattatt

SEQ ID NO: 114063 - DNA, 20 bp, Artificial Sequence
  Description of Artificial Sequence: Synthetic oligonucleotide
  Target: ATXN1; (+) strand; PAM type: NRG; PAM sequence: AAG
tttattattgagctgattca

SEQ ID NO: 114064 - DNA, 20 bp, Artificial Sequence
  Description of Artificial Sequence: Synthetic oligonucleotide
  Target: ATXN1; (+) strand; PAM type: NRG; PAM sequence: AGG
ttattattgagctgattcaa

SEQ ID NO: 114065 - DNA, 20 bp, Artificial Sequence
  Description of Artificial Sequence: Synthetic oligonucleotide
  Target: ATXN1; (+) strand; PAM type: NRG; PAM sequence: CAG
attgagctgattcaaaggaa

SEQ ID NO: 114066 - DNA, 20 bp, Artificial Sequence
  Description of Artificial Sequence: Synthetic oligonucleotide
  Target: ATXN1; (+) strand; PAM type: NRG; PAM sequence: TGG
gatactgactttaatgttca

SEQ ID NO: 114067 - DNA, 20 bp, Artificial Sequence
  Description of Artificial Sequence: Synthetic oligonucleotide
  Target: ATXN1; (+) strand; PAM type: NRG; PAM sequence: TGG
tgactttaatgttcatggac

SEQ ID NO: 114068 - DNA, 20 bp, Artificial Sequence
  Description of Artificial Sequence: Synthetic oligonucleotide
  Target: ATXN1; (+) strand; PAM type: NRG; PAM sequence: GGG
gactttaatgttcatggact

SEQ ID NO: 114069 - DNA, 20 bp, Artificial Sequence
  Description of Artificial Sequence: Synthetic oligonucleotide
  Target: ATXN1; (+) strand; PAM type: NRG; PAM sequence: TGG
tcttttctatctgtaaaata

SEQ ID NO: 114070 - DNA, 20 bp, Artificial Sequence
  Description of Artificial Sequence: Synthetic oligonucleotide
  Target: ATXN1; (+) strand; PAM type: NRG; PAM sequence: AAG
tatctgtaaaatatggttgc

SEQ ID NO: 114071 - DNA, 20 bp, Artificial Sequence
  Description of Artificial Sequence: Synthetic oligonucleotide
  Target: ATXN1; (+) strand; PAM type: NRG; PAM sequence: AGG
atctgtaaaatatggttgca

SEQ ID NO: 114072 - DNA, 20 bp, Artificial Sequence
  Description of Artificial Sequence: Synthetic oligonucleotide
  Target: ATXN1; (+) strand; PAM type: NRG; PAM sequence: TGG
atatggttgcaaggctttca

SEQ ID NO: 114073 - DNA, 20 bp, Artificial Sequence
  Description of Artificial Sequence: Synthetic oligonucleotide
  Target: ATXN1; (+) strand; PAM type: NRG; PAM sequence: AAG
gttgcaaggctttcatggac

SEQ ID NO: 114074 - DNA, 20 bp, Artificial Sequence
  Description of Artificial Sequence: Synthetic oligonucleotide
  Target: ATXN1; (+) strand; PAM type: NRG; PAM sequence: TGG
aggctttcatggacaagaca

SEQ ID NO: 114075 - DNA, 20 bp, Artificial Sequence
  Description of Artificial Sequence: Synthetic oligonucleotide
  Target: ATXN1; (+) strand; PAM type: NRG; PAM sequence: TGG
aagacatggcctcttgtctc

SEQ ID NO: 114076 - DNA, 20 bp, Artificial Sequence
  Description of Artificial Sequence: Synthetic oligonucleotide
  Target: ATXN1; (+) strand; PAM type: NRG; PAM sequence: TAG
acatggcctcttgtctctgg

SEQ ID NO: 114077 - DNA, 20 bp, Artificial Sequence
  Description of Artificial Sequence: Synthetic oligonucleotide
  Target: ATXN1; (+) strand; PAM type: NRG; PAM sequence: CAG
gcctcttgtctctggtagac

SEQ ID NO: 114078 - DNA, 20 bp, Artificial Sequence
  Description of Artificial Sequence: Synthetic oligonucleotide
  Target: ATXN1; (+) strand; PAM type: NRG; PAM sequence: AGG
cctcttgtctctggtagacc

SEQ ID NO: 114079 - DNA, 20 bp, Artificial Sequence
  Description of Artificial Sequence: Synthetic oligonucleotide
  Target: ATXN1; (+) strand; PAM type: NRG; PAM sequence: GAG
gcctttttttttttttttct

SEQ ID NO: 114080 - DNA, 20 bp, Artificial Sequence
  Description of Artificial Sequence: Synthetic oligonucleotide
  Target: ATXN1; (+) strand; PAM type: NRG; PAM sequence: TAG
ttttttttttttctgagatg

SEQ ID NO: 114081 - DNA, 20 bp, Artificial Sequence
  Description of Artificial Sequence: Synthetic oligonucleotide
  Target: ATXN1; (+) strand; PAM type: NRG; PAM sequence: CAG
gtagttttgctcttgtcacc

SEQ ID NO: 114082 - DNA, 20 bp, Artificial Sequence
  Description of Artificial Sequence: Synthetic oligonucleotide
  Target: ATXN1; (+) strand; PAM type: NRG; PAM sequence: AGG
tagttttgctcttgtcaccc

SEQ ID NO: 114083 - DNA, 20 bp, Artificial Sequence
  Description of Artificial Sequence: Synthetic oligonucleotide
  Target: ATXN1; (+) strand; PAM type: NRG; PAM sequence: TGG
tttgctcttgtcacccaggc

SEQ ID NO: 114084 - DNA, 20 bp, Artificial Sequence
  Description of Artificial Sequence: Synthetic oligonucleotide
  Target: ATXN1; (+) strand; PAM type: NRG; PAM sequence: GAG
tgctcttgtcacccaggctg

SEQ ID NO: 114085 - DNA, 20 bp, Artificial Sequence
  Description of Artificial Sequence: Synthetic oligonucleotide
  Target: ATXN1; (+) strand; PAM type: NRG; PAM sequence: TGG
tcacccaggctggagtgcaa

SEQ ID NO: 114086 - DNA, 20 bp, Artificial Sequence
  Description of Artificial Sequence: Synthetic oligonucleotide
  Target: ATXN1; (+) strand; PAM type: NRG; PAM sequence: GGG
cacccaggctggagtgcaat

SEQ ID NO: 114087 - DNA, 20 bp, Artificial Sequence
  Description of Artificial Sequence: Synthetic oligonucleotide
  Target: ATXN1; (+) strand; PAM type: NRG; PAM sequence: GGG
acccaggctggagtgcaatg

SEQ ID NO: 114088 - DNA, 20 bp, Artificial Sequence
  Description of Artificial Sequence: Synthetic oligonucleotide
  Target: ATXN1; (+) strand; PAM type: NRG; PAM sequence: CGG
ggagtgcaatggggcaatct

SEQ ID NO: 114089 - DNA, 20 bp, Artificial Sequence
  Description of Artificial Sequence: Synthetic oligonucleotide
  Target: ATXN1; (+) strand; PAM type: NRG; PAM sequence: TGG
tctcggctcactgcaacctc

SEQ ID NO: 114090 - DNA, 20 bp, Artificial Sequence
  Description of Artificial Sequence: Synthetic oligonucleotide
  Target: ATXN1; (+) strand; PAM type: NRG; PAM sequence: CAG
tcactgcaacctctggctcc

SEQ ID NO: 114091 - DNA, 20 bp, Artificial Sequence
  Description of Artificial Sequence: Synthetic oligonucleotide
  Target: ATXN1; (+) strand; PAM type: NRG; PAM sequence: AGG
cactgcaacctctggctccc

SEQ ID NO: 114092 - DNA, 20 bp, Artificial Sequence
  Description of Artificial Sequence: Synthetic oligonucleotide
  Target: ATXN1; (+) strand; PAM type: NRG; PAM sequence: AAG
aacctctggctcccaggttc

SEQ ID NO: 114093 - DNA, 20 bp, Artificial Sequence
  Description of Artificial Sequence: Synthetic oligonucleotide
  Target: ATXN1; (+) strand; PAM type: NRG; PAM sequence: CAG
ttcaagtgattctcctgcct

SEQ ID NO: 114094 - DNA, 20 bp, Artificial Sequence
  Description of Artificial Sequence: Synthetic oligonucleotide
  Target: ATXN1; (+) strand; PAM type: NRG; PAM sequence: TGG
gattctcctgcctcagcctc

SEQ ID NO: 114095 - DNA, 20 bp, Artificial Sequence
  Description of Artificial Sequence: Synthetic oligonucleotide
  Target: ATXN1; (+) strand; PAM type: NRG; PAM sequence: GAG
ttctcctgcctcagcctctg

SEQ ID NO: 114096 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctctggag

SEQ ID NO: 114097 - DNA, 20 bp, Artificial Sequence
  Description of Artificial Sequence: Synthetic oligonucleotide
  Target: ATXN1; (+) strand; PAM type: NRG; PAM sequence: TAG
tgcctcagcctctggagtag

SEQ ID NO: 114098 - DNA, 20 bp, Artificial Sequence
  Description of Artificial Sequence: Synthetic oligonucleotide
  Target: ATXN1; (+) strand; PAM type: NRG; PAM sequence: AGG
gcctcagcctctggagtagt

SEQ ID NO: 114099 - DNA, 20 bp, Artificial Sequence
  Description of Artificial Sequence: Synthetic oligonucleotide
  Target: ATXN1; (+) strand; PAM type: NRG; PAM sequence: GGG
cctcagcctctggagtagta

SEQ ID NO: 114100 - DNA, 20 bp, Artificial Sequence
  Description of Artificial Sequence: Synthetic oligonucleotide
  Target: ATXN1; (+) strand; PAM type: NRG; PAM sequence: CAG
ctctggagtagtagggatta

SEQ ID NO: 114101 - DNA, 20 bp, Artificial Sequence
  Description of Artificial Sequence: Synthetic oligonucleotide
  Target: ATXN1; (+) strand; PAM type: NRG; PAM sequence: AGG
tctggagtagtagggattac

SEQ ID NO: 114102 - DNA, 20 bp, Artificial Sequence
  Description of Artificial Sequence: Synthetic oligonucleotide
  Target: ATXN1; (+) strand; PAM type: NRG; PAM sequence: CAG
caggcgctcaccaccatgcc

SEQ ID NO: 114103 - DNA, 20 bp, Artificial Sequence
  Description of Artificial Sequence: Synthetic oligonucleotide
  Target: ATXN1; (+) strand; PAM type: NRG; PAM sequence: TAG
ccagcacatttttgtgtttt

SEQ ID NO: 114104 - DNA, 20 bp, Artificial Sequence
  Description of Artificial Sequence: Synthetic oligonucleotide
  Target: ATXN1; (+) strand; PAM type: NRG; PAM sequence: CGG
ttttgtgtttttagttgcga

SEQ ID NO: 114105 - DNA, 20 bp, Artificial Sequence
  Description of Artificial Sequence: Synthetic oligonucleotide
  Target: ATXN1; (+) strand; PAM type: NRG; PAM sequence: GGG
tttgtgtttttagttgcgac

SEQ ID NO: 114106 - DNA, 20 bp, Artificial Sequence
  Description of Artificial Sequence: Synthetic oligonucleotide
  Target: ATXN1; (+) strand; PAM type: NRG; PAM sequence: GGG
ttgtgtttttagttgcgacg

SEQ ID NO: 114107 - DNA, 20 bp, Artificial Sequence
  Description of Artificial Sequence: Synthetic oligonucleotide
  Target: ATXN1; (+) strand; PAM type: NRG; PAM sequence: TGG
gcgacggggtttcaccatgt

SEQ ID NO: 114108 - DNA, 20 bp, Artificial Sequence
  Description of Artificial Sequence: Synthetic oligonucleotide
  Target: ATXN1; (+) strand; PAM type: NRG; PAM sequence: CAG
cggggtttcaccatgttggc

SEQ ID NO: 114109 - DNA, 20 bp, Artificial Sequence
  Description of Artificial Sequence: Synthetic oligonucleotide
  Target: ATXN1; (+) strand; PAM type: NRG; PAM sequence: AGG
ggggtttcaccatgttggcc

SEQ ID NO: 114110 - DNA, 20 bp, Artificial Sequence
  Description of Artificial Sequence: Synthetic oligonucleotide
  Target: ATXN1; (+) strand; PAM type: NRG; PAM sequence: TGG
tttcaccatgttggccaggc

SEQ ID NO: 114111 - DNA, 20 bp, Artificial Sequence
  Description of Artificial Sequence: Synthetic oligonucleotide
  Target: ATXN1; (+) strand; PAM type: NRG; PAM sequence: CAG
tggtctcaaactcctgacct

SEQ ID NO: 114112 - DNA, 20 bp, Artificial Sequence
  Description of Artificial Sequence: Synthetic oligonucleotide
  Target: ATXN1; (+) strand; PAM type: NRG; PAM sequence: AGG
ggtctcaaactcctgacctc

SEQ ID NO: 114113 - DNA, 20 bp, Artificial Sequence
  Description of Artificial Sequence: Synthetic oligonucleotide
  Target: ATXN1; (+) strand; PAM type: NRG; PAM sequence: CGG
ctcaggcgatccacctgcct

SEQ ID NO: 114114 - DNA, 20 bp, Artificial Sequence
  Description of Artificial Sequence: Synthetic oligonucleotide
  Target: ATXN1; (+) strand; PAM type: NRG; PAM sequence: AAG
ccacctgcctcggcctccca

SEQ ID NO: 114115 - DNA, 20 bp, Artificial Sequence
  Description of Artificial Sequence: Synthetic oligonucleotide
  Target: ATXN1; (+) strand; PAM type: NRG; PAM sequence: GAG
cctcggcctcccaaagtgtt

SEQ ID NO: 114116 - DNA, 20 bp, Artificial Sequence
  Description of Artificial Sequence: Synthetic oligonucleotide
  Target: ATXN1; (+) strand; PAM type: NRG; PAM sequence: TAG
ctcccaaagtgttgagatta

SEQ ID NO: 114117 - DNA, 20 bp, Artificial Sequence
  Description of Artificial Sequence: Synthetic oligonucleotide
  Target: ATXN1; (+) strand; PAM type: NRG; PAM sequence: GAG
agtgttgagattatagacat

SEQ ID NO: 114118 - DNA, 20 bp, Artificial Sequence
  Description of Artificial Sequence: Synthetic oligonucleotide
  Target: ATXN1; (+) strand; PAM type: NRG; PAM sequence: CAG
tagacatgagccaccatgct

SEQ ID NO: 114119 - DNA, 20 bp, Artificial Sequence
  Description of Artificial Sequence: Synthetic oligonucleotide
  Target: ATXN1; (+) strand; PAM type: NRG; PAM sequence: CAG
agccaccatgctcagctgac

SEQ ID NO: 114120 - DNA, 20 bp, Artificial Sequence
  Description of Artificial Sequence: Synthetic oligonucleotide
  Target: ATXN1; (+) strand; PAM type: NRG; PAM sequence: AGG
gccaccatgctcagctgacc

SEQ ID NO: 114121 - DNA, 20 bp, Artificial Sequence
  Description of Artificial Sequence: Synthetic oligonucleotide
  Target: ATXN1; (+) strand; PAM type: NRG; PAM sequence: TAG
catgctcagctgaccaggac

SEQ ID NO: 114122 - DNA, 20 bp, Artificial Sequence
  Description of Artificial Sequence: Synthetic oligonucleotide
  Target: ATXN1; (+) strand; PAM type: NRG; PAM sequence: TAG
cagctgaccaggactagtaa

SEQ ID NO: 114123 - DNA, 20 bp, Artificial Sequence
  Description of Artificial Sequence: Synthetic oligonucleotide
  Target: ATXN1; (+) strand; PAM type: NRG; PAM sequence: TGG
ggactagtaatagcaaatac

SEQ ID NO: 114124 - DNA, 20 bp, Artificial Sequence
  Description of Artificial Sequence: Synthetic oligonucleotide
  Target: ATXN1; (+) strand; PAM type: NRG; PAM sequence: GGG
gactagtaatagcaaatact

SEQ ID NO: 114125 - DNA, 20 bp, Artificial Sequence
  Description of Artificial Sequence: Synthetic oligonucleotide
  Target: ATXN1; (+) strand; PAM type: NRG; PAM sequence: TGG
agtaatagcaaatactgggt

SEQ ID NO: 114126 - DNA, 20 bp, Artificial Sequence
  Description of Artificial Sequence: Synthetic oligonucleotide
  Target: ATXN1; (+) strand; PAM type: NRG; PAM sequence: AAG
caaatactgggttggtgcaa

SEQ ID NO: 114127 - DNA, 20 bp, Artificial Sequence
  Description of Artificial Sequence: Synthetic oligonucleotide
  Target: ATXN1; (+) strand; PAM type: NRG; PAM sequence: TGG
ggttggtgcaaaagtaattg

SEQ ID NO: 114128 - DNA, 20 bp, Artificial Sequence
  Description of Artificial Sequence: Synthetic oligonucleotide
  Target: ATXN1; (+) strand; PAM type: NRG; PAM sequence: AAG
attgtggtttttgccattga

SEQ ID NO: 114129 - DNA, 20 bp, Artificial Sequence
  Description of Artificial Sequence: Synthetic oligonucleotide
  Target: ATXN1; (+) strand; PAM type: NRG; PAM sequence: TGG
gtttttgccattgaaagtaa

SEQ ID NO: 114130 - DNA, 20 bp, Artificial Sequence
  Description of Artificial Sequence: Synthetic oligonucleotide
  Target: ATXN1; (+) strand; PAM type: NRG; PAM sequence: AAG
gcaccaacataatatttctt

SEQ ID NO: 114131 - DNA, 20 bp, Artificial Sequence
  Description of Artificial Sequence: Synthetic oligonucleotide
  Target: ATXN1; (+) strand; PAM type: NRG; PAM sequence: AAG
ttaagcgcttgcactgttcc

SEQ ID NO: 114132 - DNA, 20 bp, Artificial Sequence
  Description of Artificial Sequence: Synthetic oligonucleotide
  Target: ATXN1; (+) strand; PAM type: NRG; PAM sequence: GAG
aagcgcttgcactgttccaa

SEQ ID NO: 114133 - DNA, 20 bp, Artificial Sequence
  Description of Artificial Sequence: Synthetic oligonucleotide
  Target: ATXN1; (+) strand; PAM type: NRG; PAM sequence: GAG
aattatcacaacaacttttt

SEQ ID NO: 114134 - DNA, 20 bp, Artificial Sequence
  Description of Artificial Sequence: Synthetic oligonucleotide
  Target: ATXN1; (+) strand; PAM type: NRG; PAM sequence: AGG
attatcacaacaactttttg

SEQ ID NO: 114135 - DNA, 20 bp, Artificial Sequence
  Description of Artificial Sequence: Synthetic oligonucleotide
  Target: ATXN1; (+) strand; PAM type: NRG; PAM sequence: TAG
atcacaacaactttttgagg

SEQ ID NO: 114136 - DNA, 20 bp, Artificial Sequence
  Description of Artificial Sequence: Synthetic oligonucleotide
  Target: ATXN1; (+) strand; PAM type: NRG; PAM sequence: AAG
ttgaggtagctatcattatt

SEQ ID NO: 114137 - DNA, 20 bp, Artificial Sequence
  Description of Artificial Sequence: Synthetic oligonucleotide
  Target: ATXN1; (+) strand; PAM type: NRG; PAM sequence: AAG
gtagctatcattattaagcc

SEQ ID NO: 114138 - DNA, 20 bp, Artificial Sequence
  Description of Artificial Sequence: Synthetic oligonucleotide
  Target: ATXN1; (+) strand; PAM type: NRG; PAM sequence: GAG
attaagccaagtttgcaaat

SEQ ID NO: 114139 - DNA, 20 bp, Artificial Sequence
  Description of Artificial Sequence: Synthetic oligonucleotide
  Target: ATXN1; (+) strand; PAM type: NRG; PAM sequence: AGG
ttaagccaagtttgcaaatg

SEQ ID NO: 114140 - DNA, 20 bp, Artificial Sequence
  Description of Artificial Sequence: Synthetic oligonucleotide
  Target: ATXN1; (+) strand; PAM type: NRG; PAM sequence: AAG
gccaagtttgcaaatgagga

SEQ ID NO: 114141 - DNA, 20 bp, Artificial Sequence
  Description of Artificial Sequence: Synthetic oligonucleotide
  Target: ATXN1; (+) strand; PAM type: NRG; PAM sequence: AGG
ccaagtttgcaaatgaggaa

SEQ ID NO: 114142 - DNA, 20 bp, Artificial Sequence
  Description of Artificial Sequence: Synthetic oligonucleotide
  Target: ATXN1; (+) strand; PAM type: NRG; PAM sequence: GAG
aagtttgcaaatgaggaaag

SEQ ID NO: 114143 - DNA, 20 bp, Artificial Sequence
  Description of Artificial Sequence: Synthetic oligonucleotide
  Target: ATXN1; (+) strand; PAM type: NRG; PAM sequence: CAG
ttgcaaatgaggaaaggaga

SEQ ID NO: 114144 - DNA, 20 bp, Artificial Sequence
  Description of Artificial Sequence: Synthetic oligonucleotide
  Target: ATXN1; (+) strand; PAM type: NRG; PAM sequence: AGG
tgcaaatgaggaaaggagac

SEQ ID NO: 114145 - DNA, 20 bp, Artificial Sequence
  Description of Artificial Sequence: Synthetic oligonucleotide
  Target: ATXN1; (+) strand; PAM type: NRG; PAM sequence: GGG
gcaaatgaggaaaggagaca

SEQ ID NO: 114146 - DNA, 20 bp, Artificial Sequence
  Description of Artificial Sequence: Synthetic oligonucleotide
  Target: ATXN1; (+) strand; PAM type: NRG; PAM sequence: GAG
aaatgaggaaaggagacagg

SEQ ID NO: 114147 - DNA, 20 bp, Artificial Sequence
  Description of Artificial Sequence: Synthetic oligonucleotide
  Target: ATXN1; (+) strand; PAM type: NRG; PAM sequence: GAG
atgaggaaaggagacaggga

SEQ ID NO: 114148 - DNA, 20 bp, Artificial Sequence
  Description of Artificial Sequence: Synthetic oligonucleotide
  Target: ATXN1; (+) strand; PAM type: NRG; PAM sequence: CAG
aaaggagacagggagagttt

SEQ ID NO: 114149 - DNA, 20 bp, Artificial Sequence
  Description of Artificial Sequence: Synthetic oligonucleotide
  Target: ATXN1; (+) strand; PAM type: NRG; PAM sequence: CAG
ttcagcacttaccccaatta

SEQ ID NO: 114150 - DNA, 20 bp, Artificial Sequence
  Description of Artificial Sequence: Synthetic oligonucleotide
  Target: ATXN1; (+) strand; PAM type: NRG; PAM sequence: AAG
acttaccccaattacagcac

SEQ ID NO: 114151 - DNA, 20 bp, Artificial Sequence
  Description of Artificial Sequence: Synthetic oligonucleotide
  Target: ATXN1; (+) strand; PAM type: NRG; PAM sequence: CAG
attacagcacaagctgatgc

SEQ ID NO: 114152 - DNA, 20 bp, Artificial Sequence
  Description of Artificial Sequence: Synthetic oligonucleotide
  Target: ATXN1; (+) strand; PAM type: NRG; PAM sequence: GAG
tacagcacaagctgatgcca

SEQ ID NO: 114153 - DNA, 20 bp, Artificial Sequence
  Description of Artificial Sequence: Synthetic oligonucleotide
  Target: ATXN1; (+) strand; PAM type: NRG; PAM sequence: AGG
acagcacaagctgatgccag

SEQ ID NO: 114154 - DNA, 20 bp, Artificial Sequence
  Description of Artificial Sequence: Synthetic oligonucleotide
  Target: ATXN1; (+) strand; PAM type: NRG; PAM sequence: GGG
cagcacaagctgatgccaga

SEQ ID NO: 114155 - DNA, 20 bp, Artificial Sequence
  Description of Artificial Sequence: Synthetic oligonucleotide
  Target: ATXN1; (+) strand; PAM type: NRG; PAM sequence: GAG
gcacaagctgatgccagagg

SEQ ID NO: 114156 - DNA, 20 bp, Artificial Sequence
  Description of Artificial Sequence: Synthetic oligonucleotide
  Target: ATXN1; (+) strand; PAM type: NRG; PAM sequence: CAG
gccagagggagatttgaacc

SEQ ID NO: 114157 - DNA, 20 bp, Artificial Sequence
  Description of Artificial Sequence: Synthetic oligonucleotide
  Target: ATXN1; (+) strand; PAM type: NRG; PAM sequence: AGG
ccagagggagatttgaaccc

SEQ ID NO: 114158 - DNA, 20 bp, Artificial Sequence
  Description of Artificial Sequence: Synthetic oligonucleotide
  Target: ATXN1; (+) strand; PAM type: NRG; PAM sequence: TGG
agggagatttgaacccaggc

SEQ ID NO: 114159 - DNA, 20 bp, Artificial Sequence
  Description of Artificial Sequence: Synthetic oligonucleotide
  Target: ATXN1; (+) strand; PAM type: NRG; PAM sequence: CAG
gaacccaggctggctcactc

SEQ ID NO: 114160 - DNA, 20 bp, Artificial Sequence
  Description of Artificial Sequence: Synthetic oligonucleotide
  Target: ATXN1; (+) strand; PAM type: NRG; PAM sequence: CAG
taacacccaaccatcacatg

SEQ ID NO: 114161 - DNA, 20 bp, Artificial Sequence
  Description of Artificial Sequence: Synthetic oligonucleotide
  Target: ATXN1; (+) strand; PAM type: NRG; PAM sequence: AGG
aacacccaaccatcacatgc

SEQ ID NO: 114162 - DNA, 20 bp, Artificial Sequence
  Description of Artificial Sequence: Synthetic oligonucleotide
  Target: ATXN1; (+) strand; PAM type: NRG; PAM sequence: GGG
acacccaaccatcacatgca

SEQ ID NO: 114163 - DNA, 20 bp, Artificial Sequence
  Description of Artificial Sequence: Synthetic oligonucleotide
  Target: ATXN1; (+) strand; PAM type: NRG; PAM sequence: CAG
cacaactcactacacatcac

SEQ ID NO: 114164 - DNA, 20 bp, Artificial Sequence
  Description of Artificial Sequence: Synthetic oligonucleotide
  Target: ATXN1; (+) strand; PAM type: NRG; PAM sequence: AAG
tctcctaaccataaataata

SEQ ID NO: 114165 - DNA, 20 bp, Artificial Sequence
  Description of Artificial Sequence: Synthetic oligonucleotide
  Target: ATXN1; (+) strand; PAM type: NRG; PAM sequence: AGG
ctcctaaccataaataataa

SEQ ID NO: 114166 - DNA, 20 bp, Artificial Sequence
  Description of Artificial Sequence: Synthetic oligonucleotide
  Target: ATXN1; (+) strand; PAM type: NRG; PAM sequence: GGG
tcctaaccataaataataaa

SEQ ID NO: 114167 - DNA, 20 bp, Artificial Sequence
  Description of Artificial Sequence: Synthetic oligonucleotide
  Target: ATXN1; (+) strand; PAM type: NRG; PAM sequence: CAG
ccataaataataaagggact

SEQ ID NO: 114168 - DNA, 20 bp, Artificial Sequence
  Description of Artificial Sequence: Synthetic oligonucleotide
  Target: ATXN1; (+) strand; PAM type: NRG; PAM sequence: AAG
taaataataaagggactcag

SEQ ID NO: 114169 - DNA, 20 bp, Artificial Sequence
  Description of Artificial Sequence: Synthetic oligonucleotide
  Target: ATXN1; (+) strand; PAM type: NRG; PAM sequence: AAG
taaagggactcagaagcccc

SEQ ID NO: 114170 - DNA, 20 bp, Artificial Sequence
  Description of Artificial Sequence: Synthetic oligonucleotide
  Target: ATXN1; (+) strand; PAM type: NRG; PAM sequence: TGG
agggactcagaagccccaag

SEQ ID NO: 114171 - DNA, 20 bp, Artificial Sequence
  Description of Artificial Sequence: Synthetic oligonucleotide
  Target: ATXN1; (+) strand; PAM type: NRG; PAM sequence: GGG
gggactcagaagccccaagt

SEQ ID NO: 114172 - DNA, 20 bp, Artificial Sequence
  Description of Artificial Sequence: Synthetic oligonucleotide
  Target: ATXN1; (+) strand; PAM type: NRG; PAM sequence: GGG
ggactcagaagccccaagtg

SEQ ID NO: 114173 - DNA, 20 bp, Artificial Sequence
  Description of Artificial Sequence: Synthetic oligonucleotide
  Target: ATXN1; (+) strand; PAM type: NRG; PAM sequence: GAG
actcagaagccccaagtggg

SEQ ID NO: 114174 - DNA, 20 bp, Artificial Sequence
  Description of Artificial Sequence: Synthetic oligonucleotide
  Target: ATXN1; (+) strand; PAM type: NRG; PAM sequence: GAG
tcagaagccccaagtgggga

SEQ ID NO: 114175 - DNA, 20 bp, Artificial Sequence
  Description of Artificial Sequence: Synthetic oligonucleotide
  Target: ATXN1; (+) strand; PAM type: NRG; PAM sequence: AGG
cagaagccccaagtggggag

SEQ ID NO: 114176 - DNA, 20 bp, Artificial Sequence
  Description of Artificial Sequence: Synthetic oligonucleotide
  Target: ATXN1; (+) strand; PAM type: NRG; PAM sequence: TGG
cccaagtggggagaggttaa

SEQ ID NO: 114177 - DNA, 20 bp, Artificial Sequence
  Description of Artificial Sequence: Synthetic oligonucleotide
  Target: ATXN1; (+) strand; PAM type: NRG; PAM sequence: GGG
ccaagtggggagaggttaat

SEQ ID NO: 114178 - DNA, 20 bp, Artificial Sequence
  Description of Artificial Sequence: Synthetic oligonucleotide
  Target: ATXN1; (+) strand; PAM type: NRG; PAM sequence: CGG
gggagaggttaatgggtttg

SEQ ID NO: 114179 - DNA, 20 bp, Artificial Sequence
  Description of Artificial Sequence: Synthetic oligonucleotide
  Target: ATXN1; (+) strand; PAM type: NRG; PAM sequence: TAG
gaggttaatgggtttgcggt

SEQ ID NO: 114180 - DNA, 20 bp, Artificial Sequence
  Description of Artificial Sequence: Synthetic oligonucleotide
  Target: ATXN1; (+) strand; PAM type: NRG; PAM sequence: AAG
gttaatgggtttgcggttag

SEQ ID NO: 114181 - DNA, 20 bp, Artificial Sequence
  Description of Artificial Sequence: Synthetic oligonucleotide
  Target: ATXN1; (+) strand; PAM type: NRG; PAM sequence: AGG
ttaatgggtttgcggttaga

SEQ ID NO: 114182 - DNA, 20 bp, Artificial Sequence
  Description of Artificial Sequence: Synthetic oligonucleotide
  Target: ATXN1; (+) strand; PAM type: NRG; PAM sequence: CGG
tttgcggttagaaggctttg

SEQ ID NO: 114183 - DNA, 20 bp, Artificial Sequence
  Description of Artificial Sequence: Synthetic oligonucleotide
  Target: ATXN1; (+) strand; PAM type: NRG; PAM sequence: AAG
gcggttagaaggctttgcgg

SEQ ID NO: 114184 - DNA, 20 bp, Artificial Sequence
  Description of Artificial Sequence: Synthetic oligonucleotide
  Target: ATXN1; (+) strand; PAM type: NRG; PAM sequence: GAG
ggttagaaggctttgcggaa

SEQ ID NO: 114185 - DNA, 20 bp, Artificial Sequence
  Description of Artificial Sequence: Synthetic oligonucleotide
  Target: ATXN1; (+) strand; PAM type: NRG; PAM sequence: AGG
gttagaaggctttgcggaag

SEQ ID NO: 114186 - DNA, 20 bp, Artificial Sequence
  Description of Artificial Sequence: Synthetic oligonucleotide
  Target: ATXN1; (+) strand; PAM type: NRG; PAM sequence: GGG
ttagaaggctttgcggaaga

SEQ ID NO: 114187 - DNA, 20 bp, Artificial Sequence
  Description of Artificial Sequence: Synthetic oligonucleotide
  Target: ATXN1; (+) strand; PAM type: NRG; PAM sequence: GGG
tagaaggctttgcggaagag

SEQ ID NO: 114188 - DNA, 20 bp, Artificial Sequence
  Description of Artificial Sequence: Synthetic oligonucleotide
  Target: ATXN1; (+) strand; PAM type: NRG; PAM sequence: TGG
aggctttgcggaagagggga

SEQ ID NO: 114189 - DNA, 20 bp, Artificial Sequence
  Description of Artificial Sequence: Synthetic oligonucleotide
  Target: ATXN1; (+) strand; PAM type: NRG; PAM sequence: GGG
ggctttgcggaagaggggat

SEQ ID NO: 114190 - DNA, 20 bp, Artificial Sequence
  Description of Artificial Sequence: Synthetic oligonucleotide
  Target: ATXN1; (+) strand; PAM type: NRG; PAM sequence: GAG
ctttgcggaagaggggatgg

SEQ ID NO: 114191 - DNA, 20 bp, Artificial Sequence
  Description of Artificial Sequence: Synthetic oligonucleotide
  Target: ATXN1; (+) strand; PAM type: NRG; PAM sequence: TGG
gcggaagaggggatgggagc

SEQ ID NO: 114192 - DNA, 20 bp, Artificial Sequence
  Description of Artificial Sequence: Synthetic oligonucleotide
  Target: ATXN1; (+) strand; PAM type: NRG; PAM sequence: GGG
cggaagaggggatgggagct

SEQ ID NO: 114193 - DNA, 20 bp, Artificial Sequence
  Description of Artificial Sequence: Synthetic oligonucleotide
  Target: ATXN1; (+) strand; PAM type: NRG; PAM sequence: AAG
gggatgggagctgggccctg

SEQ ID NO: 114194 - DNA, 20 bp, Artificial Sequence
  Description of Artificial Sequence: Synthetic oligonucleotide
  Target: ATXN1; (+) strand; PAM type: NRG; PAM sequence: TAG
atgggagctgggccctgaag

SEQ ID NO: 114195 - DNA, 20 bp, Artificial Sequence
  Description of Artificial Sequence: Synthetic oligonucleotide
  Target: ATXN1; (+) strand; PAM type: NRG; PAM sequence: GAG
gggagctgggccctgaagta

SEQ ID NO: 114196 - DNA, 20 bp, Artificial Sequence
  Description of Artificial Sequence: Synthetic oligonucleotide
  Target: ATXN1; (+) strand; PAM type: NRG; PAM sequence: AGG
ggagctgggccctgaagtag

SEQ ID NO: 114197 - DNA, 20 bp, Artificial Sequence
  Description of Artificial Sequence: Synthetic oligonucleotide
  Target: ATXN1; (+) strand; PAM type: NRG; PAM sequence: AAG
gctgggccctgaagtagagg

SEQ ID NO: 114198 - DNA, 20 bp, Artificial Sequence
  Description of Artificial Sequence: Synthetic oligonucleotide
  Target: ATXN1; (+) strand; PAM type: NRG; PAM sequence: AGG
ctgggccctgaagtagagga

SEQ ID NO: 114199 - DNA, 20 bp, Artificial Sequence
  Description of Artificial Sequence: Synthetic oligonucleotide
  Target: ATXN1; (+) strand; PAM type: NRG; PAM sequence: CGG
aagtagaggaaggattttga

SEQ ID NO: 114200 - DNA, 20 bp, Artificial Sequence
  Description of Artificial Sequence: Synthetic oligonucleotide
  Target: ATXN1; (+) strand; PAM type: NRG; PAM sequence: GGG
agtagaggaaggattttgac

SEQ ID NO: 114201 - DNA, 20 bp, Artificial Sequence
  Description of Artificial Sequence: Synthetic oligonucleotide
  Target: ATXN1; (+) strand; PAM type: NRG; PAM sequence: TGG
gaggaaggattttgacgggc

SEQ ID NO: 114202 - DNA, 20 bp, Artificial Sequence
  Description of Artificial Sequence: Synthetic oligonucleotide
  Target: ATXN1; (+) strand; PAM type: NRG; PAM sequence: GGG
aggaaggattttgacgggct

SEQ ID NO: 114203 - DNA, 20 bp, Artificial Sequence
  Description of Artificial Sequence: Synthetic oligonucleotide
  Target: ATXN1; (+) strand; PAM type: NRG; PAM sequence: CAG
aggattttgacgggctgggt

SEQ ID NO: 114204 - DNA, 20 bp, Artificial Sequence
  Description of Artificial Sequence: Synthetic oligonucleotide
  Target: ATXN1; (+) strand; PAM type: NRG; PAM sequence: TGG
ttttgacgggctgggtcaga

SEQ ID NO: 114205 - DNA, 20 bp, Artificial Sequence
  Description of Artificial Sequence: Synthetic oligonucleotide
  Target: ATXN1; (+) strand; PAM type: NRG; PAM sequence: GAG
ttgacgggctgggtcagatg

SEQ ID NO: 114206 - DNA, 20 bp, Artificial Sequence
  Description of Artificial Sequence: Synthetic oligonucleotide
  Target: ATXN1; (+) strand; PAM type: NRG; PAM sequence: AGG
tgacgggctgggtcagatgg

SEQ ID NO: 114207 - DNA, 20 bp, Artificial Sequence
  Description of Artificial Sequence: Synthetic oligonucleotide
  Target: ATXN1; (+) strand; PAM type: NRG; PAM sequence: GGG
gacgggctgggtcagatgga

SEQ ID NO: 114208 - DNA, 20 bp, Artificial Sequence
  Description of Artificial Sequence: Synthetic oligonucleotide
  Target: ATXN1; (+) strand; PAM type: NRG; PAM sequence: TGG
gggtcagatggagggaaata

SEQ ID NO: 114209 - DNA, 20 bp, Artificial Sequence
  Description of Artificial Sequence: Synthetic oligonucleotide
  Target: ATXN1; (+) strand; PAM type: NRG; PAM sequence: CAG
aatatggcgatgaacacgca

SEQ ID NO: 114210 - DNA, 20 bp, Artificial Sequence
  Description of Artificial Sequence: Synthetic oligonucleotide
  Target: ATXN1; (+) strand; PAM type: NRG; PAM sequence: TAG
gatgaacacgcacagaacat

SEQ ID NO: 114211 - DNA, 20 bp, Artificial Sequence
  Description of Artificial Sequence: Synthetic oligonucleotide
  Target: ATXN1; (+) strand; PAM type: NRG; PAM sequence: AAG
aacattagaattacaatgtg

SEQ ID NO: 114212 - DNA, 20 bp, Artificial Sequence
  Description of Artificial Sequence: Synthetic oligonucleotide
  Target: ATXN1; (+) strand; PAM type: NRG; PAM sequence: AAG
ttagaattacaatgtgaagt

SEQ ID NO: 114213 - DNA, 20 bp, Artificial Sequence
  Description of Artificial Sequence: Synthetic oligonucleotide
  Target: ATXN1; (+) strand; PAM type: NRG; PAM sequence: AGG
tagaattacaatgtgaagta

SEQ ID NO: 114214 - DNA, 20 bp, Artificial Sequence
  Description of Artificial Sequence: Synthetic oligonucleotide
  Target: ATXN1; (+) strand; PAM type: NRG; PAM sequence: TGG
ttacaatgtgaagtaaggtt

SEQ ID NO: 114215 - DNA, 20 bp, Artificial Sequence
  Description of Artificial Sequence: Synthetic oligonucleotide
  Target: ATXN1; (+) strand; PAM type: NRG; PAM sequence: TGG
aatgtgaagtaaggtttggt

SEQ ID NO: 114216 - DNA, 20 bp, Artificial Sequence
  Description of Artificial Sequence: Synthetic oligonucleotide
  Target: ATXN1; (+) strand; PAM type: NRG; PAM sequence: GGG
atgtgaagtaaggtttggtt

SEQ ID NO: 114217 - DNA, 20 bp, Artificial Sequence
  Description of Artificial Sequence: Synthetic oligonucleotide
  Target: ATXN1; (+) strand; PAM type: NRG; PAM sequence: TAG
agtaaggtttggttgggaca

SEQ ID NO: 114218 - DNA, 20 bp, Artificial Sequence
  Description of Artificial Sequence: Synthetic oligonucleotide
  Target: ATXN1; (+) strand; PAM type: NRG; PAM sequence: AGG
gtaaggtttggttgggacat

SEQ ID NO: 114219 - DNA, 20 bp, Artificial Sequence
  Description of Artificial Sequence: Synthetic oligonucleotide
  Target: ATXN1; (+) strand; PAM type: NRG; PAM sequence: CAG
ttggttgggacataggctgc

SEQ ID NO: 114220 - DNA, 20 bp, Artificial Sequence
  Description of Artificial Sequence: Synthetic oligonucleotide
  Target: ATXN1; (+) strand; PAM type: NRG; PAM sequence: TGG
gttgggacataggctgccag

SEQ ID NO: 114221 - DNA, 20 bp, Artificial Sequence
  Description of Artificial Sequence: Synthetic oligonucleotide
  Target: ATXN1; (+) strand; PAM type: NRG; PAM sequence: GAG
tgggacataggctgccagtg

SEQ ID NO: 114222 - DNA, 20 bp, Artificial Sequence
  Description of Artificial Sequence: Synthetic oligonucleotide
  Target: ATXN1; (+) strand; PAM type: NRG; PAM sequence: CAG
gacataggctgccagtggag

SEQ ID NO: 114223 - DNA, 20 bp, Artificial Sequence
  Description of Artificial Sequence: Synthetic oligonucleotide
  Target: ATXN1; (+) strand; PAM type: NRG; PAM sequence: TGG
ataggctgccagtggagcag

SEQ ID NO: 114224 - DNA, 20 bp, Artificial Sequence
  Description of Artificial Sequence: Synthetic oligonucleotide
  Target: ATXN1; (+) strand; PAM type: NRG; PAM sequence: GGG
taggctgccagtggagcagt

SEQ ID NO: 114225 - DNA, 20 bp, Artificial Sequence
  Description of Artificial Sequence: Synthetic oligonucleotide
  Target: ATXN1; (+) strand; PAM type: NRG; PAM sequence: GGG
aggctgccagtggagcagtg

SEQ ID NO: 114226 - DNA, 20 bp, Artificial Sequence
  Description of Artificial Sequence: Synthetic oligonucleotide
  Target: ATXN1; (+) strand; PAM type: NRG; PAM sequence: GGG
ggctgccagtggagcagtgg

SEQ ID NO: 114227 - DNA, 20 bp, Artificial Sequence
  Description of Artificial Sequence: Synthetic oligonucleotide
  Target: ATXN1; (+) strand; PAM type: NRG; PAM sequence: CGG
tgccagtggagcagtggggg

SEQ ID NO: 114228 - DNA, 20 bp, Artificial Sequence
  Description of Artificial Sequence: Synthetic oligonucleotide
  Target: ATXN1; (+) strand; PAM type: NRG; PAM sequence: GAG
agtggagcagtgggggcggc

SEQ ID NO: 114229 - DNA, 20 bp, Artificial Sequence
  Description of Artificial Sequence: Synthetic oligonucleotide
  Target: ATXN1; (+) strand; PAM type: NRG; PAM sequence: AGG
gtggagcagtgggggcggcg

SEQ ID NO: 114230 - DNA, 20 bp, Artificial Sequence
  Description of Artificial Sequence: Synthetic oligonucleotide
  Target: ATXN1; (+) strand; PAM type: NRG; PAM sequence: GGG
tggagcagtgggggcggcga

SEQ ID NO: 114231 - DNA, 20 bp, Artificial Sequence
  Description of Artificial Sequence: Synthetic oligonucleotide
  Target: ATXN1; (+) strand; PAM type: NRG; PAM sequence: TAG
agcagtgggggcggcgaggg

SEQ ID NO: 114232 - DNA, 20 bp, Artificial Sequence
  Description of Artificial Sequence: Synthetic oligonucleotide
  Target: ATXN1; (+) strand; PAM type: NRG; PAM sequence: AGG
gcagtgggggcggcgagggt

SEQ ID NO: 114233 - DNA, 20 bp, Artificial Sequence
  Description of Artificial Sequence: Synthetic oligonucleotide
  Target: ATXN1; (+) strand; PAM type: NRG; PAM sequence: GGG
cagtgggggcggcgagggta

SEQ ID NO: 114234 - DNA, 20 bp, Artificial Sequence
  Description of Artificial Sequence: Synthetic oligonucleotide
  Target: ATXN1; (+) strand; PAM type: NRG; PAM sequence: GGG
agtgggggcggcgagggtag

SEQ ID NO: 114235 - DNA, 20 bp, Artificial Sequence
  Description of Artificial Sequence: Synthetic oligonucleotide
  Target: ATXN1; (+) strand; PAM type: NRG; PAM sequence: GGG
gtgggggcggcgagggtagg

SEQ ID NO: 114236 - DNA, 20 bp, Artificial Sequence
  Description of Artificial Sequence: Synthetic oligonucleotide
  Target: ATXN1; (+) strand; PAM type: NRG; PAM sequence: GGG
tgggggcggcgagggtaggg

SEQ ID NO: 114237 - DNA, 20 bp, Artificial Sequence
  Description of Artificial Sequence: Synthetic oligonucleotide
  Target: ATXN1; (+) strand; PAM type: NRG; PAM sequence: TGG
gggcggcgagggtagggggg

SEQ ID NO: 114238 - DNA, 20 bp, Artificial Sequence
  Description of Artificial Sequence: Synthetic oligonucleotide
  Target: ATXN1; (+) strand; PAM type: NRG; PAM sequence: GGG
ggcggcgagggtaggggggt

SEQ ID NO: 114239 - DNA, 20 bp, Artificial Sequence
  Description of Artificial Sequence: Synthetic oligonucleotide
  Target: ATXN1; (+) strand; PAM type: NRG; PAM sequence: GAG
cggcgagggtaggggggtgg

SEQ ID NO: 114240 - DNA, 20 bp, Artificial Sequence
  Description of Artificial Sequence: Synthetic oligonucleotide
  Target: ATXN1; (+) strand; PAM type: NRG; PAM sequence: AGG
ggcgagggtaggggggtggg

SEQ ID NO: 114241 - DNA, 20 bp, Artificial Sequence
  Description of Artificial Sequence: Synthetic oligonucleotide
  Target: ATXN1; (+) strand; PAM type: NRG; PAM sequence: TGG
gggggtgggaggtcacctgc

SEQ ID NO: 114242 - DNA, 20 bp, Artificial Sequence
  Description of Artificial Sequence: Synthetic oligonucleotide
  Target: ATXN1; (+) strand; PAM type: NRG; PAM sequence: TGG
aggtcacctgctggacaccc

SEQ ID NO: 114243 - DNA, 20 bp, Artificial Sequence
  Description of Artificial Sequence: Synthetic oligonucleotide
  Target: ATXN1; (+) strand; PAM type: NRG; PAM sequence: TAG
tgcacctgttccctcctcac

SEQ ID NO: 114244 - DNA, 20 bp, Artificial Sequence
  Description of Artificial Sequence: Synthetic oligonucleotide
  Target: ATXN1; (+) strand; PAM type: NRG; PAM sequence: AGG
gcacctgttccctcctcact

SEQ ID NO: 114245 - DNA, 20 bp, Artificial Sequence
  Description of Artificial Sequence: Synthetic oligonucleotide
  Target: ATXN1; (+) strand; PAM type: NRG; PAM sequence: TGG
gttccctcctcactaggtga

SEQ ID NO: 114246 - DNA, 20 bp, Artificial Sequence
  Description of Artificial Sequence: Synthetic oligonucleotide
  Target: ATXN1; (+) strand; PAM type: NRG; PAM sequence: GAG
tccctcctcactaggtgatg

SEQ ID NO: 114247 - DNA, 20 bp, Artificial Sequence
  Description of Artificial Sequence: Synthetic oligonucleotide
  Target: ATXN1; (+) strand; PAM type: NRG; PAM sequence: AGG
ccctcctcactaggtgatgg

SEQ ID NO: 114248 - DNA, 20 bp, Artificial Sequence
  Description of Artificial Sequence: Synthetic oligonucleotide
  Target: ATXN1; (+) strand; PAM type: NRG; PAM sequence: CAG
tcctcactaggtgatggagg

SEQ ID NO: 114249 - DNA, 20 bp, Artificial Sequence
  Description of Artificial Sequence: Synthetic oligonucleotide
  Target: ATXN1; (+) strand; PAM type: NRG; PAM sequence: GAG
ctcactaggtgatggaggca

SEQ ID NO: 114250 - DNA, 20 bp, Artificial Sequence
  Description of Artificial Sequence: Synthetic oligonucleotide
  Target: ATXN1; (+) strand; PAM type: NRG; PAM sequence: GAG
cactaggtgatggaggcaga

SEQ ID NO: 114251 - DNA, 20 bp, Artificial Sequence
  Description of Artificial Sequence: Synthetic oligonucleotide
  Target: ATXN1; (+) strand; PAM type: NRG; PAM sequence: AGG
actaggtgatggaggcagag

SEQ ID NO: 114252 - DNA, 20 bp, Artificial Sequence
  Description of Artificial Sequence: Synthetic oligonucleotide
  Target: ATXN1; (+) strand; PAM type: NRG; PAM sequence: AAG
tggaggcagagaggacactg

SEQ ID NO: 114253 - DNA, 20 bp, Artificial Sequence
  Description of Artificial Sequence: Synthetic oligonucleotide
  Target: ATXN1; (+) strand; PAM type: NRG; PAM sequence: GAG
gaggcagagaggacactgaa

SEQ ID NO: 114254 - DNA, 20 bp, Artificial Sequence
  Description of Artificial Sequence: Synthetic oligonucleotide
  Target: ATXN1; (+) strand; PAM type: NRG; PAM sequence: GAG
ggcagagaggacactgaaga

SEQ ID NO: 114255 - DNA, 20 bp, Artificial Sequence
  Description of Artificial Sequence: Synthetic oligonucleotide
  Target: ATXN1; (+) strand; PAM type: NRG; PAM sequence: AGG
gcagagaggacactgaagag

SEQ ID NO: 114256 - DNA, 20 bp, Artificial Sequence
  Description of Artificial Sequence: Synthetic oligonucleotide
  Target: ATXN1; (+) strand; PAM type: NRG; PAM sequence: GAG
agagaggacactgaagagag

SEQ ID NO: 114257 - DNA, 20 bp, Artificial Sequence
  Description of Artificial Sequence: Synthetic oligonucleotide
  Target: ATXN1; (+) strand; PAM type: NRG; PAM sequence: GAG
acactgaagagaggagacat

SEQ ID NO: 114258 - DNA, 20 bp, Artificial Sequence
  Description of Artificial Sequence: Synthetic oligonucleotide
  Target: ATXN1; (+) strand; PAM type: NRG; PAM sequence: AGG
cactgaagagaggagacatg

SEQ ID NO: 114259 - DNA, 20 bp, Artificial Sequence
  Description of Artificial Sequence: Synthetic oligonucleotide
  Target: ATXN1; (+) strand; PAM type: NRG; PAM sequence: GGG
actgaagagaggagacatga

SEQ ID NO: 114260 - DNA, 20 bp, Artificial Sequence
  Description of Artificial Sequence: Synthetic oligonucleotide
  Target: ATXN1; (+) strand; PAM type: NRG; PAM sequence: CGG
gaggagacatgagggctgtg

SEQ ID NO: 114261 - DNA, 20 bp, Artificial Sequence
  Description of Artificial Sequence: Synthetic oligonucleotide
  Target: ATXN1; (+) strand; PAM type: NRG; PAM sequence: TGG
gagacatgagggctgtgcgg

SEQ ID NO: 114262 - DNA, 20 bp, Artificial Sequence
  Description of Artificial Sequence: Synthetic oligonucleotide
  Target: ATXN1; (+) strand; PAM type: NRG; PAM sequence: TGG
tgagggctgtgcggtggccc

SEQ ID NO: 114263 - DNA, 20 bp, Artificial Sequence
  Description of Artificial Sequence: Synthetic oligonucleotide
  Target: ATXN1; (+) strand; PAM type: NRG; PAM sequence: AAG
gccctggtgcatcatttcct

SEQ ID NO: 114264 - DNA, 20 bp, Artificial Sequence
  Description of Artificial Sequence: Synthetic oligonucleotide
  Target: ATXN1; (+) strand; PAM type: NRG; PAM sequence: TAG
gccctactatttcttcccca

SEQ ID NO: 114265 - DNA, 20 bp, Artificial Sequence
  Description of Artificial Sequence: Synthetic oligonucleotide
  Target: ATXN1; (+) strand; PAM type: NRG; PAM sequence: CAG
tactatttcttccccataga

SEQ ID NO: 114266 - DNA, 20 bp, Artificial Sequence
  Description of Artificial Sequence: Synthetic oligonucleotide
  Target: ATXN1; (+) strand; PAM type: NRG; PAM sequence: GAG
ctatttcttccccatagaca

SEQ ID NO: 114267 - DNA, 20 bp, Artificial Sequence
  Description of Artificial Sequence: Synthetic oligonucleotide
  Target: ATXN1; (+) strand; PAM type: NRG; PAM sequence: TAG
ccccatagacagagatccct

SEQ ID NO: 114268 - DNA, 20 bp, Artificial Sequence
  Description of Artificial Sequence: Synthetic oligonucleotide
  Target: ATXN1; (+) strand; PAM type: NRG; PAM sequence: TAG
tcctttttccttactgactg

SEQ ID NO: 114269 - DNA, 20 bp, Artificial Sequence
  Description of Artificial Sequence: Synthetic oligonucleotide
  Target: ATXN1; (+) strand; PAM type: NRG; PAM sequence: GAG
ctttttccttactgactgta

SEQ ID NO: 114270 - DNA, 20 bp, Artificial Sequence
  Description of Artificial Sequence: Synthetic oligonucleotide
  Target: ATXN1; (+) strand; PAM type: NRG; PAM sequence: AAG
ttactgactgtagagacccc

SEQ ID NO: 114271 - DNA, 20 bp, Artificial Sequence
  Description of Artificial Sequence: Synthetic oligonucleotide
  Target: ATXN1; (+) strand; PAM type: NRG; PAM sequence: TGG
agagaccccaagtttctcac

SEQ ID NO: 114272 - DNA, 20 bp, Artificial Sequence
  Description of Artificial Sequence: Synthetic oligonucleotide
  Target: ATXN1; (+) strand; PAM type: NRG; PAM sequence: CAG
ctggcactgcaaaatatatg

SEQ ID NO: 114273 - DNA, 20 bp, Artificial Sequence
  Description of Artificial Sequence: Synthetic oligonucleotide
  Target: ATXN1; (+) strand; PAM type: NRG; PAM sequence: CAG
aaatatatgcagaaatttga

SEQ ID NO: 114274 - DNA, 20 bp, Artificial Sequence
  Description of Artificial Sequence: Synthetic oligonucleotide
  Target: ATXN1; (+) strand; PAM type: NRG; PAM sequence: TGG
tatatgcagaaatttgacag

SEQ ID NO: 114275 - DNA, 20 bp, Artificial Sequence
  Description of Artificial Sequence: Synthetic oligonucleotide
  Target: ATXN1; (+) strand; PAM type: NRG; PAM sequence: GGG
atatgcagaaatttgacagt

SEQ ID NO: 114276 - DNA, 20 bp, Artificial Sequence
  Description of Artificial Sequence: Synthetic oligonucleotide
  Target: ATXN1; (+) strand; PAM type: NRG; PAM sequence: CAG
aatttgacagtgggtgataa

SEQ ID NO: 114277 - DNA, 20 bp, Artificial Sequence
  Description of Artificial Sequence: Synthetic oligonucleotide
  Target: ATXN1; (+) strand; PAM type: NRG; PAM sequence: AGG
atttgacagtgggtgataac

SEQ ID NO: 114278 - DNA, 20 bp, Artificial Sequence
  Description of Artificial Sequence: Synthetic oligonucleotide
  Target: ATXN1; (+) strand; PAM type: NRG; PAM sequence: TGG
gtgggtgataacaggatgtt

SEQ ID NO: 114279 - DNA, 20 bp, Artificial Sequence
  Description of Artificial Sequence: Synthetic oligonucleotide
  Target: ATXN1; (+) strand; PAM type: NRG; PAM sequence: GAG
gggtgataacaggatgtttg

SEQ ID NO: 114280 - DNA, 20 bp, Artificial Sequence
  Description of Artificial Sequence: Synthetic oligonucleotide
  Target: ATXN1; (+) strand; PAM type: NRG; PAM sequence: TAG
caggatgtttggagtccttt

SEQ ID NO: 114281 - DNA, 20 bp, Artificial Sequence
  Description of Artificial Sequence: Synthetic oligonucleotide
  Target: ATXN1; (+) strand; PAM type: NRG; PAM sequence: CAG
gcattaaaaaaaaaaacaac

SEQ ID NO: 114282 - DNA, 20 bp, Artificial Sequence
  Description of Artificial Sequence: Synthetic oligonucleotide
  Target: ATXN1; (+) strand; PAM type: NRG; PAM sequence: TAG
ttaaaaaaaaaaacaaccag

SEQ ID NO: 114283 - DNA, 20 bp, Artificial Sequence
  Description of Artificial Sequence: Synthetic oligonucleotide
  Target: ATXN1; (+) strand; PAM type: NRG; PAM sequence: TAG
aaaaaaacaaccagtagcaa

SEQ ID NO: 114284 - DNA, 20 bp, Artificial Sequence
  Description of Artificial Sequence: Synthetic oligonucleotide
  Target: ATXN1; (+) strand; PAM type: NRG; PAM sequence: CAG
acaaccagtagcaatagcat

SEQ ID NO: 114285 - DNA, 20 bp, Artificial Sequence
  Description of Artificial Sequence: Synthetic oligonucleotide
  Target: ATXN1; (+) strand; PAM type: NRG; PAM sequence: GAG
aaccagtagcaatagcatca

SEQ ID NO: 114286 - DNA, 20 bp, Artificial Sequence
  Description of Artificial Sequence: Synthetic oligonucleotide
  Target: ATXN1; (+) strand; PAM type: NRG; PAM sequence: GAG
cgtttttttttttttttttt

SEQ ID NO: 114287 - DNA, 20 bp, Artificial Sequence
  Description of Artificial Sequence: Synthetic oligonucleotide
  Target: ATXN1; (+) strand; PAM type: NRG; PAM sequence: AAG
ttttttttttttttttgaga

SEQ ID NO: 114288 - DNA, 20 bp, Artificial Sequence
  Description of Artificial Sequence: Synthetic oligonucleotide
  Target: ATXN1; (+) strand; PAM type: NRG; PAM sequence: GAG
ttttttttttttttgagaaa

SEQ ID NO: 114289 - DNA, 20 bp, Artificial Sequence
  Description of Artificial Sequence: Synthetic oligonucleotide
  Target: ATXN1; (+) strand; PAM type: NRG; PAM sequence: CAG
ttttgagaaagagtctcctc

SEQ ID NO: 114290 - DNA, 20 bp, Artificial Sequence
  Description of Artificial Sequence: Synthetic oligonucleotide
  Target: ATXN1; (+) strand; PAM type: NRG; PAM sequence: AGG
tttgagaaagagtctcctcc

SEQ ID NO: 114291 - DNA, 20 bp, Artificial Sequence
  Description of Artificial Sequence: Synthetic oligonucleotide
  Target: ATXN1; (+) strand; PAM type: NRG; PAM sequence: TGG
agaaagagtctcctccaggc

SEQ ID NO: 114292 - DNA, 20 bp, Artificial Sequence
  Description of Artificial Sequence: Synthetic oligonucleotide
  Target: ATXN1; (+) strand; PAM type: NRG; PAM sequence: GAG
aaagagtctcctccaggctg

SEQ ID NO: 114293 - DNA, 20 bp, Artificial Sequence
  Description of Artificial Sequence: Synthetic oligonucleotide
  Target: ATXN1; (+) strand; PAM type: NRG; PAM sequence: CAG
gtctcctccaggctggagtg

SEQ ID NO: 114294 - DNA, 20 bp, Artificial Sequence
  Description of Artificial Sequence: Synthetic oligonucleotide
  Target: ATXN1; (+) strand; PAM type: NRG; PAM sequence: TGG
tcctccaggctggagtgcag

SEQ ID NO: 114295 - DNA, 20 bp, Artificial Sequence
  Description of Artificial Sequence: Synthetic oligonucleotide
  Target: ATXN1; (+) strand; PAM type: NRG; PAM sequence: CAG
ggagtgcagtggtacgatct

SEQ ID NO: 114296 - DNA, 20 bp, Artificial Sequence
  Description of Artificial Sequence: Synthetic oligonucleotide
  Target: ATXN1; (+) strand; PAM type: NRG; PAM sequence: CAG
tgactgcaacctccgcctcc

SEQ ID NO: 114297 - DNA, 20 bp, Artificial Sequence
  Description of Artificial Sequence: Synthetic oligonucleotide
  Target: ATXN1; (+) strand; PAM type: NRG; PAM sequence: AGG
gactgcaacctccgcctccc

SEQ ID NO: 114298 - DNA, 20 bp, Artificial Sequence
  Description of Artificial Sequence: Synthetic oligonucleotide
  Target: ATXN1; (+) strand; PAM type: NRG; PAM sequence: AAG
aacctccgcctcccaggttc

SEQ ID NO: 114299 - DNA, 20 bp, Artificial Sequence
  Description of Artificial Sequence: Synthetic oligonucleotide
  Target: ATXN1; (+) strand; PAM type: NRG; PAM sequence: TAG
ttcaagtgattctcatgcct

SEQ ID NO: 114300 - DNA, 20 bp, Artificial Sequence
  Description of Artificial Sequence: Synthetic oligonucleotide
  Target: ATXN1; (+) strand; PAM type: NRG; PAM sequence: AAG
ttctcatgccttagcctccc

SEQ ID NO: 114301 - DNA, 20 bp, Artificial Sequence
  Description of Artificial Sequence: Synthetic oligonucleotide
  Target: ATXN1; (+) strand; PAM type: NRG; PAM sequence: TAG
tcatgccttagcctcccaag

SEQ ID NO: 114302 - DNA, 20 bp, Artificial Sequence
  Description of Artificial Sequence: Synthetic oligonucleotide
  Target: ATXN1; (+) strand; PAM type: NRG; PAM sequence: TGG
gccttagcctcccaagtagc

SEQ ID NO: 114303 - DNA, 20 bp, Artificial Sequence
  Description of Artificial Sequence: Synthetic oligonucleotide
  Target: ATXN1; (+) strand; PAM type: NRG; PAM sequence: GGG
ccttagcctcccaagtagct

SEQ ID NO: 114304 - DNA, 20 bp, Artificial Sequence
  Description of Artificial Sequence: Synthetic oligonucleotide
  Target: ATXN1; (+) strand; PAM type: NRG; PAM sequence: CAG
ctcccaagtagctgggatta

SEQ ID NO: 114305 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagctgggattac

SEQ ID NO: 114306 - DNA, 20 bp, Artificial Sequence
  Description of Artificial Sequence: Synthetic oligonucleotide
  Target: ATXN1; (+) strand; PAM type: NRG; PAM sequence: TGG
caggtgcccaccaccacgcc

SEQ ID NO: 114307 - DNA, 20 bp, Artificial Sequence
  Description of Artificial Sequence: Synthetic oligonucleotide
  Target: ATXN1; (+) strand; PAM type: NRG; PAM sequence: TAG
ctggctaatttttgtatttt

SEQ ID NO: 114308 - DNA, 20 bp, Artificial Sequence
  Description of Artificial Sequence: Synthetic oligonucleotide
  Target: ATXN1; (+) strand; PAM type: NRG; PAM sequence: TAG
gctaatttttgtatttttag

SEQ ID NO: 114309 - DNA, 20 bp, Artificial Sequence
  Description of Artificial Sequence: Synthetic oligonucleotide
  Target: ATXN1; (+) strand; PAM type: NRG; PAM sequence: GAG
taatttttgtatttttagta

SEQ ID NO: 114310 - DNA, 20 bp, Artificial Sequence
  Description of Artificial Sequence: Synthetic oligonucleotide
  Target: ATXN1; (+) strand; PAM type: NRG; PAM sequence: TAG
ttttgtatttttagtagaga

SEQ ID NO: 114311 - DNA, 20 bp, Artificial Sequence
  Description of Artificial Sequence: Synthetic oligonucleotide
  Target: ATXN1; (+) strand; PAM type: NRG; PAM sequence: AGG
tttgtatttttagtagagat

SEQ ID NO: 114312 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagata

SEQ ID NO: 114313 - DNA, 20 bp, Artificial Sequence
  Description of Artificial Sequence: Synthetic oligonucleotide
  Target: ATXN1; (+) strand; PAM type: NRG; PAM sequence: TGG
gagatagggttttgccatgt

SEQ ID NO: 114314 - DNA, 20 bp, Artificial Sequence
  Description of Artificial Sequence: Synthetic oligonucleotide
  Target: ATXN1; (+) strand; PAM type: NRG; PAM sequence: CAG
tagggttttgccatgttggc

SEQ ID NO: 114315 - DNA, 20 bp, Artificial Sequence
  Description of Artificial Sequence: Synthetic oligonucleotide
  Target: ATXN1; (+) strand; PAM type: NRG; PAM sequence: AGG
agggttttgccatgttggcc

SEQ ID NO: 114316 - DNA, 20 bp, Artificial Sequence
  Description of Artificial Sequence: Synthetic oligonucleotide
  Target: ATXN1; (+) strand; PAM type: NRG; PAM sequence: TGG
ttttgccatgttggccaggc

SEQ ID NO: 114317 - DNA, 20 bp, Artificial Sequence
  Description of Artificial Sequence: Synthetic oligonucleotide
  Target: ATXN1; (+) strand; PAM type: NRG; PAM sequence: TGG
ccaggctggtctcaaactcc

SEQ ID NO: 114318 - DNA, 20 bp, Artificial Sequence
  Description of Artificial Sequence: Synthetic oligonucleotide
  Target: ATXN1; (+) strand; PAM type: NRG; PAM sequence: CAG
tggtctcaaactcctggcct

SEQ ID NO: 114319 - DNA, 20 bp, Artificial Sequence
  Description of Artificial Sequence: Synthetic oligonucleotide
  Target: ATXN1; (+) strand; PAM type: NRG; PAM sequence: AGG
ggtctcaaactcctggcctc

SEQ ID NO: 114320 - DNA, 20 bp, Artificial Sequence
  Description of Artificial Sequence: Synthetic oligonucleotide
  Target: ATXN1; (+) strand; PAM type: NRG; PAM sequence: CGG
ctcaggtgatccacccatct

SEQ ID NO: 114321 - DNA, 20 bp, Artificial Sequence
  Description of Artificial Sequence: Synthetic oligonucleotide
  Target: ATXN1; (+) strand; PAM type: NRG; PAM sequence: GAG
tctcggcctcccaaaatgct

SEQ ID NO: 114322 - DNA, 20 bp, Artificial Sequence
  Description of Artificial Sequence: Synthetic oligonucleotide
  Target: ATXN1; (+) strand; PAM type: NRG; PAM sequence: CAG
ctcccaaaatgctgagatta

SEQ ID NO: 114323 - DNA, 20 bp, Artificial Sequence
  Description of Artificial Sequence: Synthetic oligonucleotide
  Target: ATXN1; (+) strand; PAM type: NRG; PAM sequence: AGG
tcccaaaatgctgagattac

SEQ ID NO: 114324 - DNA, 20 bp, Artificial Sequence
  Description of Artificial Sequence: Synthetic oligonucleotide
  Target: ATXN1; (+) strand; PAM type: NRG; PAM sequence: GAG
aatgctgagattacaggtgt

SEQ ID NO: 114325 - DNA, 20 bp, Artificial Sequence
  Description of Artificial Sequence: Synthetic oligonucleotide
  Target: ATXN1; (+) strand; PAM type: NRG; PAM sequence: GAG
gattacaggtgtgagccact

SEQ ID NO: 114326 - DNA, 20 bp, Artificial Sequence
  Description of Artificial Sequence: Synthetic oligonucleotide
  Target: ATXN1; (+) strand; PAM type: NRG; PAM sequence: TGG
caggtgtgagccactgagcc

SEQ ID NO: 114327 - DNA, 20 bp, Artificial Sequence
  Description of Artificial Sequence: Synthetic oligonucleotide
  Target: ATXN1; (+) strand; PAM type: NRG; PAM sequence: TGG
tgtgagccactgagcctggc

SEQ ID NO: 114328 - DNA, 20 bp, Artificial Sequence
  Description of Artificial Sequence: Synthetic oligonucleotide
  Target: ATXN1; (+) strand; PAM type: NRG; PAM sequence: GAG
tgagccactgagcctggctg

SEQ ID NO: 114329 - DNA, 20 bp, Artificial Sequence
  Description of Artificial Sequence: Synthetic oligonucleotide
  Target: ATXN1; (+) strand; PAM type: NRG; PAM sequence: TAG
gctggagttttctcttatca

SEQ ID NO: 114330 - DNA, 20 bp, Artificial Sequence
  Description of Artificial Sequence: Synthetic oligonucleotide
  Target: ATXN1; (+) strand; PAM type: NRG; PAM sequence: AAG
ggagttttctcttatcatag

SEQ ID NO: 114331 - DNA, 20 bp, Artificial Sequence
  Description of Artificial Sequence: Synthetic oligonucleotide
  Target: ATXN1; (+) strand; PAM type: NRG; PAM sequence: GAG
gaagcattctgtgtttctat

SEQ ID NO: 114332 - DNA, 20 bp, Artificial Sequence
  Description of Artificial Sequence: Synthetic oligonucleotide
  Target: ATXN1; (+) strand; PAM type: NRG; PAM sequence: TAG
ttctgtgtttctatgagttt

SEQ ID NO: 114333 - DNA, 20 bp, Artificial Sequence
  Description of Artificial Sequence: Synthetic oligonucleotide
  Target: ATXN1; (+) strand; PAM type: NRG; PAM sequence: AGG
tctgtgtttctatgagtttt

SEQ ID NO: 114334 - DNA, 20 bp, Artificial Sequence
  Description of Artificial Sequence: Synthetic oligonucleotide
  Target: ATXN1; (+) strand; PAM type: NRG; PAM sequence: CAG
ttcgatccacataaaaaccg

SEQ ID NO: 114335 - DNA, 20 bp, Artificial Sequence
  Description of Artificial Sequence: Synthetic oligonucleotide
  Target: ATXN1; (+) strand; PAM type: NRG; PAM sequence: CAG
gatccacataaaaaccgcag

SEQ ID NO: 114336 - DNA, 20 bp, Artificial Sequence
  Description of Artificial Sequence: Synthetic oligonucleotide
  Target: ATXN1; (+) strand; PAM type: NRG; PAM sequence: AGG
atccacataaaaaccgcagc

SEQ ID NO: 114337 - DNA, 20 bp, Artificial Sequence
  Description of Artificial Sequence: Synthetic oligonucleotide
  Target: ATXN1; (+) strand; PAM type: NRG; PAM sequence: CGG
accacctccctcttgacaaa

SEQ ID NO: 114338 - DNA, 20 bp, Artificial Sequence
  Description of Artificial Sequence: Synthetic oligonucleotide
  Target: ATXN1; (+) strand; PAM type: NRG; PAM sequence: GGG
ccacctccctcttgacaaac

SEQ ID NO: 114339 - DNA, 20 bp, Artificial Sequence
  Description of Artificial Sequence: Synthetic oligonucleotide
  Target: ATXN1; (+) strand; PAM type: NRG; PAM sequence: GGG
cacctccctcttgacaaacg

SEQ ID NO: 114340 - DNA, 20 bp, Artificial Sequence
  Description of Artificial Sequence: Synthetic oligonucleotide
  Target: ATXN1; (+) strand; PAM type: NRG; PAM sequence: GGG
acctccctcttgacaaacgg

SEQ ID NO: 114341 - DNA, 20 bp, Artificial Sequence
  Description of Artificial Sequence: Synthetic oligonucleotide
  Target: ATXN1; (+) strand; PAM type: NRG; PAM sequence: TGG
cctcttgacaaacgggggca

SEQ ID NO: 114342 - DNA, 20 bp, Artificial Sequence
  Description of Artificial Sequence: Synthetic oligonucleotide
  Target: ATXN1; (+) strand; PAM type: NRG; PAM sequence: GAG
tcttgacaaacgggggcatg

SEQ ID NO: 114343 - DNA, 20 bp, Artificial Sequence
  Description of Artificial Sequence: Synthetic oligonucleotide
  Target: ATXN1; (+) strand; PAM type: NRG; PAM sequence: AGG
cttgacaaacgggggcatgg

SEQ ID NO: 114344 - DNA, 20 bp, Artificial Sequence
  Description of Artificial Sequence: Synthetic oligonucleotide
  Target: ATXN1; (+) strand; PAM type: NRG; PAM sequence: CAG
caaacgggggcatggaggca

SEQ ID NO: 114345 - DNA, 20 bp, Artificial Sequence
  Description of Artificial Sequence: Synthetic oligonucleotide
  Target: ATXN1; (+) strand; PAM type: NRG; PAM sequence: AGG
aaacgggggcatggaggcac

SEQ ID NO: 114346 - DNA, 20 bp, Artificial Sequence
  Description of Artificial Sequence: Synthetic oligonucleotide
  Target: ATXN1; (+) strand; PAM type: NRG; PAM sequence: CAG
cgggggcatggaggcacagg

SEQ ID NO: 114347 - DNA, 20 bp, Artificial Sequence
  Description of Artificial Sequence: Synthetic oligonucleotide
  Target: ATXN1; (+) strand; PAM type: NRG; PAM sequence: CAG
gcatggaggcacaggcagtt

SEQ ID NO: 114348 - DNA, 20 bp, Artificial Sequence
  Description of Artificial Sequence: Synthetic oligonucleotide
  Target: ATXN1; (+) strand; PAM type: NRG; PAM sequence: AAG
agttcagtgattcttttctg

SEQ ID NO: 114349 - DNA, 20 bp, Artificial Sequence
  Description of Artificial Sequence: Synthetic oligonucleotide
  Target: ATXN1; (+) strand; PAM type: NRG; PAM sequence: TGG
attcttttctgaagatcacg

SEQ ID NO: 114350 - DNA, 20 bp, Artificial Sequence
  Description of Artificial Sequence: Synthetic oligonucleotide
  Target: ATXN1; (+) strand; PAM type: NRG; PAM sequence: TGG
tgaagatcacgtggtgactg

SEQ ID NO: 114351 - DNA, 20 bp, Artificial Sequence
  Description of Artificial Sequence: Synthetic oligonucleotide
  Target: ATXN1; (+) strand; PAM type: NRG; PAM sequence: GGG
gaagatcacgtggtgactgt

SEQ ID NO: 114352 - DNA, 20 bp, Artificial Sequence
  Description of Artificial Sequence: Synthetic oligonucleotide
  Target: ATXN1; (+) strand; PAM type: NRG; PAM sequence: TGG
cacgtggtgactgtgggacg

SEQ ID NO: 114353 - DNA, 20 bp, Artificial Sequence
  Description of Artificial Sequence: Synthetic oligonucleotide
  Target: ATXN1; (+) strand; PAM type: NRG; PAM sequence: GAG
cgtggtgactgtgggacgtg

SEQ ID NO: 114354 - DNA, 20 bp, Artificial Sequence
  Description of Artificial Sequence: Synthetic oligonucleotide
  Target: ATXN1; (+) strand; PAM type: NRG; PAM sequence: AAG
gggacgtggagctcaaaccc

SEQ ID NO: 114355 - DNA, 20 bp, Artificial Sequence
  Description of Artificial Sequence: Synthetic oligonucleotide
  Target: ATXN1; (+) strand; PAM type: NRG; PAM sequence: TGG
ggagctcaaacccaagtctg

SEQ ID NO: 114356 - DNA, 20 bp, Artificial Sequence
  Description of Artificial Sequence: Synthetic oligonucleotide
  Target: ATXN1; (+) strand; PAM type: NRG; PAM sequence: TAG
aacccaagtctgtggattcc

SEQ ID NO: 114357 - DNA, 20 bp, Artificial Sequence
  Description of Artificial Sequence: Synthetic oligonucleotide
  Target: ATXN1; (+) strand; PAM type: NRG; PAM sequence: TGG
caagtctgtggattcctagc

SEQ ID NO: 114358 - DNA, 20 bp, Artificial Sequence
  Description of Artificial Sequence: Synthetic oligonucleotide
  Target: ATXN1; (+) strand; PAM type: NRG; PAM sequence: GAG
agtctgtggattcctagctg

SEQ ID NO: 114359 - DNA, 20 bp, Artificial Sequence
  Description of Artificial Sequence: Synthetic oligonucleotide
  Target: ATXN1; (+) strand; PAM type: NRG; PAM sequence: AGG
gtctgtggattcctagctgg

SEQ ID NO: 114360 - DNA, 20 bp, Artificial Sequence
  Description of Artificial Sequence: Synthetic oligonucleotide
  Target: ATXN1; (+) strand; PAM type: NRG; PAM sequence: AAG
ttctaccacatcacattttt

SEQ ID NO: 114361 - DNA, 20 bp, Artificial Sequence
  Description of Artificial Sequence: Synthetic oligonucleotide
  Target: ATXN1; (+) strand; PAM type: NRG; PAM sequence: AAG
tttaagtacacgtgcctgaa

SEQ ID NO: 114362 - DNA, 20 bp, Artificial Sequence
  Description of Artificial Sequence: Synthetic oligonucleotide
  Target: ATXN1; (+) strand; PAM type: NRG; PAM sequence: CAG
tgcctgaaaagcttgccact

SEQ ID NO: 114363 - DNA, 20 bp, Artificial Sequence
  Description of Artificial Sequence: Synthetic oligonucleotide
  Target: ATXN1; (+) strand; PAM type: NRG; PAM sequence: AGG
gcctgaaaagcttgccactc

SEQ ID NO: 114364 - DNA, 20 bp, Artificial Sequence
  Description of Artificial Sequence: Synthetic oligonucleotide
  Target: ATXN1; (+) strand; PAM type: NRG; PAM sequence: AAG
cactcaggcaaaatcacaat

SEQ ID NO: 114365 - DNA, 20 bp, Artificial Sequence
  Description of Artificial Sequence: Synthetic oligonucleotide
  Target: ATXN1; (+) strand; PAM type: NRG; PAM sequence: CAG
ggcaaaatcacaataagact

SEQ ID NO: 114366 - DNA, 20 bp, Artificial Sequence
  Description of Artificial Sequence: Synthetic oligonucleotide
  Target: ATXN1; (+) strand; PAM type: NRG; PAM sequence: AAG
caataagactcagaatccgt

SEQ ID NO: 114367 - DNA, 20 bp, Artificial Sequence
  Description of Artificial Sequence: Synthetic oligonucleotide
  Target: ATXN1; (+) strand; PAM type: NRG; PAM sequence: TGG
cgtaagcgactaaatttgcc

SEQ ID NO: 114368 - DNA, 20 bp, Artificial Sequence
  Description of Artificial Sequence: Synthetic oligonucleotide
  Target: ATXN1; (+) strand; PAM type: NRG; PAM sequence: GAG
taagcgactaaatttgcctg

SEQ ID NO: 114369 - DNA, 20 bp, Artificial Sequence
  Description of Artificial Sequence: Synthetic oligonucleotide
  Target: ATXN1; (+) strand; PAM type: NRG; PAM sequence: TGG
ctggagtgacattatttttg

SEQ ID NO: 114370 - DNA, 20 bp, Artificial Sequence
  Description of Artificial Sequence: Synthetic oligonucleotide
  Target: ATXN1; (+) strand; PAM type: NRG; PAM sequence: CGG
gagtgacattatttttgtgg

SEQ ID NO: 114371 - DNA, 20 bp, Artificial Sequence
  Description of Artificial Sequence: Synthetic oligonucleotide
  Target: ATXN1; (+) strand; PAM type: NRG; PAM sequence: GGG
agtgacattatttttgtggc

SEQ ID NO: 114372 - DNA, 20 bp, Artificial Sequence
  Description of Artificial Sequence: Synthetic oligonucleotide
  Target: ATXN1; (+) strand; PAM type: NRG; PAM sequence: GAG
ttatttttgtggcgggtgtt

SEQ ID NO: 114373 - DNA, 20 bp, Artificial Sequence
  Description of Artificial Sequence: Synthetic oligonucleotide
  Target: ATXN1; (+) strand; PAM type: NRG; PAM sequence: GAG
ttgtggcgggtgttgagact

SEQ ID NO: 114374 - DNA, 20 bp, Artificial Sequence
  Description of Artificial Sequence: Synthetic oligonucleotide
  Target: ATXN1; (+) strand; PAM type: NRG; PAM sequence: TAG
gcgggtgttgagactgagaa

SEQ ID NO: 114375 - DNA, 20 bp, Artificial Sequence
  Description of Artificial Sequence: Synthetic oligonucleotide
  Target: ATXN1; (+) strand; PAM type: NRG; PAM sequence: GAG
gggtgttgagactgagaata

SEQ ID NO: 114376 - DNA, 20 bp, Artificial Sequence
  Description of Artificial Sequence: Synthetic oligonucleotide
  Target: ATXN1; (+) strand; PAM type: NRG; PAM sequence: TAG
ctgagaatagagttaaatgt

SEQ ID NO: 114377 - DNA, 20 bp, Artificial Sequence
  Description of Artificial Sequence: Synthetic oligonucleotide
  Target: ATXN1; (+) strand; PAM type: NRG; PAM sequence: AGG
tgagaatagagttaaatgtt

SEQ ID NO: 114378 - DNA, 20 bp, Artificial Sequence
  Description of Artificial Sequence: Synthetic oligonucleotide
  Target: ATXN1; (+) strand; PAM type: NRG; PAM sequence: AAG
atgttaggaaaaaaattctg

SEQ ID NO: 114379 - DNA, 20 bp, Artificial Sequence
  Description of Artificial Sequence: Synthetic oligonucleotide
  Target: ATXN1; (+) strand; PAM type: NRG; PAM sequence: TGG
aagtttactgatacattgct

SEQ ID NO: 114380 - DNA, 20 bp, Artificial Sequence
  Description of Artificial Sequence: Synthetic oligonucleotide
  Target: ATXN1; (+) strand; PAM type: NRG; PAM sequence: AAG
gatacattgcttggacccca

SEQ ID NO: 114381 - DNA, 20 bp, Artificial Sequence
  Description of Artificial Sequence: Synthetic oligonucleotide
  Target: ATXN1; (+) strand; PAM type: NRG; PAM sequence: TAG
cccaaagtccctgcactcct

SEQ ID NO: 114382 - DNA, 20 bp, Artificial Sequence
  Description of Artificial Sequence: Synthetic oligonucleotide
  Target: ATXN1; (+) strand; PAM type: NRG; PAM sequence: AAG
agtccctgcactccttagac

SEQ ID NO: 114383 - DNA, 20 bp, Artificial Sequence
  Description of Artificial Sequence: Synthetic oligonucleotide
  Target: ATXN1; (+) strand; PAM type: NRG; PAM sequence: TGG
tgcactccttagacaagtgt

SEQ ID NO: 114384 - DNA, 20 bp, Artificial Sequence
  Description of Artificial Sequence: Synthetic oligonucleotide
  Target: ATXN1; (+) strand; PAM type: NRG; PAM sequence: GAG
cactccttagacaagtgttg

SEQ ID NO: 114385 - DNA, 20 bp, Artificial Sequence
  Description of Artificial Sequence: Synthetic oligonucleotide
  Target: ATXN1; (+) strand; PAM type: NRG; PAM sequence: AGG
actccttagacaagtgttgg

SEQ ID NO: 114386 - DNA, 20 bp, Artificial Sequence
  Description of Artificial Sequence: Synthetic oligonucleotide
  Target: ATXN1; (+) strand; PAM type: NRG; PAM sequence: GGG
ctccttagacaagtgttgga

SEQ ID NO: 114387 - DNA, 20 bp, Artificial Sequence
  Description of Artificial Sequence: Synthetic oligonucleotide
  Target: ATXN1; (+) strand; PAM type: NRG; PAM sequence: CGG
agacaagtgttggagggaaa

SEQ ID NO: 114388 - DNA, 20 bp, Artificial Sequence
  Description of Artificial Sequence: Synthetic oligonucleotide
  Target: ATXN1; (+) strand; PAM type: NRG; PAM sequence: CAG
ttggagggaaacggccacat

SEQ ID NO: 114389 - DNA, 20 bp, Artificial Sequence
  Description of Artificial Sequence: Synthetic oligonucleotide
  Target: ATXN1; (+) strand; PAM type: NRG; PAM sequence: AGG
tggagggaaacggccacatc

SEQ ID NO: 114390 - DNA, 20 bp, Artificial Sequence
  Description of Artificial Sequence: Synthetic oligonucleotide
  Target: ATXN1; (+) strand; PAM type: NRG; PAM sequence: GGG
ggagggaaacggccacatca

SEQ ID NO: 114391 - DNA, 20 bp, Artificial Sequence
  Description of Artificial Sequence: Synthetic oligonucleotide
  Target: ATXN1; (+) strand; PAM type: NRG; PAM sequence: GGG
gagggaaacggccacatcag

SEQ ID NO: 114392 - DNA, 20 bp, Artificial Sequence
  Description of Artificial Sequence: Synthetic oligonucleotide
  Target: ATXN1; (+) strand; PAM type: NRG; PAM sequence: AAG
aaacggccacatcaggggtg

SEQ ID NO: 114393 - DNA, 20 bp, Artificial Sequence
  Description of Artificial Sequence: Synthetic oligonucleotide
  Target: ATXN1; (+) strand; PAM type: NRG; PAM sequence: TGG
cggccacatcaggggtgaag

SEQ ID NO: 114394 - DNA, 20 bp, Artificial Sequence
  Description of Artificial Sequence: Synthetic oligonucleotide
  Target: ATXN1; (+) strand; PAM type: NRG; PAM sequence: TAG
gtgaagtggcatttatccac

SEQ ID NO: 114395 - DNA, 20 bp, Artificial Sequence
  Description of Artificial Sequence: Synthetic oligonucleotide
  Target: ATXN1; (+) strand; PAM type: NRG; PAM sequence: AAG
tttatccactagtatactcc

SEQ ID NO: 114396 - DNA, 20 bp, Artificial Sequence
  Description of Artificial Sequence: Synthetic oligonucleotide
  Target: ATXN1; (+) strand; PAM type: NRG; PAM sequence: GAG
agtatactccaagatgtcgc

SEQ ID NO: 114397 - DNA, 20 bp, Artificial Sequence
  Description of Artificial Sequence: Synthetic oligonucleotide
  Target: ATXN1; (+) strand; PAM type: NRG; PAM sequence: TGG
aatcccccacatctctgatt

SEQ ID NO: 114398 - DNA, 20 bp, Artificial Sequence
  Description of Artificial Sequence: Synthetic oligonucleotide
  Target: ATXN1; (+) strand; PAM type: NRG; PAM sequence: CAG
acatctctgatttggtcttc

SEQ ID NO: 114399 - DNA, 20 bp, Artificial Sequence
  Description of Artificial Sequence: Synthetic oligonucleotide
  Target: ATXN1; (+) strand; PAM type: NRG; PAM sequence: TGG
tttggtcttccagcaactat

SEQ ID NO: 114400 - DNA, 20 bp, Artificial Sequence
  Description of Artificial Sequence: Synthetic oligonucleotide
  Target: ATXN1; (+) strand; PAM type: NRG; PAM sequence: AAG
cttccagcaactattggaat

SEQ ID NO: 114401 - DNA, 20 bp, Artificial Sequence
  Description of Artificial Sequence: Synthetic oligonucleotide
  Target: ATXN1; (+) strand; PAM type: NRG; PAM sequence: AGG
ttccagcaactattggaata

SEQ ID NO: 114402 - DNA, 20 bp, Artificial Sequence
  Description of Artificial Sequence: Synthetic oligonucleotide
  Target: ATXN1; (+) strand; PAM type: NRG; PAM sequence: AAG
atttgtgcaacaacaatgaa

SEQ ID NO: 114403 - DNA, 20 bp, Artificial Sequence
  Description of Artificial Sequence: Synthetic oligonucleotide
  Target: ATXN1; (+) strand; PAM type: NRG; PAM sequence: AAG
tgtgcaacaacaatgaaaag

SEQ ID NO: 114404 - DNA, 20 bp, Artificial Sequence
  Description of Artificial Sequence: Synthetic oligonucleotide
  Target: ATXN1; (+) strand; PAM type: NRG; PAM sequence: AGG
gtgcaacaacaatgaaaaga

SEQ ID NO: 114405 - DNA, 20 bp, Artificial Sequence
  Description of Artificial Sequence: Synthetic oligonucleotide
  Target: ATXN1; (+) strand; PAM type: NRG; PAM sequence: CAG
caacaacaatgaaaagaagg

SEQ ID NO: 114406 - DNA, 20 bp, Artificial Sequence
  Description of Artificial Sequence: Synthetic oligonucleotide
  Target: ATXN1; (+) strand; PAM type: NRG; PAM sequence: AGG
aacaacaatgaaaagaaggc

SEQ ID NO: 114407 - DNA, 20 bp, Artificial Sequence
  Description of Artificial Sequence: Synthetic oligonucleotide
  Target: ATXN1; (+) strand; PAM type: NRG; PAM sequence: AAG
acaatgaaaagaaggcagga

SEQ ID NO: 114408 - DNA, 20 bp, Artificial Sequence
  Description of Artificial Sequence: Synthetic oligonucleotide
  Target: ATXN1; (+) strand; PAM type: NRG; PAM sequence: GAG
aatgaaaagaaggcaggaaa

SEQ ID NO: 114409 - DNA, 20 bp, Artificial Sequence
  Description of Artificial Sequence: Synthetic oligonucleotide
  Target: ATXN1; (+) strand; PAM type: NRG; PAM sequence: AGG
atgaaaagaaggcaggaaag

SEQ ID NO: 114410 - DNA, 20 bp, Artificial Sequence
  Description of Artificial Sequence: Synthetic oligonucleotide
  Target: ATXN1; (+) strand; PAM type: NRG; PAM sequence: GGG
tgaaaagaaggcaggaaaga

SEQ ID NO: 114411 - DNA, 20 bp, Artificial Sequence
  Description of Artificial Sequence: Synthetic oligonucleotide
  Target: ATXN1; (+) strand; PAM type: NRG; PAM sequence: AAG
aaagaaggcaggaaagaggg

SEQ ID NO: 114412 - DNA, 20 bp, Artificial Sequence
  Description of Artificial Sequence: Synthetic oligonucleotide
  Target: ATXN1; (+) strand; PAM type: NRG; PAM sequence: AGG
aagaaggcaggaaagaggga

SEQ ID NO: 114413 - DNA, 20 bp, Artificial Sequence
  Description of Artificial Sequence: Synthetic oligonucleotide
  Target: ATXN1; (+) strand; PAM type: NRG; PAM sequence: AAG
aaggcaggaaagagggaagg

SEQ ID NO: 114414 - DNA, 20 bp, Artificial Sequence
  Description of Artificial Sequence: Synthetic oligonucleotide
  Target: ATXN1; (+) strand; PAM type: NRG; PAM sequence: AGG
aggcaggaaagagggaagga

SEQ ID NO: 114415 - DNA, 20 bp, Artificial Sequence
  Description of Artificial Sequence: Synthetic oligonucleotide
  Target: ATXN1; (+) strand; PAM type: NRG; PAM sequence: TAG
aggaaagagggaaggaagga

SEQ ID NO: 114416 - DNA, 20 bp, Artificial Sequence
  Description of Artificial Sequence: Synthetic oligonucleotide
  Target: ATXN1; (+) strand; PAM type: NRG; PAM sequence: AGG
ggaaagagggaaggaaggat

SEQ ID NO: 114417 - DNA, 20 bp, Artificial Sequence
  Description of Artificial Sequence: Synthetic oligonucleotide
  Target: ATXN1; (+) strand; PAM type: NRG; PAM sequence: AAG
aaggataggaaaaaaaaaaa

SEQ ID NO: 114418 - DNA, 20 bp, Artificial Sequence
  Description of Artificial Sequence: Synthetic oligonucleotide
  Target: ATXN1; (+) strand; PAM type: NRG; PAM sequence: AAG
ataggaaaaaaaaaaaaaga

SEQ ID NO: 114419 - DNA, 20 bp, Artificial Sequence
  Description of Artificial Sequence: Synthetic oligonucleotide
  Target: ATXN1; (+) strand; PAM type: NRG; PAM sequence: AGG
taggaaaaaaaaaaaaagaa

SEQ ID NO: 114420 - DNA, 20 bp, Artificial Sequence
  Description of Artificial Sequence: Synthetic oligonucleotide
  Target: ATXN1; (+) strand; PAM type: NRG; PAM sequence: GGG
aggaaaaaaaaaaaaagaaa

SEQ ID NO: 114421 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaagaaaggga

SEQ ID NO: 114422 - DNA, 20 bp, Artificial Sequence
  Description of Artificial Sequence: Synthetic oligonucleotide
  Target: ATXN1; (+) strand; PAM type: NRG; PAM sequence: AAG
aaaaaagaaagggaaagaaa

SEQ ID NO: 114423 - DNA, 20 bp, Artificial Sequence
  Description of Artificial Sequence: Synthetic oligonucleotide
  Target: ATXN1; (+) strand; PAM type: NRG; PAM sequence: TAG
gaacaccgtactgcgaccac

SEQ ID NO: 114424 - DNA, 20 bp, Artificial Sequence
  Description of Artificial Sequence: Synthetic oligonucleotide
  Target: ATXN1; (+) strand; PAM type: NRG; PAM sequence: CAG
ctgcgaccactagttattaa

SEQ ID NO: 114425 - DNA, 20 bp, Artificial Sequence
  Description of Artificial Sequence: Synthetic oligonucleotide
  Target: ATXN1; (+) strand; PAM type: NRG; PAM sequence: CAG
accactagttattaacagcc

SEQ ID NO: 114426 - DNA, 20 bp, Artificial Sequence
  Description of Artificial Sequence: Synthetic oligonucleotide
  Target: ATXN1; (+) strand; PAM type: NRG; PAM sequence: TGG
gttattaacagcccagcctg

SEQ ID NO: 114427 - DNA, 20 bp, Artificial Sequence
  Description of Artificial Sequence: Synthetic oligonucleotide
  Target: ATXN1; (+) strand; PAM type: NRG; PAM sequence: AAG
agcccagcctgtggtacaca

SEQ ID NO: 114428 - DNA, 20 bp, Artificial Sequence
  Description of Artificial Sequence: Synthetic oligonucleotide
  Target: ATXN1; (+) strand; PAM type: NRG; PAM sequence: CAG
cctgtggtacacaaagctga

SEQ ID NO: 114429 - DNA, 20 bp, Artificial Sequence
  Description of Artificial Sequence: Synthetic oligonucleotide
  Target: ATXN1; (+) strand; PAM type: NRG; PAM sequence: GAG
acaaagctgacagttattat

SEQ ID NO: 114430 - DNA, 20 bp, Artificial Sequence
  Description of Artificial Sequence: Synthetic oligonucleotide
  Target: ATXN1; (+) strand; PAM type: NRG; PAM sequence: TAG
tgacagttattatgagtaat

SEQ ID NO: 114431 - DNA, 20 bp, Artificial Sequence
  Description of Artificial Sequence: Synthetic oligonucleotide
  Target: ATXN1; (+) strand; PAM type: NRG; PAM sequence: AAG
tattatgagtaattagcaca

SEQ ID NO: 114432 - DNA, 20 bp, Artificial Sequence
  Description of Artificial Sequence: Synthetic oligonucleotide
  Target: ATXN1; (+) strand; PAM type: NRG; PAM sequence: AGG
attatgagtaattagcacaa

SEQ ID NO: 114433 - DNA, 20 bp, Artificial Sequence
  Description of Artificial Sequence: Synthetic oligonucleotide
  Target: ATXN1; (+) strand; PAM type: NRG; PAM sequence: AAG
atgagtaattagcacaaagg

SEQ ID NO: 114434 - DNA, 20 bp, Artificial Sequence
  Description of Artificial Sequence: Synthetic oligonucleotide
  Target: ATXN1; (+) strand; PAM type: NRG; PAM sequence: AGG
tgagtaattagcacaaagga

SEQ ID NO: 114435 - DNA, 20 bp, Artificial Sequence
  Description of Artificial Sequence: Synthetic oligonucleotide
  Target: ATXN1; (+) strand; PAM type: NRG; PAM sequence: CAG
ttctgtatacacactatttc

SEQ ID NO: 114436 - DNA, 20 bp, Artificial Sequence
  Description of Artificial Sequence: Synthetic oligonucleotide
  Target: ATXN1; (+) strand; PAM type: NRG; PAM sequence: AAG
tccagacatgtttttgaaac

SEQ ID NO: 114437 - DNA, 20 bp, Artificial Sequence
  Description of Artificial Sequence: Synthetic oligonucleotide
  Target: ATXN1; (+) strand; PAM type: NRG; PAM sequence: AGG
ccagacatgtttttgaaaca

SEQ ID NO: 114438 - DNA, 20 bp, Artificial Sequence
  Description of Artificial Sequence: Synthetic oligonucleotide
  Target: ATXN1; (+) strand; PAM type: NRG; PAM sequence: GGG
cagacatgtttttgaaacaa

SEQ ID NO: 114439 - DNA, 20 bp, Artificial Sequence
  Description of Artificial Sequence: Synthetic oligonucleotide
  Target: ATXN1; (+) strand; PAM type: NRG; PAM sequence: CAG
gttgtatgttgttacttaca

SEQ ID NO: 114440 - DNA, 20 bp, Artificial Sequence
  Description of Artificial Sequence: Synthetic oligonucleotide
  Target: ATXN1; (+) strand; PAM type: NRG; PAM sequence: TGG
gttccatgattttttgcata

SEQ ID NO: 114441 - DNA, 20 bp, Artificial Sequence
  Description of Artificial Sequence: Synthetic oligonucleotide
  Target: ATXN1; (+) strand; PAM type: NRG; PAM sequence: CAG
atgattttttgcatatggct

SEQ ID NO: 114442 - DNA, 20 bp, Artificial Sequence
  Description of Artificial Sequence: Synthetic oligonucleotide
  Target: ATXN1; (+) strand; PAM type: NRG; PAM sequence: AAG
ttttgcatatggctcagcca

SEQ ID NO: 114443 - DNA, 20 bp, Artificial Sequence
  Description of Artificial Sequence: Synthetic oligonucleotide
  Target: ATXN1; (+) strand; PAM type: NRG; PAM sequence: AAG
gcatatggctcagccaaaga

SEQ ID NO: 114444 - DNA, 20 bp, Artificial Sequence
  Description of Artificial Sequence: Synthetic oligonucleotide
  Target: ATXN1; (+) strand; PAM type: NRG; PAM sequence: TGG
gctttttccccttccatttt

SEQ ID NO: 114445 - DNA, 20 bp, Artificial Sequence
  Description of Artificial Sequence: Synthetic oligonucleotide
  Target: ATXN1; (+) strand; PAM type: NRG; PAM sequence: GGG
ctttttccccttccattttt

SEQ ID NO: 114446 - DNA, 20 bp, Artificial Sequence
  Description of Artificial Sequence: Synthetic oligonucleotide
  Target: ATXN1; (+) strand; PAM type: NRG; PAM sequence: AAG
ttccccttccatttttggga

SEQ ID NO: 114447 - DNA, 20 bp, Artificial Sequence
  Description of Artificial Sequence: Synthetic oligonucleotide
  Target: ATXN1; (+) strand; PAM type: NRG; PAM sequence: AAG
aaagatgcaactgactgtgt

SEQ ID NO: 114448 - DNA, 20 bp, Artificial Sequence
  Description of Artificial Sequence: Synthetic oligonucleotide
  Target: ATXN1; (+) strand; PAM type: NRG; PAM sequence: AGG
aagatgcaactgactgtgta

SEQ ID NO: 114449 - DNA, 20 bp, Artificial Sequence
  Description of Artificial Sequence: Synthetic oligonucleotide
  Target: ATXN1; (+) strand; PAM type: NRG; PAM sequence: GGG
agatgcaactgactgtgtaa

SEQ ID NO: 114450 - DNA, 20 bp, Artificial Sequence
  Description of Artificial Sequence: Synthetic oligonucleotide
  Target: ATXN1; (+) strand; PAM type: NRG; PAM sequence: GAG
atgcaactgactgtgtaagg

SEQ ID NO: 114451 - DNA, 20 bp, Artificial Sequence
  Description of Artificial Sequence: Synthetic oligonucleotide
  Target: ATXN1; (+) strand; PAM type: NRG; PAM sequence: GAG
gcaactgactgtgtaaggga

SEQ ID NO: 114452 - DNA, 20 bp, Artificial Sequence
  Description of Artificial Sequence: Synthetic oligonucleotide
  Target: ATXN1; (+) strand; PAM type: NRG; PAM sequence: AGG
caactgactgtgtaagggag

SEQ ID NO: 114453 - DNA, 20 bp, Artificial Sequence
  Description of Artificial Sequence: Synthetic oligonucleotide
  Target: ATXN1; (+) strand; PAM type: NRG; PAM sequence: GAG
actgactgtgtaagggagag

SEQ ID NO: 114454 - DNA, 20 bp, Artificial Sequence
  Description of Artificial Sequence: Synthetic oligonucleotide
  Target: ATXN1; (+) strand; PAM type: NRG; PAM sequence: TAG
gtaagggagaggagaatgtc

SEQ ID NO: 114455 - DNA, 20 bp, Artificial Sequence
  Description of Artificial Sequence: Synthetic oligonucleotide
  Target: ATXN1; (+) strand; PAM type: NRG; PAM sequence: TGG
tagtttttacataatgtcta

SEQ ID NO: 114456 - DNA, 20 bp, Artificial Sequence
  Description of Artificial Sequence: Synthetic oligonucleotide
  Target: ATXN1; (+) strand; PAM type: NRG; PAM sequence: TAG
cataatgtctatggcgatga

SEQ ID NO: 114457 - DNA, 20 bp, Artificial Sequence
  Description of Artificial Sequence: Synthetic oligonucleotide
  Target: ATXN1; (+) strand; PAM type: NRG; PAM sequence: AGG
ataatgtctatggcgatgat

SEQ ID NO: 114458 - DNA, 20 bp, Artificial Sequence
  Description of Artificial Sequence: Synthetic oligonucleotide
  Target: ATXN1; (+) strand; PAM type: NRG; PAM sequence: GGG
taatgtctatggcgatgata

SEQ ID NO: 114459 - DNA, 20 bp, Artificial Sequence
  Description of Artificial Sequence: Synthetic oligonucleotide
  Target: ATXN1; (+) strand; PAM type: NRG; PAM sequence: GGG
aatgtctatggcgatgatag

SEQ ID NO: 114460 - DNA, 20 bp, Artificial Sequence
  Description of Artificial Sequence: Synthetic oligonucleotide
  Target: ATXN1; (+) strand; PAM type: NRG; PAM sequence: CAG
ctatggcgatgataggggtg

SEQ ID NO: 114461 - DNA, 20 bp, Artificial Sequence
  Description of Artificial Sequence: Synthetic oligonucleotide
  Target: ATXN1; (+) strand; PAM type: NRG; PAM sequence: TGG
tggcgatgataggggtgcag

SEQ ID NO: 114462 - DNA, 20 bp, Artificial Sequence
  Description of Artificial Sequence: Synthetic oligonucleotide
  Target: ATXN1; (+) strand; PAM type: NRG; PAM sequence: TGG
gatgataggggtgcagtggc

SEQ ID NO: 114463 - DNA, 20 bp, Artificial Sequence
  Description of Artificial Sequence: Synthetic oligonucleotide
  Target: ATXN1; (+) strand; PAM type: NRG; PAM sequence: TGG
ggtgcagtggctggtgctgc

SEQ ID NO: 114464 - DNA, 20 bp, Artificial Sequence
  Description of Artificial Sequence: Synthetic oligonucleotide
  Target: ATXN1; (+) strand; PAM type: NRG; PAM sequence: TAG
tgtgtgtgtgtatgtgtgtg

SEQ ID NO: 114465 - DNA, 20 bp, Artificial Sequence
  Description of Artificial Sequence: Synthetic oligonucleotide
  Target: ATXN1; (+) strand; PAM type: NRG; PAM sequence: AAG
gtgtatgtgtgtgtagtaac

SEQ ID NO: 114466 - DNA, 20 bp, Artificial Sequence
  Description of Artificial Sequence: Synthetic oligonucleotide
  Target: ATXN1; (+) strand; PAM type: NRG; PAM sequence: GAG
ttcatctaactctcttgact

SEQ ID NO: 114467 - DNA, 20 bp, Artificial Sequence
  Description of Artificial Sequence: Synthetic oligonucleotide
  Target: ATXN1; (+) strand; PAM type: NRG; PAM sequence: TGG
tcttgactgagtcattccta

SEQ ID NO: 114468 - DNA, 20 bp, Artificial Sequence
  Description of Artificial Sequence: Synthetic oligonucleotide
  Target: ATXN1; (+) strand; PAM type: NRG; PAM sequence: GGG
cttgactgagtcattcctat

SEQ ID NO: 114469 - DNA, 20 bp, Artificial Sequence
  Description of Artificial Sequence: Synthetic oligonucleotide
  Target: ATXN1; (+) strand; PAM type: NRG; PAM sequence: TAG
ctgagtcattcctatgggat

SEQ ID NO: 114470 - DNA, 20 bp, Artificial Sequence
  Description of Artificial Sequence: Synthetic oligonucleotide
  Target: ATXN1; (+) strand; PAM type: NRG; PAM sequence: AGG
tgagtcattcctatgggatt

SEQ ID NO: 114471 - DNA, 20 bp, Artificial Sequence
  Description of Artificial Sequence: Synthetic oligonucleotide
  Target: ATXN1; (+) strand; PAM type: NRG; PAM sequence: GGG
gagtcattcctatgggatta

SEQ ID NO: 114472 - DNA, 20 bp, Artificial Sequence
  Description of Artificial Sequence: Synthetic oligonucleotide
  Target: ATXN1; (+) strand; PAM type: NRG; PAM sequence: GAG
gtcattcctatgggattagg

SEQ ID NO: 114473 - DNA, 20 bp, Artificial Sequence
  Description of Artificial Sequence: Synthetic oligonucleotide
  Target: ATXN1; (+) strand; PAM type: NRG; PAM sequence: AAG
agggagtactgcgtacatcc

SEQ ID NO: 114474 - DNA, 20 bp, Artificial Sequence
  Description of Artificial Sequence: Synthetic oligonucleotide
  Target: ATXN1; (+) strand; PAM type: NRG; PAM sequence: AGG
gggagtactgcgtacatcca

SEQ ID NO: 114475 - DNA, 20 bp, Artificial Sequence
  Description of Artificial Sequence: Synthetic oligonucleotide
  Target: ATXN1; (+) strand; PAM type: NRG; PAM sequence: TGG
ctgcgtacatccaaggttcg

SEQ ID NO: 114476 - DNA, 20 bp, Artificial Sequence
  Description of Artificial Sequence: Synthetic oligonucleotide
  Target: ATXN1; (+) strand; PAM type: NRG; PAM sequence: GAG
caaggttcgtggtgtttgct

SEQ ID NO: 114477 - DNA, 20 bp, Artificial Sequence
  Description of Artificial Sequence: Synthetic oligonucleotide
  Target: ATXN1; (+) strand; PAM type: NRG; PAM sequence: AAG
ctgagataacacattatcaa

SEQ ID NO: 114478 - DNA, 20 bp, Artificial Sequence
  Description of Artificial Sequence: Synthetic oligonucleotide
  Target: ATXN1; (+) strand; PAM type: NRG; PAM sequence: AAG
ttatcaaaagcctctctaaa

SEQ ID NO: 114479 - DNA, 20 bp, Artificial Sequence
  Description of Artificial Sequence: Synthetic oligonucleotide
  Target: ATXN1; (+) strand; PAM type: NRG; PAM sequence: AGG
tatcaaaagcctctctaaaa

SEQ ID NO: 114480 - DNA, 20 bp, Artificial Sequence
  Description of Artificial Sequence: Synthetic oligonucleotide
  Target: ATXN1; (+) strand; PAM type: NRG; PAM sequence: GGG
atcaaaagcctctctaaaaa

SEQ ID NO: 114481 - DNA, 20 bp, Artificial Sequence
  Description of Artificial Sequence: Synthetic oligonucleotide
  Target: ATXN1; (+) strand; PAM type: NRG; PAM sequence: CAG
taaaaagggttgaatattta

SEQ ID NO: 114482 - DNA, 20 bp, Artificial Sequence
  Description of Artificial Sequence: Synthetic oligonucleotide
  Target: ATXN1; (+) strand; PAM type: NRG; PAM sequence: AAG
aaagggttgaatatttacag

SEQ ID NO: 114483 - DNA, 20 bp, Artificial Sequence
  Description of Artificial Sequence: Synthetic oligonucleotide
  Target: ATXN1; (+) strand; PAM type: NRG; PAM sequence: AAG
tgaatatttacagaagaaaa

SEQ ID NO: 114484 - DNA, 20 bp, Artificial Sequence
  Description of Artificial Sequence: Synthetic oligonucleotide
  Target: ATXN1; (+) strand; PAM type: NRG; PAM sequence: GAG
aatatttacagaagaaaaaa

SEQ ID NO: 114485 - DNA, 20 bp, Artificial Sequence
  Description of Artificial Sequence: Synthetic oligonucleotide
  Target: ATXN1; (+) strand; PAM type: NRG; PAM sequence: AGG
atatttacagaagaaaaaag

SEQ ID NO: 114486 - DNA, 20 bp, Artificial Sequence
  Description of Artificial Sequence: Synthetic oligonucleotide
  Target: ATXN1; (+) strand; PAM type: NRG; PAM sequence: CGG
tttacagaagaaaaaagagg

SEQ ID NO: 114487 - DNA, 20 bp, Artificial Sequence
  Description of Artificial Sequence: Synthetic oligonucleotide
  Target: ATXN1; (+) strand; PAM type: NRG; PAM sequence: GGG
ttacagaagaaaaaagaggc

SEQ ID NO: 114488 - DNA, 20 bp, Artificial Sequence
  Description of Artificial Sequence: Synthetic oligonucleotide
  Target: ATXN1; (+) strand; PAM type: NRG; PAM sequence: GAG
acagaagaaaaaagaggcgg

SEQ ID NO: 114489 - DNA, 20 bp, Artificial Sequence
  Description of Artificial Sequence: Synthetic oligonucleotide
  Target: ATXN1; (+) strand; PAM type: NRG; PAM sequence: GAG
ggagaaatgtgaatgcattt

SEQ ID NO: 114490 - DNA, 20 bp, Artificial Sequence
  Description of Artificial Sequence: Synthetic oligonucleotide
  Target: ATXN1; (+) strand; PAM type: NRG; PAM sequence: TGG
atttttttgttgttctttct

SEQ ID NO: 114491 - DNA, 20 bp, Artificial Sequence
  Description of Artificial Sequence: Synthetic oligonucleotide
  Target: ATXN1; (+) strand; PAM type: NRG; PAM sequence: CAG
tttttgttgttctttcttgg

SEQ ID NO: 114492 - DNA, 20 bp, Artificial Sequence
  Description of Artificial Sequence: Synthetic oligonucleotide
  Target: ATXN1; (+) strand; PAM type: NRG; PAM sequence: CAG
gcagtctttacaactgacaa

SEQ ID NO: 114493 - DNA, 20 bp, Artificial Sequence
  Description of Artificial Sequence: Synthetic oligonucleotide
  Target: ATXN1; (+) strand; PAM type: NRG; PAM sequence: CAG
gtctttacaactgacaacag

SEQ ID NO: 114494 - DNA, 20 bp, Artificial Sequence
  Description of Artificial Sequence: Synthetic oligonucleotide
  Target: ATXN1; (+) strand; PAM type: NRG; PAM sequence: GAG
ctttacaactgacaacagca

SEQ ID NO: 114495 - DNA, 20 bp, Artificial Sequence
  Description of Artificial Sequence: Synthetic oligonucleotide
  Target: ATXN1; (+) strand; PAM type: NRG; PAM sequence: CAG
catgtttctatgaccttcct

SEQ ID NO: 114496 - DNA, 20 bp, Artificial Sequence
  Description of Artificial Sequence: Synthetic oligonucleotide
  Target: ATXN1; (+) strand; PAM type: NRG; PAM sequence: CAG
ttctatgaccttcctcagca

SEQ ID NO: 114497 - DNA, 20 bp, Artificial Sequence
  Description of Artificial Sequence: Synthetic oligonucleotide
  Target: ATXN1; (+) strand; PAM type: NRG; PAM sequence: CGG
tgaccttcctcagcacagtc

SEQ ID NO: 114498 - DNA, 20 bp, Artificial Sequence
  Description of Artificial Sequence: Synthetic oligonucleotide
  Target: ATXN1; (+) strand; PAM type: NRG; PAM sequence: CGG
cagtccggaatgcacatgta

SEQ ID NO: 114499 - DNA, 20 bp, Artificial Sequence
  Description of Artificial Sequence: Synthetic oligonucleotide
  Target: ATXN1; (+) strand; PAM type: NRG; PAM sequence: CAG
ggaatgcacatgtacggtat

SEQ ID NO: 114500 - DNA, 20 bp, Artificial Sequence
  Description of Artificial Sequence: Synthetic oligonucleotide
  Target: ATXN1; (+) strand; PAM type: NRG; PAM sequence: GAG
aatgcacatgtacggtatca

SEQ ID NO: 114501 - DNA, 20 bp, Artificial Sequence
  Description of Artificial Sequence: Synthetic oligonucleotide
  Target: ATXN1; (+) strand; PAM type: NRG; PAM sequence: GAG
tgcacatgtacggtatcaga

SEQ ID NO: 114502 - DNA, 20 bp, Artificial Sequence
  Description of Artificial Sequence: Synthetic oligonucleotide
  Target: ATXN1; (+) strand; PAM type: NRG; PAM sequence: CAG
acatgtacggtatcagagag

SEQ ID NO: 114503 - DNA, 20 bp, Artificial Sequence
  Description of Artificial Sequence: Synthetic oligonucleotide
  Target: ATXN1; (+) strand; PAM type: NRG; PAM sequence: TGG
agcccgcctccatgttttct

SEQ ID NO: 114504 - DNA, 20 bp, Artificial Sequence
  Description of Artificial Sequence: Synthetic oligonucleotide
  Target: ATXN1; (+) strand; PAM type: NRG; PAM sequence: GGG
gcccgcctccatgttttctt

SEQ ID NO: 114505 - DNA, 20 bp, Artificial Sequence
  Description of Artificial Sequence: Synthetic oligonucleotide
  Target: ATXN1; (+) strand; PAM type: NRG; PAM sequence: AAG
cgcctccatgttttcttggg

SEQ ID NO: 114506 - DNA, 20 bp, Artificial Sequence
  Description of Artificial Sequence: Synthetic oligonucleotide
  Target: ATXN1; (+) strand; PAM type: NRG; PAM sequence: AGG
gcctccatgttttcttggga

SEQ ID NO: 114507 - DNA, 20 bp, Artificial Sequence
  Description of Artificial Sequence: Synthetic oligonucleotide
  Target: ATXN1; (+) strand; PAM type: NRG; PAM sequence: GAG
ctccatgttttcttgggaag

SEQ ID NO: 114508 - DNA, 20 bp, Artificial Sequence
  Description of Artificial Sequence: Synthetic oligonucleotide
  Target: ATXN1; (+) strand; PAM type: NRG; PAM sequence: AGG
tccatgttttcttgggaagg

SEQ ID NO: 114509 - DNA, 20 bp, Artificial Sequence
  Description of Artificial Sequence: Synthetic oligonucleotide
  Target: ATXN1; (+) strand; PAM type: NRG; PAM sequence: GGG
ccatgttttcttgggaagga

SEQ ID NO: 114510 - DNA, 20 bp, Artificial Sequence
  Description of Artificial Sequence: Synthetic oligonucleotide
  Target: ATXN1; (+) strand; PAM type: NRG; PAM sequence: CAG
cttgggaaggagggtctgtg

SEQ ID NO: 114511 - DNA, 20 bp, Artificial Sequence
  Description of Artificial Sequence: Synthetic oligonucleotide
  Target: ATXN1; (+) strand; PAM type: NRG; PAM sequence: TGG
aaggagggtctgtgcagatg

SEQ ID NO: 114512 - DNA, 20 bp, Artificial Sequence
  Description of Artificial Sequence: Synthetic oligonucleotide
  Target: ATXN1; (+) strand; PAM type: NRG; PAM sequence: GGG
aggagggtctgtgcagatgt

SEQ ID NO: 114513 - DNA, 20 bp, Artificial Sequence
  Description of Artificial Sequence: Synthetic oligonucleotide
  Target: ATXN1; (+) strand; PAM type: NRG; PAM sequence: GGG
ggagggtctgtgcagatgtg

SEQ ID NO: 114514 - DNA, 20 bp, Artificial Sequence
  Description of Artificial Sequence: Synthetic oligonucleotide
  Target: ATXN1; (+) strand; PAM type: NRG; PAM sequence: TGG
gtgcagatgtggggtttttt

SEQ ID NO: 114515 - DNA, 20 bp, Artificial Sequence
  Description of Artificial Sequence: Synthetic oligonucleotide
  Target: ATXN1; (+) strand; PAM type: NRG; PAM sequence: GGG
tgcagatgtggggttttttt

SEQ ID NO: 114516 - DNA, 20 bp, Artificial Sequence
  Description of Artificial Sequence: Synthetic oligonucleotide
  Target: ATXN1; (+) strand; PAM type: NRG; PAM sequence: GGG
gcagatgtggggtttttttg

SEQ ID NO: 114517 - DNA, 20 bp, Artificial Sequence
  Description of Artificial Sequence: Synthetic oligonucleotide
  Target: ATXN1; (+) strand; PAM type: NRG; PAM sequence: GGG
cagatgtggggtttttttgg

SEQ ID NO: 114518 - DNA, 20 bp, Artificial Sequence
  Description of Artificial Sequence: Synthetic oligonucleotide
  Target: ATXN1; (+) strand; PAM type: NRG; PAM sequence: TGG
tggggtttttttgggggaaa

SEQ ID NO: 114519 - DNA, 20 bp, Artificial Sequence
  Description of Artificial Sequence: Synthetic oligonucleotide
  Target: ATXN1; (+) strand; PAM type: NRG; PAM sequence: GGG
ggggtttttttgggggaaat

SEQ ID NO: 114520 - DNA, 20 bp, Artificial Sequence
  Description of Artificial Sequence: Synthetic oligonucleotide
  Target: ATXN1; (+) strand; PAM type: NRG; PAM sequence: TGG
ttttttgggggaaatgggtg

SEQ ID NO: 114521 - DNA, 20 bp, Artificial Sequence
  Description of Artificial Sequence: Synthetic oligonucleotide
  Target: ATXN1; (+) strand; PAM type: NRG; PAM sequence: GGG
tttttgggggaaatgggtgt

SEQ ID NO: 114522 - DNA, 20 bp, Artificial Sequence
  Description of Artificial Sequence: Synthetic oligonucleotide
  Target: ATXN1; (+) strand; PAM type: NRG; PAM sequence: GGG
ttttgggggaaatgggtgtg

SEQ ID NO: 114523 - DNA, 20 bp, Artificial Sequence
  Description of Artificial Sequence: Synthetic oligonucleotide
  Target: ATXN1; (+) strand; PAM type: NRG; PAM sequence: GGG
tttgggggaaatgggtgtgg

SEQ ID NO: 114524 - DNA, 20 bp, Artificial Sequence
  Description of Artificial Sequence: Synthetic oligonucleotide
  Target: ATXN1; (+) strand; PAM type: NRG; PAM sequence: TAG
gggggaaatgggtgtggggg

SEQ ID NO: 114525 - DNA, 20 bp, Artificial Sequence
  Description of Artificial Sequence: Synthetic oligonucleotide
  Target: ATXN1; (+) strand; PAM type: NRG; PAM sequence: AGG
ggggaaatgggtgtgggggt

SEQ ID NO: 114526 - DNA, 20 bp, Artificial Sequence
  Description of Artificial Sequence: Synthetic oligonucleotide
  Target: ATXN1; (+) strand; PAM type: NRG; PAM sequence: GAG
ggaaatgggtgtgggggtag

SEQ ID NO: 114527 - DNA, 20 bp, Artificial Sequence
  Description of Artificial Sequence: Synthetic oligonucleotide
  Target: ATXN1; (+) strand; PAM type: NRG; PAM sequence: CAG
aatgggtgtgggggtaggag

SEQ ID NO: 114528 - DNA, 20 bp, Artificial Sequence
  Description of Artificial Sequence: Synthetic oligonucleotide
  Target: ATXN1; (+) strand; PAM type: NRG; PAM sequence: AGG
atgggtgtgggggtaggagc

SEQ ID NO: 114529 - DNA, 20 bp, Artificial Sequence
  Description of Artificial Sequence: Synthetic oligonucleotide
  Target: ATXN1; (+) strand; PAM type: NRG; PAM sequence: GAG
gggtgtgggggtaggagcag

SEQ ID NO: 114530 - DNA, 20 bp, Artificial Sequence
  Description of Artificial Sequence: Synthetic oligonucleotide
  Target: ATXN1; (+) strand; PAM type: NRG; PAM sequence: TAG
tgggggtaggagcaggagcg

SEQ ID NO: 114531 - DNA, 20 bp, Artificial Sequence
  Description of Artificial Sequence: Synthetic oligonucleotide
  Target: ATXN1; (+) strand; PAM type: NRG; PAM sequence: TAG
ggtaggagcaggagcgtaga

SEQ ID NO: 114532 - DNA, 20 bp, Artificial Sequence
  Description of Artificial Sequence: Synthetic oligonucleotide
  Target: ATXN1; (+) strand; PAM type: NRG; PAM sequence: AGG
gtaggagcaggagcgtagat

SEQ ID NO: 114533 - DNA, 20 bp, Artificial Sequence
  Description of Artificial Sequence: Synthetic oligonucleotide
  Target: ATXN1; (+) strand; PAM type: NRG; PAM sequence: GAG
aggagcaggagcgtagatag

SEQ ID NO: 114534 - DNA, 20 bp, Artificial Sequence
  Description of Artificial Sequence: Synthetic oligonucleotide
  Target: ATXN1; (+) strand; PAM type: NRG; PAM sequence: TGG
agcaggagcgtagataggag

SEQ ID NO: 114535 - DNA, 20 bp, Artificial Sequence
  Description of Artificial Sequence: Synthetic oligonucleotide
  Target: ATXN1; (+) strand; PAM type: NRG; PAM sequence: GAG
ggagcgtagataggagtggt

SEQ ID NO: 114536 - DNA, 20 bp, Artificial Sequence
  Description of Artificial Sequence: Synthetic oligonucleotide
  Target: ATXN1; (+) strand; PAM type: NRG; PAM sequence: AAG
ggagtggtgagattaaatcc

SEQ ID NO: 114537 - DNA, 20 bp, Artificial Sequence
  Description of Artificial Sequence: Synthetic oligonucleotide
  Target: ATXN1; (+) strand; PAM type: NRG; PAM sequence: CAG
gagattaaatccaagcatac

SEQ ID NO: 114538 - DNA, 20 bp, Artificial Sequence
  Description of Artificial Sequence: Synthetic oligonucleotide
  Target: ATXN1; (+) strand; PAM type: NRG; PAM sequence: AGG
agattaaatccaagcatacc

SEQ ID NO: 114539 - DNA, 20 bp, Artificial Sequence
  Description of Artificial Sequence: Synthetic oligonucleotide
  Target: ATXN1; (+) strand; PAM type: NRG; PAM sequence: TAG
atccaagcataccaggtttt

SEQ ID NO: 114540 - DNA, 20 bp, Artificial Sequence
  Description of Artificial Sequence: Synthetic oligonucleotide
  Target: ATXN1; (+) strand; PAM type: NRG; PAM sequence: TAG
agcataccaggtttttagaa

SEQ ID NO: 114541 - DNA, 20 bp, Artificial Sequence
  Description of Artificial Sequence: Synthetic oligonucleotide
  Target: ATXN1; (+) strand; PAM type: NRG; PAM sequence: GAG
cataccaggtttttagaata

SEQ ID NO: 114542 - DNA, 20 bp, Artificial Sequence
  Description of Artificial Sequence: Synthetic oligonucleotide
  Target: ATXN1; (+) strand; PAM type: NRG; PAM sequence: TGG
ttagaatagagaaatacaac

SEQ ID NO: 114543 - DNA, 20 bp, Artificial Sequence
  Description of Artificial Sequence: Synthetic oligonucleotide
  Target: ATXN1; (+) strand; PAM type: NRG; PAM sequence: CAG
atacaactggctgaaattat

SEQ ID NO: 114544 - DNA, 20 bp, Artificial Sequence
  Description of Artificial Sequence: Synthetic oligonucleotide
  Target: ATXN1; (+) strand; PAM type: NRG; PAM sequence: AGG
tacaactggctgaaattatc

SEQ ID NO: 114545 - DNA, 20 bp, Artificial Sequence
  Description of Artificial Sequence: Synthetic oligonucleotide
  Target: ATXN1; (+) strand; PAM type: NRG; PAM sequence: GGG
acaactggctgaaattatca

SEQ ID NO: 114546 - DNA, 20 bp, Artificial Sequence
  Description of Artificial Sequence: Synthetic oligonucleotide
  Target: ATXN1; (+) strand; PAM type: NRG; PAM sequence: GAG
aactggctgaaattatcagg

SEQ ID NO: 114547 - DNA, 20 bp, Artificial Sequence
  Description of Artificial Sequence: Synthetic oligonucleotide
  Target: ATXN1; (+) strand; PAM type: NRG; PAM sequence: AGG
actggctgaaattatcaggg

SEQ ID NO: 114548 - DNA, 20 bp, Artificial Sequence
  Description of Artificial Sequence: Synthetic oligonucleotide
  Target: ATXN1; (+) strand; PAM type: NRG; PAM sequence: AAG
ggctgaaattatcagggagg

SEQ ID NO: 114549 - DNA, 20 bp, Artificial Sequence
  Description of Artificial Sequence: Synthetic oligonucleotide
  Target: ATXN1; (+) strand; PAM type: NRG; PAM sequence: GAG
ctgaaattatcagggaggaa

SEQ ID NO: 114550 - DNA, 20 bp, Artificial Sequence
  Description of Artificial Sequence: Synthetic oligonucleotide
  Target: ATXN1; (+) strand; PAM type: NRG; PAM sequence: CAG
aaattatcagggaggaagag

SEQ ID NO: 114551 - DNA, 20 bp, Artificial Sequence
  Description of Artificial Sequence: Synthetic oligonucleotide
  Target: ATXN1; (+) strand; PAM type: NRG; PAM sequence: GAG
ttattgcaataccaccaatt

SEQ ID NO: 114552 - DNA, 20 bp, Artificial Sequence
  Description of Artificial Sequence: Synthetic oligonucleotide
  Target: ATXN1; (+) strand; PAM type: NRG; PAM sequence: GAG
attgcaataccaccaattga

SEQ ID NO: 114553 - DNA, 20 bp, Artificial Sequence
  Description of Artificial Sequence: Synthetic oligonucleotide
  Target: ATXN1; (+) strand; PAM type: NRG; PAM sequence: TGG
caattgagagaacattctgc

SEQ ID NO: 114554 - DNA, 20 bp, Artificial Sequence
  Description of Artificial Sequence: Synthetic oligonucleotide
  Target: ATXN1; (+) strand; PAM type: NRG; PAM sequence: GGG
aattgagagaacattctgct

SEQ ID NO: 114555 - DNA, 20 bp, Artificial Sequence
  Description of Artificial Sequence: Synthetic oligonucleotide
  Target: ATXN1; (+) strand; PAM type: NRG; PAM sequence: GGG
attgagagaacattctgctg

SEQ ID NO: 114556 - DNA, 20 bp, Artificial Sequence
  Description of Artificial Sequence: Synthetic oligonucleotide
  Target: ATXN1; (+) strand; PAM type: NRG; PAM sequence: GGG
ttgagagaacattctgctgg

SEQ ID NO: 114557 - DNA, 20 bp, Artificial Sequence
  Description of Artificial Sequence: Synthetic oligonucleotide
  Target: ATXN1; (+) strand; PAM type: NRG; PAM sequence: GGG
tgagagaacattctgctggg

SEQ ID NO: 114558 - DNA, 20 bp, Artificial Sequence
  Description of Artificial Sequence: Synthetic oligonucleotide
  Target: ATXN1; (+) strand; PAM type: NRG; PAM sequence: GGG
gagagaacattctgctgggg

SEQ ID NO: 114559 - DNA, 20 bp, Artificial Sequence
  Description of Artificial Sequence: Synthetic oligonucleotide
  Target: ATXN1; (+) strand; PAM type: NRG; PAM sequence: AAG
tgctgggggggatgtctgcc

SEQ ID NO: 114560 - DNA, 20 bp, Artificial Sequence
  Description of Artificial Sequence: Synthetic oligonucleotide
  Target: ATXN1; (+) strand; PAM type: NRG; PAM sequence: AGG
gctgggggggatgtctgcca

SEQ ID NO: 114561 - DNA, 20 bp, Artificial Sequence
  Description of Artificial Sequence: Synthetic oligonucleotide
  Target: ATXN1; (+) strand; PAM type: NRG; PAM sequence: CAG
tctgccaaggacttctaatt

SEQ ID NO: 114562 - DNA, 20 bp, Artificial Sequence
  Description of Artificial Sequence: Synthetic oligonucleotide
  Target: ATXN1; (+) strand; PAM type: NRG; PAM sequence: GAG
cccgttttatttttaaactc

SEQ ID NO: 114563 - DNA, 20 bp, Artificial Sequence
  Description of Artificial Sequence: Synthetic oligonucleotide
  Target: ATXN1; (+) strand; PAM type: NRG; PAM sequence: CAG
tttatttttaaactcgagtg

SEQ ID NO: 114564 - DNA, 20 bp, Artificial Sequence
  Description of Artificial Sequence: Synthetic oligonucleotide
  Target: ATXN1; (+) strand; PAM type: NRG; PAM sequence: TGG
tcgagtgcagattttattcc

SEQ ID NO: 114565 - DNA, 20 bp, Artificial Sequence
  Description of Artificial Sequence: Synthetic oligonucleotide
  Target: ATXN1; (+) strand; PAM type: NRG; PAM sequence: AAG
ttttattcctggaatgttat

SEQ ID NO: 114566 - DNA, 20 bp, Artificial Sequence
  Description of Artificial Sequence: Synthetic oligonucleotide
  Target: ATXN1; (+) strand; PAM type: NRG; PAM sequence: TGG
ttcctggaatgttataagat

SEQ ID NO: 114567 - DNA, 20 bp, Artificial Sequence
  Description of Artificial Sequence: Synthetic oligonucleotide
  Target: ATXN1; (+) strand; PAM type: NRG; PAM sequence: TGG
ggaatgttataagattggtg

SEQ ID NO: 114568 - DNA, 20 bp, Artificial Sequence
  Description of Artificial Sequence: Synthetic oligonucleotide
  Target: ATXN1; (+) strand; PAM type: NRG; PAM sequence: GGG
gaatgttataagattggtgt

SEQ ID NO: 114569 - DNA, 20 bp, Artificial Sequence
  Description of Artificial Sequence: Synthetic oligonucleotide
  Target: ATXN1; (+) strand; PAM type: NRG; PAM sequence: CAG
tgttataagattggtgtggg

SEQ ID NO: 114570 - DNA, 20 bp, Artificial Sequence
  Description of Artificial Sequence: Synthetic oligonucleotide
  Target: ATXN1; (+) strand; PAM type: NRG; PAM sequence: TGG
aagattggtgtgggcagaaa

SEQ ID NO: 114571 - DNA, 20 bp, Artificial Sequence
  Description of Artificial Sequence: Synthetic oligonucleotide
  Target: ATXN1; (+) strand; PAM type: NRG; PAM sequence: GGG
agattggtgtgggcagaaat

SEQ ID NO: 114572 - DNA, 20 bp, Artificial Sequence
  Description of Artificial Sequence: Synthetic oligonucleotide
  Target: ATXN1; (+) strand; PAM type: NRG; PAM sequence: CAG
agaaatgggcaaattcactt

SEQ ID NO: 114573 - DNA, 20 bp, Artificial Sequence
  Description of Artificial Sequence: Synthetic oligonucleotide
  Target: ATXN1; (+) strand; PAM type: NRG; PAM sequence: AAG
aatgggcaaattcacttcag

SEQ ID NO: 114574 - DNA, 20 bp, Artificial Sequence
  Description of Artificial Sequence: Synthetic oligonucleotide
  Target: ATXN1; (+) strand; PAM type: NRG; PAM sequence: TGG
agaagtgctttataacaact

SEQ ID NO: 114575 - DNA, 20 bp, Artificial Sequence
  Description of Artificial Sequence: Synthetic oligonucleotide
  Target: ATXN1; (+) strand; PAM type: NRG; PAM sequence: AAG
tgctttataacaacttggaa

SEQ ID NO: 114576 - DNA, 20 bp, Artificial Sequence
  Description of Artificial Sequence: Synthetic oligonucleotide
  Target: ATXN1; (+) strand; PAM type: NRG; PAM sequence: AAG
aagaccctctaaaattctcc

SEQ ID NO: 114577 - DNA, 20 bp, Artificial Sequence
  Description of Artificial Sequence: Synthetic oligonucleotide
  Target: ATXN1; (+) strand; PAM type: NRG; PAM sequence: TAG
aaaattctccaagtacattt

SEQ ID NO: 114578 - DNA, 20 bp, Artificial Sequence
  Description of Artificial Sequence: Synthetic oligonucleotide
  Target: ATXN1; (+) strand; PAM type: NRG; PAM sequence: AGG
aaattctccaagtacatttt

SEQ ID NO: 114579 - DNA, 20 bp, Artificial Sequence
  Description of Artificial Sequence: Synthetic oligonucleotide
  Target: ATXN1; (+) strand; PAM type: NRG; PAM sequence: GGG
aattctccaagtacatttta

SEQ ID NO: 114580 - DNA, 20 bp, Artificial Sequence
  Description of Artificial Sequence: Synthetic oligonucleotide
  Target: ATXN1; (+) strand; PAM type: NRG; PAM sequence: GGG
attctccaagtacattttag

SEQ ID NO: 114581 - DNA, 20 bp, Artificial Sequence
  Description of Artificial Sequence: Synthetic oligonucleotide
  Target: ATXN1; (+) strand; PAM type: NRG; PAM sequence: AAG
ccaagtacattttaggggtg

SEQ ID NO: 114582 - DNA, 20 bp, Artificial Sequence
  Description of Artificial Sequence: Synthetic oligonucleotide
  Target: ATXN1; (+) strand; PAM type: NRG; PAM sequence: AAG
gttcatttctctcttttctg

SEQ ID NO: 114583 - DNA, 20 bp, Artificial Sequence
  Description of Artificial Sequence: Synthetic oligonucleotide
  Target: ATXN1; (+) strand; PAM type: NRG; PAM sequence: AAG
atttctctcttttctgaaga

SEQ ID NO: 114584 - DNA, 20 bp, Artificial Sequence
  Description of Artificial Sequence: Synthetic oligonucleotide
  Target: ATXN1; (+) strand; PAM type: NRG; PAM sequence: CAG
agaaagctgccttgattttg

SEQ ID NO: 114585 - DNA, 20 bp, Artificial Sequence
  Description of Artificial Sequence: Synthetic oligonucleotide
  Target: ATXN1; (+) strand; PAM type: NRG; PAM sequence: AAG
aagctgccttgattttgcag

SEQ ID NO: 114586 - DNA, 20 bp, Artificial Sequence
  Description of Artificial Sequence: Synthetic oligonucleotide
  Target: ATXN1; (+) strand; PAM type: NRG; PAM sequence: GAG
attttgcagaagtaaaactc

SEQ ID NO: 114587 - DNA, 20 bp, Artificial Sequence
  Description of Artificial Sequence: Synthetic oligonucleotide
  Target: ATXN1; (+) strand; PAM type: NRG; PAM sequence: AAG
aaactcgagtataattttga

SEQ ID NO: 114588 - DNA, 20 bp, Artificial Sequence
  Description of Artificial Sequence: Synthetic oligonucleotide
  Target: ATXN1; (+) strand; PAM type: NRG; PAM sequence: TAG
attttgaaagcatttcaaaa

SEQ ID NO: 114589 - DNA, 20 bp, Artificial Sequence
  Description of Artificial Sequence: Synthetic oligonucleotide
  Target: ATXN1; (+) strand; PAM type: NRG; PAM sequence: TGG
aaaatagtgatgctatctat

SEQ ID NO: 114590 - DNA, 20 bp, Artificial Sequence
  Description of Artificial Sequence: Synthetic oligonucleotide
  Target: ATXN1; (+) strand; PAM type: NRG; PAM sequence: GGG
aaatagtgatgctatctatt

SEQ ID NO: 114591 - DNA, 20 bp, Artificial Sequence
  Description of Artificial Sequence: Synthetic oligonucleotide
  Target: ATXN1; (+) strand; PAM type: NRG; PAM sequence: CAG
ttgggtatttaactattttc

SEQ ID NO: 114592 - DNA, 20 bp, Artificial Sequence
  Description of Artificial Sequence: Synthetic oligonucleotide
  Target: ATXN1; (+) strand; PAM type: NRG; PAM sequence: AGG
tgggtatttaactattttcc

SEQ ID NO: 114593 - DNA, 20 bp, Artificial Sequence
  Description of Artificial Sequence: Synthetic oligonucleotide
  Target: ATXN1; (+) strand; PAM type: NRG; PAM sequence: GGG
gggtatttaactattttcca

SEQ ID NO: 114594 - DNA, 20 bp, Artificial Sequence
  Description of Artificial Sequence: Synthetic oligonucleotide
  Target: ATXN1; (+) strand; PAM type: NRG; PAM sequence: GAG
gtatttaactattttccagg

SEQ ID NO: 114595 - DNA, 20 bp, Artificial Sequence
  Description of Artificial Sequence: Synthetic oligonucleotide
  Target: ATXN1; (+) strand; PAM type: NRG; PAM sequence: TAG
gagtattataacaatttgca

SEQ ID NO: 114596 - DNA, 20 bp, Artificial Sequence
  Description of Artificial Sequence: Synthetic oligonucleotide
  Target: ATXN1; (+) strand; PAM type: NRG; PAM sequence: CGG
tacctcatcacccccattta

SEQ ID NO: 114597 - DNA, 20 bp, Artificial Sequence
  Description of Artificial Sequence: Synthetic oligonucleotide
  Target: ATXN1; (+) strand; PAM type: NRG; PAM sequence: GGG
acctcatcacccccatttac

SEQ ID NO: 114598 - DNA, 20 bp, Artificial Sequence
  Description of Artificial Sequence: Synthetic oligonucleotide
  Target: ATXN1; (+) strand; PAM type: NRG; PAM sequence: AAG
catcacccccatttacgggc

SEQ ID NO: 114599 - DNA, 20 bp, Artificial Sequence
  Description of Artificial Sequence: Synthetic oligonucleotide
  Target: ATXN1; (+) strand; PAM type: NRG; PAM sequence: AAG
ccatttacgggcaagaaact

SEQ ID NO: 114600 - DNA, 20 bp, Artificial Sequence
  Description of Artificial Sequence: Synthetic oligonucleotide
  Target: ATXN1; (+) strand; PAM type: NRG; PAM sequence: AGG
catttacgggcaagaaacta

SEQ ID NO: 114601 - DNA, 20 bp, Artificial Sequence
  Description of Artificial Sequence: Synthetic oligonucleotide
  Target: ATXN1; (+) strand; PAM type: NRG; PAM sequence: CAG
ttacgggcaagaaactaagg

SEQ ID NO: 114602 - DNA, 20 bp, Artificial Sequence
  Description of Artificial Sequence: Synthetic oligonucleotide
  Target: ATXN1; (+) strand; PAM type: NRG; PAM sequence: AGG
tacgggcaagaaactaaggc

SEQ ID NO: 114603 - DNA, 20 bp, Artificial Sequence
  Description of Artificial Sequence: Synthetic oligonucleotide
  Target: ATXN1; (+) strand; PAM type: NRG; PAM sequence: GGG
acgggcaagaaactaaggca

SEQ ID NO: 114604 - DNA, 20 bp, Artificial Sequence
  Description of Artificial Sequence: Synthetic oligonucleotide
  Target: ATXN1; (+) strand; PAM type: NRG; PAM sequence: GAG
gggcaagaaactaaggcagg

SEQ ID NO: 114605 - DNA, 20 bp, Artificial Sequence
  Description of Artificial Sequence: Synthetic oligonucleotide
  Target: ATXN1; (+) strand; PAM type: NRG; PAM sequence: CAG
actaaggcagggagaactgc

SEQ ID NO: 114606 - DNA, 20 bp, Artificial Sequence
  Description of Artificial Sequence: Synthetic oligonucleotide
  Target: ATXN1; (+) strand; PAM type: NRG; PAM sequence: GAG
taaggcagggagaactgcca

SEQ ID NO: 114607 - DNA, 20 bp, Artificial Sequence
  Description of Artificial Sequence: Synthetic oligonucleotide
  Target: ATXN1; (+) strand; PAM type: NRG; PAM sequence: GAG
cagggagaactgccagagtt

SEQ ID NO: 114608 - DNA, 20 bp, Artificial Sequence
  Description of Artificial Sequence: Synthetic oligonucleotide
  Target: ATXN1; (+) strand; PAM type: NRG; PAM sequence: CAG
gccagagttgagttcaaatc

SEQ ID NO: 114609 - DNA, 20 bp, Artificial Sequence
  Description of Artificial Sequence: Synthetic oligonucleotide
  Target: ATXN1; (+) strand; PAM type: NRG; PAM sequence: CAG
tgctttcgtgtattcatatc

SEQ ID NO: 114610 - DNA, 20 bp, Artificial Sequence
  Description of Artificial Sequence: Synthetic oligonucleotide
  Target: ATXN1; (+) strand; PAM type: NRG; PAM sequence: AGG
gctttcgtgtattcatatcc

SEQ ID NO: 114611 - DNA, 20 bp, Artificial Sequence
  Description of Artificial Sequence: Synthetic oligonucleotide
  Target: ATXN1; (+) strand; PAM type: NRG; PAM sequence: CAG
gacatcataaactatcaata

SEQ ID NO: 114612 - DNA, 20 bp, Artificial Sequence
  Description of Artificial Sequence: Synthetic oligonucleotide
  Target: ATXN1; (+) strand; PAM type: NRG; PAM sequence: TGG
tattaaataaatatacaact

SEQ ID NO: 114613 - DNA, 20 bp, Artificial Sequence
  Description of Artificial Sequence: Synthetic oligonucleotide
  Target: ATXN1; (+) strand; PAM type: NRG; PAM sequence: CAG
taaatatacaacttggccat

SEQ ID NO: 114614 - DNA, 20 bp, Artificial Sequence
  Description of Artificial Sequence: Synthetic oligonucleotide
  Target: ATXN1; (+) strand; PAM type: NRG; PAM sequence: AGG
aaatatacaacttggccatc

SEQ ID NO: 114615 - DNA, 20 bp, Artificial Sequence
  Description of Artificial Sequence: Synthetic oligonucleotide
  Target: ATXN1; (+) strand; PAM type: NRG; PAM sequence: CAG
gctactatttatcattctaa

SEQ ID NO: 114616 - DNA, 20 bp, Artificial Sequence
  Description of Artificial Sequence: Synthetic oligonucleotide
  Target: ATXN1; (+) strand; PAM type: NRG; PAM sequence: AGG
ctactatttatcattctaac

SEQ ID NO: 114617 - DNA, 20 bp, Artificial Sequence
  Description of Artificial Sequence: Synthetic oligonucleotide
  Target: ATXN1; (+) strand; PAM type: NRG; PAM sequence: TGG
tatttatcattctaacagga

SEQ ID NO: 114618 - DNA, 20 bp, Artificial Sequence
  Description of Artificial Sequence: Synthetic oligonucleotide
  Target: ATXN1; (+) strand; PAM type: NRG; PAM sequence: GGG
atttatcattctaacaggat

SEQ ID NO: 114619 - DNA, 20 bp, Artificial Sequence
  Description of Artificial Sequence: Synthetic oligonucleotide
  Target: ATXN1; (+) strand; PAM type: NRG; PAM sequence: GGG
tttatcattctaacaggatg

SEQ ID NO: 114620 - DNA, 20 bp, Artificial Sequence
  Description of Artificial Sequence: Synthetic oligonucleotide
  Target: ATXN1; (+) strand; PAM type: NRG; PAM sequence: GGG
ttatcattctaacaggatgg

SEQ ID NO: 114621 - DNA, 20 bp, Artificial Sequence
  Description of Artificial Sequence: Synthetic oligonucleotide
  Target: ATXN1; (+) strand; PAM type: NRG; PAM sequence: AAG
ttctaacaggatgggggcaa

SEQ ID NO: 114622 - DNA, 20 bp, Artificial Sequence
  Description of Artificial Sequence: Synthetic oligonucleotide
  Target: ATXN1; (+) strand; PAM type: NRG; PAM sequence: CAG
taacaggatgggggcaaaag

SEQ ID NO: 114623 - DNA, 20 bp, Artificial Sequence
  Description of Artificial Sequence: Synthetic oligonucleotide
  Target: ATXN1; (+) strand; PAM type: NRG; PAM sequence: TAG
gggggcaaaagcagattcct

SEQ ID NO: 114624 - DNA, 20 bp, Artificial Sequence
  Description of Artificial Sequence: Synthetic oligonucleotide
  Target: ATXN1; (+) strand; PAM type: NRG; PAM sequence: GAG
ccttagcctgcttttctgat

SEQ ID NO: 114625 - DNA, 20 bp, Artificial Sequence
  Description of Artificial Sequence: Synthetic oligonucleotide
  Target: ATXN1; (+) strand; PAM type: NRG; PAM sequence: GAG
ttagcctgcttttctgatga

SEQ ID NO: 114626 - DNA, 20 bp, Artificial Sequence
  Description of Artificial Sequence: Synthetic oligonucleotide
  Target: ATXN1; (+) strand; PAM type: NRG; PAM sequence: CGG
gcttttctgatgagagatcg

SEQ ID NO: 114627 - DNA, 20 bp, Artificial Sequence
  Description of Artificial Sequence: Synthetic oligonucleotide
  Target: ATXN1; (+) strand; PAM type: NRG; PAM sequence: GGG
cttttctgatgagagatcgc

SEQ ID NO: 114628 - DNA, 20 bp, Artificial Sequence
  Description of Artificial Sequence: Synthetic oligonucleotide
  Target: ATXN1; (+) strand; PAM type: NRG; PAM sequence: GGG
ttttctgatgagagatcgcg

SEQ ID NO: 114629 - DNA, 20 bp, Artificial Sequence
  Description of Artificial Sequence: Synthetic oligonucleotide
  Target: ATXN1; (+) strand; PAM type: NRG; PAM sequence: GGG
tttctgatgagagatcgcgg

SEQ ID NO: 114630 - DNA, 20 bp, Artificial Sequence
  Description of Artificial Sequence: Synthetic oligonucleotide
  Target: ATXN1; (+) strand; PAM type: NRG; PAM sequence: GAG
tctgatgagagatcgcgggg

SEQ ID NO: 114631 - DNA, 20 bp, Artificial Sequence
  Description of Artificial Sequence: Synthetic oligonucleotide
  Target: ATXN1; (+) strand; PAM type: NRG; PAM sequence: AAG
gagagatcgcgggggagcca

SEQ ID NO: 114632 - DNA, 20 bp, Artificial Sequence
  Description of Artificial Sequence: Synthetic oligonucleotide
  Target: ATXN1; (+) strand; PAM type: NRG; PAM sequence: AGG
agagatcgcgggggagccaa

SEQ ID NO: 114633 - DNA, 20 bp, Artificial Sequence
  Description of Artificial Sequence: Synthetic oligonucleotide
  Target: ATXN1; (+) strand; PAM type: NRG; PAM sequence: CAG
gatcgcgggggagccaaagg

SEQ ID NO: 114634 - DNA, 20 bp, Artificial Sequence
  Description of Artificial Sequence: Synthetic oligonucleotide
  Target: ATXN1; (+) strand; PAM type: NRG; PAM sequence: AAG
gagccaaaggcagtttgcaa

SEQ ID NO: 114635 - DNA, 20 bp, Artificial Sequence
  Description of Artificial Sequence: Synthetic oligonucleotide
  Target: ATXN1; (+) strand; PAM type: NRG; PAM sequence: GAG
gccaaaggcagtttgcaaaa

SEQ ID NO: 114636 - DNA, 20 bp, Artificial Sequence
  Description of Artificial Sequence: Synthetic oligonucleotide
  Target: ATXN1; (+) strand; PAM type: NRG; PAM sequence: AGG
ccaaaggcagtttgcaaaag

SEQ ID NO: 114637 - DNA, 20 bp, Artificial Sequence
  Description of Artificial Sequence: Synthetic oligonucleotide
  Target: ATXN1; (+) strand; PAM type: NRG; PAM sequence: CAG
ggcagtttgcaaaagaggac

SEQ ID NO: 114638 - DNA, 20 bp, Artificial Sequence
  Description of Artificial Sequence: Synthetic oligonucleotide
  Target: ATXN1; (+) strand; PAM type: NRG; PAM sequence: CAG
aaagaggaccagtctctgcg

SEQ ID NO: 114639 - DNA, 20 bp, Artificial Sequence
  Description of Artificial Sequence: Synthetic oligonucleotide
  Target: ATXN1; (+) strand; PAM type: NRG; PAM sequence: AGG
aagaggaccagtctctgcgc

SEQ ID NO: 114640 - DNA, 20 bp, Artificial Sequence
  Description of Artificial Sequence: Synthetic oligonucleotide
  Target: ATXN1; (+) strand; PAM type: NRG; PAM sequence: GAG
gaggaccagtctctgcgcag

SEQ ID NO: 114641 - DNA, 20 bp, Artificial Sequence
  Description of Artificial Sequence: Synthetic oligonucleotide
  Target: ATXN1; (+) strand; PAM type: NRG; PAM sequence: TGG
cagtctctgcgcaggagttt

SEQ ID NO: 114642 - DNA, 20 bp, Artificial Sequence
  Description of Artificial Sequence: Synthetic oligonucleotide
  Target: ATXN1; (+) strand; PAM type: NRG; PAM sequence: TGG
tctctgcgcaggagttttgg

SEQ ID NO: 114643 - DNA, 20 bp, Artificial Sequence
  Description of Artificial Sequence: Synthetic oligonucleotide
  Target: ATXN1; (+) strand; PAM type: NRG; PAM sequence: GAG
agttttggtggtaaacatgt

SEQ ID NO: 114644 - DNA, 20 bp, Artificial Sequence
  Description of Artificial Sequence: Synthetic oligonucleotide
  Target: ATXN1; (+) strand; PAM type: NRG; PAM sequence: AGG
gttttggtggtaaacatgtg

SEQ ID NO: 114645 - DNA, 20 bp, Artificial Sequence
  Description of Artificial Sequence: Synthetic oligonucleotide
  Target: ATXN1; (+) strand; PAM type: NRG; PAM sequence: GGG
ttttggtggtaaacatgtga

SEQ ID NO: 114646 - DNA, 20 bp, Artificial Sequence
  Description of Artificial Sequence: Synthetic oligonucleotide
  Target: ATXN1; (+) strand; PAM type: NRG; PAM sequence: CAG
ggtaaacatgtgagggtatc

SEQ ID NO: 114647 - DNA, 20 bp, Artificial Sequence
  Description of Artificial Sequence: Synthetic oligonucleotide
  Target: ATXN1; (+) strand; PAM type: NRG; PAM sequence: GAG
taaacatgtgagggtatcca

SEQ ID NO: 114648 - DNA, 20 bp, Artificial Sequence
  Description of Artificial Sequence: Synthetic oligonucleotide
  Target: ATXN1; (+) strand; PAM type: NRG; PAM sequence: GAG
aacatgtgagggtatccaga

SEQ ID NO: 114649 - DNA, 20 bp, Artificial Sequence
  Description of Artificial Sequence: Synthetic oligonucleotide
  Target: ATXN1; (+) strand; PAM type: NRG; PAM sequence: TGG
tgagggtatccagagagtga

SEQ ID NO: 114650 - DNA, 20 bp, Artificial Sequence
  Description of Artificial Sequence: Synthetic oligonucleotide
  Target: ATXN1; (+) strand; PAM type: NRG; PAM sequence: TGG
tatccagagagtgatggaaa

SEQ ID NO: 114651 - DNA, 20 bp, Artificial Sequence
  Description of Artificial Sequence: Synthetic oligonucleotide
  Target: ATXN1; (+) strand; PAM type: NRG; PAM sequence: TGG
ccagagagtgatggaaatgg

SEQ ID NO: 114652 - DNA, 20 bp, Artificial Sequence
  Description of Artificial Sequence: Synthetic oligonucleotide
  Target: ATXN1; (+) strand; PAM type: NRG; PAM sequence: TGG
atttattttgaaataccaaa

SEQ ID NO: 114653 - DNA, 20 bp, Artificial Sequence
  Description of Artificial Sequence: Synthetic oligonucleotide
  Target: ATXN1; (+) strand; PAM type: NRG; PAM sequence: TGG
aaaacttgttcaacctactt

SEQ ID NO: 114654 - DNA, 20 bp, Artificial Sequence
  Description of Artificial Sequence: Synthetic oligonucleotide
  Target: ATXN1; (+) strand; PAM type: NRG; PAM sequence: AAG
ctttggcaacattaaatatg

SEQ ID NO: 114655 - DNA, 20 bp, Artificial Sequence
  Description of Artificial Sequence: Synthetic oligonucleotide
  Target: ATXN1; (+) strand; PAM type: NRG; PAM sequence: AGG
tttggcaacattaaatatga

SEQ ID NO: 114656 - DNA, 20 bp, Artificial Sequence
  Description of Artificial Sequence: Synthetic oligonucleotide
  Target: ATXN1; (+) strand; PAM type: NRG; PAM sequence: GGG
ttggcaacattaaatatgaa

SEQ ID NO: 114657 - DNA, 20 bp, Artificial Sequence
  Description of Artificial Sequence: Synthetic oligonucleotide
  Target: ATXN1; (+) strand; PAM type: NRG; PAM sequence: AAG
accttcttcccctcctccaa

SEQ ID NO: 114658 - DNA, 20 bp, Artificial Sequence
  Description of Artificial Sequence: Synthetic oligonucleotide
  Target: ATXN1; (+) strand; PAM type: NRG; PAM sequence: TGG
aaatcgatttcctctgtcac

SEQ ID NO: 114659 - DNA, 20 bp, Artificial Sequence
  Description of Artificial Sequence: Synthetic oligonucleotide
  Target: ATXN1; (+) strand; PAM type: NRG; PAM sequence: CAG
ggttattgctgcattttgct

SEQ ID NO: 114660 - DNA, 20 bp, Artificial Sequence
  Description of Artificial Sequence: Synthetic oligonucleotide
  Target: ATXN1; (+) strand; PAM type: NRG; PAM sequence: TGG
tattgctgcattttgctcag

SEQ ID NO: 114661 - DNA, 20 bp, Artificial Sequence
  Description of Artificial Sequence: Synthetic oligonucleotide
  Target: ATXN1; (+) strand; PAM type: NRG; PAM sequence: GAG
gcattttgctcagtggttct

SEQ ID NO: 114662 - DNA, 20 bp, Artificial Sequence
  Description of Artificial Sequence: Synthetic oligonucleotide
  Target: ATXN1; (+) strand; PAM type: NRG; PAM sequence: TGG
agtggttctgagaaaccgca

SEQ ID NO: 114663 - DNA, 20 bp, Artificial Sequence
  Description of Artificial Sequence: Synthetic oligonucleotide
  Target: ATXN1; (+) strand; PAM type: NRG; PAM sequence: CAG
cactcgttaaattgaccctg

SEQ ID NO: 114664 - DNA, 20 bp, Artificial Sequence
  Description of Artificial Sequence: Synthetic oligonucleotide
  Target: ATXN1; (+) strand; PAM type: NRG; PAM sequence: AGG
actcgttaaattgaccctgc

SEQ ID NO: 114665 - DNA, 20 bp, Artificial Sequence
  Description of Artificial Sequence: Synthetic oligonucleotide
  Target: ATXN1; (+) strand; PAM type: NRG; PAM sequence: GGG
ctcgttaaattgaccctgca

SEQ ID NO: 114666 - DNA, 20 bp, Artificial Sequence
  Description of Artificial Sequence: Synthetic oligonucleotide
  Target: ATXN1; (+) strand; PAM type: NRG; PAM sequence: CAG
accctgcagggctctaccac

SEQ ID NO: 114667 - DNA, 20 bp, Artificial Sequence
  Description of Artificial Sequence: Synthetic oligonucleotide
  Target: ATXN1; (+) strand; PAM type: NRG; PAM sequence: AAG
accagtacatgcatcatccc

SEQ ID NO: 114668 - DNA, 20 bp, Artificial Sequence
  Description of Artificial Sequence: Synthetic oligonucleotide
  Target: ATXN1; (+) strand; PAM type: NRG; PAM sequence: GAG
cagtacatgcatcatcccaa

SEQ ID NO: 114669 - DNA, 20 bp, Artificial Sequence
  Description of Artificial Sequence: Synthetic oligonucleotide
  Target: ATXN1; (+) strand; PAM type: NRG; PAM sequence: AGG
agtacatgcatcatcccaag

SEQ ID NO: 114670 - DNA, 20 bp, Artificial Sequence
  Description of Artificial Sequence: Synthetic oligonucleotide
  Target: ATXN1; (+) strand; PAM type: NRG; PAM sequence: AAG
gcatcatcccaagaggtaaa

SEQ ID NO: 114671 - DNA, 20 bp, Artificial Sequence
  Description of Artificial Sequence: Synthetic oligonucleotide
  Target: ATXN1; (+) strand; PAM type: NRG; PAM sequence: AGG
catcatcccaagaggtaaaa

SEQ ID NO: 114672 - DNA, 20 bp, Artificial Sequence
  Description of Artificial Sequence: Synthetic oligonucleotide
  Target: ATXN1; (+) strand; PAM type: NRG; PAM sequence: AAG
atcccaagaggtaaaaaggc

SEQ ID NO: 114673 - DNA, 20 bp, Artificial Sequence
  Description of Artificial Sequence: Synthetic oligonucleotide
  Target: ATXN1; (+) strand; PAM type: NRG; PAM sequence: AGG
tcccaagaggtaaaaaggca

SEQ ID NO: 114674 - DNA, 20 bp, Artificial Sequence
  Description of Artificial Sequence: Synthetic oligonucleotide
  Target: ATXN1; (+) strand; PAM type: NRG; PAM sequence: CAG
aggtaaaaaggcaaggctgc

SEQ ID NO: 114675 - DNA, 20 bp, Artificial Sequence
  Description of Artificial Sequence: Synthetic oligonucleotide
  Target: ATXN1; (+) strand; PAM type: NRG; PAM sequence: AGG
ggtaaaaaggcaaggctgcc

SEQ ID NO: 114676 - DNA, 20 bp, Artificial Sequence
  Description of Artificial Sequence: Synthetic oligonucleotide
  Target: ATXN1; (+) strand; PAM type: NRG; PAM sequence: GAG
aaggctgccaggctcatgct

SEQ ID NO: 114677 - DNA, 20 bp, Artificial Sequence
  Description of Artificial Sequence: Synthetic oligonucleotide
  Target: ATXN1; (+) strand; PAM type: NRG; PAM sequence: GAG
aatatcatcatgaaatcaac

SEQ ID NO: 114678 - DNA, 20 bp, Artificial Sequence
  Description of Artificial Sequence: Synthetic oligonucleotide
  Target: ATXN1; (+) strand; PAM type: NRG; PAM sequence: AGG
atatcatcatgaaatcaacg

SEQ ID NO: 114679 - DNA, 20 bp, Artificial Sequence
  Description of Artificial Sequence: Synthetic oligonucleotide
  Target: ATXN1; (+) strand; PAM type: NRG; PAM sequence: TAG
atgcaaatctctctgttcca

SEQ ID NO: 114680 - DNA, 20 bp, Artificial Sequence
  Description of Artificial Sequence: Synthetic oligonucleotide
  Target: ATXN1; (+) strand; PAM type: NRG; PAM sequence: TGG
tgttccatagctcatttgca

SEQ ID NO: 114681 - DNA, 20 bp, Artificial Sequence
  Description of Artificial Sequence: Synthetic oligonucleotide
  Target: ATXN1; (+) strand; PAM type: NRG; PAM sequence: TGG
ctcatttgcatggttttcat

SEQ ID NO: 114682 - DNA, 20 bp, Artificial Sequence
  Description of Artificial Sequence: Synthetic oligonucleotide
  Target: ATXN1; (+) strand; PAM type: NRG; PAM sequence: TAG
catggttttcattggttttg

SEQ ID NO: 114683 - DNA, 20 bp, Artificial Sequence
  Description of Artificial Sequence: Synthetic oligonucleotide
  Target: ATXN1; (+) strand; PAM type: NRG; PAM sequence: AAG
caatttccttttctttccta

SEQ ID NO: 114684 - DNA, 20 bp, Artificial Sequence
  Description of Artificial Sequence: Synthetic oligonucleotide
  Target: ATXN1; (+) strand; PAM type: NRG; PAM sequence: TAG
ttttctttcctaaagcttat

SEQ ID NO: 114685 - DNA, 20 bp, Artificial Sequence
  Description of Artificial Sequence: Synthetic oligonucleotide
  Target: ATXN1; (+) strand; PAM type: NRG; PAM sequence: CAG
ttagctgtgtgtgatgttta

SEQ ID NO: 114686 - DNA, 20 bp, Artificial Sequence
  Description of Artificial Sequence: Synthetic oligonucleotide
  Target: ATXN1; (+) strand; PAM type: NRG; PAM sequence: AAG
tgtgtgatgtttacagcttg

SEQ ID NO: 114687 - DNA, 20 bp, Artificial Sequence
  Description of Artificial Sequence: Synthetic oligonucleotide
  Target: ATXN1; (+) strand; PAM type: NRG; PAM sequence: CAG
tttacagcttgaagaccaaa

SEQ ID NO: 114688 - DNA, 20 bp, Artificial Sequence
  Description of Artificial Sequence: Synthetic oligonucleotide
  Target: ATXN1; (+) strand; PAM type: NRG; PAM sequence: TAG
tgaagaccaaacagatttaa

SEQ ID NO: 114689 - DNA, 20 bp, Artificial Sequence
  Description of Artificial Sequence: Synthetic oligonucleotide
  Target: ATXN1; (+) strand; PAM type: NRG; PAM sequence: AAG
atttaaactatataatttaa

SEQ ID NO: 114690 - DNA, 20 bp, Artificial Sequence
  Description of Artificial Sequence: Synthetic oligonucleotide
  Target: ATXN1; (+) strand; PAM type: NRG; PAM sequence: AAG
tatataatttaaaagcatgc

SEQ ID NO: 114691 - DNA, 20 bp, Artificial Sequence
  Description of Artificial Sequence: Synthetic oligonucleotide
  Target: ATXN1; (+) strand; PAM type: NRG; PAM sequence: AGG
atataatttaaaagcatgca

SEQ ID NO: 114692 - DNA, 20 bp, Artificial Sequence
  Description of Artificial Sequence: Synthetic oligonucleotide
  Target: ATXN1; (+) strand; PAM type: NRG; PAM sequence: AAG
taatttaaaagcatgcaagg

SEQ ID NO: 114693 - DNA, 20 bp, Artificial Sequence
  Description of Artificial Sequence: Synthetic oligonucleotide
  Target: ATXN1; (+) strand; PAM type: NRG; PAM sequence: GAG
atttaaaagcatgcaaggaa

SEQ ID NO: 114694 - DNA, 20 bp, Artificial Sequence
  Description of Artificial Sequence: Synthetic oligonucleotide
  Target: ATXN1; (+) strand; PAM type: NRG; PAM sequence: AGG
tttaaaagcatgcaaggaag

SEQ ID NO: 114695 - DNA, 20 bp, Artificial Sequence
  Description of Artificial Sequence: Synthetic oligonucleotide
  Target: ATXN1; (+) strand; PAM type: NRG; PAM sequence: GGG
ttaaaagcatgcaaggaaga

SEQ ID NO: 114696 - DNA, 20 bp, Artificial Sequence
  Description of Artificial Sequence: Synthetic oligonucleotide
  Target: ATXN1; (+) strand; PAM type: NRG; PAM sequence: AAG
atgcaaggaagagggaaaaa

SEQ ID NO: 114697 - DNA, 20 bp, Artificial Sequence
  Description of Artificial Sequence: Synthetic oligonucleotide
  Target: ATXN1; (+) strand; PAM type: NRG; PAM sequence: GAG
gcaaggaagagggaaaaaaa

SEQ ID NO: 114698 - DNA, 20 bp, Artificial Sequence
  Description of Artificial Sequence: Synthetic oligonucleotide
  Target: ATXN1; (+) strand; PAM type: NRG; PAM sequence: AGG
caaggaagagggaaaaaaag

SEQ ID NO: 114699 - DNA, 20 bp, Artificial Sequence
  Description of Artificial Sequence: Synthetic oligonucleotide
  Target: ATXN1; (+) strand; PAM type: NRG; PAM sequence: TAG
gaaaaaaagaggctctgatg

SEQ ID NO: 114700 - DNA, 20 bp, Artificial Sequence
  Description of Artificial Sequence: Synthetic oligonucleotide
  Target: ATXN1; (+) strand; PAM type: NRG; PAM sequence: TAG
tctgatgtagatcaaacatg

SEQ ID NO: 114701 - DNA, 20 bp, Artificial Sequence
  Description of Artificial Sequence: Synthetic oligonucleotide
  Target: ATXN1; (+) strand; PAM type: NRG; PAM sequence: AAG
gctgttaaaatatgctttcc

SEQ ID NO: 114702 - DNA, 20 bp, Artificial Sequence
  Description of Artificial Sequence: Synthetic oligonucleotide
  Target: ATXN1; (+) strand; PAM type: NRG; PAM sequence: TGG
taaaatatgctttccaagtt

SEQ ID NO: 114703 - DNA, 20 bp, Artificial Sequence
  Description of Artificial Sequence: Synthetic oligonucleotide
  Target: ATXN1; (+) strand; PAM type: NRG; PAM sequence: AAG
aatatgctttccaagtttgg

SEQ ID NO: 114704 - DNA, 20 bp, Artificial Sequence
  Description of Artificial Sequence: Synthetic oligonucleotide
  Target: ATXN1; (+) strand; PAM type: NRG; PAM sequence: CGG
ctttccaagtttggaagatg

SEQ ID NO: 114705 - DNA, 20 bp, Artificial Sequence
  Description of Artificial Sequence: Synthetic oligonucleotide
  Target: ATXN1; (+) strand; PAM type: NRG; PAM sequence: GAG
ttccaagtttggaagatgcg

SEQ ID NO: 114706 - DNA, 20 bp, Artificial Sequence
  Description of Artificial Sequence: Synthetic oligonucleotide
  Target: ATXN1; (+) strand; PAM type: NRG; PAM sequence: AGG
tccaagtttggaagatgcgg

SEQ ID NO: 114707 - DNA, 20 bp, Artificial Sequence
  Description of Artificial Sequence: Synthetic oligonucleotide
  Target: ATXN1; (+) strand; PAM type: NRG; PAM sequence: AAG
atgcatgtctgtgcacacat

SEQ ID NO: 114708 - DNA, 20 bp, Artificial Sequence
  Description of Artificial Sequence: Synthetic oligonucleotide
  Target: ATXN1; (+) strand; PAM type: NRG; PAM sequence: TAG
tttttttttttgcaatgatc

SEQ ID NO: 114709 - DNA, 20 bp, Artificial Sequence
  Description of Artificial Sequence: Synthetic oligonucleotide
  Target: ATXN1; (+) strand; PAM type: NRG; PAM sequence: AAG
ttttttttgcaatgatctag

SEQ ID NO: 114710 - DNA, 20 bp, Artificial Sequence
  Description of Artificial Sequence: Synthetic oligonucleotide
  Target: ATXN1; (+) strand; PAM type: NRG; PAM sequence: AAG
tttttgcaatgatctagaag

SEQ ID NO: 114711 - DNA, 20 bp, Artificial Sequence
  Description of Artificial Sequence: Synthetic oligonucleotide
  Target: ATXN1; (+) strand; PAM type: NRG; PAM sequence: CAG
ttgcaatgatctagaagaag

SEQ ID NO: 114712 - DNA, 20 bp, Artificial Sequence
  Description of Artificial Sequence: Synthetic oligonucleotide
  Target: ATXN1; (+) strand; PAM type: NRG; PAM sequence: GAG
gcaatgatctagaagaagca

SEQ ID NO: 114713 - DNA, 20 bp, Artificial Sequence
  Description of Artificial Sequence: Synthetic oligonucleotide
  Target: ATXN1; (+) strand; PAM type: NRG; PAM sequence: AAG
acatttgcttataaactatg

SEQ ID NO: 114714 - DNA, 20 bp, Artificial Sequence
  Description of Artificial Sequence: Synthetic oligonucleotide
  Target: ATXN1; (+) strand; PAM type: NRG; PAM sequence: AGG
catttgcttataaactatga

SEQ ID NO: 114715 - DNA, 20 bp, Artificial Sequence
  Description of Artificial Sequence: Synthetic oligonucleotide
  Target: ATXN1; (+) strand; PAM type: NRG; PAM sequence: GGG
atttgcttataaactatgaa

SEQ ID NO: 114716 - DNA, 20 bp, Artificial Sequence
  Description of Artificial Sequence: Synthetic oligonucleotide
  Target: ATXN1; (+) strand; PAM type: NRG; PAM sequence: CAG
aactatgaagggcttgaacc

SEQ ID NO: 114717 - DNA, 20 bp, Artificial Sequence
  Description of Artificial Sequence: Synthetic oligonucleotide
  Target: ATXN1; (+) strand; PAM type: NRG; PAM sequence: GAG
agggcttgaacccagccact

SEQ ID NO: 114718 - DNA, 20 bp, Artificial Sequence
  Description of Artificial Sequence: Synthetic oligonucleotide
  Target: ATXN1; (+) strand; PAM type: NRG; PAM sequence: TGG
tactcacaatgaaatctgca

SEQ ID NO: 114719 - DNA, 20 bp, Artificial Sequence
  Description of Artificial Sequence: Synthetic oligonucleotide
  Target: ATXN1; (+) strand; PAM type: NRG; PAM sequence: AAG
tcacaatgaaatctgcatgg

SEQ ID NO: 114720 - DNA, 20 bp, Artificial Sequence
  Description of Artificial Sequence: Synthetic oligonucleotide
  Target: ATXN1; (+) strand; PAM type: NRG; PAM sequence: TGG
catggaagcctgccaatgtc

SEQ ID NO: 114721 - DNA, 20 bp, Artificial Sequence
  Description of Artificial Sequence: Synthetic oligonucleotide
  Target: ATXN1; (+) strand; PAM type: NRG; PAM sequence: GGG
atggaagcctgccaatgtct

SEQ ID NO: 114722 - DNA, 20 bp, Artificial Sequence
  Description of Artificial Sequence: Synthetic oligonucleotide
  Target: ATXN1; (+) strand; PAM type: NRG; PAM sequence: AAG
ggctgacattcaaacattcc

SEQ ID NO: 114723 - DNA, 20 bp, Artificial Sequence
  Description of Artificial Sequence: Synthetic oligonucleotide
  Target: ATXN1; (+) strand; PAM type: NRG; PAM sequence: GAG
taaaactcttgatattttct

SEQ ID NO: 114724 - DNA, 20 bp, Artificial Sequence
  Description of Artificial Sequence: Synthetic oligonucleotide
  Target: ATXN1; (+) strand; PAM type: NRG; PAM sequence: AGG
aaaactcttgatattttctg

SEQ ID NO: 114725 - DNA, 20 bp, Artificial Sequence
  Description of Artificial Sequence: Synthetic oligonucleotide
  Target: ATXN1; (+) strand; PAM type: NRG; PAM sequence: CAG
atattttctgaggcactaca

SEQ ID NO: 114726 - DNA, 20 bp, Artificial Sequence
  Description of Artificial Sequence: Synthetic oligonucleotide
  Target: ATXN1; (+) strand; PAM type: NRG; PAM sequence: CAG
acagttcaatcctcacctct

SEQ ID NO: 114727 - DNA, 20 bp, Artificial Sequence
  Description of Artificial Sequence: Synthetic oligonucleotide
  Target: ATXN1; (+) strand; PAM type: NRG; PAM sequence: CAG
tcaatcctcacctctcagtt

SEQ ID NO: 114728 - DNA, 20 bp, Artificial Sequence
  Description of Artificial Sequence: Synthetic oligonucleotide
  Target: ATXN1; (+) strand; PAM type: NRG; PAM sequence: GAG
aatcctcacctctcagttca

SEQ ID NO: 114729 - DNA, 20 bp, Artificial Sequence
  Description of Artificial Sequence: Synthetic oligonucleotide
  Target: ATXN1; (+) strand; PAM type: NRG; PAM sequence: CAG
ctcagttcagagtgaatata

SEQ ID NO: 114730 - DNA, 20 bp, Artificial Sequence
  Description of Artificial Sequence: Synthetic oligonucleotide
  Target: ATXN1; (+) strand; PAM type: NRG; PAM sequence: AAG
acagcaataattctgcttga

SEQ ID NO: 114731 - DNA, 20 bp, Artificial Sequence
  Description of Artificial Sequence: Synthetic oligonucleotide
  Target: ATXN1; (+) strand; PAM type: NRG; PAM sequence: AAG
gcaataattctgcttgaaag

SEQ ID NO: 114732 - DNA, 20 bp, Artificial Sequence
  Description of Artificial Sequence: Synthetic oligonucleotide
  Target: ATXN1; (+) strand; PAM type: NRG; PAM sequence: AAG
ttctgcttgaaagaagtgca

SEQ ID NO: 114733 - DNA, 20 bp, Artificial Sequence
  Description of Artificial Sequence: Synthetic oligonucleotide
  Target: ATXN1; (+) strand; PAM type: NRG; PAM sequence: AAG
tgcttgaaagaagtgcaaag

SEQ ID NO: 114734 - DNA, 20 bp, Artificial Sequence
  Description of Artificial Sequence: Synthetic oligonucleotide
  Target: ATXN1; (+) strand; PAM type: NRG; PAM sequence: AGG
gcttgaaagaagtgcaaaga

SEQ ID NO: 114735 - DNA, 20 bp, Artificial Sequence
  Description of Artificial Sequence: Synthetic oligonucleotide
  Target: ATXN1; (+) strand; PAM type: NRG; PAM sequence: CAG
aaagaaggtcttttgctgtg

SEQ ID NO: 114736 - DNA, 20 bp, Artificial Sequence
  Description of Artificial Sequence: Synthetic oligonucleotide
  Target: ATXN1; (+) strand; PAM type: NRG; PAM sequence: TAG
gtcttttgctgtgcagcatg

SEQ ID NO: 114737 - DNA, 20 bp, Artificial Sequence
  Description of Artificial Sequence: Synthetic oligonucleotide
  Target: ATXN1; (+) strand; PAM type: NRG; PAM sequence: TAG
taccgcaacaatacaatgaa

SEQ ID NO: 114738 - DNA, 20 bp, Artificial Sequence
  Description of Artificial Sequence: Synthetic oligonucleotide
  Target: ATXN1; (+) strand; PAM type: NRG; PAM sequence: AGG
accgcaacaatacaatgaat

SEQ ID NO: 114739 - DNA, 20 bp, Artificial Sequence
  Description of Artificial Sequence: Synthetic oligonucleotide
  Target: ATXN1; (+) strand; PAM type: NRG; PAM sequence: TGG
acaatacaatgaataggtta

SEQ ID NO: 114740 - DNA, 20 bp, Artificial Sequence
  Description of Artificial Sequence: Synthetic oligonucleotide
  Target: ATXN1; (+) strand; PAM type: NRG; PAM sequence: GGG
caatacaatgaataggttat

SEQ ID NO: 114741 - DNA, 20 bp, Artificial Sequence
  Description of Artificial Sequence: Synthetic oligonucleotide
  Target: ATXN1; (+) strand; PAM type: NRG; PAM sequence: CAG
tattattttcctttgtgcat

SEQ ID NO: 114742 - DNA, 20 bp, Artificial Sequence
  Description of Artificial Sequence: Synthetic oligonucleotide
  Target: ATXN1; (+) strand; PAM type: NRG; PAM sequence: TAG
tttcctttgtgcatcagatc

SEQ ID NO: 114743 - DNA, 20 bp, Artificial Sequence
  Description of Artificial Sequence: Synthetic oligonucleotide
  Target: ATXN1; (+) strand; PAM type: NRG; PAM sequence: CAG
ttgtgcatcagatctagaaa

SEQ ID NO: 114744 - DNA, 20 bp, Artificial Sequence
  Description of Artificial Sequence: Synthetic oligonucleotide
  Target: ATXN1; (+) strand; PAM type: NRG; PAM sequence: AGG
tgtgcatcagatctagaaac

SEQ ID NO: 114745 - DNA, 20 bp, Artificial Sequence
  Description of Artificial Sequence: Synthetic oligonucleotide
  Target: ATXN1; (+) strand; PAM type: NRG; PAM sequence: GGG
gtgcatcagatctagaaaca

SEQ ID NO: 114746 - DNA, 20 bp, Artificial Sequence
  Description of Artificial Sequence: Synthetic oligonucleotide
  Target: ATXN1; (+) strand; PAM type: NRG; PAM sequence: GAG
atcagatctagaaacagggt

SEQ ID NO: 114747 - DNA, 20 bp, Artificial Sequence
  Description of Artificial Sequence: Synthetic oligonucleotide
  Target: ATXN1; (+) strand; PAM type: NRG; PAM sequence: AAG
atctagaaacagggtgagaa

SEQ ID NO: 114748 - DNA, 20 bp, Artificial Sequence
  Description of Artificial Sequence: Synthetic oligonucleotide
  Target: ATXN1; (+) strand; PAM type: NRG; PAM sequence: AAG
tagaaacagggtgagaaaag

SEQ ID NO: 114749 - DNA, 20 bp, Artificial Sequence
  Description of Artificial Sequence: Synthetic oligonucleotide
  Target: ATXN1; (+) strand; PAM type: NRG; PAM sequence: AGG
agaaacagggtgagaaaaga

SEQ ID NO: 114750 - DNA, 20 bp, Artificial Sequence
  Description of Artificial Sequence: Synthetic oligonucleotide
  Target: ATXN1; (+) strand; PAM type: NRG; PAM sequence: AAG
agggtgagaaaagaaggttg

SEQ ID NO: 114751 - DNA, 20 bp, Artificial Sequence
  Description of Artificial Sequence: Synthetic oligonucleotide
  Target: ATXN1; (+) strand; PAM type: NRG; PAM sequence: TAG
atctataaatatttaaatat

SEQ ID NO: 114752 - DNA, 20 bp, Artificial Sequence
  Description of Artificial Sequence: Synthetic oligonucleotide
  Target: ATXN1; (+) strand; PAM type: NRG; PAM sequence: TAG
atatttaaatattagttaca

SEQ ID NO: 114753 - DNA, 20 bp, Artificial Sequence
  Description of Artificial Sequence: Synthetic oligonucleotide
  Target: ATXN1; (+) strand; PAM type: NRG; PAM sequence: TAG
tttaaatattagttacatag

SEQ ID NO: 114754 - DNA, 20 bp, Artificial Sequence
  Description of Artificial Sequence: Synthetic oligonucleotide
  Target: ATXN1; (+) strand; PAM type: NRG; PAM sequence: TAG
acatagtagacaatgtccta

SEQ ID NO: 114755 - DNA, 20 bp, Artificial Sequence
  Description of Artificial Sequence: Synthetic oligonucleotide
  Target: ATXN1; (+) strand; PAM type: NRG; PAM sequence: TGG
tgtcctatagccatgcttta

SEQ ID NO: 114756 - DNA, 20 bp, Artificial Sequence
  Description of Artificial Sequence: Synthetic oligonucleotide
  Target: ATXN1; (+) strand; PAM type: NRG; PAM sequence: AAG
tagccatgctttatggaata

SEQ ID NO: 114757 - DNA, 20 bp, Artificial Sequence
  Description of Artificial Sequence: Synthetic oligonucleotide
  Target: ATXN1; (+) strand; PAM type: NRG; PAM sequence: TAG
atgctttatggaataaagca

SEQ ID NO: 114758 - DNA, 20 bp, Artificial Sequence
  Description of Artificial Sequence: Synthetic oligonucleotide
  Target: ATXN1; (+) strand; PAM type: NRG; PAM sequence: TGG
agaatcttttgcatttcatg

SEQ ID NO: 114759 - DNA, 20 bp, Artificial Sequence
  Description of Artificial Sequence: Synthetic oligonucleotide
  Target: ATXN1; (+) strand; PAM type: NRG; PAM sequence: GAG
ttgcatttcatgtggcatct

SEQ ID NO: 114760 - DNA, 20 bp, Artificial Sequence
  Description of Artificial Sequence: Synthetic oligonucleotide
  Target: ATXN1; (+) strand; PAM type: NRG; PAM sequence: TAG
agtacattatctactgctac

SEQ ID NO: 114761 - DNA, 20 bp, Artificial Sequence
  Description of Artificial Sequence: Synthetic oligonucleotide
  Target: ATXN1; (+) strand; PAM type: NRG; PAM sequence: TAG
tatctactgctactagttat

SEQ ID NO: 114762 - DNA, 20 bp, Artificial Sequence
  Description of Artificial Sequence: Synthetic oligonucleotide
  Target: ATXN1; (+) strand; PAM type: NRG; PAM sequence: CAG
tgctactagttattagttca

SEQ ID NO: 114763 - DNA, 20 bp, Artificial Sequence
  Description of Artificial Sequence: Synthetic oligonucleotide
  Target: ATXN1; (+) strand; PAM type: NRG; PAM sequence: AAG
tattagttcacagctctgcc

SEQ ID NO: 114764 - DNA, 20 bp, Artificial Sequence
  Description of Artificial Sequence: Synthetic oligonucleotide
  Target: ATXN1; (+) strand; PAM type: NRG; PAM sequence: GAG
ttagttcacagctctgccaa

SEQ ID NO: 114765 - DNA, 20 bp, Artificial Sequence
  Description of Artificial Sequence: Synthetic oligonucleotide
  Target: ATXN1; (+) strand; PAM type: NRG; PAM sequence: AGG
tagttcacagctctgccaag

SEQ ID NO: 114766 - DNA, 20 bp, Artificial Sequence
  Description of Artificial Sequence: Synthetic oligonucleotide
  Target: ATXN1; (+) strand; PAM type: NRG; PAM sequence: TGG
cagctctgccaagaggtaat

SEQ ID NO: 114767 - DNA, 20 bp, Artificial Sequence
  Description of Artificial Sequence: Synthetic oligonucleotide
  Target: ATXN1; (+) strand; PAM type: NRG; PAM sequence: TGG
accttctgaatacttctttt

SEQ ID NO: 114768 - DNA, 20 bp, Artificial Sequence
  Description of Artificial Sequence: Synthetic oligonucleotide
  Target: ATXN1; (+) strand; PAM type: NRG; PAM sequence: GGG
ccttctgaatacttcttttt

SEQ ID NO: 114769 - DNA, 20 bp, Artificial Sequence
  Description of Artificial Sequence: Synthetic oligonucleotide
  Target: ATXN1; (+) strand; PAM type: NRG; PAM sequence: TAG
atacttctttttgggaactt

SEQ ID NO: 114770 - DNA, 20 bp, Artificial Sequence
  Description of Artificial Sequence: Synthetic oligonucleotide
  Target: ATXN1; (+) strand; PAM type: NRG; PAM sequence: TAG
tttgggaactttagcacaat

SEQ ID NO: 114771 - DNA, 20 bp, Artificial Sequence
  Description of Artificial Sequence: Synthetic oligonucleotide
  Target: ATXN1; (+) strand; PAM type: NRG; PAM sequence: TGG
ctgatacctcaaatttcacc

SEQ ID NO: 114772 - DNA, 20 bp, Artificial Sequence
  Description of Artificial Sequence: Synthetic oligonucleotide
  Target: ATXN1; (+) strand; PAM type: NRG; PAM sequence: CAG
aaatttcacctggaccgcaa

SEQ ID NO: 114773 - DNA, 20 bp, Artificial Sequence
  Description of Artificial Sequence: Synthetic oligonucleotide
  Target: ATXN1; (+) strand; PAM type: NRG; PAM sequence: CAG
cacctggaccgcaacagaaa

SEQ ID NO: 114774 - DNA, 20 bp, Artificial Sequence
  Description of Artificial Sequence: Synthetic oligonucleotide
  Target: ATXN1; (+) strand; PAM type: NRG; PAM sequence: TAG
caacattaaattaaatttta

SEQ ID NO: 114775 - DNA, 20 bp, Artificial Sequence
  Description of Artificial Sequence: Synthetic oligonucleotide
  Target: ATXN1; (+) strand; PAM type: NRG; PAM sequence: TGG
aaattaaattttatagttgt

SEQ ID NO: 114776 - DNA, 20 bp, Artificial Sequence
  Description of Artificial Sequence: Synthetic oligonucleotide
  Target: ATXN1; (+) strand; PAM type: NRG; PAM sequence: AAG
attttatagttgttggcttt

SEQ ID NO: 114777 - DNA, 20 bp, Artificial Sequence
  Description of Artificial Sequence: Synthetic oligonucleotide
  Target: ATXN1; (+) strand; PAM type: NRG; PAM sequence: AGG
ttttatagttgttggcttta

SEQ ID NO: 114778 - DNA, 20 bp, Artificial Sequence
  Description of Artificial Sequence: Synthetic oligonucleotide
  Target: ATXN1; (+) strand; PAM type: NRG; PAM sequence: GAG
ttatagttgttggctttaag

SEQ ID NO: 114779 - DNA, 20 bp, Artificial Sequence
  Description of Artificial Sequence: Synthetic oligonucleotide
  Target: ATXN1; (+) strand; PAM type: NRG; PAM sequence: AGG
tatagttgttggctttaagg

SEQ ID NO: 114780 - DNA, 20 bp, Artificial Sequence
  Description of Artificial Sequence: Synthetic oligonucleotide
  Target: ATXN1; (+) strand; PAM type: NRG; PAM sequence: AAG
ttgttggctttaaggaggat

SEQ ID NO: 114781 - DNA, 20 bp, Artificial Sequence
  Description of Artificial Sequence: Synthetic oligonucleotide
  Target: ATXN1; (+) strand; PAM type: NRG; PAM sequence: AAG
ttggctttaaggaggataag

SEQ ID NO: 114782 - DNA, 20 bp, Artificial Sequence
  Description of Artificial Sequence: Synthetic oligonucleotide
  Target: ATXN1; (+) strand; PAM type: NRG; PAM sequence: GAG
taaggaggataagaagaact

SEQ ID NO: 114783 - DNA, 20 bp, Artificial Sequence
  Description of Artificial Sequence: Synthetic oligonucleotide
  Target: ATXN1; (+) strand; PAM type: NRG; PAM sequence: AAG
taagaagaactgagtgctcc

SEQ ID NO: 114784 - DNA, 20 bp, Artificial Sequence
  Description of Artificial Sequence: Synthetic oligonucleotide
  Target: ATXN1; (+) strand; PAM type: NRG; PAM sequence: AGG
aagaagaactgagtgctcca

SEQ ID NO: 114785 - DNA, 20 bp, Artificial Sequence
  Description of Artificial Sequence: Synthetic oligonucleotide
  Target: ATXN1; (+) strand; PAM type: NRG; PAM sequence: GAG
gaagaactgagtgctccaag

SEQ ID NO: 114786 - DNA, 20 bp, Artificial Sequence
  Description of Artificial Sequence: Synthetic oligonucleotide
  Target: ATXN1; (+) strand; PAM type: NRG; PAM sequence: TAG
tgagtgctccaaggagattt

SEQ ID NO: 114787 - DNA, 20 bp, Artificial Sequence
  Description of Artificial Sequence: Synthetic oligonucleotide
  Target: ATXN1; (+) strand; PAM type: NRG; PAM sequence: GAG
agtgctccaaggagatttta

SEQ ID NO: 114788 - DNA, 20 bp, Artificial Sequence
  Description of Artificial Sequence: Synthetic oligonucleotide
  Target: ATXN1; (+) strand; PAM type: NRG; PAM sequence: AGG
gtgctccaaggagattttag

SEQ ID NO: 114789 - DNA, 20 bp, Artificial Sequence
  Description of Artificial Sequence: Synthetic oligonucleotide
  Target: ATXN1; (+) strand; PAM type: NRG; PAM sequence: TGG
ctccaaggagattttagagg

SEQ ID NO: 114790 - DNA, 20 bp, Artificial Sequence
  Description of Artificial Sequence: Synthetic oligonucleotide
  Target: ATXN1; (+) strand; PAM type: NRG; PAM sequence: GGG
tccaaggagattttagaggt

SEQ ID NO: 114791 - DNA, 20 bp, Artificial Sequence
  Description of Artificial Sequence: Synthetic oligonucleotide
  Target: ATXN1; (+) strand; PAM type: NRG; PAM sequence: CAG
ttttagaggtgggcaaaaaa

SEQ ID NO: 114792 - DNA, 20 bp, Artificial Sequence
  Description of Artificial Sequence: Synthetic oligonucleotide
  Target: ATXN1; (+) strand; PAM type: NRG; PAM sequence: AAG
aaacagcaacctgcccctac

SEQ ID NO: 114793 - DNA, 20 bp, Artificial Sequence
  Description of Artificial Sequence: Synthetic oligonucleotide
  Target: ATXN1; (+) strand; PAM type: NRG; PAM sequence: AAG
gcaacctgcccctacaagca

SEQ ID NO: 114794 - DNA, 20 bp, Artificial Sequence
  Description of Artificial Sequence: Synthetic oligonucleotide
  Target: ATXN1; (+) strand; PAM type: NRG; PAM sequence: GAG
aacctgcccctacaagcaaa

SEQ ID NO: 114795 - DNA, 20 bp, Artificial Sequence
  Description of Artificial Sequence: Synthetic oligonucleotide
  Target: ATXN1; (+) strand; PAM type: NRG; PAM sequence: GAG
cctgcccctacaagcaaaga

SEQ ID NO: 114796 - DNA, 20 bp, Artificial Sequence
  Description of Artificial Sequence: Synthetic oligonucleotide
  Target: ATXN1; (+) strand; PAM type: NRG; PAM sequence: TGG
gcaaagagagatgtccctcc

SEQ ID NO: 114797 - DNA, 20 bp, Artificial Sequence
  Description of Artificial Sequence: Synthetic oligonucleotide
  Target: ATXN1; (+) strand; PAM type: NRG; PAM sequence: AAG
gagagatgtccctcctggtt

SEQ ID NO: 114798 - DNA, 20 bp, Artificial Sequence
  Description of Artificial Sequence: Synthetic oligonucleotide
  Target: ATXN1; (+) strand; PAM type: NRG; PAM sequence: CAG
aagcacccctttgtcacgtg

SEQ ID NO: 114799 - DNA, 20 bp, Artificial Sequence
  Description of Artificial Sequence: Synthetic oligonucleotide
  Target: ATXN1; (+) strand; PAM type: NRG; PAM sequence: CAG
cccctttgtcacgtgcagcc

SEQ ID NO: 114800 - DNA, 20 bp, Artificial Sequence
  Description of Artificial Sequence: Synthetic oligonucleotide
  Target: ATXN1; (+) strand; PAM type: NRG; PAM sequence: GAG
cctttgtcacgtgcagccca

SEQ ID NO: 114801 - DNA, 20 bp, Artificial Sequence
  Description of Artificial Sequence: Synthetic oligonucleotide
  Target: ATXN1; (+) strand; PAM type: NRG; PAM sequence: AGG
ctttgtcacgtgcagcccag

SEQ ID NO: 114802 - DNA, 20 bp, Artificial Sequence
  Description of Artificial Sequence: Synthetic oligonucleotide
  Target: ATXN1; (+) strand; PAM type: NRG; PAM sequence: AAG
tgtcacgtgcagcccagagg

SEQ ID NO: 114803 - DNA, 20 bp, Artificial Sequence
  Description of Artificial Sequence: Synthetic oligonucleotide
  Target: ATXN1; (+) strand; PAM type: NRG; PAM sequence: AAG
gcccagaggaagttgtgata

SEQ ID NO: 114804 - DNA, 20 bp, Artificial Sequence
  Description of Artificial Sequence: Synthetic oligonucleotide
  Target: ATXN1; (+) strand; PAM type: NRG; PAM sequence: AAG
tgtgataaagcatcatttga

SEQ ID NO: 114805 - DNA, 20 bp, Artificial Sequence
  Description of Artificial Sequence: Synthetic oligonucleotide
  Target: ATXN1; (+) strand; PAM type: NRG; PAM sequence: TGG
tttgaaagttttaatgccgt

SEQ ID NO: 114806 - DNA, 20 bp, Artificial Sequence
  Description of Artificial Sequence: Synthetic oligonucleotide
  Target: ATXN1; (+) strand; PAM type: NRG; PAM sequence: GGG
ttgaaagttttaatgccgtt

SEQ ID NO: 114807 - DNA, 20 bp, Artificial Sequence
  Description of Artificial Sequence: Synthetic oligonucleotide
  Target: ATXN1; (+) strand; PAM type: NRG; PAM sequence: GGG
tgaaagttttaatgccgttg

SEQ ID NO: 114808 - DNA, 20 bp, Artificial Sequence
  Description of Artificial Sequence: Synthetic oligonucleotide
  Target: ATXN1; (+) strand; PAM type: NRG; PAM sequence: AAG
tttaatgccgttggggctac

SEQ ID NO: 114809 - DNA, 20 bp, Artificial Sequence
  Description of Artificial Sequence: Synthetic oligonucleotide
  Target: ATXN1; (+) strand; PAM type: NRG; PAM sequence: TGG
ctacaagcacattgtcttga

SEQ ID NO: 114810 - DNA, 20 bp, Artificial Sequence
  Description of Artificial Sequence: Synthetic oligonucleotide
  Target: ATXN1; (+) strand; PAM type: NRG; PAM sequence: CAG
cacattgtcttgatggaatt

SEQ ID NO: 114811 - DNA, 20 bp, Artificial Sequence
  Description of Artificial Sequence: Synthetic oligonucleotide
  Target: ATXN1; (+) strand; PAM type: NRG; PAM sequence: CAG
cttgatggaattcagctgta

SEQ ID NO: 114812 - DNA, 20 bp, Artificial Sequence
  Description of Artificial Sequence: Synthetic oligonucleotide
  Target: ATXN1; (+) strand; PAM type: NRG; PAM sequence: CAG
ttaaattcctttaactgtga

SEQ ID NO: 114813 - DNA, 20 bp, Artificial Sequence
  Description of Artificial Sequence: Synthetic oligonucleotide
  Target: ATXN1; (+) strand; PAM type: NRG; PAM sequence: AGG
taaattcctttaactgtgac

SEQ ID NO: 114814 - DNA, 20 bp, Artificial Sequence
  Description of Artificial Sequence: Synthetic oligonucleotide
  Target: ATXN1; (+) strand; PAM type: NRG; PAM sequence: CAG
attcctttaactgtgacagg

SEQ ID NO: 114815 - DNA, 20 bp, Artificial Sequence
  Description of Artificial Sequence: Synthetic oligonucleotide
  Target: ATXN1; (+) strand; PAM type: NRG; PAM sequence: CAG
tgacaggcagcatgatgaaa

SEQ ID NO: 114816 - DNA, 20 bp, Artificial Sequence
  Description of Artificial Sequence: Synthetic oligonucleotide
  Target: ATXN1; (+) strand; PAM type: NRG; PAM sequence: AGG
gacaggcagcatgatgaaac

SEQ ID NO: 114817 - DNA, 20 bp, Artificial Sequence
  Description of Artificial Sequence: Synthetic oligonucleotide
  Target: ATXN1; (+) strand; PAM type: NRG; PAM sequence: AAG
catgatgaaacaggtgcatt

SEQ ID NO: 114818 - DNA, 20 bp, Artificial Sequence
  Description of Artificial Sequence: Synthetic oligonucleotide
  Target: ATXN1; (+) strand; PAM type: NRG; PAM sequence: CAG
ggtgcattaagtgcatgaaa

SEQ ID NO: 114819 - DNA, 20 bp, Artificial Sequence
  Description of Artificial Sequence: Synthetic oligonucleotide
  Target: ATXN1; (+) strand; PAM type: NRG; PAM sequence: AAG
aagtgcatgaaacagaacaa

SEQ ID NO: 114820 - DNA, 20 bp, Artificial Sequence
  Description of Artificial Sequence: Synthetic oligonucleotide
  Target: ATXN1; (+) strand; PAM type: NRG; PAM sequence: AAG
gcatgaaacagaacaaaagt

SEQ ID NO: 114821 - DNA, 20 bp, Artificial Sequence
  Description of Artificial Sequence: Synthetic oligonucleotide
  Target: ATXN1; (+) strand; PAM type: NRG; PAM sequence: AAG
aaacagaacaaaagtaagaa

SEQ ID NO: 114822 - DNA, 20 bp, Artificial Sequence
  Description of Artificial Sequence: Synthetic oligonucleotide
  Target: ATXN1; (+) strand; PAM type: NRG; PAM sequence: AAG
aaaagtaagaaaagtgctca

SEQ ID NO: 114823 - DNA, 20 bp, Artificial Sequence
  Description of Artificial Sequence: Synthetic oligonucleotide
  Target: ATXN1; (+) strand; PAM type: NRG; PAM sequence: AGG
aaagtaagaaaagtgctcaa

SEQ ID NO: 114824 - DNA, 20 bp, Artificial Sequence
  Description of Artificial Sequence: Synthetic oligonucleotide
  Target: ATXN1; (+) strand; PAM type: NRG; PAM sequence: AAG
gtaagaaaagtgctcaaagg

SEQ ID NO: 114825 - DNA, 20 bp, Artificial Sequence
  Description of Artificial Sequence: Synthetic oligonucleotide
  Target: ATXN1; (+) strand; PAM type: NRG; PAM sequence: AGG
taagaaaagtgctcaaagga

SEQ ID NO: 114826 - DNA, 20 bp, Artificial Sequence
  Description of Artificial Sequence: Synthetic oligonucleotide
  Target: ATXN1; (+) strand; PAM type: NRG; PAM sequence: CAG
aaaagtgctcaaaggaaggc

SEQ ID NO: 114827 - DNA, 20 bp, Artificial Sequence
  Description of Artificial Sequence: Synthetic oligonucleotide
  Target: ATXN1; (+) strand; PAM type: NRG; PAM sequence: TAG
gctcaaaggaaggccagaaa

SEQ ID NO: 114828 - DNA, 20 bp, Artificial Sequence
  Description of Artificial Sequence: Synthetic oligonucleotide
  Target: ATXN1; (+) strand; PAM type: NRG; PAM sequence: AAG
aaggaaggccagaaatagtg

SEQ ID NO: 114829 - DNA, 20 bp, Artificial Sequence
  Description of Artificial Sequence: Synthetic oligonucleotide
  Target: ATXN1; (+) strand; PAM type: NRG; PAM sequence: CAG
aaggccagaaatagtgaagc

SEQ ID NO: 114830 - DNA, 20 bp, Artificial Sequence
  Description of Artificial Sequence: Synthetic oligonucleotide
  Target: ATXN1; (+) strand; PAM type: NRG; PAM sequence: GAG
ggccagaaatagtgaagcca

SEQ ID NO: 114831 - DNA, 20 bp, Artificial Sequence
  Description of Artificial Sequence: Synthetic oligonucleotide
  Target: ATXN1; (+) strand; PAM type: NRG; PAM sequence: CAG
aaatagtgaagccagagtga

SEQ ID NO: 114832 - DNA, 20 bp, Artificial Sequence
  Description of Artificial Sequence: Synthetic oligonucleotide
  Target: ATXN1; (+) strand; PAM type: NRG; PAM sequence: CAG
gaagccagagtgacagtctg

SEQ ID NO: 114833 - DNA, 20 bp, Artificial Sequence
  Description of Artificial Sequence: Synthetic oligonucleotide
  Target: ATXN1; (+) strand; PAM type: NRG; PAM sequence: TGG
agagtgacagtctgcagacc

SEQ ID NO: 114834 - DNA, 20 bp, Artificial Sequence
  Description of Artificial Sequence: Synthetic oligonucleotide
  Target: ATXN1; (+) strand; PAM type: NRG; PAM sequence: GGG
gagtgacagtctgcagacct

SEQ ID NO: 114835 - DNA, 20 bp, Artificial Sequence
  Description of Artificial Sequence: Synthetic oligonucleotide
  Target: ATXN1; (+) strand; PAM type: NRG; PAM sequence: CAG
cagtctgcagacctgggtct

SEQ ID NO: 114836 - DNA, 20 bp, Artificial Sequence
  Description of Artificial Sequence: Synthetic oligonucleotide
  Target: ATXN1; (+) strand; PAM type: NRG; PAM sequence: CAG
tctgcagacctgggtctcag

SEQ ID NO: 114837 - DNA, 20 bp, Artificial Sequence
  Description of Artificial Sequence: Synthetic oligonucleotide
  Target: ATXN1; (+) strand; PAM type: NRG; PAM sequence: CAG
tgggtctcagcagctccgcc

SEQ ID NO: 114838 - DNA, 20 bp, Artificial Sequence
  Description of Artificial Sequence: Synthetic oligonucleotide
  Target: ATXN1; (+) strand; PAM type: NRG; PAM sequence: AGG
gggtctcagcagctccgccc

SEQ ID NO: 114839 - DNA, 20 bp, Artificial Sequence
  Description of Artificial Sequence: Synthetic oligonucleotide
  Target: ATXN1; (+) strand; PAM type: NRG; PAM sequence: GAG
gtctcagcagctccgcccag

SEQ ID NO: 114840 - DNA, 20 bp, Artificial Sequence
  Description of Artificial Sequence: Synthetic oligonucleotide
  Target: ATXN1; (+) strand; PAM type: NRG; PAM sequence: CGG
ctccgcccaggagttcctgc

SEQ ID NO: 114841 - DNA, 20 bp, Artificial Sequence
  Description of Artificial Sequence: Synthetic oligonucleotide
  Target: ATXN1; (+) strand; PAM type: NRG; PAM sequence: GAG
ccgcccaggagttcctgccg

SEQ ID NO: 114842 - DNA, 20 bp, Artificial Sequence
  Description of Artificial Sequence: Synthetic oligonucleotide
  Target: ATXN1; (+) strand; PAM type: NRG; PAM sequence: CAG
caggagttcctgccggagct

SEQ ID NO: 114843 - DNA, 20 bp, Artificial Sequence
  Description of Artificial Sequence: Synthetic oligonucleotide
  Target: ATXN1; (+) strand; PAM type: NRG; PAM sequence: AGG
aggagttcctgccggagctc

SEQ ID NO: 114844 - DNA, 20 bp, Artificial Sequence
  Description of Artificial Sequence: Synthetic oligonucleotide
  Target: ATXN1; (+) strand; PAM type: NRG; PAM sequence: GAG
gttcctgccggagctcaggc

SEQ ID NO: 114845 - DNA, 20 bp, Artificial Sequence
  Description of Artificial Sequence: Synthetic oligonucleotide
  Target: ATXN1; (+) strand; PAM type: NRG; PAM sequence: CGG
gccggagctcaggcgagcca

SEQ ID NO: 114846 - DNA, 20 bp, Artificial Sequence
  Description of Artificial Sequence: Synthetic oligonucleotide
  Target: ATXN1; (+) strand; PAM type: NRG; PAM sequence: CGG
agctcaggcgagccacggat

SEQ ID NO: 114847 - DNA, 20 bp, Artificial Sequence
  Description of Artificial Sequence: Synthetic oligonucleotide
  Target: ATXN1; (+) strand; PAM type: NRG; PAM sequence: GAG
tacctcctcacctgccaaac

SEQ ID NO: 114848 - DNA, 20 bp, Artificial Sequence
  Description of Artificial Sequence: Synthetic oligonucleotide
  Target: ATXN1; (+) strand; PAM type: NRG; PAM sequence: AGG
acctcctcacctgccaaacg

SEQ ID NO: 114849 - DNA, 20 bp, Artificial Sequence
  Description of Artificial Sequence: Synthetic oligonucleotide
  Target: ATXN1; (+) strand; PAM type: NRG; PAM sequence: GGG
cctcctcacctgccaaacga

SEQ ID NO: 114850 - DNA, 20 bp, Artificial Sequence
  Description of Artificial Sequence: Synthetic oligonucleotide
  Target: ATXN1; (+) strand; PAM type: NRG; PAM sequence: CAG
cacgacgcgtcctctaacct

SEQ ID NO: 114851 - DNA, 20 bp, Artificial Sequence
  Description of Artificial Sequence: Synthetic oligonucleotide
  Target: ATXN1; (+) strand; PAM type: NRG; PAM sequence: GAG
cgacgcgtcctctaacctca

SEQ ID NO: 114852 - DNA, 20 bp, Artificial Sequence
  Description of Artificial Sequence: Synthetic oligonucleotide
  Target: ATXN1; (+) strand; PAM type: NRG; PAM sequence: GAG
cagagaatttttgtgaaatt

SEQ ID NO: 114853 - DNA, 20 bp, Artificial Sequence
  Description of Artificial Sequence: Synthetic oligonucleotide
  Target: ATXN1; (+) strand; PAM type: NRG; PAM sequence: AAG
gaaattgagaaacttacaac

SEQ ID NO: 114854 - DNA, 20 bp, Artificial Sequence
  Description of Artificial Sequence: Synthetic oligonucleotide
  Target: ATXN1; (+) strand; PAM type: NRG; PAM sequence: CAG
agaaacttacaacaagcact

SEQ ID NO: 114855 - DNA, 20 bp, Artificial Sequence
  Description of Artificial Sequence: Synthetic oligonucleotide
  Target: ATXN1; (+) strand; PAM type: NRG; PAM sequence: TGG
caacaagcactcagcaaaca

SEQ ID NO: 114856 - DNA, 20 bp, Artificial Sequence
  Description of Artificial Sequence: Synthetic oligonucleotide
  Target: ATXN1; (+) strand; PAM type: NRG; PAM sequence: CAG
ataattcaatgtgcccaaat

SEQ ID NO: 114857 - DNA, 20 bp, Artificial Sequence
  Description of Artificial Sequence: Synthetic oligonucleotide
  Target: ATXN1; (+) strand; PAM type: NRG; PAM sequence: AAG
tgcccaaatcagactgaaac

SEQ ID NO: 114858 - DNA, 20 bp, Artificial Sequence
  Description of Artificial Sequence: Synthetic oligonucleotide
  Target: ATXN1; (+) strand; PAM type: NRG; PAM sequence: TGG
taatttgacaccatatgcta

SEQ ID NO: 114859 - DNA, 20 bp, Artificial Sequence
  Description of Artificial Sequence: Synthetic oligonucleotide
  Target: ATXN1; (+) strand; PAM type: NRG; PAM sequence: GGG
aatttgacaccatatgctat

SEQ ID NO: 114860 - DNA, 20 bp, Artificial Sequence
  Description of Artificial Sequence: Synthetic oligonucleotide
  Target: ATXN1; (+) strand; PAM type: NRG; PAM sequence: AAG
ctatgggttacattttccaa

SEQ ID NO: 114861 - DNA, 20 bp, Artificial Sequence
  Description of Artificial Sequence: Synthetic oligonucleotide
  Target: ATXN1; (+) strand; PAM type: NRG; PAM sequence: CGG
ttacattttccaaaagcctt

SEQ ID NO: 114862 - DNA, 20 bp, Artificial Sequence
  Description of Artificial Sequence: Synthetic oligonucleotide
  Target: ATXN1; (+) strand; PAM type: NRG; PAM sequence: TGG
ttccaaaagccttcggaaat

SEQ ID NO: 114863 - DNA, 20 bp, Artificial Sequence
  Description of Artificial Sequence: Synthetic oligonucleotide
  Target: ATXN1; (+) strand; PAM type: NRG; PAM sequence: TGG
attggcatttataatatttg

SEQ ID NO: 114864 - DNA, 20 bp, Artificial Sequence
  Description of Artificial Sequence: Synthetic oligonucleotide
  Target: ATXN1; (+) strand; PAM type: NRG; PAM sequence: GGG
ttggcatttataatatttgt

SEQ ID NO: 114865 - DNA, 20 bp, Artificial Sequence
  Description of Artificial Sequence: Synthetic oligonucleotide
  Target: ATXN1; (+) strand; PAM type: NRG; PAM sequence: CAG
ggttcatccttctccatgta

SEQ ID NO: 114866 - DNA, 20 bp, Artificial Sequence
  Description of Artificial Sequence: Synthetic oligonucleotide
  Target: ATXN1; (+) strand; PAM type: NRG; PAM sequence: CAG
aacatgtgcacacatcaaaa

SEQ ID NO: 114867 - DNA, 20 bp, Artificial Sequence
  Description of Artificial Sequence: Synthetic oligonucleotide
  Target: ATXN1; (+) strand; PAM type: NRG; PAM sequence: CAG
tgcacacatcaaaacagacc

SEQ ID NO: 114868 - DNA, 20 bp, Artificial Sequence
  Description of Artificial Sequence: Synthetic oligonucleotide
  Target: ATXN1; (+) strand; PAM type: NRG; PAM sequence: AAG
acatcaaaacagacccagtt

SEQ ID NO: 114869 - DNA, 20 bp, Artificial Sequence
  Description of Artificial Sequence: Synthetic oligonucleotide
  Target: ATXN1; (+) strand; PAM type: NRG; PAM sequence: TAG
ccagttaagtcttaattatc

SEQ ID NO: 114870 - DNA, 20 bp, Artificial Sequence
  Description of Artificial Sequence: Synthetic oligonucleotide
  Target: ATXN1; (+) strand; PAM type: NRG; PAM sequence: TGG
gttaagtcttaattatctag

SEQ ID NO: 114871 - DNA, 20 bp, Artificial Sequence
  Description of Artificial Sequence: Synthetic oligonucleotide
  Target: ATXN1; (+) strand; PAM type: NRG; PAM sequence: AAG
aagtcttaattatctagtgg

SEQ ID NO: 114872 - DNA, 20 bp, Artificial Sequence
  Description of Artificial Sequence: Synthetic oligonucleotide
  Target: ATXN1; (+) strand; PAM type: NRG; PAM sequence: AAG
tatctagtggaagattatcc

SEQ ID NO: 114873 - DNA, 20 bp, Artificial Sequence
  Description of Artificial Sequence: Synthetic oligonucleotide
  Target: ATXN1; (+) strand; PAM type: NRG; PAM sequence: TAG
cttttcctgttgcccatttt

SEQ ID NO: 114874 - DNA, 20 bp, Artificial Sequence
  Description of Artificial Sequence: Synthetic oligonucleotide
  Target: ATXN1; (+) strand; PAM type: NRG; PAM sequence: TGG
tgcccatttttagccttttt

SEQ ID NO: 114875 - DNA, 20 bp, Artificial Sequence
  Description of Artificial Sequence: Synthetic oligonucleotide
  Target: ATXN1; (+) strand; PAM type: NRG; PAM sequence: AAG
tggcaattcctccactatta

SEQ ID NO: 114876 - DNA, 20 bp, Artificial Sequence
  Description of Artificial Sequence: Synthetic oligonucleotide
  Target: ATXN1; (+) strand; PAM type: NRG; PAM sequence: AAG
attcctccactattaaagaa

SEQ ID NO: 114877 - DNA, 20 bp, Artificial Sequence
  Description of Artificial Sequence: Synthetic oligonucleotide
  Target: ATXN1; (+) strand; PAM type: NRG; PAM sequence: GAG
tcctccactattaaagaaaa

SEQ ID NO: 114878 - DNA, 20 bp, Artificial Sequence
  Description of Artificial Sequence: Synthetic oligonucleotide
  Target: ATXN1; (+) strand; PAM type: NRG; PAM sequence: TGG
ccactattaaagaaaagaga

SEQ ID NO: 114879 - DNA, 20 bp, Artificial Sequence
  Description of Artificial Sequence: Synthetic oligonucleotide
  Target: ATXN1; (+) strand; PAM type: NRG; PAM sequence: CAG
ttcaattatctgtgctacct

SEQ ID NO: 114880 - DNA, 20 bp, Artificial Sequence
  Description of Artificial Sequence: Synthetic oligonucleotide
  Target: ATXN1; (+) strand; PAM type: NRG; PAM sequence: TGG
tgtgctacctcagcctccgt

SEQ ID NO: 114881 - DNA, 20 bp, Artificial Sequence
  Description of Artificial Sequence: Synthetic oligonucleotide
  Target: ATXN1; (+) strand; PAM type: NRG; PAM sequence: TGG
tacctcagcctccgttggca

SEQ ID NO: 114882 - DNA, 20 bp, Artificial Sequence
  Description of Artificial Sequence: Synthetic oligonucleotide
  Target: ATXN1; (+) strand; PAM type: NRG; PAM sequence: TGG
tcagcctccgttggcatgga

SEQ ID NO: 114883 - DNA, 20 bp, Artificial Sequence
  Description of Artificial Sequence: Synthetic oligonucleotide
  Target: ATXN1; (+) strand; PAM type: NRG; PAM sequence: GGG
cagcctccgttggcatggat

SEQ ID NO: 114884 - DNA, 20 bp, Artificial Sequence
  Description of Artificial Sequence: Synthetic oligonucleotide
  Target: ATXN1; (+) strand; PAM type: NRG; PAM sequence: GAG
ctccgttggcatggatgggc

SEQ ID NO: 114885 - DNA, 20 bp, Artificial Sequence
  Description of Artificial Sequence: Synthetic oligonucleotide
  Target: ATXN1; (+) strand; PAM type: NRG; PAM sequence: AGG
tccgttggcatggatgggcg

SEQ ID NO: 114886 - DNA, 20 bp, Artificial Sequence
  Description of Artificial Sequence: Synthetic oligonucleotide
  Target: ATXN1; (+) strand; PAM type: NRG; PAM sequence: GAG
cgttggcatggatgggcgag

SEQ ID NO: 114887 - DNA, 20 bp, Artificial Sequence
  Description of Artificial Sequence: Synthetic oligonucleotide
  Target: ATXN1; (+) strand; PAM type: NRG; PAM sequence: AGG
gttggcatggatgggcgagg

SEQ ID NO: 114888 - DNA, 20 bp, Artificial Sequence
  Description of Artificial Sequence: Synthetic oligonucleotide
  Target: ATXN1; (+) strand; PAM type: NRG; PAM sequence: CAG
ggaggtgctatctttgtcct

SEQ ID NO: 114889 - DNA, 20 bp, Artificial Sequence
  Description of Artificial Sequence: Synthetic oligonucleotide
  Target: ATXN1; (+) strand; PAM type: NRG; PAM sequence: TGG
gctatctttgtcctcagaat

SEQ ID NO: 114890 - DNA, 20 bp, Artificial Sequence
  Description of Artificial Sequence: Synthetic oligonucleotide
  Target: ATXN1; (+) strand; PAM type: NRG; PAM sequence: TGG
tctttgtcctcagaattgga

SEQ ID NO: 114891 - DNA, 20 bp, Artificial Sequence
  Description of Artificial Sequence: Synthetic oligonucleotide
  Target: ATXN1; (+) strand; PAM type: NRG; PAM sequence: TGG
aaaacattcatctgtgttat

SEQ ID NO: 114892 - DNA, 20 bp, Artificial Sequence
  Description of Artificial Sequence: Synthetic oligonucleotide
  Target: ATXN1; (+) strand; PAM type: NRG; PAM sequence: GGG
aaacattcatctgtgttatt

SEQ ID NO: 114893 - DNA, 20 bp, Artificial Sequence
  Description of Artificial Sequence: Synthetic oligonucleotide
  Target: ATXN1; (+) strand; PAM type: NRG; PAM sequence: TGG
ctaaaactttgcttactgaa

SEQ ID NO: 114894 - DNA, 20 bp, Artificial Sequence
  Description of Artificial Sequence: Synthetic oligonucleotide
  Target: ATXN1; (+) strand; PAM type: NRG; PAM sequence: GAG
tactgaatggaaatgttcct

SEQ ID NO: 114895 - DNA, 20 bp, Artificial Sequence
  Description of Artificial Sequence: Synthetic oligonucleotide
  Target: ATXN1; (+) strand; PAM type: NRG; PAM sequence: TGG
gttcctgagatctgtttatt

SEQ ID NO: 114896 - DNA, 20 bp, Artificial Sequence
  Description of Artificial Sequence: Synthetic oligonucleotide
  Target: ATXN1; (+) strand; PAM type: NRG; PAM sequence: TAG
tatgtacctcccttttaaaa

SEQ ID NO: 114897 - DNA, 20 bp, Artificial Sequence
  Description of Artificial Sequence: Synthetic oligonucleotide
  Target: ATXN1; (+) strand; PAM type: NRG; PAM sequence: GAG
tgtacctcccttttaaaata

SEQ ID NO: 114898 - DNA, 20 bp, Artificial Sequence
  Description of Artificial Sequence: Synthetic oligonucleotide
  Target: ATXN1; (+) strand; PAM type: NRG; PAM sequence: CAG
ttaatgtttctttgatgact

SEQ ID NO: 114899 - DNA, 20 bp, Artificial Sequence
  Description of Artificial Sequence: Synthetic oligonucleotide
  Target: ATXN1; (+) strand; PAM type: NRG; PAM sequence: CGG
gatgactcagtgtgtattat

SEQ ID NO: 114900 - DNA, 20 bp, Artificial Sequence
  Description of Artificial Sequence: Synthetic oligonucleotide
  Target: ATXN1; (+) strand; PAM type: NRG; PAM sequence: CAG
tcagtgtgtattatcggtaa

SEQ ID NO: 114901 - DNA, 20 bp, Artificial Sequence
  Description of Artificial Sequence: Synthetic oligonucleotide
  Target: ATXN1; (+) strand; PAM type: NRG; PAM sequence: CAG
catgatgttgccataccaca

SEQ ID NO: 114902 - DNA, 20 bp, Artificial Sequence
  Description of Artificial Sequence: Synthetic oligonucleotide
  Target: ATXN1; (+) strand; PAM type: NRG; PAM sequence: CAG
tcttcattctcccttgatct

SEQ ID NO: 114903 - DNA, 20 bp, Artificial Sequence
  Description of Artificial Sequence: Synthetic oligonucleotide
  Target: ATXN1; (+) strand; PAM type: NRG; PAM sequence: AAG
gtttgtcatttaatacatct

SEQ ID NO: 114904 - DNA, 20 bp, Artificial Sequence
  Description of Artificial Sequence: Synthetic oligonucleotide
  Target: ATXN1; (+) strand; PAM type: NRG; PAM sequence: TGG
ctcaacaaatcaaatactga

SEQ ID NO: 114905 - DNA, 20 bp, Artificial Sequence
  Description of Artificial Sequence: Synthetic oligonucleotide
  Target: ATXN1; (+) strand; PAM type: NRG; PAM sequence: GAG
caacaaatcaaatactgatg

SEQ ID NO: 114906 - DNA, 20 bp, Artificial Sequence
  Description of Artificial Sequence: Synthetic oligonucleotide
  Target: ATXN1; (+) strand; PAM type: NRG; PAM sequence: CAG
atggagaatctgctatacac

SEQ ID NO: 114907 - DNA, 20 bp, Artificial Sequence
  Description of Artificial Sequence: Synthetic oligonucleotide
  Target: ATXN1; (+) strand; PAM type: NRG; PAM sequence: AGG
tggagaatctgctatacacc

SEQ ID NO: 114908 - DNA, 20 bp, Artificial Sequence
  Description of Artificial Sequence: Synthetic oligonucleotide
  Target: ATXN1; (+) strand; PAM type: NRG; PAM sequence: TAG
tacaccaggcactgtgctgc

SEQ ID NO: 114909 - DNA, 20 bp, Artificial Sequence
  Description of Artificial Sequence: Synthetic oligonucleotide
  Target: ATXN1; (+) strand; PAM type: NRG; PAM sequence: AGG
acaccaggcactgtgctgct

SEQ ID NO: 114910 - DNA, 20 bp, Artificial Sequence
  Description of Artificial Sequence: Synthetic oligonucleotide
  Target: ATXN1; (+) strand; PAM type: NRG; PAM sequence: GAG
accaggcactgtgctgctag

SEQ ID NO: 114911 - DNA, 20 bp, Artificial Sequence
  Description of Artificial Sequence: Synthetic oligonucleotide
  Target: ATXN1; (+) strand; PAM type: NRG; PAM sequence: GAG
gcactgtgctgctaggagct

SEQ ID NO: 114912 - DNA, 20 bp, Artificial Sequence
  Description of Artificial Sequence: Synthetic oligonucleotide
  Target: ATXN1; (+) strand; PAM type: NRG; PAM sequence: AGG
cactgtgctgctaggagctg

SEQ ID NO: 114913 - DNA, 20 bp, Artificial Sequence
  Description of Artificial Sequence: Synthetic oligonucleotide
  Target: ATXN1; (+) strand; PAM type: NRG; PAM sequence: CGG
gctaggagctgaggattgaa

SEQ ID NO: 114914 - DNA, 20 bp, Artificial Sequence
  Description of Artificial Sequence: Synthetic oligonucleotide
  Target: ATXN1; (+) strand; PAM type: NRG; PAM sequence: GGG
ctaggagctgaggattgaac

SEQ ID NO: 114915 - DNA, 20 bp, Artificial Sequence
  Description of Artificial Sequence: Synthetic oligonucleotide
  Target: ATXN1; (+) strand; PAM type: NRG; PAM sequence: GGG
taggagctgaggattgaacg

SEQ ID NO: 114916 - DNA, 20 bp, Artificial Sequence
  Description of Artificial Sequence: Synthetic oligonucleotide
  Target: ATXN1; (+) strand; PAM type: NRG; PAM sequence: GAG
ggagctgaggattgaacggg

SEQ ID NO: 114917 - DNA, 20 bp, Artificial Sequence
  Description of Artificial Sequence: Synthetic oligonucleotide
  Target: ATXN1; (+) strand; PAM type: NRG; PAM sequence: CAG
gaggattgaacggggagaaa

SEQ ID NO: 114918 - DNA, 20 bp, Artificial Sequence
  Description of Artificial Sequence: Synthetic oligonucleotide
  Target: ATXN1; (+) strand; PAM type: NRG; PAM sequence: AGG
aggattgaacggggagaaac

SEQ ID NO: 114919 - DNA, 20 bp, Artificial Sequence
  Description of Artificial Sequence: Synthetic oligonucleotide
  Target: ATXN1; (+) strand; PAM type: NRG; PAM sequence: AAG
attgaacggggagaaacagg

SEQ ID NO: 114920 - DNA, 20 bp, Artificial Sequence
  Description of Artificial Sequence: Synthetic oligonucleotide
  Target: ATXN1; (+) strand; PAM type: NRG; PAM sequence: TAG
caggaagctccctgctctca

SEQ ID NO: 114921 - DNA, 20 bp, Artificial Sequence
  Description of Artificial Sequence: Synthetic oligonucleotide
  Target: ATXN1; (+) strand; PAM type: NRG; PAM sequence: TAG
cctgctctcatagtgcttct

SEQ ID NO: 114922 - DNA, 20 bp, Artificial Sequence
  Description of Artificial Sequence: Synthetic oligonucleotide
  Target: ATXN1; (+) strand; PAM type: NRG; PAM sequence: TGG
ctctcatagtgcttcttagt

SEQ ID NO: 114923 - DNA, 20 bp, Artificial Sequence
  Description of Artificial Sequence: Synthetic oligonucleotide
  Target: ATXN1; (+) strand; PAM type: NRG; PAM sequence: GGG
tctcatagtgcttcttagtt

SEQ ID NO: 114924 - DNA, 20 bp, Artificial Sequence
  Description of Artificial Sequence: Synthetic oligonucleotide
  Target: ATXN1; (+) strand; PAM type: NRG; PAM sequence: GGG
ctcatagtgcttcttagttg

SEQ ID NO: 114925 - DNA, 20 bp, Artificial Sequence
  Description of Artificial Sequence: Synthetic oligonucleotide
  Target: ATXN1; (+) strand; PAM type: NRG; PAM sequence: GAG
catagtgcttcttagttggg

SEQ ID NO: 114926 - DNA, 20 bp, Artificial Sequence
  Description of Artificial Sequence: Synthetic oligonucleotide
  Target: ATXN1; (+) strand; PAM type: NRG; PAM sequence: AAG
tgcttcttagttggggagaa

SEQ ID NO: 114927 - DNA, 20 bp, Artificial Sequence
  Description of Artificial Sequence: Synthetic oligonucleotide
  Target: ATXN1; (+) strand; PAM type: NRG; PAM sequence: AAG
atatgtaaaaaatgttgtca

SEQ ID NO: 114928 - DNA, 20 bp, Artificial Sequence
  Description of Artificial Sequence: Synthetic oligonucleotide
  Target: ATXN1; (+) strand; PAM type: NRG; PAM sequence: AAG
taaaaaatgttgtcaaagaa

SEQ ID NO: 114929 - DNA, 20 bp, Artificial Sequence
  Description of Artificial Sequence: Synthetic oligonucleotide
  Target: ATXN1; (+) strand; PAM type: NRG; PAM sequence: CGG
aatgttgtcaaagaaaagaa

SEQ ID NO: 114930 - DNA, 20 bp, Artificial Sequence
  Description of Artificial Sequence: Synthetic oligonucleotide
  Target: ATXN1; (+) strand; PAM type: NRG; PAM sequence: GGG
atgttgtcaaagaaaagaac

SEQ ID NO: 114931 - DNA, 20 bp, Artificial Sequence
  Description of Artificial Sequence: Synthetic oligonucleotide
  Target: ATXN1; (+) strand; PAM type: NRG; PAM sequence: GGG
tgttgtcaaagaaaagaacg

SEQ ID NO: 114932 - DNA, 20 bp, Artificial Sequence
  Description of Artificial Sequence: Synthetic oligonucleotide
  Target: ATXN1; (+) strand; PAM type: NRG; PAM sequence: TGG
caaagaaaagaacggggtga

SEQ ID NO: 114933 - DNA, 20 bp, Artificial Sequence
  Description of Artificial Sequence: Synthetic oligonucleotide
  Target: ATXN1; (+) strand; PAM type: NRG; PAM sequence: GGG
aaagaaaagaacggggtgat

SEQ ID NO: 114934 - DNA, 20 bp, Artificial Sequence
  Description of Artificial Sequence: Synthetic oligonucleotide
  Target: ATXN1; (+) strand; PAM type: NRG; PAM sequence: CAG
aaagaacggggtgatgggaa

SEQ ID NO: 114935 - DNA, 20 bp, Artificial Sequence
  Description of Artificial Sequence: Synthetic oligonucleotide
  Target: ATXN1; (+) strand; PAM type: NRG; PAM sequence: TGG
aacggggtgatgggaacagt

SEQ ID NO: 114936 - DNA, 20 bp, Artificial Sequence
  Description of Artificial Sequence: Synthetic oligonucleotide
  Target: ATXN1; (+) strand; PAM type: NRG; PAM sequence: AAG
ggggtgatgggaacagttgg

SEQ ID NO: 114937 - DNA, 20 bp, Artificial Sequence
  Description of Artificial Sequence: Synthetic oligonucleotide
  Target: ATXN1; (+) strand; PAM type: NRG; PAM sequence: GAG
ggtgatgggaacagttggaa

SEQ ID NO: 114938 - DNA, 20 bp, Artificial Sequence
  Description of Artificial Sequence: Synthetic oligonucleotide
  Target: ATXN1; (+) strand; PAM type: NRG; PAM sequence: AGG
gtgatgggaacagttggaag

SEQ ID NO: 114939 - DNA, 20 bp, Artificial Sequence
  Description of Artificial Sequence: Synthetic oligonucleotide
  Target: ATXN1; (+) strand; PAM type: NRG; PAM sequence: CAG
tggaagaggtgtaaaaactc

SEQ ID NO: 114940 - DNA, 20 bp, Artificial Sequence
  Description of Artificial Sequence: Synthetic oligonucleotide
  Target: ATXN1; (+) strand; PAM type: NRG; PAM sequence: GAG
gaagaggtgtaaaaactcca

SEQ ID NO: 114941 - DNA, 20 bp, Artificial Sequence
  Description of Artificial Sequence: Synthetic oligonucleotide
  Target: ATXN1; (+) strand; PAM type: NRG; PAM sequence: AAG
gaggtgtaaaaactccagag

SEQ ID NO: 114942 - DNA, 20 bp, Artificial Sequence
  Description of Artificial Sequence: Synthetic oligonucleotide
  Target: ATXN1; (+) strand; PAM type: NRG; PAM sequence: TGG
taaaaactccagagaagctg

SEQ ID NO: 114943 - DNA, 20 bp, Artificial Sequence
  Description of Artificial Sequence: Synthetic oligonucleotide
  Target: ATXN1; (+) strand; PAM type: NRG; PAM sequence: TAG
tccagagaagctgtggctcc

SEQ ID NO: 114944 - DNA, 20 bp, Artificial Sequence
  Description of Artificial Sequence: Synthetic oligonucleotide
  Target: ATXN1; (+) strand; PAM type: NRG; PAM sequence: AAG
gagaagctgtggctcctaga

SEQ ID NO: 114945 - DNA, 20 bp, Artificial Sequence
  Description of Artificial Sequence: Synthetic oligonucleotide
  Target: ATXN1; (+) strand; PAM type: NRG; PAM sequence: AAG
aagctgtggctcctagaaag

SEQ ID NO: 114946 - DNA, 20 bp, Artificial Sequence
  Description of Artificial Sequence: Synthetic oligonucleotide
  Target: ATXN1; (+) strand; PAM type: NRG; PAM sequence: AGG
agctgtggctcctagaaaga

SEQ ID NO: 114947 - DNA, 20 bp, Artificial Sequence
  Description of Artificial Sequence: Synthetic oligonucleotide
  Target: ATXN1; (+) strand; PAM type: NRG; PAM sequence: TAG
tgtggctcctagaaagaagg

SEQ ID NO: 114948 - DNA, 20 bp, Artificial Sequence
  Description of Artificial Sequence: Synthetic oligonucleotide
  Target: ATXN1; (+) strand; PAM type: NRG; PAM sequence: AGG
gtggctcctagaaagaaggt

SEQ ID NO: 114949 - DNA, 20 bp, Artificial Sequence
  Description of Artificial Sequence: Synthetic oligonucleotide
  Target: ATXN1; (+) strand; PAM type: NRG; PAM sequence: TAG
cctagaaagaaggtaggttt

SEQ ID NO: 114950 - DNA, 20 bp, Artificial Sequence
  Description of Artificial Sequence: Synthetic oligonucleotide
  Target: ATXN1; (+) strand; PAM type: NRG; PAM sequence: AGG
ctagaaagaaggtaggtttt

SEQ ID NO: 114951 - DNA, 20 bp, Artificial Sequence
  Description of Artificial Sequence: Synthetic oligonucleotide
  Target: ATXN1; (+) strand; PAM type: NRG; PAM sequence: TAG
aagaaggtaggttttaggac

SEQ ID NO: 114952 - DNA, 20 bp, Artificial Sequence
  Description of Artificial Sequence: Synthetic oligonucleotide
  Target: ATXN1; (+) strand; PAM type: NRG; PAM sequence: TGG
ggtaggttttaggactagaa

SEQ ID NO: 114953 - DNA, 20 bp, Artificial Sequence
  Description of Artificial Sequence: Synthetic oligonucleotide
  Target: ATXN1; (+) strand; PAM type: NRG; PAM sequence: TAG
ttttaggactagaatggtga

SEQ ID NO: 114954 - DNA, 20 bp, Artificial Sequence
  Description of Artificial Sequence: Synthetic oligonucleotide
  Target: ATXN1; (+) strand; PAM type: NRG; PAM sequence: TGG
taggactagaatggtgatag

SEQ ID NO: 114955 - DNA, 20 bp, Artificial Sequence
  Description of Artificial Sequence: Synthetic oligonucleotide
  Target: ATXN1; (+) strand; PAM type: NRG; PAM sequence: GGG
aggactagaatggtgatagt

SEQ ID NO: 114956 - DNA, 20 bp, Artificial Sequence
  Description of Artificial Sequence: Synthetic oligonucleotide
  Target: ATXN1; (+) strand; PAM type: NRG; PAM sequence: CGG
ctagaatggtgatagtgggc

SEQ ID NO: 114957 - DNA, 20 bp, Artificial Sequence
  Description of Artificial Sequence: Synthetic oligonucleotide
  Target: ATXN1; (+) strand; PAM type: NRG; PAM sequence: AAG
gaatggtgatagtgggccgg

SEQ ID NO: 114958 - DNA, 20 bp, Artificial Sequence
  Description of Artificial Sequence: Synthetic oligonucleotide
  Target: ATXN1; (+) strand; PAM type: NRG; PAM sequence: GAG
atggtgatagtgggccggaa

SEQ ID NO: 114959 - DNA, 20 bp, Artificial Sequence
  Description of Artificial Sequence: Synthetic oligonucleotide
  Target: ATXN1; (+) strand; PAM type: NRG; PAM sequence: GAG
ggtgatagtgggccggaaga

SEQ ID NO: 114960 - DNA, 20 bp, Artificial Sequence
  Description of Artificial Sequence: Synthetic oligonucleotide
  Target: ATXN1; (+) strand; PAM type: NRG; PAM sequence: GAG
tgatagtgggccggaagaga

SEQ ID NO: 114961 - DNA, 20 bp, Artificial Sequence
  Description of Artificial Sequence: Synthetic oligonucleotide
  Target: ATXN1; (+) strand; PAM type: NRG; PAM sequence: GAG
atagtgggccggaagagaga

SEQ ID NO: 114962 - DNA, 20 bp, Artificial Sequence
  Description of Artificial Sequence: Synthetic oligonucleotide
  Target: ATXN1; (+) strand; PAM type: NRG; PAM sequence: AAG
aagagagagagtgcattcga

SEQ ID NO: 114963 - DNA, 20 bp, Artificial Sequence
  Description of Artificial Sequence: Synthetic oligonucleotide
  Target: ATXN1; (+) strand; PAM type: NRG; PAM sequence: GAG
gagtgcattcgaaagacact

SEQ ID NO: 114964 - DNA, 20 bp, Artificial Sequence
  Description of Artificial Sequence: Synthetic oligonucleotide
  Target: ATXN1; (+) strand; PAM type: NRG; PAM sequence: AGG
agtgcattcgaaagacactg

SEQ ID NO: 114965 - DNA, 20 bp, Artificial Sequence
  Description of Artificial Sequence: Synthetic oligonucleotide
  Target: ATXN1; (+) strand; PAM type: NRG; PAM sequence: GAG
tgcattcgaaagacactgag

SEQ ID NO: 114966 - DNA, 20 bp, Artificial Sequence
  Description of Artificial Sequence: Synthetic oligonucleotide
  Target: ATXN1; (+) strand; PAM type: NRG; PAM sequence: CAG
agacactgaggagattgcat

SEQ ID NO: 114967 - DNA, 20 bp, Artificial Sequence
  Description of Artificial Sequence: Synthetic oligonucleotide
  Target: ATXN1; (+) strand; PAM type: NRG; PAM sequence: TAG
cactgaggagattgcatcag

SEQ ID NO: 114968 - DNA, 20 bp, Artificial Sequence
  Description of Artificial Sequence: Synthetic oligonucleotide
  Target: ATXN1; (+) strand; PAM type: NRG; PAM sequence: AGG
actgaggagattgcatcagt

SEQ ID NO: 114969 - DNA, 20 bp, Artificial Sequence
  Description of Artificial Sequence: Synthetic oligonucleotide
  Target: ATXN1; (+) strand; PAM type: NRG; PAM sequence: TGG
gagattgcatcagtaggact

SEQ ID NO: 114970 - DNA, 20 bp, Artificial Sequence
  Description of Artificial Sequence: Synthetic oligonucleotide
  Target: ATXN1; (+) strand; PAM type: NRG; PAM sequence: TAG
agtaggacttggtgacacat

SEQ ID NO: 114971 - DNA, 20 bp, Artificial Sequence
  Description of Artificial Sequence: Synthetic oligonucleotide
  Target: ATXN1; (+) strand; PAM type: NRG; PAM sequence: CAG
acttggtgacacattagatg

SEQ ID NO: 114972 - DNA, 20 bp, Artificial Sequence
  Description of Artificial Sequence: Synthetic oligonucleotide
  Target: ATXN1; (+) strand; PAM type: NRG; PAM sequence: GAG
ttggtgacacattagatgca

SEQ ID NO: 114973 - DNA, 20 bp, Artificial Sequence
  Description of Artificial Sequence: Synthetic oligonucleotide
  Target: ATXN1; (+) strand; PAM type: NRG; PAM sequence: AGG
tggtgacacattagatgcag

SEQ ID NO: 114974 - DNA, 20 bp, Artificial Sequence
  Description of Artificial Sequence: Synthetic oligonucleotide
  Target: ATXN1; (+) strand; PAM type: NRG; PAM sequence: AAG
tgacacattagatgcagagg

SEQ ID NO: 114975 - DNA, 20 bp, Artificial Sequence
  Description of Artificial Sequence: Synthetic oligonucleotide
  Target: ATXN1; (+) strand; PAM type: NRG; PAM sequence: GAG
acacattagatgcagaggaa

SEQ ID NO: 114976 - DNA, 20 bp, Artificial Sequence
  Description of Artificial Sequence: Synthetic oligonucleotide
  Target: ATXN1; (+) strand; PAM type: NRG; PAM sequence: AGG
cacattagatgcagaggaag

SEQ ID NO: 114977 - DNA, 20 bp, Artificial Sequence
  Description of Artificial Sequence: Synthetic oligonucleotide
  Target: ATXN1; (+) strand; PAM type: NRG; PAM sequence: GGG
acattagatgcagaggaaga

SEQ ID NO: 114978 - DNA, 20 bp, Artificial Sequence
  Description of Artificial Sequence: Synthetic oligonucleotide
  Target: ATXN1; (+) strand; PAM type: NRG; PAM sequence: CAG
tagatgcagaggaagaggga

SEQ ID NO: 114979 - DNA, 20 bp, Artificial Sequence
  Description of Artificial Sequence: Synthetic oligonucleotide
  Target: ATXN1; (+) strand; PAM type: NRG; PAM sequence: AAG
aagagggacagaaatgcttc

SEQ ID NO: 114980 - DNA, 20 bp, Artificial Sequence
  Description of Artificial Sequence: Synthetic oligonucleotide
  Target: ATXN1; (+) strand; PAM type: NRG; PAM sequence: AGG
agagggacagaaatgcttca

SEQ ID NO: 114981 - DNA, 20 bp, Artificial Sequence
  Description of Artificial Sequence: Synthetic oligonucleotide
  Target: ATXN1; (+) strand; PAM type: NRG; PAM sequence: GAG
agggacagaaatgcttcaag

SEQ ID NO: 114982 - DNA, 20 bp, Artificial Sequence
  Description of Artificial Sequence: Synthetic oligonucleotide
  Target: ATXN1; (+) strand; PAM type: NRG; PAM sequence: AGG
gggacagaaatgcttcaagg

SEQ ID NO: 114983 - DNA, 20 bp, Artificial Sequence
  Description of Artificial Sequence: Synthetic oligonucleotide
  Target: ATXN1; (+) strand; PAM type: NRG; PAM sequence: TAG
aatgcttcaaggaggacttt

SEQ ID NO: 114984 - DNA, 20 bp, Artificial Sequence
  Description of Artificial Sequence: Synthetic oligonucleotide
  Target: ATXN1; (+) strand; PAM type: NRG; PAM sequence: AGG
atgcttcaaggaggactttt

SEQ ID NO: 114985 - DNA, 20 bp, Artificial Sequence
  Description of Artificial Sequence: Synthetic oligonucleotide
  Target: ATXN1; (+) strand; PAM type: NRG; PAM sequence: TGG
ggacttttaggcatctgtct

SEQ ID NO: 114986 - DNA, 20 bp, Artificial Sequence
  Description of Artificial Sequence: Synthetic oligonucleotide
  Target: ATXN1; (+) strand; PAM type: NRG; PAM sequence: GGG
gacttttaggcatctgtctt

SEQ ID NO: 114987 - DNA, 20 bp, Artificial Sequence
  Description of Artificial Sequence: Synthetic oligonucleotide
  Target: ATXN1; (+) strand; PAM type: NRG; PAM sequence: TAG
aggcatctgtcttgggtaac

SEQ ID NO: 114988 - DNA, 20 bp, Artificial Sequence
  Description of Artificial Sequence: Synthetic oligonucleotide
  Target: ATXN1; (+) strand; PAM type: NRG; PAM sequence: TGG
gggtaactagatgatgccaa

SEQ ID NO: 114989 - DNA, 20 bp, Artificial Sequence
  Description of Artificial Sequence: Synthetic oligonucleotide
  Target: ATXN1; (+) strand; PAM type: NRG; PAM sequence: GAG
actagatgatgccaatggct

SEQ ID NO: 114990 - DNA, 20 bp, Artificial Sequence
  Description of Artificial Sequence: Synthetic oligonucleotide
  Target: ATXN1; (+) strand; PAM type: NRG; PAM sequence: TGG
gatgatgccaatggctgaga

SEQ ID NO: 114991 - DNA, 20 bp, Artificial Sequence
  Description of Artificial Sequence: Synthetic oligonucleotide
  Target: ATXN1; (+) strand; PAM type: NRG; PAM sequence: GGG
atgatgccaatggctgagat

SEQ ID NO: 114992 - DNA, 20 bp, Artificial Sequence
  Description of Artificial Sequence: Synthetic oligonucleotide
  Target: ATXN1; (+) strand; PAM type: NRG; PAM sequence: GGG
tgatgccaatggctgagatg

SEQ ID NO: 114993 - DNA, 20 bp, Artificial Sequence
  Description of Artificial Sequence: Synthetic oligonucleotide
  Target: ATXN1; (+) strand; PAM type: NRG; PAM sequence: TGG
tggctgagatggggaattct

SEQ ID NO: 114994 - DNA, 20 bp, Artificial Sequence
  Description of Artificial Sequence: Synthetic oligonucleotide
  Target: ATXN1; (+) strand; PAM type: NRG; PAM sequence: GGG
ggctgagatggggaattctt

SEQ ID NO: 114995 - DNA, 20 bp, Artificial Sequence
  Description of Artificial Sequence: Synthetic oligonucleotide
  Target: ATXN1; (+) strand; PAM type: NRG; PAM sequence: TAG
tgagatggggaattcttggg

SEQ ID NO: 114996 - DNA, 20 bp, Artificial Sequence
  Description of Artificial Sequence: Synthetic oligonucleotide
  Target: ATXN1; (+) strand; PAM type: NRG; PAM sequence: GAG
tggggaattcttgggtagat

SEQ ID NO: 114997 - DNA, 20 bp, Artificial Sequence
  Description of Artificial Sequence: Synthetic oligonucleotide
  Target: ATXN1; (+) strand; PAM type: NRG; PAM sequence: AGG
ggggaattcttgggtagatg

SEQ ID NO: 114998 - DNA, 20 bp, Artificial Sequence
  Description of Artificial Sequence: Synthetic oligonucleotide
  Target: ATXN1; (+) strand; PAM type: NRG; PAM sequence: TGG
attcttgggtagatgaggtt

SEQ ID NO: 114999 - DNA, 20 bp, Artificial Sequence
  Description of Artificial Sequence: Synthetic oligonucleotide
  Target: ATXN1; (+) strand; PAM type: NRG; PAM sequence: TGG
cttgggtagatgaggtttgg

SEQ ID NO: 115000 - DNA, 20 bp, Artificial Sequence
  Description of Artificial Sequence: Synthetic oligonucleotide
  Target: ATXN1; (+) strand; PAM type: NRG; PAM sequence: GGG
ttgggtagatgaggtttggt

SEQ ID NO: 115001 - DNA, 20 bp, Artificial Sequence
  Description of Artificial Sequence: Synthetic oligonucleotide
  Target: ATXN1; (+) strand; PAM type: NRG; PAM sequence: TGG
gtagatgaggtttggtggga

SEQ ID NO: 115002 - DNA, 20 bp, Artificial Sequence
  Description of Artificial Sequence: Synthetic oligonucleotide
  Target: ATXN1; (+) strand; PAM type: NRG; PAM sequence: GAG
actttgactttgaacgtgct

SEQ ID NO: 115003 - DNA, 20 bp, Artificial Sequence
  Description of Artificial Sequence: Synthetic oligonucleotide
  Target: ATXN1; (+) strand; PAM type: NRG; PAM sequence: CAG
gactttgaacgtgctgagtt

SEQ ID NO: 115004 - DNA, 20 bp, Artificial Sequence
  Description of Artificial Sequence: Synthetic oligonucleotide
  Target: ATXN1; (+) strand; PAM type: NRG; PAM sequence: AGG
actttgaacgtgctgagttc

SEQ ID NO: 115005 - DNA, 20 bp, Artificial Sequence
  Description of Artificial Sequence: Synthetic oligonucleotide
  Target: ATXN1; (+) strand; PAM type: NRG; PAM sequence: AAG
ggtgacattgtgatacccca

SEQ ID NO: 115006 - DNA, 20 bp, Artificial Sequence
  Description of Artificial Sequence: Synthetic oligonucleotide
  Target: ATXN1; (+) strand; PAM type: NRG; PAM sequence: AGG
gtgacattgtgataccccaa

SEQ ID NO: 115007 - DNA, 20 bp, Artificial Sequence
  Description of Artificial Sequence: Synthetic oligonucleotide
  Target: ATXN1; (+) strand; PAM type: NRG; PAM sequence: GAG
gacattgtgataccccaaag

SEQ ID NO: 115008 - DNA, 20 bp, Artificial Sequence
  Description of Artificial Sequence: Synthetic oligonucleotide
  Target: ATXN1; (+) strand; PAM type: NRG; PAM sequence: AGG
acattgtgataccccaaagg

SEQ ID NO: 115009 - DNA, 20 bp, Artificial Sequence
  Description of Artificial Sequence: Synthetic oligonucleotide
  Target: ATXN1; (+) strand; PAM type: NRG; PAM sequence: CAG
gtgataccccaaaggaggtg

SEQ ID NO: 115010 - DNA, 20 bp, Artificial Sequence
  Description of Artificial Sequence: Synthetic oligonucleotide
  Target: ATXN1; (+) strand; PAM type: NRG; PAM sequence: GAG
gataccccaaaggaggtgca

SEQ ID NO: 115011 - DNA, 20 bp, Artificial Sequence
  Description of Artificial Sequence: Synthetic oligonucleotide
  Target: ATXN1; (+) strand; PAM type: NRG; PAM sequence: TAG
accccaaaggaggtgcagag

SEQ ID NO: 115012 - DNA, 20 bp, Artificial Sequence
  Description of Artificial Sequence: Synthetic oligonucleotide
  Target: ATXN1; (+) strand; PAM type: NRG; PAM sequence: AGG
ccccaaaggaggtgcagagt

SEQ ID NO: 115013 - DNA, 20 bp, Artificial Sequence
  Description of Artificial Sequence: Synthetic oligonucleotide
  Target: ATXN1; (+) strand; PAM type: NRG; PAM sequence: TAG
caaaggaggtgcagagtagg

SEQ ID NO: 115014 - DNA, 20 bp, Artificial Sequence
  Description of Artificial Sequence: Synthetic oligonucleotide
  Target: ATXN1; (+) strand; PAM type: NRG; PAM sequence: TGG
ggaggtgcagagtaggtagc

SEQ ID NO: 115015 - DNA, 20 bp, Artificial Sequence
  Description of Artificial Sequence: Synthetic oligonucleotide
  Target: ATXN1; (+) strand; PAM type: NRG; PAM sequence: GAG
aggtgcagagtaggtagctg

SEQ ID NO: 115016 - DNA, 20 bp, Artificial Sequence
  Description of Artificial Sequence: Synthetic oligonucleotide
  Target: ATXN1; (+) strand; PAM type: NRG; PAM sequence: CAG
agagtaggtagctggagaca

SEQ ID NO: 115017 - DNA, 20 bp, Artificial Sequence
  Description of Artificial Sequence: Synthetic oligonucleotide
  Target: ATXN1; (+) strand; PAM type: NRG; PAM sequence: AGG
gagtaggtagctggagacac

SEQ ID NO: 115018 - DNA, 20 bp, Artificial Sequence
  Description of Artificial Sequence: Synthetic oligonucleotide
  Target: ATXN1; (+) strand; PAM type: NRG; PAM sequence: AAG
tagctggagacacaggcccg

SEQ ID NO: 115019 - DNA, 20 bp, Artificial Sequence
  Description of Artificial Sequence: Synthetic oligonucleotide
  Target: ATXN1; (+) strand; PAM type: NRG; PAM sequence: GAG
gacacaggcccgaagatgat

SEQ ID NO: 115020 - DNA, 20 bp, Artificial Sequence
  Description of Artificial Sequence: Synthetic oligonucleotide
  Target: ATXN1; (+) strand; PAM type: NRG; PAM sequence: GAG
cacaggcccgaagatgatga

SEQ ID NO: 115021 - DNA, 20 bp, Artificial Sequence
  Description of Artificial Sequence: Synthetic oligonucleotide
  Target: ATXN1; (+) strand; PAM type: NRG; PAM sequence: AGG
acaggcccgaagatgatgag

SEQ ID NO: 115022 - DNA, 20 bp, Artificial Sequence
  Description of Artificial Sequence: Synthetic oligonucleotide
  Target: ATXN1; (+) strand; PAM type: NRG; PAM sequence: TGG
cccgaagatgatgagaggtc

SEQ ID NO: 115023 - DNA, 20 bp, Artificial Sequence
  Description of Artificial Sequence: Synthetic oligonucleotide
  Target: ATXN1; (+) strand; PAM type: NRG; PAM sequence: TAG
agatgatgagaggtctggcc

SEQ ID NO: 115024 - DNA, 20 bp, Artificial Sequence
  Description of Artificial Sequence: Synthetic oligonucleotide
  Target: ATXN1; (+) strand; PAM type: NRG; PAM sequence: TGG
agaggtctggcctagaaaca

SEQ ID NO: 115025 - DNA, 20 bp, Artificial Sequence
  Description of Artificial Sequence: Synthetic oligonucleotide
  Target: ATXN1; (+) strand; PAM type: NRG; PAM sequence: CAG
ctggcctagaaacatggatg

SEQ ID NO: 115026 - DNA, 20 bp, Artificial Sequence
  Description of Artificial Sequence: Synthetic oligonucleotide
  Target: ATXN1; (+) strand; PAM type: NRG; PAM sequence: AGG
tggcctagaaacatggatgc

SEQ ID NO: 115027 - DNA, 20 bp, Artificial Sequence
  Description of Artificial Sequence: Synthetic oligonucleotide
  Target: ATXN1; (+) strand; PAM type: NRG; PAM sequence: GAG
gcctagaaacatggatgcag

SEQ ID NO: 115028 - DNA, 20 bp, Artificial Sequence
  Description of Artificial Sequence: Synthetic oligonucleotide
  Target: ATXN1; (+) strand; PAM type: NRG; PAM sequence: TGG
aaacatggatgcaggagtca

SEQ ID NO: 115029 - DNA, 20 bp, Artificial Sequence
  Description of Artificial Sequence: Synthetic oligonucleotide
  Target: ATXN1; (+) strand; PAM type: NRG; PAM sequence: AAG
gcaggagtcatggatccatc

SEQ ID NO: 115030 - DNA, 20 bp, Artificial Sequence
  Description of Artificial Sequence: Synthetic oligonucleotide
  Target: ATXN1; (+) strand; PAM type: NRG; PAM sequence: AGG
caggagtcatggatccatca

SEQ ID NO: 115031 - DNA, 20 bp, Artificial Sequence
  Description of Artificial Sequence: Synthetic oligonucleotide
  Target: ATXN1; (+) strand; PAM type: NRG; PAM sequence: GAG
tggatccatcaaggcactgt

SEQ ID NO: 115032 - DNA, 20 bp, Artificial Sequence
  Description of Artificial Sequence: Synthetic oligonucleotide
  Target: ATXN1; (+) strand; PAM type: NRG; PAM sequence: TGG
ccatcaaggcactgtgagtt

SEQ ID NO: 115033 - DNA, 20 bp, Artificial Sequence
  Description of Artificial Sequence: Synthetic oligonucleotide
  Target: ATXN1; (+) strand; PAM type: NRG; PAM sequence: GAG
aaggcactgtgagtttggat

SEQ ID NO: 115034 - DNA, 20 bp, Artificial Sequence
  Description of Artificial Sequence: Synthetic oligonucleotide
  Target: ATXN1; (+) strand; PAM type: NRG; PAM sequence: TAG
tgagtttggatgagatcatc

SEQ ID NO: 115035 - DNA, 20 bp, Artificial Sequence
  Description of Artificial Sequence: Synthetic oligonucleotide
  Target: ATXN1; (+) strand; PAM type: NRG; PAM sequence: CAG
gtttggatgagatcatctag

SEQ ID NO: 115036 - DNA, 20 bp, Artificial Sequence
  Description of Artificial Sequence: Synthetic oligonucleotide
  Target: ATXN1; (+) strand; PAM type: NRG; PAM sequence: AAG
gatcatctagcagaacactt

SEQ ID NO: 115037 - DNA, 20 bp, Artificial Sequence
  Description of Artificial Sequence: Synthetic oligonucleotide
  Target: ATXN1; (+) strand; PAM type: NRG; PAM sequence: TGG
catctagcagaacacttaag

SEQ ID NO: 115038 - DNA, 20 bp, Artificial Sequence
  Description of Artificial Sequence: Synthetic oligonucleotide
  Target: ATXN1; (+) strand; PAM type: NRG; PAM sequence: GAG
tctagcagaacacttaagtg

SEQ ID NO: 115039 - DNA, 20 bp, Artificial Sequence
  Description of Artificial Sequence: Synthetic oligonucleotide
  Target: ATXN1; (+) strand; PAM type: NRG; PAM sequence: AAG
agcagaacacttaagtggag

SEQ ID NO: 115040 - DNA, 20 bp, Artificial Sequence
  Description of Artificial Sequence: Synthetic oligonucleotide
  Target: ATXN1; (+) strand; PAM type: NRG; PAM sequence: AAG
aacacttaagtggagaagca

SEQ ID NO: 115041 - DNA, 20 bp, Artificial Sequence
  Description of Artificial Sequence: Synthetic oligonucleotide
  Target: ATXN1; (+) strand; PAM type: NRG; PAM sequence: TGG
acttaagtggagaagcaaag

SEQ ID NO: 115042 - DNA, 20 bp, Artificial Sequence
  Description of Artificial Sequence: Synthetic oligonucleotide
  Target: ATXN1; (+) strand; PAM type: NRG; PAM sequence: TAG
agtggagaagcaaagtggtc

SEQ ID NO: 115043 - DNA, 20 bp, Artificial Sequence
  Description of Artificial Sequence: Synthetic oligonucleotide
  Target: ATXN1; (+) strand; PAM type: NRG; PAM sequence: GAG
tggagaagcaaagtggtcta

SEQ ID NO: 115044 - DNA, 20 bp, Artificial Sequence
  Description of Artificial Sequence: Synthetic oligonucleotide
  Target: ATXN1; (+) strand; PAM type: NRG; PAM sequence: AAG
agcaaagtggtctagagact

SEQ ID NO: 115045 - DNA, 20 bp, Artificial Sequence
  Description of Artificial Sequence: Synthetic oligonucleotide
  Target: ATXN1; (+) strand; PAM type: NRG; PAM sequence: GAG
tggtctagagactaagccat

SEQ ID NO: 115046 - DNA, 20 bp, Artificial Sequence
  Description of Artificial Sequence: Synthetic oligonucleotide
  Target: ATXN1; (+) strand; PAM type: NRG; PAM sequence: AGG
ggtctagagactaagccatg

SEQ ID NO: 115047 - DNA, 20 bp, Artificial Sequence
  Description of Artificial Sequence: Synthetic oligonucleotide
  Target: ATXN1; (+) strand; PAM type: NRG; PAM sequence: TAG
ccatgaggaactccaacact

SEQ ID NO: 115048 - DNA, 20 bp, Artificial Sequence
  Description of Artificial Sequence: Synthetic oligonucleotide
  Target: ATXN1; (+) strand; PAM type: NRG; PAM sequence: GAG
atgaggaactccaacactta

SEQ ID NO: 115049 - DNA, 20 bp, Artificial Sequence
  Description of Artificial Sequence: Synthetic oligonucleotide
  Target: ATXN1; (+) strand; PAM type: NRG; PAM sequence: AGG
tgaggaactccaacacttag

SEQ ID NO: 115050 - DNA, 20 bp, Artificial Sequence
  Description of Artificial Sequence: Synthetic oligonucleotide
  Target: ATXN1; (+) strand; PAM type: NRG; PAM sequence: TAG
aactccaacacttagaggcg

SEQ ID NO: 115051 - DNA, 20 bp, Artificial Sequence
  Description of Artificial Sequence: Synthetic oligonucleotide
  Target: ATXN1; (+) strand; PAM type: NRG; PAM sequence: AAG
ccaacacttagaggcgtaga

SEQ ID NO: 115052 - DNA, 20 bp, Artificial Sequence
  Description of Artificial Sequence: Synthetic oligonucleotide
  Target: ATXN1; (+) strand; PAM type: NRG; PAM sequence: CAG
acacttagaggcgtagaaag

SEQ ID NO: 115053 - DNA, 20 bp, Artificial Sequence
  Description of Artificial Sequence: Synthetic oligonucleotide
  Target: ATXN1; (+) strand; PAM type: NRG; PAM sequence: AGG
cacttagaggcgtagaaagc

SEQ ID NO: 115054 - DNA, 20 bp, Artificial Sequence
  Description of Artificial Sequence: Synthetic oligonucleotide
  Target: ATXN1; (+) strand; PAM type: NRG; PAM sequence: TAG
ttagaggcgtagaaagcagg

SEQ ID NO: 115055 - DNA, 20 bp, Artificial Sequence
  Description of Artificial Sequence: Synthetic oligonucleotide
  Target: ATXN1; (+) strand; PAM type: NRG; PAM sequence: AAG
aggcgtagaaagcaggtaga

SEQ ID NO: 115056 - DNA, 20 bp, Artificial Sequence
  Description of Artificial Sequence: Synthetic oligonucleotide
  Target: ATXN1; (+) strand; PAM type: NRG; PAM sequence: AGG
ggcgtagaaagcaggtagaa

SEQ ID NO: 115057 - DNA, 20 bp, Artificial Sequence
  Description of Artificial Sequence: Synthetic oligonucleotide
  Target: ATXN1; (+) strand; PAM type: NRG; PAM sequence: GGG
gcgtagaaagcaggtagaaa

SEQ ID NO: 115058 - DNA, 20 bp, Artificial Sequence
  Description of Artificial Sequence: Synthetic oligonucleotide
  Target: ATXN1; (+) strand; PAM type: NRG; PAM sequence: AAG
aggtagaaagggaacacctg

SEQ ID NO: 115059 - DNA, 20 bp, Artificial Sequence
  Description of Artificial Sequence: Synthetic oligonucleotide
  Target: ATXN1; (+) strand; PAM type: NRG; PAM sequence: TAG
aaagggaacacctgaagact

SEQ ID NO: 115060 - DNA, 20 bp, Artificial Sequence
  Description of Artificial Sequence: Synthetic oligonucleotide
  Target: ATXN1; (+) strand; PAM type: NRG; PAM sequence: AGG
aagggaacacctgaagactt

SEQ ID NO: 115061 - DNA, 20 bp, Artificial Sequence
  Description of Artificial Sequence: Synthetic oligonucleotide
  Target: ATXN1; (+) strand; PAM type: NRG; PAM sequence: AAG
ggaacacctgaagacttagg

SEQ ID NO: 115062 - DNA, 20 bp, Artificial Sequence
  Description of Artificial Sequence: Synthetic oligonucleotide
  Target: ATXN1; (+) strand; PAM type: NRG; PAM sequence: AGG
gaacacctgaagacttagga

SEQ ID NO: 115063 - DNA, 20 bp, Artificial Sequence
  Description of Artificial Sequence: Synthetic oligonucleotide
  Target: ATXN1; (+) strand; PAM type: NRG; PAM sequence: GAG
acacctgaagacttaggaag

SEQ ID NO: 115064 - DNA, 20 bp, Artificial Sequence
  Description of Artificial Sequence: Synthetic oligonucleotide
  Target: ATXN1; (+) strand; PAM type: NRG; PAM sequence: AGG
cacctgaagacttaggaagg

SEQ ID NO: 115065 - DNA, 20 bp, Artificial Sequence
  Description of Artificial Sequence: Synthetic oligonucleotide
  Target: ATXN1; (+) strand; PAM type: NRG; PAM sequence: GGG
acctgaagacttaggaagga

SEQ ID NO: 115066 - DNA, 20 bp, Artificial Sequence
  Description of Artificial Sequence: Synthetic oligonucleotide
  Target: ATXN1; (+) strand; PAM type: NRG; PAM sequence: GGG
cctgaagacttaggaaggag

SEQ ID NO: 115067 - DNA, 20 bp, Artificial Sequence
  Description of Artificial Sequence: Synthetic oligonucleotide
  Target: ATXN1; (+) strand; PAM type: NRG; PAM sequence: CAG
aagacttaggaaggaggggc

SEQ ID NO: 115068 - DNA, 20 bp, Artificial Sequence
  Description of Artificial Sequence: Synthetic oligonucleotide
  Target: ATXN1; (+) strand; PAM type: NRG; PAM sequence: AAG
cttaggaaggaggggccaga

SEQ ID NO: 115069 - DNA, 20 bp, Artificial Sequence
  Description of Artificial Sequence: Synthetic oligonucleotide
  Target: ATXN1; (+) strand; PAM type: NRG; PAM sequence: AGG
ttaggaaggaggggccagaa

SEQ ID NO: 115070 - DNA, 20 bp, Artificial Sequence
  Description of Artificial Sequence: Synthetic oligonucleotide
  Target: ATXN1; (+) strand; PAM type: NRG; PAM sequence: GGG
taggaaggaggggccagaaa

SEQ ID NO: 115071 - DNA, 20 bp, Artificial Sequence
  Description of Artificial Sequence: Synthetic oligonucleotide
  Target: ATXN1; (+) strand; PAM type: NRG; PAM sequence: TGG
gaggggccagaaagggatga

SEQ ID NO: 115072 - DNA, 20 bp, Artificial Sequence
  Description of Artificial Sequence: Synthetic oligonucleotide
  Target: ATXN1; (+) strand; PAM type: NRG; PAM sequence: AAG
gaaagggatgatggcacccg

SEQ ID NO: 115073 - DNA, 20 bp, Artificial Sequence
  Description of Artificial Sequence: Synthetic oligonucleotide
  Target: ATXN1; (+) strand; PAM type: NRG; PAM sequence: CAG
gggatgatggcacccgaaga

SEQ ID NO: 115074 - DNA, 20 bp, Artificial Sequence
  Description of Artificial Sequence: Synthetic oligonucleotide
  Target: ATXN1; (+) strand; PAM type: NRG; PAM sequence: TGG
atgatggcacccgaagacag

SEQ ID NO: 115075 - DNA, 20 bp, Artificial Sequence
  Description of Artificial Sequence: Synthetic oligonucleotide
  Target: ATXN1; (+) strand; PAM type: NRG; PAM sequence: CAG
cacccgaagacagtggtgtt

SEQ ID NO: 115076 - DNA, 20 bp, Artificial Sequence
  Description of Artificial Sequence: Synthetic oligonucleotide
  Target: ATXN1; (+) strand; PAM type: NRG; PAM sequence: AGG
acccgaagacagtggtgttc

SEQ ID NO: 115077 - DNA, 20 bp, Artificial Sequence
  Description of Artificial Sequence: Synthetic oligonucleotide
  Target: ATXN1; (+) strand; PAM type: NRG; PAM sequence: AAG
cgaagacagtggtgttcagg

SEQ ID NO: 115078 - DNA, 20 bp, Artificial Sequence
  Description of Artificial Sequence: Synthetic oligonucleotide
  Target: ATXN1; (+) strand; PAM type: NRG; PAM sequence: AAG
acagtggtgttcaggaagcc

SEQ ID NO: 115079 - DNA, 20 bp, Artificial Sequence
  Description of Artificial Sequence: Synthetic oligonucleotide
  Target: ATXN1; (+) strand; PAM type: NRG; PAM sequence: AGG
cagtggtgttcaggaagcca

SEQ ID NO: 115080 - DNA, 20 bp, Artificial Sequence
  Description of Artificial Sequence: Synthetic oligonucleotide
  Target: ATXN1; (+) strand; PAM type: NRG; PAM sequence: GGG
agtggtgttcaggaagccaa

SEQ ID NO: 115081 - DNA, 20 bp, Artificial Sequence
  Description of Artificial Sequence: Synthetic oligonucleotide
  Target: ATXN1; (+) strand; PAM type: NRG; PAM sequence: GAG
tggtgttcaggaagccaagg

SEQ ID NO: 115082 - DNA, 20 bp, Artificial Sequence
  Description of Artificial Sequence: Synthetic oligonucleotide
  Target: ATXN1; (+) strand; PAM type: NRG; PAM sequence: AGG
ggtgttcaggaagccaaggg

SEQ ID NO: 115083 - DNA, 20 bp, Artificial Sequence
  Description of Artificial Sequence: Synthetic oligonucleotide
  Target: ATXN1; (+) strand; PAM type: NRG; PAM sequence: AAG
gttcaggaagccaagggagg

SEQ ID NO: 115084 - DNA, 20 bp, Artificial Sequence
  Description of Artificial Sequence: Synthetic oligonucleotide
  Target: ATXN1; (+) strand; PAM type: NRG; PAM sequence: AGG
ttcaggaagccaagggagga

SEQ ID NO: 115085 - DNA, 20 bp, Artificial Sequence
  Description of Artificial Sequence: Synthetic oligonucleotide
  Target: ATXN1; (+) strand; PAM type: NRG; PAM sequence: TAG
agccaagggaggaaggtatt

SEQ ID NO: 115086 - DNA, 20 bp, Artificial Sequence
  Description of Artificial Sequence: Synthetic oligonucleotide
  Target: ATXN1; (+) strand; PAM type: NRG; PAM sequence: CAG
aagggaggaaggtatttaga

SEQ ID NO: 115087 - DNA, 20 bp, Artificial Sequence
  Description of Artificial Sequence: Synthetic oligonucleotide
  Target: ATXN1; (+) strand; PAM type: NRG; PAM sequence: AGG
agggaggaaggtatttagac

SEQ ID NO: 115088 - DNA, 20 bp, Artificial Sequence
  Description of Artificial Sequence: Synthetic oligonucleotide
  Target: ATXN1; (+) strand; PAM type: NRG; PAM sequence: GAG
ggaggaaggtatttagacag

SEQ ID NO: 115089 - DNA, 20 bp, Artificial Sequence
  Description of Artificial Sequence: Synthetic oligonucleotide
  Target: ATXN1; (+) strand; PAM type: NRG; PAM sequence: AGG
gaggaaggtatttagacagg

SEQ ID NO: 115090 - DNA, 20 bp, Artificial Sequence
  Description of Artificial Sequence: Synthetic oligonucleotide
  Target: ATXN1; (+) strand; PAM type: NRG; PAM sequence: GGG
aggaaggtatttagacagga

SEQ ID NO: 115091 - DNA, 20 bp, Artificial Sequence
  Description of Artificial Sequence: Synthetic oligonucleotide
  Target: ATXN1; (+) strand; PAM type: NRG; PAM sequence: GGG
ggaaggtatttagacaggag

SEQ ID NO: 115092 - DNA, 20 bp, Artificial Sequence
  Description of Artificial Sequence: Synthetic oligonucleotide
  Target: ATXN1; (+) strand; PAM type: NRG; PAM sequence: GGG
gaaggtatttagacaggagg

SEQ ID NO: 115093 - DNA, 20 bp, Artificial Sequence
  Description of Artificial Sequence: Synthetic oligonucleotide
  Target: ATXN1; (+) strand; PAM type: NRG; PAM sequence: GAG
aggtatttagacaggagggg

SEQ ID NO: 115094 - DNA, 20 bp, Artificial Sequence
  Description of Artificial Sequence: Synthetic oligonucleotide
  Target: ATXN1; (+) strand; PAM type: NRG; PAM sequence: GAG
gtatttagacaggaggggga

SEQ ID NO: 115095 - DNA, 20 bp, Artificial Sequence
  Description of Artificial Sequence: Synthetic oligonucleotide
  Target: ATXN1; (+) strand; PAM type: NRG; PAM sequence: CAG
tttagacaggagggggagag

SEQ ID NO: 115096 - DNA, 20 bp, Artificial Sequence
  Description of Artificial Sequence: Synthetic oligonucleotide
  Target: ATXN1; (+) strand; PAM type: NRG; PAM sequence: TGG
caggagggggagagcagaat

SEQ ID NO: 115097 - DNA, 20 bp, Artificial Sequence
  Description of Artificial Sequence: Synthetic oligonucleotide
  Target: ATXN1; (+) strand; PAM type: NRG; PAM sequence: AAG
gggggagagcagaattggca

SEQ ID NO: 115098 - DNA, 20 bp, Artificial Sequence
  Description of Artificial Sequence: Synthetic oligonucleotide
  Target: ATXN1; (+) strand; PAM type: NRG; PAM sequence: TGG
gagcagaattggcaaagctg

SEQ ID NO: 115099 - DNA, 20 bp, Artificial Sequence
  Description of Artificial Sequence: Synthetic oligonucleotide
  Target: ATXN1; (+) strand; PAM type: NRG; PAM sequence: GAG
gcagaattggcaaagctgtg

SEQ ID NO: 115100 - DNA, 20 bp, Artificial Sequence
  Description of Artificial Sequence: Synthetic oligonucleotide
  Target: ATXN1; (+) strand; PAM type: NRG; PAM sequence: AAG
aattggcaaagctgtggaga

SEQ ID NO: 115101 - DNA, 20 bp, Artificial Sequence
  Description of Artificial Sequence: Synthetic oligonucleotide
  Target: ATXN1; (+) strand; PAM type: NRG; PAM sequence: GAG
ggcaaagctgtggagaaagt

SEQ ID NO: 115102 - DNA, 20 bp, Artificial Sequence
  Description of Artificial Sequence: Synthetic oligonucleotide
  Target: ATXN1; (+) strand; PAM type: NRG; PAM sequence: GAG
agctgtggagaaagtgagat

SEQ ID NO: 115103 - DNA, 20 bp, Artificial Sequence
  Description of Artificial Sequence: Synthetic oligonucleotide
  Target: ATXN1; (+) strand; PAM type: NRG; PAM sequence: TGG
tcctattaaaaacacacaac

SEQ ID NO: 115104 - DNA, 20 bp, Artificial Sequence
  Description of Artificial Sequence: Synthetic oligonucleotide
  Target: ATXN1; (+) strand; PAM type: NRG; PAM sequence: TGG
acacaactggtccaatgaca

SEQ ID NO: 115105 - DNA, 20 bp, Artificial Sequence
  Description of Artificial Sequence: Synthetic oligonucleotide
  Target: ATXN1; (+) strand; PAM type: NRG; PAM sequence: GGG
cacaactggtccaatgacat

SEQ ID NO: 115106 - DNA, 20 bp, Artificial Sequence
  Description of Artificial Sequence: Synthetic oligonucleotide
  Target: ATXN1; (+) strand; PAM type: NRG; PAM sequence: TGG
actggtccaatgacatggga

SEQ ID NO: 115107 - DNA, 20 bp, Artificial Sequence
  Description of Artificial Sequence: Synthetic oligonucleotide
  Target: ATXN1; (+) strand; PAM type: NRG; PAM sequence: TGG
tccaatgacatgggatggca

SEQ ID NO: 115108 - DNA, 20 bp, Artificial Sequence
  Description of Artificial Sequence: Synthetic oligonucleotide
  Target: ATXN1; (+) strand; PAM type: NRG; PAM sequence: AAG
catggaaatcactgatgacc

SEQ ID NO: 115109 - DNA, 20 bp, Artificial Sequence
  Description of Artificial Sequence: Synthetic oligonucleotide
  Target: ATXN1; (+) strand; PAM type: NRG; PAM sequence: CAG
ggaaatcactgatgaccaag

SEQ ID NO: 115110 - DNA, 20 bp, Artificial Sequence
  Description of Artificial Sequence: Synthetic oligonucleotide
  Target: ATXN1; (+) strand; PAM type: NRG; PAM sequence: AGG
gaaatcactgatgaccaagc

SEQ ID NO: 115111 - DNA, 20 bp, Artificial Sequence
  Description of Artificial Sequence: Synthetic oligonucleotide
  Target: ATXN1; (+) strand; PAM type: NRG; PAM sequence: GAG
aatcactgatgaccaagcag

SEQ ID NO: 115112 - DNA, 20 bp, Artificial Sequence
  Description of Artificial Sequence: Synthetic oligonucleotide
  Target: ATXN1; (+) strand; PAM type: NRG; PAM sequence: CAG
actgatgaccaagcaggaga

SEQ ID NO: 115113 - DNA, 20 bp, Artificial Sequence
  Description of Artificial Sequence: Synthetic oligonucleotide
  Target: ATXN1; (+) strand; PAM type: NRG; PAM sequence: AGG
ctgatgaccaagcaggagac

SEQ ID NO: 115114 - DNA, 20 bp, Artificial Sequence
  Description of Artificial Sequence: Synthetic oligonucleotide
  Target: ATXN1; (+) strand; PAM type: NRG; PAM sequence: GGG
tgatgaccaagcaggagaca

SEQ ID NO: 115115 - DNA, 20 bp, Artificial Sequence
  Description of Artificial Sequence: Synthetic oligonucleotide
  Target: ATXN1; (+) strand; PAM type: NRG; PAM sequence: GGG
gatgaccaagcaggagacag

SEQ ID NO: 115116 - DNA, 20 bp, Artificial Sequence
  Description of Artificial Sequence: Synthetic oligonucleotide
  Target: ATXN1; (+) strand; PAM type: NRG; PAM sequence: TGG
gaccaagcaggagacagggg

SEQ ID NO: 115117 - DNA, 20 bp, Artificial Sequence
  Description of Artificial Sequence: Synthetic oligonucleotide
  Target: ATXN1; (+) strand; PAM type: NRG; PAM sequence: CAG
caggagacaggggtggaccg

SEQ ID NO: 115118 - DNA, 20 bp, Artificial Sequence
  Description of Artificial Sequence: Synthetic oligonucleotide
  Target: ATXN1; (+) strand; PAM type: NRG; PAM sequence: AGG
aggagacaggggtggaccgc

SEQ ID NO: 115119 - DNA, 20 bp, Artificial Sequence
  Description of Artificial Sequence: Synthetic oligonucleotide
  Target: ATXN1; (+) strand; PAM type: NRG; PAM sequence: GGG
ggagacaggggtggaccgca

SEQ ID NO: 115120 - DNA, 20 bp, Artificial Sequence
  Description of Artificial Sequence: Synthetic oligonucleotide
  Target: ATXN1; (+) strand; PAM type: NRG; PAM sequence: GGG
gagacaggggtggaccgcag

SEQ ID NO: 115121 - DNA, 20 bp, Artificial Sequence
  Description of Artificial Sequence: Synthetic oligonucleotide
  Target: ATXN1; (+) strand; PAM type: NRG; PAM sequence: AAG
ggggtggaccgcaggggaaa

SEQ ID NO: 115122 - DNA, 20 bp, Artificial Sequence
  Description of Artificial Sequence: Synthetic oligonucleotide
  Target: ATXN1; (+) strand; PAM type: NRG; PAM sequence: GAG
ggtggaccgcaggggaaaaa

SEQ ID NO: 115123 - DNA, 20 bp, Artificial Sequence
  Description of Artificial Sequence: Synthetic oligonucleotide
  Target: ATXN1; (+) strand; PAM type: NRG; PAM sequence: AAG
gaccgcaggggaaaaagagc

SEQ ID NO: 115124 - DNA, 20 bp, Artificial Sequence
  Description of Artificial Sequence: Synthetic oligonucleotide
  Target: ATXN1; (+) strand; PAM type: NRG; PAM sequence: AAG
aggggaaaaagagcaagctg

SEQ ID NO: 115125 - DNA, 20 bp, Artificial Sequence
  Description of Artificial Sequence: Synthetic oligonucleotide
  Target: ATXN1; (+) strand; PAM type: NRG; PAM sequence: CAG
gaaaaagagcaagctgaagc

SEQ ID NO: 115126 - DNA, 20 bp, Artificial Sequence
  Description of Artificial Sequence: Synthetic oligonucleotide
  Target: ATXN1; (+) strand; PAM type: NRG; PAM sequence: AAG
agagcaagctgaagccagct

SEQ ID NO: 115127 - DNA, 20 bp, Artificial Sequence
  Description of Artificial Sequence: Synthetic oligonucleotide
  Target: ATXN1; (+) strand; PAM type: NRG; PAM sequence: AGG
gagcaagctgaagccagcta

SEQ ID NO: 115128 - DNA, 20 bp, Artificial Sequence
  Description of Artificial Sequence: Synthetic oligonucleotide
  Target: ATXN1; (+) strand; PAM type: NRG; PAM sequence: CGG
agccagctaaggaatgtcct

SEQ ID NO: 115129 - DNA, 20 bp, Artificial Sequence
  Description of Artificial Sequence: Synthetic oligonucleotide
  Target: ATXN1; (+) strand; PAM type: NRG; PAM sequence: GGG
gccagctaaggaatgtcctc

SEQ ID NO: 115130 - DNA, 20 bp, Artificial Sequence
  Description of Artificial Sequence: Synthetic oligonucleotide
  Target: ATXN1; (+) strand; PAM type: NRG; PAM sequence: TAG
aatgtcctcgggccatctcc

SEQ ID NO: 115131 - DNA, 20 bp, Artificial Sequence
  Description of Artificial Sequence: Synthetic oligonucleotide
  Target: ATXN1; (+) strand; PAM type: NRG; PAM sequence: CGG
gtcctcgggccatctcctag

SEQ ID NO: 115132 - DNA, 20 bp, Artificial Sequence
  Description of Artificial Sequence: Synthetic oligonucleotide
  Target: ATXN1; (+) strand; PAM type: NRG; PAM sequence: GAG
cctcgggccatctcctagcg

SEQ ID NO: 115133 - DNA, 20 bp, Artificial Sequence
  Description of Artificial Sequence: Synthetic oligonucleotide
  Target: ATXN1; (+) strand; PAM type: NRG; PAM sequence: AGG
ctcgggccatctcctagcgg

SEQ ID NO: 115134 - DNA, 20 bp, Artificial Sequence
  Description of Artificial Sequence: Synthetic oligonucleotide
  Target: ATXN1; (+) strand; PAM type: NRG; PAM sequence: CGG
gggccatctcctagcggagg

SEQ ID NO: 115135 - DNA, 20 bp, Artificial Sequence
  Description of Artificial Sequence: Synthetic oligonucleotide
  Target: ATXN1; (+) strand; PAM type: NRG; PAM sequence: TAG
ccatctcctagcggaggcgg

SEQ ID NO: 115136 - DNA, 20 bp, Artificial Sequence
  Description of Artificial Sequence: Synthetic oligonucleotide
  Target: ATXN1; (+) strand; PAM type: NRG; PAM sequence: GAG
atctcctagcggaggcggta

SEQ ID NO: 115137 - DNA, 20 bp, Artificial Sequence
  Description of Artificial Sequence: Synthetic oligonucleotide
  Target: ATXN1; (+) strand; PAM type: NRG; PAM sequence: TGG
tagcggaggcggtagagccg

SEQ ID NO: 115138 - DNA, 20 bp, Artificial Sequence
  Description of Artificial Sequence: Synthetic oligonucleotide
  Target: ATXN1; (+) strand; PAM type: NRG; PAM sequence: AAG
aggcggtagagccgtggttg

SEQ ID NO: 115139 - DNA, 20 bp, Artificial Sequence
  Description of Artificial Sequence: Synthetic oligonucleotide
  Target: ATXN1; (+) strand; PAM type: NRG; PAM sequence: AGG
ggcggtagagccgtggttga

SEQ ID NO: 115140 - DNA, 20 bp, Artificial Sequence
  Description of Artificial Sequence: Synthetic oligonucleotide
  Target: ATXN1; (+) strand; PAM type: NRG; PAM sequence: CAG
tagagccgtggttgaaggta

SEQ ID NO: 115141 - DNA, 20 bp, Artificial Sequence
  Description of Artificial Sequence: Synthetic oligonucleotide
  Target: ATXN1; (+) strand; PAM type: NRG; PAM sequence: AGG
agagccgtggttgaaggtac

SEQ ID NO: 115142 - DNA, 20 bp, Artificial Sequence
  Description of Artificial Sequence: Synthetic oligonucleotide
  Target: ATXN1; (+) strand; PAM type: NRG; PAM sequence: AAG
gccgtggttgaaggtacagg

SEQ ID NO: 115143 - DNA, 20 bp, Artificial Sequence
  Description of Artificial Sequence: Synthetic oligonucleotide
  Target: ATXN1; (+) strand; PAM type: NRG; PAM sequence: TGG
gtggttgaaggtacaggaag

SEQ ID NO: 115144 - DNA, 20 bp, Artificial Sequence
  Description of Artificial Sequence: Synthetic oligonucleotide
  Target: ATXN1; (+) strand; PAM type: NRG; PAM sequence: TAG
aggtacaggaagtggactgt

SEQ ID NO: 115145 - DNA, 20 bp, Artificial Sequence
  Description of Artificial Sequence: Synthetic oligonucleotide
  Target: ATXN1; (+) strand; PAM type: NRG; PAM sequence: AGG
ggtacaggaagtggactgtt

SEQ ID NO: 115146 - DNA, 20 bp, Artificial Sequence
  Description of Artificial Sequence: Synthetic oligonucleotide
  Target: ATXN1; (+) strand; PAM type: NRG; PAM sequence: GGG
gtacaggaagtggactgtta

SEQ ID NO: 115147 - DNA, 20 bp, Artificial Sequence
  Description of Artificial Sequence: Synthetic oligonucleotide
  Target: ATXN1; (+) strand; PAM type: NRG; PAM sequence: CAG
ggaagtggactgttagggcc

SEQ ID NO: 115148 - DNA, 20 bp, Artificial Sequence
  Description of Artificial Sequence: Synthetic oligonucleotide
  Target: ATXN1; (+) strand; PAM type: NRG; PAM sequence: AGG
gaagtggactgttagggccc

SEQ ID NO: 115149 - DNA, 20 bp, Artificial Sequence
  Description of Artificial Sequence: Synthetic oligonucleotide
  Target: ATXN1; (+) strand; PAM type: NRG; PAM sequence: GAG
cccaggttccccttaaccat

SEQ ID NO: 115150 - DNA, 20 bp, Artificial Sequence
  Description of Artificial Sequence: Synthetic oligonucleotide
  Target: ATXN1; (+) strand; PAM type: NRG; PAM sequence: AAG
ccccttaaccatgagacctg

SEQ ID NO: 115151 - DNA, 20 bp, Artificial Sequence
  Description of Artificial Sequence: Synthetic oligonucleotide
  Target: ATXN1; (+) strand; PAM type: NRG; PAM sequence: AAG
ttaaccatgagacctgaagc

SEQ ID NO: 115152 - DNA, 20 bp, Artificial Sequence
  Description of Artificial Sequence: Synthetic oligonucleotide
  Target: ATXN1; (+) strand; PAM type: NRG; PAM sequence: TAG
agcaagttactttatttctc

SEQ ID NO: 115153 - DNA, 20 bp, Artificial Sequence
  Description of Artificial Sequence: Synthetic oligonucleotide
  Target: ATXN1; (+) strand; PAM type: NRG; PAM sequence: AGG
gcaagttactttatttctct

SEQ ID NO: 115154 - DNA, 20 bp, Artificial Sequence
  Description of Artificial Sequence: Synthetic oligonucleotide
  Target: ATXN1; (+) strand; PAM type: NRG; PAM sequence: GGG
caagttactttatttctcta

SEQ ID NO: 115155 - DNA, 20 bp, Artificial Sequence
  Description of Artificial Sequence: Synthetic oligonucleotide
  Target: ATXN1; (+) strand; PAM type: NRG; PAM sequence: AAG
aattttctcacctgtaaaac

SEQ ID NO: 115156 - DNA, 20 bp, Artificial Sequence
  Description of Artificial Sequence: Synthetic oligonucleotide
  Target: ATXN1; (+) strand; PAM type: NRG; PAM sequence: GAG
ttttctcacctgtaaaacaa

SEQ ID NO: 115157 - DNA, 20 bp, Artificial Sequence
  Description of Artificial Sequence: Synthetic oligonucleotide
  Target: ATXN1; (+) strand; PAM type: NRG; PAM sequence: CAG
cacctgtaaaacaagagtaa

SEQ ID NO: 115158 - DNA, 20 bp, Artificial Sequence
  Description of Artificial Sequence: Synthetic oligonucleotide
  Target: ATXN1; (+) strand; PAM type: NRG; PAM sequence: TAG
gagtaacagtgctcacctac

SEQ ID NO: 115159 - DNA, 20 bp, Artificial Sequence
  Description of Artificial Sequence: Synthetic oligonucleotide
  Target: ATXN1; (+) strand; PAM type: NRG; PAM sequence: AGG
agtaacagtgctcacctact

SEQ ID NO: 115160 - DNA, 20 bp, Artificial Sequence
  Description of Artificial Sequence: Synthetic oligonucleotide
  Target: ATXN1; (+) strand; PAM type: NRG; PAM sequence: GAG
ctcacctactaggttgctgt

SEQ ID NO: 115161 - DNA, 20 bp, Artificial Sequence
  Description of Artificial Sequence: Synthetic oligonucleotide
  Target: ATXN1; (+) strand; PAM type: NRG; PAM sequence: AGG
tcacctactaggttgctgtg

SEQ ID NO: 115162 - DNA, 20 bp, Artificial Sequence
  Description of Artificial Sequence: Synthetic oligonucleotide
  Target: ATXN1; (+) strand; PAM type: NRG; PAM sequence: TGG
ttttctttttcttttttttt

SEQ ID NO: 115163 - DNA, 20 bp, Artificial Sequence
  Description of Artificial Sequence: Synthetic oligonucleotide
  Target: ATXN1; (+) strand; PAM type: NRG; PAM sequence: GAG
ttctttttcttttttttttg

SEQ ID NO: 115164 - DNA, 20 bp, Artificial Sequence
  Description of Artificial Sequence: Synthetic oligonucleotide
  Target: ATXN1; (+) strand; PAM type: NRG; PAM sequence: CAG
ttttcttttttttttggaga

SEQ ID NO: 115165 - DNA, 20 bp, Artificial Sequence
  Description of Artificial Sequence: Synthetic oligonucleotide
  Target: ATXN1; (+) strand; PAM type: NRG; PAM sequence: GAG
ttcttttttttttggagaca

SEQ ID NO: 115166 - DNA, 20 bp, Artificial Sequence
  Description of Artificial Sequence: Synthetic oligonucleotide
  Target: ATXN1; (+) strand; PAM type: NRG; PAM sequence: CAG
cagagtctcactctgtcacc

SEQ ID NO: 115167 - DNA, 20 bp, Artificial Sequence
  Description of Artificial Sequence: Synthetic oligonucleotide
  Target: ATXN1; (+) strand; PAM type: NRG; PAM sequence: AGG
agagtctcactctgtcaccc

SEQ ID NO: 115168 - DNA, 20 bp, Artificial Sequence
  Description of Artificial Sequence: Synthetic oligonucleotide
  Target: ATXN1; (+) strand; PAM type: NRG; PAM sequence: TGG
tctcactctgtcacccaggc

SEQ ID NO: 115169 - DNA, 20 bp, Artificial Sequence
  Description of Artificial Sequence: Synthetic oligonucleotide
  Target: ATXN1; (+) strand; PAM type: NRG; PAM sequence: GAG
tcactctgtcacccaggctg

SEQ ID NO: 115170 - DNA, 20 bp, Artificial Sequence
  Description of Artificial Sequence: Synthetic oligonucleotide
  Target: ATXN1; (+) strand; PAM type: NRG; PAM sequence: CAG
ctgtcacccaggctggagtg

SEQ ID NO: 115171 - DNA, 20 bp, Artificial Sequence
  Description of Artificial Sequence: Synthetic oligonucleotide
  Target: ATXN1; (+) strand; PAM type: NRG; PAM sequence: TGG
tcacccaggctggagtgcag

SEQ ID NO: 115172 - DNA, 20 bp, Artificial Sequence
  Description of Artificial Sequence: Synthetic oligonucleotide
  Target: ATXN1; (+) strand; PAM type: NRG; PAM sequence: TGG
ggagtgcagtggtgcaatct

SEQ ID NO: 115173 - DNA, 20 bp, Artificial Sequence
  Description of Artificial Sequence: Synthetic oligonucleotide
  Target: ATXN1; (+) strand; PAM type: NRG; PAM sequence: CGG
tcactgcaatctccacctcc

SEQ ID NO: 115174 - DNA, 20 bp, Artificial Sequence
  Description of Artificial Sequence: Synthetic oligonucleotide
  Target: ATXN1; (+) strand; PAM type: NRG; PAM sequence: GGG
cactgcaatctccacctccc

SEQ ID NO: 115175 - DNA, 20 bp, Artificial Sequence
  Description of Artificial Sequence: Synthetic oligonucleotide
  Target: ATXN1; (+) strand; PAM type: NRG; PAM sequence: CAG
aatctccacctcccgggttc

SEQ ID NO: 115176 - DNA, 20 bp, Artificial Sequence
  Description of Artificial Sequence: Synthetic oligonucleotide
  Target: ATXN1; (+) strand; PAM type: NRG; PAM sequence: TAG
ttccagctattctcctgcct

SEQ ID NO: 115177 - DNA, 20 bp, Artificial Sequence
  Description of Artificial Sequence: Synthetic oligonucleotide
  Target: ATXN1; (+) strand; PAM type: NRG; PAM sequence: GAG
ttctcctgccttagcctcct

SEQ ID NO: 115178 - DNA, 20 bp, Artificial Sequence
  Description of Artificial Sequence: Synthetic oligonucleotide
  Target: ATXN1; (+) strand; PAM type: NRG; PAM sequence: TGG
tcctgccttagcctcctgag

SEQ ID NO: 115179 - DNA, 20 bp, Artificial Sequence
  Description of Artificial Sequence: Synthetic oligonucleotide
  Target: ATXN1; (+) strand; PAM type: NRG; PAM sequence: TGG
gccttagcctcctgagtggc

SEQ ID NO: 115180 - DNA, 20 bp, Artificial Sequence
  Description of Artificial Sequence: Synthetic oligonucleotide
  Target: ATXN1; (+) strand; PAM type: NRG; PAM sequence: GGG
ccttagcctcctgagtggct

SEQ ID NO: 115181 - DNA, 20 bp, Artificial Sequence
  Description of Artificial Sequence: Synthetic oligonucleotide
  Target: ATXN1; (+) strand; PAM type: NRG; PAM sequence: CAG
ctcctgagtggctgggacta

SEQ ID NO: 115182 - DNA, 20 bp, Artificial Sequence
  Description of Artificial Sequence: Synthetic oligonucleotide
  Target: ATXN1; (+) strand; PAM type: NRG; PAM sequence: AGG
tcctgagtggctgggactac

SEQ ID NO: 115183 - DNA, 20 bp, Artificial Sequence
  Description of Artificial Sequence: Synthetic oligonucleotide
  Target: ATXN1; (+) strand; PAM type: NRG; PAM sequence: TGG
caggcgcctgccaccacaac

SEQ ID NO: 115184 - DNA, 20 bp, Artificial Sequence
  Description of Artificial Sequence: Synthetic oligonucleotide
  Target: ATXN1; (+) strand; PAM type: NRG; PAM sequence: TAG
ctggctaatttttgtatttt

SEQ ID NO: 115185 - DNA, 20 bp, Artificial Sequence
  Description of Artificial Sequence: Synthetic oligonucleotide
  Target: ATXN1; (+) strand; PAM type: NRG; PAM sequence: TAG
gctaatttttgtatttttag

SEQ ID NO: 115186 - DNA, 20 bp, Artificial Sequence
  Description of Artificial Sequence: Synthetic oligonucleotide
  Target: ATXN1; (+) strand; PAM type: NRG; PAM sequence: GAG
taatttttgtatttttagta

SEQ ID NO: 115187 - DNA, 20 bp, Artificial Sequence
  Description of Artificial Sequence: Synthetic oligonucleotide
  Target: ATXN1; (+) strand; PAM type: NRG; PAM sequence: TGG
ttttgtatttttagtagaga

SEQ ID NO: 115188 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtagagat

SEQ ID NO: 115189 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagatg

SEQ ID NO: 115190 - DNA, 20 bp, Artificial Sequence
  Description of Artificial Sequence: Synthetic oligonucleotide
  Target: ATXN1; (+) strand; PAM type: NRG; PAM sequence: TGG
gagatggggtttcaccacgt

SEQ ID NO: 115191 - DNA, 20 bp, Artificial Sequence
  Description of Artificial Sequence: Synthetic oligonucleotide
  Target: ATXN1; (+) strand; PAM type: NRG; PAM sequence: CAG
tggggtttcaccacgttggc

SEQ ID NO: 115192 - DNA, 20 bp, Artificial Sequence
  Description of Artificial Sequence: Synthetic oligonucleotide
  Target: ATXN1; (+) strand; PAM type: NRG; PAM sequence: TGG
tttcaccacgttggccagcc

SEQ ID NO: 115193 - DNA, 20 bp, Artificial Sequence
  Description of Artificial Sequence: Synthetic oligonucleotide
  Target: ATXN1; (+) strand; PAM type: NRG; PAM sequence: CAG
tggactcaaactcctgacct

SEQ ID NO: 115194 - DNA, 20 bp, Artificial Sequence
  Description of Artificial Sequence: Synthetic oligonucleotide
  Target: ATXN1; (+) strand; PAM type: NRG; PAM sequence: AGG
ggactcaaactcctgacctc

SEQ ID NO: 115195 - DNA, 20 bp, Artificial Sequence
  Description of Artificial Sequence: Synthetic oligonucleotide
  Target: ATXN1; (+) strand; PAM type: NRG; PAM sequence: CAG
ctcaggtgatctgcctgctt

SEQ ID NO: 115196 - DNA, 20 bp, Artificial Sequence
  Description of Artificial Sequence: Synthetic oligonucleotide
  Target: ATXN1; (+) strand; PAM type: NRG; PAM sequence: AAG
ctgcctgcttcagcctccca

SEQ ID NO: 115197 - DNA, 20 bp, Artificial Sequence
  Description of Artificial Sequence: Synthetic oligonucleotide
  Target: ATXN1; (+) strand; PAM type: NRG; PAM sequence: TGG
gcttcagcctcccaaagtgc

SEQ ID NO: 115198 - DNA, 20 bp, Artificial Sequence
  Description of Artificial Sequence: Synthetic oligonucleotide
  Target: ATXN1; (+) strand; PAM type: NRG; PAM sequence: GGG
cttcagcctcccaaagtgct

SEQ ID NO: 115199 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 115200 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 115201 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggcgt

SEQ ID NO: 115202 - DNA, 20 bp, Artificial Sequence
  Description of Artificial Sequence: Synthetic oligonucleotide
  Target: ATXN1; (+) strand; PAM type: NRG; PAM sequence: TGG
caggcgtgagccaccacacc

SEQ ID NO: 115203 - DNA, 20 bp, Artificial Sequence
  Description of Artificial Sequence: Synthetic oligonucleotide
  Target: ATXN1; (+) strand; PAM type: NRG; PAM sequence: GAG
caccacacctggccttctgt

SEQ ID NO: 115204 - DNA, 20 bp, Artificial Sequence
  Description of Artificial Sequence: Synthetic oligonucleotide
  Target: ATXN1; (+) strand; PAM type: NRG; PAM sequence: AGG
accacacctggccttctgtg

SEQ ID NO: 115205 - DNA, 20 bp, Artificial Sequence
  Description of Artificial Sequence: Synthetic oligonucleotide
  Target: ATXN1; (+) strand; PAM type: NRG; PAM sequence: AAG
ctgtgaggttcttaacatgt

SEQ ID NO: 115206 - DNA, 20 bp, Artificial Sequence
  Description of Artificial Sequence: Synthetic oligonucleotide
  Target: ATXN1; (+) strand; PAM type: NRG; PAM sequence: TAG
ttcttaacatgtaagccact

SEQ ID NO: 115207 - DNA, 20 bp, Artificial Sequence
  Description of Artificial Sequence: Synthetic oligonucleotide
  Target: ATXN1; (+) strand; PAM type: NRG; PAM sequence: CAG
aacatgtaagccacttagcc

SEQ ID NO: 115208 - DNA, 20 bp, Artificial Sequence
  Description of Artificial Sequence: Synthetic oligonucleotide
  Target: ATXN1; (+) strand; PAM type: NRG; PAM sequence: TGG
atgtaagccacttagcccag

SEQ ID NO: 115209 - DNA, 20 bp, Artificial Sequence
  Description of Artificial Sequence: Synthetic oligonucleotide
  Target: ATXN1; (+) strand; PAM type: NRG; PAM sequence: TAG
ttagcccagtggctgactca

SEQ ID NO: 115210 - DNA, 20 bp, Artificial Sequence
  Description of Artificial Sequence: Synthetic oligonucleotide
  Target: ATXN1; (+) strand; PAM type: NRG; PAM sequence: TAG
gcccagtggctgactcatag

SEQ ID NO: 115211 - DNA, 20 bp, Artificial Sequence
  Description of Artificial Sequence: Synthetic oligonucleotide
  Target: ATXN1; (+) strand; PAM type: NRG; PAM sequence: GAG
ccattaaatcaatatttatt

SEQ ID NO: 115212 - DNA, 20 bp, Artificial Sequence
  Description of Artificial Sequence: Synthetic oligonucleotide
  Target: ATXN1; (+) strand; PAM type: NRG; PAM sequence: CAG
tttattgagcatccatctgc

SEQ ID NO: 115213 - DNA, 20 bp, Artificial Sequence
  Description of Artificial Sequence: Synthetic oligonucleotide
  Target: ATXN1; (+) strand; PAM type: NRG; PAM sequence: AGG
ttattgagcatccatctgcc

SEQ ID NO: 115214 - DNA, 20 bp, Artificial Sequence
  Description of Artificial Sequence: Synthetic oligonucleotide
  Target: ATXN1; (+) strand; PAM type: NRG; PAM sequence: TAG
ccatctgccaggcactgtac

SEQ ID NO: 115215 - DNA, 20 bp, Artificial Sequence
  Description of Artificial Sequence: Synthetic oligonucleotide
  Target: ATXN1; (+) strand; PAM type: NRG; PAM sequence: AAG
cactgtactagatgctgaca

SEQ ID NO: 115216 - DNA, 20 bp, Artificial Sequence
  Description of Artificial Sequence: Synthetic oligonucleotide
  Target: ATXN1; (+) strand; PAM type: NRG; PAM sequence: TGG
caaataattacctatcctca

SEQ ID NO: 115217 - DNA, 20 bp, Artificial Sequence
  Description of Artificial Sequence: Synthetic oligonucleotide
  Target: ATXN1; (+) strand; PAM type: NRG; PAM sequence: AAG
acctatcctcatggaaataa

SEQ ID NO: 115218 - DNA, 20 bp, Artificial Sequence
  Description of Artificial Sequence: Synthetic oligonucleotide
  Target: ATXN1; (+) strand; PAM type: NRG; PAM sequence: AAG
gaaataaaagatttataatg

SEQ ID NO: 115219 - DNA, 20 bp, Artificial Sequence
  Description of Artificial Sequence: Synthetic oligonucleotide
  Target: ATXN1; (+) strand; PAM type: NRG; PAM sequence: TGG
atgaagtattttccattaaa

SEQ ID NO: 115220 - DNA, 20 bp, Artificial Sequence
  Description of Artificial Sequence: Synthetic oligonucleotide
  Target: ATXN1; (+) strand; PAM type: NRG; PAM sequence: TAG
tattttccattaaatggtga

SEQ ID NO: 115221 - DNA, 20 bp, Artificial Sequence
  Description of Artificial Sequence: Synthetic oligonucleotide
  Target: ATXN1; (+) strand; PAM type: NRG; PAM sequence: AAG
aaatggtgatagatgctaaa

SEQ ID NO: 115222 - DNA, 20 bp, Artificial Sequence
  Description of Artificial Sequence: Synthetic oligonucleotide
  Target: ATXN1; (+) strand; PAM type: NRG; PAM sequence: AAG
gtgatagatgctaaaaagtt

SEQ ID NO: 115223 - DNA, 20 bp, Artificial Sequence
  Description of Artificial Sequence: Synthetic oligonucleotide
  Target: ATXN1; (+) strand; PAM type: NRG; PAM sequence: CAG
atagatgctaaaaagttaag

SEQ ID NO: 115224 - DNA, 20 bp, Artificial Sequence
  Description of Artificial Sequence: Synthetic oligonucleotide
  Target: ATXN1; (+) strand; PAM type: NRG; PAM sequence: AAG
tgctaaaaagttaagcagaa

SEQ ID NO: 115225 - DNA, 20 bp, Artificial Sequence
  Description of Artificial Sequence: Synthetic oligonucleotide
  Target: ATXN1; (+) strand; PAM type: NRG; PAM sequence: AGG
gctaaaaagttaagcagaaa

SEQ ID NO: 115226 - DNA, 20 bp, Artificial Sequence
  Description of Artificial Sequence: Synthetic oligonucleotide
  Target: ATXN1; (+) strand; PAM type: NRG; PAM sequence: GGG
ctaaaaagttaagcagaaaa

SEQ ID NO: 115227 - DNA, 20 bp, Artificial Sequence
  Description of Artificial Sequence: Synthetic oligonucleotide
  Target: ATXN1; (+) strand; PAM type: NRG; PAM sequence: GGG
taaaaagttaagcagaaaag

SEQ ID NO: 115228 - DNA, 20 bp, Artificial Sequence
  Description of Artificial Sequence: Synthetic oligonucleotide
  Target: ATXN1; (+) strand; PAM type: NRG; PAM sequence: GGG
aaaaagttaagcagaaaagg

SEQ ID NO: 115229 - DNA, 20 bp, Artificial Sequence
  Description of Artificial Sequence: Synthetic oligonucleotide
  Target: ATXN1; (+) strand; PAM type: NRG; PAM sequence: TAG
agttaagcagaaaagggggc

SEQ ID NO: 115230 - DNA, 20 bp, Artificial Sequence
  Description of Artificial Sequence: Synthetic oligonucleotide
  Target: ATXN1; (+) strand; PAM type: NRG; PAM sequence: AGG
gttaagcagaaaagggggct

SEQ ID NO: 115231 - DNA, 20 bp, Artificial Sequence
  Description of Artificial Sequence: Synthetic oligonucleotide
  Target: ATXN1; (+) strand; PAM type: NRG; PAM sequence: GGG
ttaagcagaaaagggggcta

SEQ ID NO: 115232 - DNA, 20 bp, Artificial Sequence
  Description of Artificial Sequence: Synthetic oligonucleotide
  Target: ATXN1; (+) strand; PAM type: NRG; PAM sequence: TGG
agcagaaaagggggctaggg

SEQ ID NO: 115233 - DNA, 20 bp, Artificial Sequence
  Description of Artificial Sequence: Synthetic oligonucleotide
  Target: ATXN1; (+) strand; PAM type: NRG; PAM sequence: TGG
agaaaagggggctagggtgg

SEQ ID NO: 115234 - DNA, 20 bp, Artificial Sequence
  Description of Artificial Sequence: Synthetic oligonucleotide
  Target: ATXN1; (+) strand; PAM type: NRG; PAM sequence: TGG
agggggctagggtggtggtc

SEQ ID NO: 115235 - DNA, 20 bp, Artificial Sequence
  Description of Artificial Sequence: Synthetic oligonucleotide
  Target: ATXN1; (+) strand; PAM type: NRG; PAM sequence: AAG
ggtctggtgaccattttttc

SEQ ID NO: 115236 - DNA, 20 bp, Artificial Sequence
  Description of Artificial Sequence: Synthetic oligonucleotide
  Target: ATXN1; (+) strand; PAM type: NRG; PAM sequence: CAG
gaccattttttcaagcttgt

SEQ ID NO: 115237 - DNA, 20 bp, Artificial Sequence
  Description of Artificial Sequence: Synthetic oligonucleotide
  Target: ATXN1; (+) strand; PAM type: NRG; PAM sequence: AAG
ttcaagcttgtcagtcaaaa

SEQ ID NO: 115238 - DNA, 20 bp, Artificial Sequence
  Description of Artificial Sequence: Synthetic oligonucleotide
  Target: ATXN1; (+) strand; PAM type: NRG; PAM sequence: CAG
gtcagtcaaaaaagacctca

SEQ ID NO: 115239 - DNA, 20 bp, Artificial Sequence
  Description of Artificial Sequence: Synthetic oligonucleotide
  Target: ATXN1; (+) strand; PAM type: NRG; PAM sequence: GAG
cagtcaaaaaagacctcaca

SEQ ID NO: 115240 - DNA, 20 bp, Artificial Sequence
  Description of Artificial Sequence: Synthetic oligonucleotide
  Target: ATXN1; (+) strand; PAM type: NRG; PAM sequence: CAG
caaaaaagacctcacagaga

SEQ ID NO: 115241 - DNA, 20 bp, Artificial Sequence
  Description of Artificial Sequence: Synthetic oligonucleotide
  Target: ATXN1; (+) strand; PAM type: NRG; PAM sequence: TGG
ctcacagagacagtaacttt

SEQ ID NO: 115242 - DNA, 20 bp, Artificial Sequence
  Description of Artificial Sequence: Synthetic oligonucleotide
  Target: ATXN1; (+) strand; PAM type: NRG; PAM sequence: GGG
tcacagagacagtaactttt

SEQ ID NO: 115243 - DNA, 20 bp, Artificial Sequence
  Description of Artificial Sequence: Synthetic oligonucleotide
  Target: ATXN1; (+) strand; PAM type: NRG; PAM sequence: GGG
cacagagacagtaacttttg

SEQ ID NO: 115244 - DNA, 20 bp, Artificial Sequence
  Description of Artificial Sequence: Synthetic oligonucleotide
  Target: ATXN1; (+) strand; PAM type: NRG; PAM sequence: AAG
agacagtaacttttggggaa

SEQ ID NO: 115245 - DNA, 20 bp, Artificial Sequence
  Description of Artificial Sequence: Synthetic oligonucleotide
  Target: ATXN1; (+) strand; PAM type: NRG; PAM sequence: AAG
aacttttggggaaaagcctg

SEQ ID NO: 115246 - DNA, 20 bp, Artificial Sequence
  Description of Artificial Sequence: Synthetic oligonucleotide
  Target: ATXN1; (+) strand; PAM type: NRG; PAM sequence: AAG
tttggggaaaagcctgaaga

SEQ ID NO: 115247 - DNA, 20 bp, Artificial Sequence
  Description of Artificial Sequence: Synthetic oligonucleotide
  Target: ATXN1; (+) strand; PAM type: NRG; PAM sequence: AGG
ttggggaaaagcctgaagaa

SEQ ID NO: 115248 - DNA, 20 bp, Artificial Sequence
  Description of Artificial Sequence: Synthetic oligonucleotide
  Target: ATXN1; (+) strand; PAM type: NRG; PAM sequence: GGG
tggggaaaagcctgaagaaa

SEQ ID NO: 115249 - DNA, 20 bp, Artificial Sequence
  Description of Artificial Sequence: Synthetic oligonucleotide
  Target: ATXN1; (+) strand; PAM type: NRG; PAM sequence: TAG
aaagcctgaagaaagggaaa

SEQ ID NO: 115250 - DNA, 20 bp, Artificial Sequence
  Description of Artificial Sequence: Synthetic oligonucleotide
  Target: ATXN1; (+) strand; PAM type: NRG; PAM sequence: AAG
cctgaagaaagggaaataga

SEQ ID NO: 115251 - DNA, 20 bp, Artificial Sequence
  Description of Artificial Sequence: Synthetic oligonucleotide
  Target: ATXN1; (+) strand; PAM type: NRG; PAM sequence: TGG
aagggaaatagaaagcaatg

SEQ ID NO: 115252 - DNA, 20 bp, Artificial Sequence
  Description of Artificial Sequence: Synthetic oligonucleotide
  Target: ATXN1; (+) strand; PAM type: NRG; PAM sequence: TGG
atagaaagcaatgtggtgac

SEQ ID NO: 115253 - DNA, 20 bp, Artificial Sequence
  Description of Artificial Sequence: Synthetic oligonucleotide
  Target: ATXN1; (+) strand; PAM type: NRG; PAM sequence: GGG
tagaaagcaatgtggtgact

SEQ ID NO: 115254 - DNA, 20 bp, Artificial Sequence
  Description of Artificial Sequence: Synthetic oligonucleotide
  Target: ATXN1; (+) strand; PAM type: NRG; PAM sequence: GGG
agaaagcaatgtggtgactg

SEQ ID NO: 115255 - DNA, 20 bp, Artificial Sequence
  Description of Artificial Sequence: Synthetic oligonucleotide
  Target: ATXN1; (+) strand; PAM type: NRG; PAM sequence: GGG
gaaagcaatgtggtgactgg

SEQ ID NO: 115256 - DNA, 20 bp, Artificial Sequence
  Description of Artificial Sequence: Synthetic oligonucleotide
  Target: ATXN1; (+) strand; PAM type: NRG; PAM sequence: AAG
agcaatgtggtgactggggg

SEQ ID NO: 115257 - DNA, 20 bp, Artificial Sequence
  Description of Artificial Sequence: Synthetic oligonucleotide
  Target: ATXN1; (+) strand; PAM type: NRG; PAM sequence: GAG
caatgtggtgactgggggaa

SEQ ID NO: 115258 - DNA, 20 bp, Artificial Sequence
  Description of Artificial Sequence: Synthetic oligonucleotide
  Target: ATXN1; (+) strand; PAM type: NRG; PAM sequence: CAG
tgggggaagagccttcctga

SEQ ID NO: 115259 - DNA, 20 bp, Artificial Sequence
  Description of Artificial Sequence: Synthetic oligonucleotide
  Target: ATXN1; (+) strand; PAM type: NRG; PAM sequence: AAG
ggaagagccttcctgacaga

SEQ ID NO: 115260 - DNA, 20 bp, Artificial Sequence
  Description of Artificial Sequence: Synthetic oligonucleotide
  Target: ATXN1; (+) strand; PAM type: NRG; PAM sequence: CAG
agccttcctgacagaaagaa

SEQ ID NO: 115261 - DNA, 20 bp, Artificial Sequence
  Description of Artificial Sequence: Synthetic oligonucleotide
  Target: ATXN1; (+) strand; PAM type: NRG; PAM sequence: AAG
cttcctgacagaaagaacag

SEQ ID NO: 115262 - DNA, 20 bp, Artificial Sequence
  Description of Artificial Sequence: Synthetic oligonucleotide
  Target: ATXN1; (+) strand; PAM type: NRG; PAM sequence: AGG
ttcctgacagaaagaacaga

SEQ ID NO: 115263 - DNA, 20 bp, Artificial Sequence
  Description of Artificial Sequence: Synthetic oligonucleotide
  Target: ATXN1; (+) strand; PAM type: NRG; PAM sequence: AAG
cagaaagaacagaaggtacc

SEQ ID NO: 115264 - DNA, 20 bp, Artificial Sequence
  Description of Artificial Sequence: Synthetic oligonucleotide
  Target: ATXN1; (+) strand; PAM type: NRG; PAM sequence: AGG
agaaagaacagaaggtacca

SEQ ID NO: 115265 - DNA, 20 bp, Artificial Sequence
  Description of Artificial Sequence: Synthetic oligonucleotide
  Target: ATXN1; (+) strand; PAM type: NRG; PAM sequence: TGG
aacagaaggtaccaaggtcc

SEQ ID NO: 115266 - DNA, 20 bp, Artificial Sequence
  Description of Artificial Sequence: Synthetic oligonucleotide
  Target: ATXN1; (+) strand; PAM type: NRG; PAM sequence: GGG
acagaaggtaccaaggtcct

SEQ ID NO: 115267 - DNA, 20 bp, Artificial Sequence
  Description of Artificial Sequence: Synthetic oligonucleotide
  Target: ATXN1; (+) strand; PAM type: NRG; PAM sequence: GGG
cagaaggtaccaaggtcctg

SEQ ID NO: 115268 - DNA, 20 bp, Artificial Sequence
  Description of Artificial Sequence: Synthetic oligonucleotide
  Target: ATXN1; (+) strand; PAM type: NRG; PAM sequence: TGG
aaggtaccaaggtcctgggg

SEQ ID NO: 115269 - DNA, 20 bp, Artificial Sequence
  Description of Artificial Sequence: Synthetic oligonucleotide
  Target: ATXN1; (+) strand; PAM type: NRG; PAM sequence: GGG
aggtaccaaggtcctggggt

SEQ ID NO: 115270 - DNA, 20 bp, Artificial Sequence
  Description of Artificial Sequence: Synthetic oligonucleotide
  Target: ATXN1; (+) strand; PAM type: NRG; PAM sequence: TGG
tcctggggtgggctcctgtg

SEQ ID NO: 115271 - DNA, 20 bp, Artificial Sequence
  Description of Artificial Sequence: Synthetic oligonucleotide
  Target: ATXN1; (+) strand; PAM type: NRG; PAM sequence: TGG
tgggctcctgtgtggtgtgt

SEQ ID NO: 115272 - DNA, 20 bp, Artificial Sequence
  Description of Artificial Sequence: Synthetic oligonucleotide
  Target: ATXN1; (+) strand; PAM type: NRG; PAM sequence: GAG
ggctcctgtgtggtgtgttg

SEQ ID NO: 115273 - DNA, 20 bp, Artificial Sequence
  Description of Artificial Sequence: Synthetic oligonucleotide
  Target: ATXN1; (+) strand; PAM type: NRG; PAM sequence: AGG
gctcctgtgtggtgtgttgg

SEQ ID NO: 115274 - DNA, 20 bp, Artificial Sequence
  Description of Artificial Sequence: Synthetic oligonucleotide
  Target: ATXN1; (+) strand; PAM type: NRG; PAM sequence: GAG
tgtgttggaggaacaccatc

SEQ ID NO: 115275 - DNA, 20 bp, Artificial Sequence
  Description of Artificial Sequence: Synthetic oligonucleotide
  Target: ATXN1; (+) strand; PAM type: NRG; PAM sequence: AGG
gtgttggaggaacaccatcg

SEQ ID NO: 115276 - DNA, 20 bp, Artificial Sequence
  Description of Artificial Sequence: Synthetic oligonucleotide
  Target: ATXN1; (+) strand; PAM type: NRG; PAM sequence: TGG
ttggaggaacaccatcgagg

SEQ ID NO: 115277 - DNA, 20 bp, Artificial Sequence
  Description of Artificial Sequence: Synthetic oligonucleotide
  Target: ATXN1; (+) strand; PAM type: NRG; PAM sequence: TGG
caccatcgaggtggtgttcc

SEQ ID NO: 115278 - DNA, 20 bp, Artificial Sequence
  Description of Artificial Sequence: Synthetic oligonucleotide
  Target: ATXN1; (+) strand; PAM type: NRG; PAM sequence: GAG
gaggtggtgttcctggcact

SEQ ID NO: 115279 - DNA, 20 bp, Artificial Sequence
  Description of Artificial Sequence: Synthetic oligonucleotide
  Target: ATXN1; (+) strand; PAM type: NRG; PAM sequence: AAG
ggtgttcctggcactgagta

SEQ ID NO: 115280 - DNA, 20 bp, Artificial Sequence
  Description of Artificial Sequence: Synthetic oligonucleotide
  Target: ATXN1; (+) strand; PAM type: NRG; PAM sequence: AGG
gtgttcctggcactgagtaa

SEQ ID NO: 115281 - DNA, 20 bp, Artificial Sequence
  Description of Artificial Sequence: Synthetic oligonucleotide
  Target: ATXN1; (+) strand; PAM type: NRG; PAM sequence: GGG
tgttcctggcactgagtaaa

SEQ ID NO: 115282 - DNA, 20 bp, Artificial Sequence
  Description of Artificial Sequence: Synthetic oligonucleotide
  Target: ATXN1; (+) strand; PAM type: NRG; PAM sequence: GGG
gttcctggcactgagtaaag

SEQ ID NO: 115283 - DNA, 20 bp, Artificial Sequence
  Description of Artificial Sequence: Synthetic oligonucleotide
  Target: ATXN1; (+) strand; PAM type: NRG; PAM sequence: GGG
ttcctggcactgagtaaagg

SEQ ID NO: 115284 - DNA, 20 bp, Artificial Sequence
  Description of Artificial Sequence: Synthetic oligonucleotide
  Target: ATXN1; (+) strand; PAM type: NRG; PAM sequence: TGG
ctggcactgagtaaaggggg

SEQ ID NO: 115285 - DNA, 20 bp, Artificial Sequence
  Description of Artificial Sequence: Synthetic oligonucleotide
  Target: ATXN1; (+) strand; PAM type: NRG; PAM sequence: GGG
tggcactgagtaaagggggt

SEQ ID NO: 115286 - DNA, 20 bp, Artificial Sequence
  Description of Artificial Sequence: Synthetic oligonucleotide
  Target: ATXN1; (+) strand; PAM type: NRG; PAM sequence: GGG
ggcactgagtaaagggggtg

SEQ ID NO: 115287 - DNA, 20 bp, Artificial Sequence
  Description of Artificial Sequence: Synthetic oligonucleotide
  Target: ATXN1; (+) strand; PAM type: NRG; PAM sequence: GAG
cactgagtaaagggggtggg

SEQ ID NO: 115288 - DNA, 20 bp, Artificial Sequence
  Description of Artificial Sequence: Synthetic oligonucleotide
  Target: ATXN1; (+) strand; PAM type: NRG; PAM sequence: CAG
tgagtaaagggggtggggag

SEQ ID NO: 115289 - DNA, 20 bp, Artificial Sequence
  Description of Artificial Sequence: Synthetic oligonucleotide
  Target: ATXN1; (+) strand; PAM type: NRG; PAM sequence: AGG
gagtaaagggggtggggagc

SEQ ID NO: 115290 - DNA, 20 bp, Artificial Sequence
  Description of Artificial Sequence: Synthetic oligonucleotide
  Target: ATXN1; (+) strand; PAM type: NRG; PAM sequence: AAG
ggggtggggagcaggaaatg

SEQ ID NO: 115291 - DNA, 20 bp, Artificial Sequence
  Description of Artificial Sequence: Synthetic oligonucleotide
  Target: ATXN1; (+) strand; PAM type: NRG; PAM sequence: CAG
tggggagcaggaaatgaagt

SEQ ID NO: 115292 - DNA, 20 bp, Artificial Sequence
  Description of Artificial Sequence: Synthetic oligonucleotide
  Target: ATXN1; (+) strand; PAM type: NRG; PAM sequence: GAG
gggagcaggaaatgaagtca

SEQ ID NO: 115293 - DNA, 20 bp, Artificial Sequence
  Description of Artificial Sequence: Synthetic oligonucleotide
  Target: ATXN1; (+) strand; PAM type: NRG; PAM sequence: AGG
ggagcaggaaatgaagtcag

SEQ ID NO: 115294 - DNA, 20 bp, Artificial Sequence
  Description of Artificial Sequence: Synthetic oligonucleotide
  Target: ATXN1; (+) strand; PAM type: NRG; PAM sequence: GGG
gagcaggaaatgaagtcaga

SEQ ID NO: 115295 - DNA, 20 bp, Artificial Sequence
  Description of Artificial Sequence: Synthetic oligonucleotide
  Target: ATXN1; (+) strand; PAM type: NRG; PAM sequence: TGG
caggaaatgaagtcagaggg

SEQ ID NO: 115296 - DNA, 20 bp, Artificial Sequence
  Description of Artificial Sequence: Synthetic oligonucleotide
  Target: ATXN1; (+) strand; PAM type: NRG; PAM sequence: GGG
aggaaatgaagtcagagggt

SEQ ID NO: 115297 - DNA, 20 bp, Artificial Sequence
  Description of Artificial Sequence: Synthetic oligonucleotide
  Target: ATXN1; (+) strand; PAM type: NRG; PAM sequence: GGG
ggaaatgaagtcagagggtg

SEQ ID NO: 115298 - DNA, 20 bp, Artificial Sequence
  Description of Artificial Sequence: Synthetic oligonucleotide
  Target: ATXN1; (+) strand; PAM type: NRG; PAM sequence: GGG
gaaatgaagtcagagggtgg

SEQ ID NO: 115299 - DNA, 20 bp, Artificial Sequence
  Description of Artificial Sequence: Synthetic oligonucleotide
  Target: ATXN1; (+) strand; PAM type: NRG; PAM sequence: AAG
agtcagagggtgggggtgac

SEQ ID NO: 115300 - DNA, 20 bp, Artificial Sequence
  Description of Artificial Sequence: Synthetic oligonucleotide
  Target: ATXN1; (+) strand; PAM type: NRG; PAM sequence: GAG
gtgggggtgacaagttcttt

SEQ ID NO: 115301 - DNA, 20 bp, Artificial Sequence
  Description of Artificial Sequence: Synthetic oligonucleotide
  Target: ATXN1; (+) strand; PAM type: NRG; PAM sequence: AAG
aagttctttgagccacaata

SEQ ID NO: 115302 - DNA, 20 bp, Artificial Sequence
  Description of Artificial Sequence: Synthetic oligonucleotide
  Target: ATXN1; (+) strand; PAM type: NRG; PAM sequence: GAG
tttgagccacaataaagtct

SEQ ID NO: 115303 - DNA, 20 bp, Artificial Sequence
  Description of Artificial Sequence: Synthetic oligonucleotide
  Target: ATXN1; (+) strand; PAM type: NRG; PAM sequence: AGG
ttgagccacaataaagtctg

SEQ ID NO: 115304 - DNA, 20 bp, Artificial Sequence
  Description of Artificial Sequence: Synthetic oligonucleotide
  Target: ATXN1; (+) strand; PAM type: NRG; PAM sequence: GAG
aagtctgaggtccttactct

SEQ ID NO: 115305 - DNA, 20 bp, Artificial Sequence
  Description of Artificial Sequence: Synthetic oligonucleotide
  Target: ATXN1; (+) strand; PAM type: NRG; PAM sequence: GAG
ctgaggtccttactctgagt

SEQ ID NO: 115306 - DNA, 20 bp, Artificial Sequence
  Description of Artificial Sequence: Synthetic oligonucleotide
  Target: ATXN1; (+) strand; PAM type: NRG; PAM sequence: GAG
gtccttactctgagtgagct

SEQ ID NO: 115307 - DNA, 20 bp, Artificial Sequence
  Description of Artificial Sequence: Synthetic oligonucleotide
  Target: ATXN1; (+) strand; PAM type: NRG; PAM sequence: GAG
ccttactctgagtgagctga

SEQ ID NO: 115308 - DNA, 20 bp, Artificial Sequence
  Description of Artificial Sequence: Synthetic oligonucleotide
  Target: ATXN1; (+) strand; PAM type: NRG; PAM sequence: AGG
cttactctgagtgagctgag

SEQ ID NO: 115309 - DNA, 20 bp, Artificial Sequence
  Description of Artificial Sequence: Synthetic oligonucleotide
  Target: ATXN1; (+) strand; PAM type: NRG; PAM sequence: TGG
ctgagtgagctgagaggcac

SEQ ID NO: 115310 - DNA, 20 bp, Artificial Sequence
  Description of Artificial Sequence: Synthetic oligonucleotide
  Target: ATXN1; (+) strand; PAM type: NRG; PAM sequence: GAG
gagtgagctgagaggcactg

SEQ ID NO: 115311 - DNA, 20 bp, Artificial Sequence
  Description of Artificial Sequence: Synthetic oligonucleotide
  Target: ATXN1; (+) strand; PAM type: NRG; PAM sequence: AGG
agtgagctgagaggcactgg

SEQ ID NO: 115312 - DNA, 20 bp, Artificial Sequence
  Description of Artificial Sequence: Synthetic oligonucleotide
  Target: ATXN1; (+) strand; PAM type: NRG; PAM sequence: GGG
gtgagctgagaggcactgga

SEQ ID NO: 115313 - DNA, 20 bp, Artificial Sequence
  Description of Artificial Sequence: Synthetic oligonucleotide
  Target: ATXN1; (+) strand; PAM type: NRG; PAM sequence: CAG
aggcactggagggttttgat

SEQ ID NO: 115314 - DNA, 20 bp, Artificial Sequence
  Description of Artificial Sequence: Synthetic oligonucleotide
  Target: ATXN1; (+) strand; PAM type: NRG; PAM sequence: GAG
gcactggagggttttgatca

SEQ ID NO: 115315 - DNA, 20 bp, Artificial Sequence
  Description of Artificial Sequence: Synthetic oligonucleotide
  Target: ATXN1; (+) strand; PAM type: NRG; PAM sequence: AGG
cactggagggttttgatcag

SEQ ID NO: 115316 - DNA, 20 bp, Artificial Sequence
  Description of Artificial Sequence: Synthetic oligonucleotide
  Target: ATXN1; (+) strand; PAM type: NRG; PAM sequence: GAG
ctggagggttttgatcagag

SEQ ID NO: 115317 - DNA, 20 bp, Artificial Sequence
  Description of Artificial Sequence: Synthetic oligonucleotide
  Target: ATXN1; (+) strand; PAM type: NRG; PAM sequence: AGG
tggagggttttgatcagagg

SEQ ID NO: 115318 - DNA, 20 bp, Artificial Sequence
  Description of Artificial Sequence: Synthetic oligonucleotide
  Target: ATXN1; (+) strand; PAM type: NRG; PAM sequence: CAG
ggttttgatcagaggaggta

SEQ ID NO: 115319 - DNA, 20 bp, Artificial Sequence
  Description of Artificial Sequence: Synthetic oligonucleotide
  Target: ATXN1; (+) strand; PAM type: NRG; PAM sequence: AGG
gttttgatcagaggaggtac

SEQ ID NO: 115320 - DNA, 20 bp, Artificial Sequence
  Description of Artificial Sequence: Synthetic oligonucleotide
  Target: ATXN1; (+) strand; PAM type: NRG; PAM sequence: GGG
ttttgatcagaggaggtaca

SEQ ID NO: 115321 - DNA, 20 bp, Artificial Sequence
  Description of Artificial Sequence: Synthetic oligonucleotide
  Target: ATXN1; (+) strand; PAM type: NRG; PAM sequence: TGG
atcagaggaggtacagggtc

SEQ ID NO: 115322 - DNA, 20 bp, Artificial Sequence
  Description of Artificial Sequence: Synthetic oligonucleotide
  Target: ATXN1; (+) strand; PAM type: NRG; PAM sequence: CAG
ggtctggactacattttcac

SEQ ID NO: 115323 - DNA, 20 bp, Artificial Sequence
  Description of Artificial Sequence: Synthetic oligonucleotide
  Target: ATXN1; (+) strand; PAM type: NRG; PAM sequence: TGG
acattttcaccagttcatgc

SEQ ID NO: 115324 - DNA, 20 bp, Artificial Sequence
  Description of Artificial Sequence: Synthetic oligonucleotide
  Target: ATXN1; (+) strand; PAM type: NRG; PAM sequence: TGG
agttcatgctggctgttgca

SEQ ID NO: 115325 - DNA, 20 bp, Artificial Sequence
  Description of Artificial Sequence: Synthetic oligonucleotide
  Target: ATXN1; (+) strand; PAM type: NRG; PAM sequence: GAG
ttcatgctggctgttgcatg

SEQ ID NO: 115326 - DNA, 20 bp, Artificial Sequence
  Description of Artificial Sequence: Synthetic oligonucleotide
  Target: ATXN1; (+) strand; PAM type: NRG; PAM sequence: AGG
tcatgctggctgttgcatgg

SEQ ID NO: 115327 - DNA, 20 bp, Artificial Sequence
  Description of Artificial Sequence: Synthetic oligonucleotide
  Target: ATXN1; (+) strand; PAM type: NRG; PAM sequence: GAG
atgctggctgttgcatggag

SEQ ID NO: 115328 - DNA, 20 bp, Artificial Sequence
  Description of Artificial Sequence: Synthetic oligonucleotide
  Target: ATXN1; (+) strand; PAM type: NRG; PAM sequence: GAG
ttgcatggaggagatattct

SEQ ID NO: 115329 - DNA, 20 bp, Artificial Sequence
  Description of Artificial Sequence: Synthetic oligonucleotide
  Target: ATXN1; (+) strand; PAM type: NRG; PAM sequence: AAG
catggaggagatattctgag

SEQ ID NO: 115330 - DNA, 20 bp, Artificial Sequence
  Description of Artificial Sequence: Synthetic oligonucleotide
  Target: ATXN1; (+) strand; PAM type: NRG; PAM sequence: AAG
ggaggagatattctgagaag

SEQ ID NO: 115331 - DNA, 20 bp, Artificial Sequence
  Description of Artificial Sequence: Synthetic oligonucleotide
  Target: ATXN1; (+) strand; PAM type: NRG; PAM sequence: CAG
ggagatattctgagaagaag

SEQ ID NO: 115332 - DNA, 20 bp, Artificial Sequence
  Description of Artificial Sequence: Synthetic oligonucleotide
  Target: ATXN1; (+) strand; PAM type: NRG; PAM sequence: GAG
agatattctgagaagaagca

SEQ ID NO: 115333 - DNA, 20 bp, Artificial Sequence
  Description of Artificial Sequence: Synthetic oligonucleotide
  Target: ATXN1; (+) strand; PAM type: NRG; PAM sequence: GAG
atattctgagaagaagcaga

SEQ ID NO: 115334 - DNA, 20 bp, Artificial Sequence
  Description of Artificial Sequence: Synthetic oligonucleotide
  Target: ATXN1; (+) strand; PAM type: NRG; PAM sequence: CAG
gaagaagcagagagactact

SEQ ID NO: 115335 - DNA, 20 bp, Artificial Sequence
  Description of Artificial Sequence: Synthetic oligonucleotide
  Target: ATXN1; (+) strand; PAM type: NRG; PAM sequence: AGG
aagaagcagagagactactc

SEQ ID NO: 115336 - DNA, 20 bp, Artificial Sequence
  Description of Artificial Sequence: Synthetic oligonucleotide
  Target: ATXN1; (+) strand; PAM type: NRG; PAM sequence: GAG
gaagcagagagactactcag

SEQ ID NO: 115337 - DNA, 20 bp, Artificial Sequence
  Description of Artificial Sequence: Synthetic oligonucleotide
  Target: ATXN1; (+) strand; PAM type: NRG; PAM sequence: AGG
aagcagagagactactcagg

SEQ ID NO: 115338 - DNA, 20 bp, Artificial Sequence
  Description of Artificial Sequence: Synthetic oligonucleotide
  Target: ATXN1; (+) strand; PAM type: NRG; PAM sequence: CAG
aggaggttactgatgaactc

SEQ ID NO: 115339 - DNA, 20 bp, Artificial Sequence
  Description of Artificial Sequence: Synthetic oligonucleotide
  Target: ATXN1; (+) strand; PAM type: NRG; PAM sequence: AAG
gttactgatgaactccagcc

SEQ ID NO: 115340 - DNA, 20 bp, Artificial Sequence
  Description of Artificial Sequence: Synthetic oligonucleotide
  Target: ATXN1; (+) strand; PAM type: NRG; PAM sequence: GAG
tactgatgaactccagccaa

SEQ ID NO: 115341 - DNA, 20 bp, Artificial Sequence
  Description of Artificial Sequence: Synthetic oligonucleotide
  Target: ATXN1; (+) strand; PAM type: NRG; PAM sequence: TGG
gatgaactccagccaagaga

SEQ ID NO: 115342 - DNA, 20 bp, Artificial Sequence
  Description of Artificial Sequence: Synthetic oligonucleotide
  Target: ATXN1; (+) strand; PAM type: NRG; PAM sequence: TGG
gaactccagccaagagatgg

SEQ ID NO: 115343 - DNA, 20 bp, Artificial Sequence
  Description of Artificial Sequence: Synthetic oligonucleotide
  Target: ATXN1; (+) strand; PAM type: NRG; PAM sequence: TGG
gccaagagatggtggcaccg

SEQ ID NO: 115344 - DNA, 20 bp, Artificial Sequence
  Description of Artificial Sequence: Synthetic oligonucleotide
  Target: ATXN1; (+) strand; PAM type: NRG; PAM sequence: CAG
gagatggtggcaccgtggac

SEQ ID NO: 115345 - DNA, 20 bp, Artificial Sequence
  Description of Artificial Sequence: Synthetic oligonucleotide
  Target: ATXN1; (+) strand; PAM type: NRG; PAM sequence: CAG
atggtggcaccgtggaccag

SEQ ID NO: 115346 - DNA, 20 bp, Artificial Sequence
  Description of Artificial Sequence: Synthetic oligonucleotide
  Target: ATXN1; (+) strand; PAM type: NRG; PAM sequence: TAG
cgtggaccagcagaattgtg

SEQ ID NO: 115347 - DNA, 20 bp, Artificial Sequence
  Description of Artificial Sequence: Synthetic oligonucleotide
  Target: ATXN1; (+) strand; PAM type: NRG; PAM sequence: AGG
gtggaccagcagaattgtgt

SEQ ID NO: 115348 - DNA, 20 bp, Artificial Sequence
  Description of Artificial Sequence: Synthetic oligonucleotide
  Target: ATXN1; (+) strand; PAM type: NRG; PAM sequence: GAG
ggaccagcagaattgtgtag

SEQ ID NO: 115349 - DNA, 20 bp, Artificial Sequence
  Description of Artificial Sequence: Synthetic oligonucleotide
  Target: ATXN1; (+) strand; PAM type: NRG; PAM sequence: AAG
gcagaattgtgtaggagaaa

SEQ ID NO: 115350 - DNA, 20 bp, Artificial Sequence
  Description of Artificial Sequence: Synthetic oligonucleotide
  Target: ATXN1; (+) strand; PAM type: NRG; PAM sequence: GAG
agaattgtgtaggagaaaaa

SEQ ID NO: 115351 - DNA, 20 bp, Artificial Sequence
  Description of Artificial Sequence: Synthetic oligonucleotide
  Target: ATXN1; (+) strand; PAM type: NRG; PAM sequence: AGG
gaattgtgtaggagaaaaag

SEQ ID NO: 115352 - DNA, 20 bp, Artificial Sequence
  Description of Artificial Sequence: Synthetic oligonucleotide
  Target: ATXN1; (+) strand; PAM type: NRG; PAM sequence: AAG
gtaggagaaaaagaggcatc

SEQ ID NO: 115353 - DNA, 20 bp, Artificial Sequence
  Description of Artificial Sequence: Synthetic oligonucleotide
  Target: ATXN1; (+) strand; PAM type: NRG; PAM sequence: AGG
taggagaaaaagaggcatca

SEQ ID NO: 115354 - DNA, 20 bp, Artificial Sequence
  Description of Artificial Sequence: Synthetic oligonucleotide
  Target: ATXN1; (+) strand; PAM type: NRG; PAM sequence: TGG
aaggacaacgtcaacaactg

SEQ ID NO: 115355 - DNA, 20 bp, Artificial Sequence
  Description of Artificial Sequence: Synthetic oligonucleotide
  Target: ATXN1; (+) strand; PAM type: NRG; PAM sequence: GAG
aacgtcaacaactgtggcct

SEQ ID NO: 115356 - DNA, 20 bp, Artificial Sequence
  Description of Artificial Sequence: Synthetic oligonucleotide
  Target: ATXN1; (+) strand; PAM type: NRG; PAM sequence: TGG
acaactgtggcctgagtaac

SEQ ID NO: 115357 - DNA, 20 bp, Artificial Sequence
  Description of Artificial Sequence: Synthetic oligonucleotide
  Target: ATXN1; (+) strand; PAM type: NRG; PAM sequence: AAG
actgtggcctgagtaactgg

SEQ ID NO: 115358 - DNA, 20 bp, Artificial Sequence
  Description of Artificial Sequence: Synthetic oligonucleotide
  Target: ATXN1; (+) strand; PAM type: NRG; PAM sequence: AGG
ctgtggcctgagtaactgga

SEQ ID NO: 115359 - DNA, 20 bp, Artificial Sequence
  Description of Artificial Sequence: Synthetic oligonucleotide
  Target: ATXN1; (+) strand; PAM type: NRG; PAM sequence: GAG
gtggcctgagtaactggaag

SEQ ID NO: 115360 - DNA, 20 bp, Artificial Sequence
  Description of Artificial Sequence: Synthetic oligonucleotide
  Target: ATXN1; (+) strand; PAM type: NRG; PAM sequence: TGG
cctgagtaactggaaggaga

SEQ ID NO: 115361 - DNA, 20 bp, Artificial Sequence
  Description of Artificial Sequence: Synthetic oligonucleotide
  Target: ATXN1; (+) strand; PAM type: NRG; PAM sequence: GGG
ctgagtaactggaaggagat

SEQ ID NO: 115362 - DNA, 20 bp, Artificial Sequence
  Description of Artificial Sequence: Synthetic oligonucleotide
  Target: ATXN1; (+) strand; PAM type: NRG; PAM sequence: AAG
agtaactggaaggagatggg

SEQ ID NO: 115363 - DNA, 20 bp, Artificial Sequence
  Description of Artificial Sequence: Synthetic oligonucleotide
  Target: ATXN1; (+) strand; PAM type: NRG; PAM sequence: AGG
gtaactggaaggagatggga

SEQ ID NO: 115364 - DNA, 20 bp, Artificial Sequence
  Description of Artificial Sequence: Synthetic oligonucleotide
  Target: ATXN1; (+) strand; PAM type: NRG; PAM sequence: CAG
actggaaggagatgggaagg

SEQ ID NO: 115365 - DNA, 20 bp, Artificial Sequence
  Description of Artificial Sequence: Synthetic oligonucleotide
  Target: ATXN1; (+) strand; PAM type: NRG; PAM sequence: TGG
ggaaggagatgggaaggcag

SEQ ID NO: 115366 - DNA, 20 bp, Artificial Sequence
  Description of Artificial Sequence: Synthetic oligonucleotide
  Target: ATXN1; (+) strand; PAM type: NRG; PAM sequence: GGG
gaaggagatgggaaggcagt

SEQ ID NO: 115367 - DNA, 20 bp, Artificial Sequence
  Description of Artificial Sequence: Synthetic oligonucleotide
  Target: ATXN1; (+) strand; PAM type: NRG; PAM sequence: GAG
aggagatgggaaggcagtgg

SEQ ID NO: 115368 - DNA, 20 bp, Artificial Sequence
  Description of Artificial Sequence: Synthetic oligonucleotide
  Target: ATXN1; (+) strand; PAM type: NRG; PAM sequence: AAG
agatgggaaggcagtgggag

SEQ ID NO: 115369 - DNA, 20 bp, Artificial Sequence
  Description of Artificial Sequence: Synthetic oligonucleotide
  Target: ATXN1; (+) strand; PAM type: NRG; PAM sequence: CAG
tgggaaggcagtgggagaag

SEQ ID NO: 115370 - DNA, 20 bp, Artificial Sequence
  Description of Artificial Sequence: Synthetic oligonucleotide
  Target: ATXN1; (+) strand; PAM type: NRG; PAM sequence: AGG
gggaaggcagtgggagaagc

SEQ ID NO: 115371 - DNA, 20 bp, Artificial Sequence
  Description of Artificial Sequence: Synthetic oligonucleotide
  Target: ATXN1; (+) strand; PAM type: NRG; PAM sequence: TGG
aggcagtgggagaagcaggt

SEQ ID NO: 115372 - DNA, 20 bp, Artificial Sequence
  Description of Artificial Sequence: Synthetic oligonucleotide
  Target: ATXN1; (+) strand; PAM type: NRG; PAM sequence: GGG
ggcagtgggagaagcaggtt

SEQ ID NO: 115373 - DNA, 20 bp, Artificial Sequence
  Description of Artificial Sequence: Synthetic oligonucleotide
  Target: ATXN1; (+) strand; PAM type: NRG; PAM sequence: GGG
gcagtgggagaagcaggttg

SEQ ID NO: 115374 - DNA, 20 bp, Artificial Sequence
  Description of Artificial Sequence: Synthetic oligonucleotide
  Target: ATXN1; (+) strand; PAM type: NRG; PAM sequence: TAG
gtgggagaagcaggttgggg

SEQ ID NO: 115375 - DNA, 20 bp, Artificial Sequence
  Description of Artificial Sequence: Synthetic oligonucleotide
  Target: ATXN1; (+) strand; PAM type: NRG; PAM sequence: AAG
gcaggttggggtagaatatc

SEQ ID NO: 115376 - DNA, 20 bp, Artificial Sequence
  Description of Artificial Sequence: Synthetic oligonucleotide
  Target: ATXN1; (+) strand; PAM type: NRG; PAM sequence: GAG
aggttggggtagaatatcaa

SEQ ID NO: 115377 - DNA, 20 bp, Artificial Sequence
  Description of Artificial Sequence: Synthetic oligonucleotide
  Target: ATXN1; (+) strand; PAM type: NRG; PAM sequence: AAG
atcaagagttcatcccactg

SEQ ID NO: 115378 - DNA, 20 bp, Artificial Sequence
  Description of Artificial Sequence: Synthetic oligonucleotide
  Target: ATXN1; (+) strand; PAM type: NRG; PAM sequence: AGG
tcaagagttcatcccactga

SEQ ID NO: 115379 - DNA, 20 bp, Artificial Sequence
  Description of Artificial Sequence: Synthetic oligonucleotide
  Target: ATXN1; (+) strand; PAM type: NRG; PAM sequence: CAG
agagttcatcccactgaagg

SEQ ID NO: 115380 - DNA, 20 bp, Artificial Sequence
  Description of Artificial Sequence: Synthetic oligonucleotide
  Target: ATXN1; (+) strand; PAM type: NRG; PAM sequence: AAG
tcatcccactgaaggcagtt

SEQ ID NO: 115381 - DNA, 20 bp, Artificial Sequence
  Description of Artificial Sequence: Synthetic oligonucleotide
  Target: ATXN1; (+) strand; PAM type: NRG; PAM sequence: GAG
atcccactgaaggcagttaa

SEQ ID NO: 115382 - DNA, 20 bp, Artificial Sequence
  Description of Artificial Sequence: Synthetic oligonucleotide
  Target: ATXN1; (+) strand; PAM type: NRG; PAM sequence: CAG
cactgaaggcagttaagaga

SEQ ID NO: 115383 - DNA, 20 bp, Artificial Sequence
  Description of Artificial Sequence: Synthetic oligonucleotide
  Target: ATXN1; (+) strand; PAM type: NRG; PAM sequence: TGG
tgaaggcagttaagagacag

SEQ ID NO: 115384 - DNA, 20 bp, Artificial Sequence
  Description of Artificial Sequence: Synthetic oligonucleotide
  Target: ATXN1; (+) strand; PAM type: NRG; PAM sequence: GGG
gaaggcagttaagagacagt

SEQ ID NO: 115385 - DNA, 20 bp, Artificial Sequence
  Description of Artificial Sequence: Synthetic oligonucleotide
  Target: ATXN1; (+) strand; PAM type: NRG; PAM sequence: AAG
taagagacagtgggatatgc

SEQ ID NO: 115386 - DNA, 20 bp, Artificial Sequence
  Description of Artificial Sequence: Synthetic oligonucleotide
  Target: ATXN1; (+) strand; PAM type: NRG; PAM sequence: GAG
acagtgggatatgcaagcct

SEQ ID NO: 115387 - DNA, 20 bp, Artificial Sequence
  Description of Artificial Sequence: Synthetic oligonucleotide
  Target: ATXN1; (+) strand; PAM type: NRG; PAM sequence: AGG
cagtgggatatgcaagcctg

SEQ ID NO: 115388 - DNA, 20 bp, Artificial Sequence
  Description of Artificial Sequence: Synthetic oligonucleotide
  Target: ATXN1; (+) strand; PAM type: NRG; PAM sequence: AAG
atatgcaagcctgaggttca

SEQ ID NO: 115389 - DNA, 20 bp, Artificial Sequence
  Description of Artificial Sequence: Synthetic oligonucleotide
  Target: ATXN1; (+) strand; PAM type: NRG; PAM sequence: AAG
caagcctgaggttcaaagaa

SEQ ID NO: 115390 - DNA, 20 bp, Artificial Sequence
  Description of Artificial Sequence: Synthetic oligonucleotide
  Target: ATXN1; (+) strand; PAM type: NRG; PAM sequence: AGG
aagcctgaggttcaaagaaa

SEQ ID NO: 115391 - DNA, 20 bp, Artificial Sequence
  Description of Artificial Sequence: Synthetic oligonucleotide
  Target: ATXN1; (+) strand; PAM type: NRG; PAM sequence: CAG
tgaggttcaaagaaaaggcc

SEQ ID NO: 115392 - DNA, 20 bp, Artificial Sequence
  Description of Artificial Sequence: Synthetic oligonucleotide
  Target: ATXN1; (+) strand; PAM type: NRG; PAM sequence: AGG
gaggttcaaagaaaaggccc

SEQ ID NO: 115393 - DNA, 20 bp, Artificial Sequence
  Description of Artificial Sequence: Synthetic oligonucleotide
  Target: ATXN1; (+) strand; PAM type: NRG; PAM sequence: TGG
ttcaaagaaaaggcccaggc

SEQ ID NO: 115394 - DNA, 20 bp, Artificial Sequence
  Description of Artificial Sequence: Synthetic oligonucleotide
  Target: ATXN1; (+) strand; PAM type: NRG; PAM sequence: GAG
caaagaaaaggcccaggctg

SEQ ID NO: 115395 - DNA, 20 bp, Artificial Sequence
  Description of Artificial Sequence: Synthetic oligonucleotide
  Target: ATXN1; (+) strand; PAM type: NRG; PAM sequence: AAG
agaaaaggcccaggctggag

SEQ ID NO: 115396 - DNA, 20 bp, Artificial Sequence
  Description of Artificial Sequence: Synthetic oligonucleotide
  Target: ATXN1; (+) strand; PAM type: NRG; PAM sequence: AGG
gaaaaggcccaggctggaga

SEQ ID NO: 115397 - DNA, 20 bp, Artificial Sequence
  Description of Artificial Sequence: Synthetic oligonucleotide
  Target: ATXN1; (+) strand; PAM type: NRG; PAM sequence: CAG
gcccaggctggagaaggtgt

SEQ ID NO: 115398 - DNA, 20 bp, Artificial Sequence
  Description of Artificial Sequence: Synthetic oligonucleotide
  Target: ATXN1; (+) strand; PAM type: NRG; PAM sequence: GAG
ctggagaaggtgtcagtttt

SEQ ID NO: 115399 - DNA, 20 bp, Artificial Sequence
  Description of Artificial Sequence: Synthetic oligonucleotide
  Target: ATXN1; (+) strand; PAM type: NRG; PAM sequence: TGG
agaaggtgtcagttttgaga

SEQ ID NO: 115400 - DNA, 20 bp, Artificial Sequence
  Description of Artificial Sequence: Synthetic oligonucleotide
  Target: ATXN1; (+) strand; PAM type: NRG; PAM sequence: AAG
gtcagttttgagatggtttg

SEQ ID NO: 115401 - DNA, 20 bp, Artificial Sequence
  Description of Artificial Sequence: Synthetic oligonucleotide
  Target: ATXN1; (+) strand; PAM type: NRG; PAM sequence: AGG
tcagttttgagatggtttga

SEQ ID NO: 115402 - DNA, 20 bp, Artificial Sequence
  Description of Artificial Sequence: Synthetic oligonucleotide
  Target: ATXN1; (+) strand; PAM type: NRG; PAM sequence: CAG
ttgaaggcatcaacaaaaaa

SEQ ID NO: 115403 - DNA, 20 bp, Artificial Sequence
  Description of Artificial Sequence: Synthetic oligonucleotide
  Target: ATXN1; (+) strand; PAM type: NRG; PAM sequence: CAG
ggcatcaacaaaaaacagac

SEQ ID NO: 115404 - DNA, 20 bp, Artificial Sequence
  Description of Artificial Sequence: Synthetic oligonucleotide
  Target: ATXN1; (+) strand; PAM type: NRG; PAM sequence: AGG
gcatcaacaaaaaacagacc

SEQ ID NO: 115405 - DNA, 20 bp, Artificial Sequence
  Description of Artificial Sequence: Synthetic oligonucleotide
  Target: ATXN1; (+) strand; PAM type: NRG; PAM sequence: GAG
acaaaaaacagaccaggttt

SEQ ID NO: 115406 - DNA, 20 bp, Artificial Sequence
  Description of Artificial Sequence: Synthetic oligonucleotide
  Target: ATXN1; (+) strand; PAM type: NRG; PAM sequence: AGG
caaaaaacagaccaggtttg

SEQ ID NO: 115407 - DNA, 20 bp, Artificial Sequence
  Description of Artificial Sequence: Synthetic oligonucleotide
  Target: ATXN1; (+) strand; PAM type: NRG; PAM sequence: GAG
acagaccaggtttgaggact

SEQ ID NO: 115408 - DNA, 20 bp, Artificial Sequence
  Description of Artificial Sequence: Synthetic oligonucleotide
  Target: ATXN1; (+) strand; PAM type: NRG; PAM sequence: GAG
aggtttgaggactgagccct

SEQ ID NO: 115409 - DNA, 20 bp, Artificial Sequence
  Description of Artificial Sequence: Synthetic oligonucleotide
  Target: ATXN1; (+) strand; PAM type: NRG; PAM sequence: AGG
ggtttgaggactgagccctg

SEQ ID NO: 115410 - DNA, 20 bp, Artificial Sequence
  Description of Artificial Sequence: Synthetic oligonucleotide
  Target: ATXN1; (+) strand; PAM type: NRG; PAM sequence: TGG
ccctgaggctctctcacatt

SEQ ID NO: 115411 - DNA, 20 bp, Artificial Sequence
  Description of Artificial Sequence: Synthetic oligonucleotide
  Target: ATXN1; (+) strand; PAM type: NRG; PAM sequence: CAG
gctctctcacatttggaaac

SEQ ID NO: 115412 - DNA, 20 bp, Artificial Sequence
  Description of Artificial Sequence: Synthetic oligonucleotide
  Target: ATXN1; (+) strand; PAM type: NRG; PAM sequence: GAG
tctctcacatttggaaacca

SEQ ID NO: 115413 - DNA, 20 bp, Artificial Sequence
  Description of Artificial Sequence: Synthetic oligonucleotide
  Target: ATXN1; (+) strand; PAM type: NRG; PAM sequence: AGG
ctctcacatttggaaaccag

SEQ ID NO: 115414 - DNA, 20 bp, Artificial Sequence
  Description of Artificial Sequence: Synthetic oligonucleotide
  Target: ATXN1; (+) strand; PAM type: NRG; PAM sequence: TAG
ctgattgttccacttgtgat

SEQ ID NO: 115415 - DNA, 20 bp, Artificial Sequence
  Description of Artificial Sequence: Synthetic oligonucleotide
  Target: ATXN1; (+) strand; PAM type: NRG; PAM sequence: AGG
tgattgttccacttgtgatt

SEQ ID NO: 115416 - DNA, 20 bp, Artificial Sequence
  Description of Artificial Sequence: Synthetic oligonucleotide
  Target: ATXN1; (+) strand; PAM type: NRG; PAM sequence: CGG
cacttgtgattaggctgtat

SEQ ID NO: 115417 - DNA, 20 bp, Artificial Sequence
  Description of Artificial Sequence: Synthetic oligonucleotide
  Target: ATXN1; (+) strand; PAM type: NRG; PAM sequence: TGG
tgattaggctgtatcggctg

SEQ ID NO: 115418 - DNA, 20 bp, Artificial Sequence
  Description of Artificial Sequence: Synthetic oligonucleotide
  Target: ATXN1; (+) strand; PAM type: NRG; PAM sequence: GGG
gattaggctgtatcggctgt

SEQ ID NO: 115419 - DNA, 20 bp, Artificial Sequence
  Description of Artificial Sequence: Synthetic oligonucleotide
  Target: ATXN1; (+) strand; PAM type: NRG; PAM sequence: TGG
taggctgtatcggctgtggg

SEQ ID NO: 115420 - DNA, 20 bp, Artificial Sequence
  Description of Artificial Sequence: Synthetic oligonucleotide
  Target: ATXN1; (+) strand; PAM type: NRG; PAM sequence: GGG
aggctgtatcggctgtgggt

SEQ ID NO: 115421 - DNA, 20 bp, Artificial Sequence
  Description of Artificial Sequence: Synthetic oligonucleotide
  Target: ATXN1; (+) strand; PAM type: NRG; PAM sequence: GAG
gctgtatcggctgtgggtgg

SEQ ID NO: 115422 - DNA, 20 bp, Artificial Sequence
  Description of Artificial Sequence: Synthetic oligonucleotide
  Target: ATXN1; (+) strand; PAM type: NRG; PAM sequence: CAG
ctgtgggtgggagtgcgtat

SEQ ID NO: 115423 - DNA, 20 bp, Artificial Sequence
  Description of Artificial Sequence: Synthetic oligonucleotide
  Target: ATXN1; (+) strand; PAM type: NRG; PAM sequence: TGG
gcgtatcagcaccacccccg

SEQ ID NO: 115424 - DNA, 20 bp, Artificial Sequence
  Description of Artificial Sequence: Synthetic oligonucleotide
  Target: ATXN1; (+) strand; PAM type: NRG; PAM sequence: AAG
tatcagcaccacccccgtgg

SEQ ID NO: 115425 - DNA, 20 bp, Artificial Sequence
  Description of Artificial Sequence: Synthetic oligonucleotide
  Target: ATXN1; (+) strand; PAM type: NRG; PAM sequence: AGG
atcagcaccacccccgtgga

SEQ ID NO: 115426 - DNA, 20 bp, Artificial Sequence
  Description of Artificial Sequence: Synthetic oligonucleotide
  Target: ATXN1; (+) strand; PAM type: NRG; PAM sequence: CGG
ccgtggaaggctacttgatg

SEQ ID NO: 115427 - DNA, 20 bp, Artificial Sequence
  Description of Artificial Sequence: Synthetic oligonucleotide
  Target: ATXN1; (+) strand; PAM type: NRG; PAM sequence: AAG
gaaggctacttgatgcggat

SEQ ID NO: 115428 - DNA, 20 bp, Artificial Sequence
  Description of Artificial Sequence: Synthetic oligonucleotide
  Target: ATXN1; (+) strand; PAM type: NRG; PAM sequence: TGG
tgcggataagttccatccac

SEQ ID NO: 115429 - DNA, 20 bp, Artificial Sequence
  Description of Artificial Sequence: Synthetic oligonucleotide
  Target: ATXN1; (+) strand; PAM type: NRG; PAM sequence: AAG
ccatccactggcaaacccaa

SEQ ID NO: 115430 - DNA, 20 bp, Artificial Sequence
  Description of Artificial Sequence: Synthetic oligonucleotide
  Target: ATXN1; (+) strand; PAM type: NRG; PAM sequence: TGG
aaaagctacacatgtctaca

SEQ ID NO: 115431 - DNA, 20 bp, Artificial Sequence
  Description of Artificial Sequence: Synthetic oligonucleotide
  Target: ATXN1; (+) strand; PAM type: NRG; PAM sequence: GGG
aaagctacacatgtctacat

SEQ ID NO: 115432 - DNA, 20 bp, Artificial Sequence
  Description of Artificial Sequence: Synthetic oligonucleotide
  Target: ATXN1; (+) strand; PAM type: NRG; PAM sequence: AAG
gctacacatgtctacatggg

SEQ ID NO: 115433 - DNA, 20 bp, Artificial Sequence
  Description of Artificial Sequence: Synthetic oligonucleotide
  Target: ATXN1; (+) strand; PAM type: NRG; PAM sequence: AGG
ctacacatgtctacatggga

SEQ ID NO: 115434 - DNA, 20 bp, Artificial Sequence
  Description of Artificial Sequence: Synthetic oligonucleotide
  Target: ATXN1; (+) strand; PAM type: NRG; PAM sequence: GGG
tacacatgtctacatgggaa

SEQ ID NO: 115435 - DNA, 20 bp, Artificial Sequence
  Description of Artificial Sequence: Synthetic oligonucleotide
  Target: ATXN1; (+) strand; PAM type: NRG; PAM sequence: CGG
tctacatgggaagggctgtg

SEQ ID NO: 115436 - DNA, 20 bp, Artificial Sequence
  Description of Artificial Sequence: Synthetic oligonucleotide
  Target: ATXN1; (+) strand; PAM type: NRG; PAM sequence: CAG
atgggaagggctgtgcggca

SEQ ID NO: 115437 - DNA, 20 bp, Artificial Sequence
  Description of Artificial Sequence: Synthetic oligonucleotide
  Target: ATXN1; (+) strand; PAM type: NRG; PAM sequence: AGG
tgggaagggctgtgcggcac

SEQ ID NO: 115438 - DNA, 20 bp, Artificial Sequence
  Description of Artificial Sequence: Synthetic oligonucleotide
  Target: ATXN1; (+) strand; PAM type: NRG; PAM sequence: CAG
ggctgtgcggcacaggtgca

SEQ ID NO: 115439 - DNA, 20 bp, Artificial Sequence
  Description of Artificial Sequence: Synthetic oligonucleotide
  Target: ATXN1; (+) strand; PAM type: NRG; PAM sequence: CAG
tgtgcggcacaggtgcacag

SEQ ID NO: 115440 - DNA, 20 bp, Artificial Sequence
  Description of Artificial Sequence: Synthetic oligonucleotide
  Target: ATXN1; (+) strand; PAM type: NRG; PAM sequence: CAG
cacaggtgcacagcagatct

SEQ ID NO: 115441 - DNA, 20 bp, Artificial Sequence
  Description of Artificial Sequence: Synthetic oligonucleotide
  Target: ATXN1; (+) strand; PAM type: NRG; PAM sequence: AAG
ttctgctcttcccatgcact

SEQ ID NO: 115442 - DNA, 20 bp, Artificial Sequence
  Description of Artificial Sequence: Synthetic oligonucleotide
  Target: ATXN1; (+) strand; PAM type: NRG; PAM sequence: AGG
tctgctcttcccatgcacta

SEQ ID NO: 115443 - DNA, 20 bp, Artificial Sequence
  Description of Artificial Sequence: Synthetic oligonucleotide
  Target: ATXN1; (+) strand; PAM type: NRG; PAM sequence: GAG
tgctcttcccatgcactaag

SEQ ID NO: 115444 - DNA, 20 bp, Artificial Sequence
  Description of Artificial Sequence: Synthetic oligonucleotide
  Target: ATXN1; (+) strand; PAM type: NRG; PAM sequence: GAG
ttcccatgcactaaggagct

SEQ ID NO: 115445 - DNA, 20 bp, Artificial Sequence
  Description of Artificial Sequence: Synthetic oligonucleotide
  Target: ATXN1; (+) strand; PAM type: NRG; PAM sequence: CAG
gcactaaggagctgagcaaa

SEQ ID NO: 115446 - DNA, 20 bp, Artificial Sequence
  Description of Artificial Sequence: Synthetic oligonucleotide
  Target: ATXN1; (+) strand; PAM type: NRG; PAM sequence: AAG
taaggagctgagcaaacagc

SEQ ID NO: 115447 - DNA, 20 bp, Artificial Sequence
  Description of Artificial Sequence: Synthetic oligonucleotide
  Target: ATXN1; (+) strand; PAM type: NRG; PAM sequence: CAG
gagctgagcaaacagcaagt

SEQ ID NO: 115448 - DNA, 20 bp, Artificial Sequence
  Description of Artificial Sequence: Synthetic oligonucleotide
  Target: ATXN1; (+) strand; PAM type: NRG; PAM sequence: AAG
ctgagcaaacagcaagtcag

SEQ ID NO: 115449 - DNA, 20 bp, Artificial Sequence
  Description of Artificial Sequence: Synthetic oligonucleotide
  Target: ATXN1; (+) strand; PAM type: NRG; PAM sequence: AGG
tgagcaaacagcaagtcaga

SEQ ID NO: 115450 - DNA, 20 bp, Artificial Sequence
  Description of Artificial Sequence: Synthetic oligonucleotide
  Target: ATXN1; (+) strand; PAM type: NRG; PAM sequence: CAG
gcaaacagcaagtcagaagg

SEQ ID NO: 115451 - DNA, 20 bp, Artificial Sequence
  Description of Artificial Sequence: Synthetic oligonucleotide
  Target: ATXN1; (+) strand; PAM type: NRG; PAM sequence: AGG
caaacagcaagtcagaaggc

SEQ ID NO: 115452 - DNA, 20 bp, Artificial Sequence
  Description of Artificial Sequence: Synthetic oligonucleotide
  Target: ATXN1; (+) strand; PAM type: NRG; PAM sequence: GGG
aaacagcaagtcagaaggca

SEQ ID NO: 115453 - DNA, 20 bp, Artificial Sequence
  Description of Artificial Sequence: Synthetic oligonucleotide
  Target: ATXN1; (+) strand; PAM type: NRG; PAM sequence: TGG
caagtcagaaggcagggcca

SEQ ID NO: 115454 - DNA, 20 bp, Artificial Sequence
  Description of Artificial Sequence: Synthetic oligonucleotide
  Target: ATXN1; (+) strand; PAM type: NRG; PAM sequence: AAG
tcagaaggcagggccatggt

SEQ ID NO: 115455 - DNA, 20 bp, Artificial Sequence
  Description of Artificial Sequence: Synthetic oligonucleotide
  Target: ATXN1; (+) strand; PAM type: NRG; PAM sequence: CAG
gaaggcagggccatggtaag

SEQ ID NO: 115456 - DNA, 20 bp, Artificial Sequence
  Description of Artificial Sequence: Synthetic oligonucleotide
  Target: ATXN1; (+) strand; PAM type: NRG; PAM sequence: GAG
aggcagggccatggtaagca

SEQ ID NO: 115457 - DNA, 20 bp, Artificial Sequence
  Description of Artificial Sequence: Synthetic oligonucleotide
  Target: ATXN1; (+) strand; PAM type: NRG; PAM sequence: AGG
ggcagggccatggtaagcag

SEQ ID NO: 115458 - DNA, 20 bp, Artificial Sequence
  Description of Artificial Sequence: Synthetic oligonucleotide
  Target: ATXN1; (+) strand; PAM type: NRG; PAM sequence: CAG
gggccatggtaagcagaggc

SEQ ID NO: 115459 - DNA, 20 bp, Artificial Sequence
  Description of Artificial Sequence: Synthetic oligonucleotide
  Target: ATXN1; (+) strand; PAM type: NRG; PAM sequence: GAG
gccatggtaagcagaggcca

SEQ ID NO: 115460 - DNA, 20 bp, Artificial Sequence
  Description of Artificial Sequence: Synthetic oligonucleotide
  Target: ATXN1; (+) strand; PAM type: NRG; PAM sequence: AGG
ccatggtaagcagaggccag

SEQ ID NO: 115461 - DNA, 20 bp, Artificial Sequence
  Description of Artificial Sequence: Synthetic oligonucleotide
  Target: ATXN1; (+) strand; PAM type: NRG; PAM sequence: TGG
tggtaagcagaggccagagg

SEQ ID NO: 115462 - DNA, 20 bp, Artificial Sequence
  Description of Artificial Sequence: Synthetic oligonucleotide
  Target: ATXN1; (+) strand; PAM type: NRG; PAM sequence: TGG
aagcagaggccagaggtggc

SEQ ID NO: 115463 - DNA, 20 bp, Artificial Sequence
  Description of Artificial Sequence: Synthetic oligonucleotide
  Target: ATXN1; (+) strand; PAM type: NRG; PAM sequence: GGG
agcagaggccagaggtggct

SEQ ID NO: 115464 - DNA, 20 bp, Artificial Sequence
  Description of Artificial Sequence: Synthetic oligonucleotide
  Target: ATXN1; (+) strand; PAM type: NRG; PAM sequence: AAG
cagaggtggctgggaattaa

SEQ ID NO: 115465 - DNA, 20 bp, Artificial Sequence
  Description of Artificial Sequence: Synthetic oligonucleotide
  Target: ATXN1; (+) strand; PAM type: NRG; PAM sequence: AGG
agaggtggctgggaattaaa

SEQ ID NO: 115466 - DNA, 20 bp, Artificial Sequence
  Description of Artificial Sequence: Synthetic oligonucleotide
  Target: ATXN1; (+) strand; PAM type: NRG; PAM sequence: CAG
actgttctgccaaattccta

SEQ ID NO: 115467 - DNA, 20 bp, Artificial Sequence
  Description of Artificial Sequence: Synthetic oligonucleotide
  Target: ATXN1; (+) strand; PAM type: NRG; PAM sequence: AAG
caaattcctacagaactgat

SEQ ID NO: 115468 - DNA, 20 bp, Artificial Sequence
  Description of Artificial Sequence: Synthetic oligonucleotide
  Target: ATXN1; (+) strand; PAM type: NRG; PAM sequence: TGG
acagaactgataagactccc

SEQ ID NO: 115469 - DNA, 20 bp, Artificial Sequence
  Description of Artificial Sequence: Synthetic oligonucleotide
  Target: ATXN1; (+) strand; PAM type: NRG; PAM sequence: CAG
tttgttgtattattttctaa

SEQ ID NO: 115470 - DNA, 20 bp, Artificial Sequence
  Description of Artificial Sequence: Synthetic oligonucleotide
  Target: ATXN1; (+) strand; PAM type: NRG; PAM sequence: TAG
ttattttctaacagaaaaca

SEQ ID NO: 115471 - DNA, 20 bp, Artificial Sequence
  Description of Artificial Sequence: Synthetic oligonucleotide
  Target: ATXN1; (+) strand; PAM type: NRG; PAM sequence: AAG
acagaaaacatagataatcc

SEQ ID NO: 115472 - DNA, 20 bp, Artificial Sequence
  Description of Artificial Sequence: Synthetic oligonucleotide
  Target: ATXN1; (+) strand; PAM type: NRG; PAM sequence: TGG
ttgattaacttacaaattat

SEQ ID NO: 115473 - DNA, 20 bp, Artificial Sequence
  Description of Artificial Sequence: Synthetic oligonucleotide
  Target: ATXN1; (+) strand; PAM type: NRG; PAM sequence: CAG
attggtattcccttttgttc

SEQ ID NO: 115474 - DNA, 20 bp, Artificial Sequence
  Description of Artificial Sequence: Synthetic oligonucleotide
  Target: ATXN1; (+) strand; PAM type: NRG; PAM sequence: GAG
ccttttgttccagcccattt

SEQ ID NO: 115475 - DNA, 20 bp, Artificial Sequence
  Description of Artificial Sequence: Synthetic oligonucleotide
  Target: ATXN1; (+) strand; PAM type: NRG; PAM sequence: AGG
cttttgttccagcccatttg

SEQ ID NO: 115476 - DNA, 20 bp, Artificial Sequence
  Description of Artificial Sequence: Synthetic oligonucleotide
  Target: ATXN1; (+) strand; PAM type: NRG; PAM sequence: AAG
tcatctcttcctaaatgcat

SEQ ID NO: 115477 - DNA, 20 bp, Artificial Sequence
  Description of Artificial Sequence: Synthetic oligonucleotide
  Target: ATXN1; (+) strand; PAM type: NRG; PAM sequence: TGG
ctcttcctaaatgcataagt

SEQ ID NO: 115478 - DNA, 20 bp, Artificial Sequence
  Description of Artificial Sequence: Synthetic oligonucleotide
  Target: ATXN1; (+) strand; PAM type: NRG; PAM sequence: CAG
cctaaatgcataagttggct

SEQ ID NO: 115479 - DNA, 20 bp, Artificial Sequence
  Description of Artificial Sequence: Synthetic oligonucleotide
  Target: ATXN1; (+) strand; PAM type: NRG; PAM sequence: AAG
gcataagttggctcagcata

SEQ ID NO: 115480 - DNA, 20 bp, Artificial Sequence
  Description of Artificial Sequence: Synthetic oligonucleotide
  Target: ATXN1; (+) strand; PAM type: NRG; PAM sequence: TGG
gtataattacttgataacca

SEQ ID NO: 115481 - DNA, 20 bp, Artificial Sequence
  Description of Artificial Sequence: Synthetic oligonucleotide
  Target: ATXN1; (+) strand; PAM type: NRG; PAM sequence: AAG
taattacttgataaccatgg

SEQ ID NO: 115482 - DNA, 20 bp, Artificial Sequence
  Description of Artificial Sequence: Synthetic oligonucleotide
  Target: ATXN1; (+) strand; PAM type: NRG; PAM sequence: TAG
tacttgataaccatggaagc

SEQ ID NO: 115483 - DNA, 20 bp, Artificial Sequence
  Description of Artificial Sequence: Synthetic oligonucleotide
  Target: ATXN1; (+) strand; PAM type: NRG; PAM sequence: AGG
acttgataaccatggaagct

SEQ ID NO: 115484 - DNA, 20 bp, Artificial Sequence
  Description of Artificial Sequence: Synthetic oligonucleotide
  Target: ATXN1; (+) strand; PAM type: NRG; PAM sequence: TAG
tgataaccatggaagctagg

SEQ ID NO: 115485 - DNA, 20 bp, Artificial Sequence
  Description of Artificial Sequence: Synthetic oligonucleotide
  Target: ATXN1; (+) strand; PAM type: NRG; PAM sequence: CAG
taaccatggaagctaggtag

SEQ ID NO: 115486 - DNA, 20 bp, Artificial Sequence
  Description of Artificial Sequence: Synthetic oligonucleotide
  Target: ATXN1; (+) strand; PAM type: NRG; PAM sequence: GAG
accatggaagctaggtagca

SEQ ID NO: 115487 - DNA, 20 bp, Artificial Sequence
  Description of Artificial Sequence: Synthetic oligonucleotide
  Target: ATXN1; (+) strand; PAM type: NRG; PAM sequence: GAG
catggaagctaggtagcaga

SEQ ID NO: 115488 - DNA, 20 bp, Artificial Sequence
  Description of Artificial Sequence: Synthetic oligonucleotide
  Target: ATXN1; (+) strand; PAM type: NRG; PAM sequence: AAG
agctaggtagcagagagtgt

SEQ ID NO: 115489 - DNA, 20 bp, Artificial Sequence
  Description of Artificial Sequence: Synthetic oligonucleotide
  Target: ATXN1; (+) strand; PAM type: NRG; PAM sequence: AGG
gctaggtagcagagagtgta

SEQ ID NO: 115490 - DNA, 20 bp, Artificial Sequence
  Description of Artificial Sequence: Synthetic oligonucleotide
  Target: ATXN1; (+) strand; PAM type: NRG; PAM sequence: GAG
taggtagcagagagtgtaag

SEQ ID NO: 115491 - DNA, 20 bp, Artificial Sequence
  Description of Artificial Sequence: Synthetic oligonucleotide
  Target: ATXN1; (+) strand; PAM type: NRG; PAM sequence: GAG
ggtagcagagagtgtaagga

SEQ ID NO: 115492 - DNA, 20 bp, Artificial Sequence
  Description of Artificial Sequence: Synthetic oligonucleotide
  Target: ATXN1; (+) strand; PAM type: NRG; PAM sequence: TGG
attttgaaatgcactgtcca

SEQ ID NO: 115493 - DNA, 20 bp, Artificial Sequence
  Description of Artificial Sequence: Synthetic oligonucleotide
  Target: ATXN1; (+) strand; PAM type: NRG; PAM sequence: TGG
cactgtccatggaccttgtc

SEQ ID NO: 115494 - DNA, 20 bp, Artificial Sequence
  Description of Artificial Sequence: Synthetic oligonucleotide
  Target: ATXN1; (+) strand; PAM type: NRG; PAM sequence: GGG
actgtccatggaccttgtct

SEQ ID NO: 115495 - DNA, 20 bp, Artificial Sequence
  Description of Artificial Sequence: Synthetic oligonucleotide
  Target: ATXN1; (+) strand; PAM type: NRG; PAM sequence: GGG
ctgtccatggaccttgtctg

SEQ ID NO: 115496 - DNA, 20 bp, Artificial Sequence
  Description of Artificial Sequence: Synthetic oligonucleotide
  Target: ATXN1; (+) strand; PAM type: NRG; PAM sequence: AAG
tccatggaccttgtctgggg

SEQ ID NO: 115497 - DNA, 20 bp, Artificial Sequence
  Description of Artificial Sequence: Synthetic oligonucleotide
  Target: ATXN1; (+) strand; PAM type: NRG; PAM sequence: GAG
catggaccttgtctggggaa

SEQ ID NO: 115498 - DNA, 20 bp, Artificial Sequence
  Description of Artificial Sequence: Synthetic oligonucleotide
  Target: ATXN1; (+) strand; PAM type: NRG; PAM sequence: AGG
atggaccttgtctggggaag

SEQ ID NO: 115499 - DNA, 20 bp, Artificial Sequence
  Description of Artificial Sequence: Synthetic oligonucleotide
  Target: ATXN1; (+) strand; PAM type: NRG; PAM sequence: GGG
tggaccttgtctggggaaga

SEQ ID NO: 115500 - DNA, 20 bp, Artificial Sequence
  Description of Artificial Sequence: Synthetic oligonucleotide
  Target: ATXN1; (+) strand; PAM type: NRG; PAM sequence: TGG
agagggtgccacactaattc

SEQ ID NO: 115501 - DNA, 20 bp, Artificial Sequence
  Description of Artificial Sequence: Synthetic oligonucleotide
  Target: ATXN1; (+) strand; PAM type: NRG; PAM sequence: TGG
tgccacactaattctggcct

SEQ ID NO: 115502 - DNA, 20 bp, Artificial Sequence
  Description of Artificial Sequence: Synthetic oligonucleotide
  Target: ATXN1; (+) strand; PAM type: NRG; PAM sequence: TGG
aattctggccttggctacta

SEQ ID NO: 115503 - DNA, 20 bp, Artificial Sequence
  Description of Artificial Sequence: Synthetic oligonucleotide
  Target: ATXN1; (+) strand; PAM type: NRG; PAM sequence: GGG
attctggccttggctactat

SEQ ID NO: 115504 - DNA, 20 bp, Artificial Sequence
  Description of Artificial Sequence: Synthetic oligonucleotide
  Target: ATXN1; (+) strand; PAM type: NRG; PAM sequence: AAG
cttggctactatgggtgttc

SEQ ID NO: 115505 - DNA, 20 bp, Artificial Sequence
  Description of Artificial Sequence: Synthetic oligonucleotide
  Target: ATXN1; (+) strand; PAM type: NRG; PAM sequence: AAG
ggctactatgggtgttcaag

SEQ ID NO: 115506 - DNA, 20 bp, Artificial Sequence
  Description of Artificial Sequence: Synthetic oligonucleotide
  Target: ATXN1; (+) strand; PAM type: NRG; PAM sequence: CAG
tactatgggtgttcaagaag

SEQ ID NO: 115507 - DNA, 20 bp, Artificial Sequence
  Description of Artificial Sequence: Synthetic oligonucleotide
  Target: ATXN1; (+) strand; PAM type: NRG; PAM sequence: TAG
caagaagcagcatcatgcaa

SEQ ID NO: 115508 - DNA, 20 bp, Artificial Sequence
  Description of Artificial Sequence: Synthetic oligonucleotide
  Target: ATXN1; (+) strand; PAM type: NRG; PAM sequence: AAG
aagcagcatcatgcaataga

SEQ ID NO: 115509 - DNA, 20 bp, Artificial Sequence
  Description of Artificial Sequence: Synthetic oligonucleotide
  Target: ATXN1; (+) strand; PAM type: NRG; PAM sequence: TGG
atagaaagatgtgacacttc

SEQ ID NO: 115510 - DNA, 20 bp, Artificial Sequence
  Description of Artificial Sequence: Synthetic oligonucleotide
  Target: ATXN1; (+) strand; PAM type: NRG; PAM sequence: CGG
aaagatgtgacacttctggt

SEQ ID NO: 115511 - DNA, 20 bp, Artificial Sequence
  Description of Artificial Sequence: Synthetic oligonucleotide
  Target: ATXN1; (+) strand; PAM type: NRG; PAM sequence: GGG
aagatgtgacacttctggtc

SEQ ID NO: 115512 - DNA, 20 bp, Artificial Sequence
  Description of Artificial Sequence: Synthetic oligonucleotide
  Target: ATXN1; (+) strand; PAM type: NRG; PAM sequence: TGG
cttctggtcgggacttctta

SEQ ID NO: 115513 - DNA, 20 bp, Artificial Sequence
  Description of Artificial Sequence: Synthetic oligonucleotide
  Target: ATXN1; (+) strand; PAM type: NRG; PAM sequence: CAG
ctggtcgggacttcttatgg

SEQ ID NO: 115514 - DNA, 20 bp, Artificial Sequence
  Description of Artificial Sequence: Synthetic oligonucleotide
  Target: ATXN1; (+) strand; PAM type: NRG; PAM sequence: TGG
gtcgggacttcttatggcag

SEQ ID NO: 115515 - DNA, 20 bp, Artificial Sequence
  Description of Artificial Sequence: Synthetic oligonucleotide
  Target: ATXN1; (+) strand; PAM type: NRG; PAM sequence: TGG
gcagtggtccccaaactttt

SEQ ID NO: 115516 - DNA, 20 bp, Artificial Sequence
  Description of Artificial Sequence: Synthetic oligonucleotide
  Target: ATXN1; (+) strand; PAM type: NRG; PAM sequence: TGG
gtccccaaactttttggcac

SEQ ID NO: 115517 - DNA, 20 bp, Artificial Sequence
  Description of Artificial Sequence: Synthetic oligonucleotide
  Target: ATXN1; (+) strand; PAM type: NRG; PAM sequence: GAG
actttttggcactggtccat

SEQ ID NO: 115518 - DNA, 20 bp, Artificial Sequence
  Description of Artificial Sequence: Synthetic oligonucleotide
  Target: ATXN1; (+) strand; PAM type: NRG; PAM sequence: AGG
ctttttggcactggtccatg

SEQ ID NO: 115519 - DNA, 20 bp, Artificial Sequence
  Description of Artificial Sequence: Synthetic oligonucleotide
  Target: ATXN1; (+) strand; PAM type: NRG; PAM sequence: TAG
ttggcactggtccatgaggc

SEQ ID NO: 115520 - DNA, 20 bp, Artificial Sequence
  Description of Artificial Sequence: Synthetic oligonucleotide
  Target: ATXN1; (+) strand; PAM type: NRG; PAM sequence: AGG
tggcactggtccatgaggct

SEQ ID NO: 115521 - DNA, 20 bp, Artificial Sequence
  Description of Artificial Sequence: Synthetic oligonucleotide
  Target: ATXN1; (+) strand; PAM type: NRG; PAM sequence: GGG
ggcactggtccatgaggcta

SEQ ID NO: 115522 - DNA, 20 bp, Artificial Sequence
  Description of Artificial Sequence: Synthetic oligonucleotide
  Target: ATXN1; (+) strand; PAM type: NRG; PAM sequence: GGG
gcactggtccatgaggctag

SEQ ID NO: 115523 - DNA, 20 bp, Artificial Sequence
  Description of Artificial Sequence: Synthetic oligonucleotide
  Target: ATXN1; (+) strand; PAM type: NRG; PAM sequence: TAG
ctggtccatgaggctagggg

SEQ ID NO: 115524 - DNA, 20 bp, Artificial Sequence
  Description of Artificial Sequence: Synthetic oligonucleotide
  Target: ATXN1; (+) strand; PAM type: NRG; PAM sequence: AGG
tggtccatgaggctaggggt

SEQ ID NO: 115525 - DNA, 20 bp, Artificial Sequence
  Description of Artificial Sequence: Synthetic oligonucleotide
  Target: ATXN1; (+) strand; PAM type: NRG; PAM sequence: GGG
ggtccatgaggctaggggta

SEQ ID NO: 115526 - DNA, 20 bp, Artificial Sequence
  Description of Artificial Sequence: Synthetic oligonucleotide
  Target: ATXN1; (+) strand; PAM type: NRG; PAM sequence: GGG
gtccatgaggctaggggtag

SEQ ID NO: 115527 - DNA, 20 bp, Artificial Sequence
  Description of Artificial Sequence: Synthetic oligonucleotide
  Target: ATXN1; (+) strand; PAM type: NRG; PAM sequence: GGG
tccatgaggctaggggtagg

SEQ ID NO: 115528 - DNA, 20 bp, Artificial Sequence
  Description of Artificial Sequence: Synthetic oligonucleotide
  Target: ATXN1; (+) strand; PAM type: NRG; PAM sequence: CAG
gaggctaggggtagggggat

SEQ ID NO: 115529 - DNA, 20 bp, Artificial Sequence
  Description of Artificial Sequence: Synthetic oligonucleotide
  Target: ATXN1; (+) strand; PAM type: NRG; PAM sequence: AGG
aggctaggggtagggggatc

SEQ ID NO: 115530 - DNA, 20 bp, Artificial Sequence
  Description of Artificial Sequence: Synthetic oligonucleotide
  Target: ATXN1; (+) strand; PAM type: NRG; PAM sequence: TAG
ggggtagggggatcaggcat

SEQ ID NO: 115531 - DNA, 20 bp, Artificial Sequence
  Description of Artificial Sequence: Synthetic oligonucleotide
  Target: ATXN1; (+) strand; PAM type: NRG; PAM sequence: AAG
atcaggcattagattctcat

SEQ ID NO: 115532 - DNA, 20 bp, Artificial Sequence
  Description of Artificial Sequence: Synthetic oligonucleotide
  Target: ATXN1; (+) strand; PAM type: NRG; PAM sequence: AGG
tcaggcattagattctcata

SEQ ID NO: 115533 - DNA, 20 bp, Artificial Sequence
  Description of Artificial Sequence: Synthetic oligonucleotide
  Target: ATXN1; (+) strand; PAM type: NRG; PAM sequence: AAG
ggcattagattctcataagg

SEQ ID NO: 115534 - DNA, 20 bp, Artificial Sequence
  Description of Artificial Sequence: Synthetic oligonucleotide
  Target: ATXN1; (+) strand; PAM type: NRG; PAM sequence: AGG
gcattagattctcataagga

SEQ ID NO: 115535 - DNA, 20 bp, Artificial Sequence
  Description of Artificial Sequence: Synthetic oligonucleotide
  Target: ATXN1; (+) strand; PAM type: NRG; PAM sequence: TAG
ctcataaggaaggtacaacc

SEQ ID NO: 115536 - DNA, 20 bp, Artificial Sequence
  Description of Artificial Sequence: Synthetic oligonucleotide
  Target: ATXN1; (+) strand; PAM type: NRG; PAM sequence: CAG
acctagatccctcacatgtg

SEQ ID NO: 115537 - DNA, 20 bp, Artificial Sequence
  Description of Artificial Sequence: Synthetic oligonucleotide
  Target: ATXN1; (+) strand; PAM type: NRG; PAM sequence: CAG
tccctcacatgtgcagttca

SEQ ID NO: 115538 - DNA, 20 bp, Artificial Sequence
  Description of Artificial Sequence: Synthetic oligonucleotide
  Target: ATXN1; (+) strand; PAM type: NRG; PAM sequence: CGG
cacatgtgcagttcacagta

SEQ ID NO: 115539 - DNA, 20 bp, Artificial Sequence
  Description of Artificial Sequence: Synthetic oligonucleotide
  Target: ATXN1; (+) strand; PAM type: NRG; PAM sequence: GAG
agtacggttcactttcctat

SEQ ID NO: 115540 - DNA, 20 bp, Artificial Sequence
  Description of Artificial Sequence: Synthetic oligonucleotide
  Target: ATXN1; (+) strand; PAM type: NRG; PAM sequence: AAG
cggttcactttcctatgaga

SEQ ID NO: 115541 - DNA, 20 bp, Artificial Sequence
  Description of Artificial Sequence: Synthetic oligonucleotide
  Target: ATXN1; (+) strand; PAM type: NRG; PAM sequence: CAG
taatgctgccactgatctga

SEQ ID NO: 115542 - DNA, 20 bp, Artificial Sequence
  Description of Artificial Sequence: Synthetic oligonucleotide
  Target: ATXN1; (+) strand; PAM type: NRG; PAM sequence: AGG
aatgctgccactgatctgac

SEQ ID NO: 115543 - DNA, 20 bp, Artificial Sequence
  Description of Artificial Sequence: Synthetic oligonucleotide
  Target: ATXN1; (+) strand; PAM type: NRG; PAM sequence: GAG
tgctgccactgatctgacag

SEQ ID NO: 115544 - DNA, 20 bp, Artificial Sequence
  Description of Artificial Sequence: Synthetic oligonucleotide
  Target: ATXN1; (+) strand; PAM type: NRG; PAM sequence: AGG
gctgccactgatctgacagg

SEQ ID NO: 115545 - DNA, 20 bp, Artificial Sequence
  Description of Artificial Sequence: Synthetic oligonucleotide
  Target: ATXN1; (+) strand; PAM type: NRG; PAM sequence: TGG
gccactgatctgacaggagg

SEQ ID NO: 115546 - DNA, 20 bp, Artificial Sequence
  Description of Artificial Sequence: Synthetic oligonucleotide
  Target: ATXN1; (+) strand; PAM type: NRG; PAM sequence: GAG
cactgatctgacaggaggtg

SEQ ID NO: 115547 - DNA, 20 bp, Artificial Sequence
  Description of Artificial Sequence: Synthetic oligonucleotide
  Target: ATXN1; (+) strand; PAM type: NRG; PAM sequence: TAG
atctgacaggaggtggagct

SEQ ID NO: 115548 - DNA, 20 bp, Artificial Sequence
  Description of Artificial Sequence: Synthetic oligonucleotide
  Target: ATXN1; (+) strand; PAM type: NRG; PAM sequence: AGG
tctgacaggaggtggagctt

SEQ ID NO: 115549 - DNA, 20 bp, Artificial Sequence
  Description of Artificial Sequence: Synthetic oligonucleotide
  Target: ATXN1; (+) strand; PAM type: NRG; PAM sequence: TGG
acaggaggtggagcttaggc

SEQ ID NO: 115550 - DNA, 20 bp, Artificial Sequence
  Description of Artificial Sequence: Synthetic oligonucleotide
  Target: ATXN1; (+) strand; PAM type: NRG; PAM sequence: GAG
aggtggagcttaggctggct

SEQ ID NO: 115551 - DNA, 20 bp, Artificial Sequence
  Description of Artificial Sequence: Synthetic oligonucleotide
  Target: ATXN1; (+) strand; PAM type: NRG; PAM sequence: TGG
ggagcttaggctggctgagc

SEQ ID NO: 115552 - DNA, 20 bp, Artificial Sequence
  Description of Artificial Sequence: Synthetic oligonucleotide
  Target: ATXN1; (+) strand; PAM type: NRG; PAM sequence: CGG
ctggctgagctggctaatgc

SEQ ID NO: 115553 - DNA, 20 bp, Artificial Sequence
  Description of Artificial Sequence: Synthetic oligonucleotide
  Target: ATXN1; (+) strand; PAM type: NRG; PAM sequence: TGG
ctcgcctgcctctcacctac

SEQ ID NO: 115554 - DNA, 20 bp, Artificial Sequence
  Description of Artificial Sequence: Synthetic oligonucleotide
  Target: ATXN1; (+) strand; PAM type: NRG; PAM sequence: CAG
tcacctactggtgtgccacc

SEQ ID NO: 115555 - DNA, 20 bp, Artificial Sequence
  Description of Artificial Sequence: Synthetic oligonucleotide
  Target: ATXN1; (+) strand; PAM type: NRG; PAM sequence: CAG
gtgtgccacccagttcctaa

SEQ ID NO: 115556 - DNA, 20 bp, Artificial Sequence
  Description of Artificial Sequence: Synthetic oligonucleotide
  Target: ATXN1; (+) strand; PAM type: NRG; PAM sequence: AGG
tgtgccacccagttcctaac

SEQ ID NO: 115557 - DNA, 20 bp, Artificial Sequence
  Description of Artificial Sequence: Synthetic oligonucleotide
  Target: ATXN1; (+) strand; PAM type: NRG; PAM sequence: CAG
acccagttcctaacaggcca

SEQ ID NO: 115558 - DNA, 20 bp, Artificial Sequence
  Description of Artificial Sequence: Synthetic oligonucleotide
  Target: ATXN1; (+) strand; PAM type: NRG; PAM sequence: TGG
aacaggccacagacccataa

SEQ ID NO: 115559 - DNA, 20 bp, Artificial Sequence
  Description of Artificial Sequence: Synthetic oligonucleotide
  Target: ATXN1; (+) strand; PAM type: NRG; PAM sequence: TGG
cacagacccataatggtcca

SEQ ID NO: 115560 - DNA, 20 bp, Artificial Sequence
  Description of Artificial Sequence: Synthetic oligonucleotide
  Target: ATXN1; (+) strand; PAM type: NRG; PAM sequence: CAG
acccataatggtccatggcc

SEQ ID NO: 115561 - DNA, 20 bp, Artificial Sequence
  Description of Artificial Sequence: Synthetic oligonucleotide
  Target: ATXN1; (+) strand; PAM type: NRG; PAM sequence: AGG
cccataatggtccatggccc

SEQ ID NO: 115562 - DNA, 20 bp, Artificial Sequence
  Description of Artificial Sequence: Synthetic oligonucleotide
  Target: ATXN1; (+) strand; PAM type: NRG; PAM sequence: GGG
ccataatggtccatggccca

SEQ ID NO: 115563 - DNA, 20 bp, Artificial Sequence
  Description of Artificial Sequence: Synthetic oligonucleotide
  Target: ATXN1; (+) strand; PAM type: NRG; PAM sequence: GGG
cataatggtccatggcccag

SEQ ID NO: 115564 - DNA, 20 bp, Artificial Sequence
  Description of Artificial Sequence: Synthetic oligonucleotide
  Target: ATXN1; (+) strand; PAM type: NRG; PAM sequence: TGG
atggtccatggcccaggggt

SEQ ID NO: 115565 - DNA, 20 bp, Artificial Sequence
  Description of Artificial Sequence: Synthetic oligonucleotide
  Target: ATXN1; (+) strand; PAM type: NRG; PAM sequence: GGG
tggtccatggcccaggggtt

SEQ ID NO: 115566 - DNA, 20 bp, Artificial Sequence
  Description of Artificial Sequence: Synthetic oligonucleotide
  Target: ATXN1; (+) strand; PAM type: NRG; PAM sequence: TAG
ggttgggaacccctgtgtta

SEQ ID NO: 115567 - DNA, 20 bp, Artificial Sequence
  Description of Artificial Sequence: Synthetic oligonucleotide
  Target: ATXN1; (+) strand; PAM type: NRG; PAM sequence: AGG
gttgggaacccctgtgttat

SEQ ID NO: 115568 - DNA, 20 bp, Artificial Sequence
  Description of Artificial Sequence: Synthetic oligonucleotide
  Target: ATXN1; (+) strand; PAM type: NRG; PAM sequence: AAG
cccaatttctgccatctgaa

SEQ ID NO: 115569 - DNA, 20 bp, Artificial Sequence
  Description of Artificial Sequence: Synthetic oligonucleotide
  Target: ATXN1; (+) strand; PAM type: NRG; PAM sequence: AAG
tttctgccatctgaaaagca

SEQ ID NO: 115570 - DNA, 20 bp, Artificial Sequence
  Description of Artificial Sequence: Synthetic oligonucleotide
  Target: ATXN1; (+) strand; PAM type: NRG; PAM sequence: AAG
tgccatctgaaaagcaaaga

SEQ ID NO: 115571 - DNA, 20 bp, Artificial Sequence
  Description of Artificial Sequence: Synthetic oligonucleotide
  Target: ATXN1; (+) strand; PAM type: NRG; PAM sequence: TGG
aaagcaaagaaagataacaa

SEQ ID NO: 115572 - DNA, 20 bp, Artificial Sequence
  Description of Artificial Sequence: Synthetic oligonucleotide
  Target: ATXN1; (+) strand; PAM type: NRG; PAM sequence: TAG
aatggactctgttgactttt

SEQ ID NO: 115573 - DNA, 20 bp, Artificial Sequence
  Description of Artificial Sequence: Synthetic oligonucleotide
  Target: ATXN1; (+) strand; PAM type: NRG; PAM sequence: CAG
ggactctgttgactttttag

SEQ ID NO: 115574 - DNA, 20 bp, Artificial Sequence
  Description of Artificial Sequence: Synthetic oligonucleotide
  Target: ATXN1; (+) strand; PAM type: NRG; PAM sequence: TAG
caaaatattacaacacataa

SEQ ID NO: 115575 - DNA, 20 bp, Artificial Sequence
  Description of Artificial Sequence: Synthetic oligonucleotide
  Target: ATXN1; (+) strand; PAM type: NRG; PAM sequence: AGG
aaaatattacaacacataat

SEQ ID NO: 115576 - DNA, 20 bp, Artificial Sequence
  Description of Artificial Sequence: Synthetic oligonucleotide
  Target: ATXN1; (+) strand; PAM type: NRG; PAM sequence: CAG
ttacaacacataataggaca

SEQ ID NO: 115577 - DNA, 20 bp, Artificial Sequence
  Description of Artificial Sequence: Synthetic oligonucleotide
  Target: ATXN1; (+) strand; PAM type: NRG; PAM sequence: TAG
agatactgaaataatacatt

SEQ ID NO: 115578 - DNA, 20 bp, Artificial Sequence
  Description of Artificial Sequence: Synthetic oligonucleotide
  Target: ATXN1; (+) strand; PAM type: NRG; PAM sequence: CAG
tgaaataatacatttagtgc

SEQ ID NO: 115579 - DNA, 20 bp, Artificial Sequence
  Description of Artificial Sequence: Synthetic oligonucleotide
  Target: ATXN1; (+) strand; PAM type: NRG; PAM sequence: GAG
atacatttagtgccagcttt

SEQ ID NO: 115580 - DNA, 20 bp, Artificial Sequence
  Description of Artificial Sequence: Synthetic oligonucleotide
  Target: ATXN1; (+) strand; PAM type: NRG; PAM sequence: CAG
atttagtgccagctttgagt

SEQ ID NO: 115581 - DNA, 20 bp, Artificial Sequence
  Description of Artificial Sequence: Synthetic oligonucleotide
  Target: ATXN1; (+) strand; PAM type: NRG; PAM sequence: AGG
tttagtgccagctttgagtc

SEQ ID NO: 115582 - DNA, 20 bp, Artificial Sequence
  Description of Artificial Sequence: Synthetic oligonucleotide
  Target: ATXN1; (+) strand; PAM type: NRG; PAM sequence: AAG
agtcaggtttcattgctgtc

SEQ ID NO: 115583 - DNA, 20 bp, Artificial Sequence
  Description of Artificial Sequence: Synthetic oligonucleotide
  Target: ATXN1; (+) strand; PAM type: NRG; PAM sequence: GAG
tcaggtttcattgctgtcaa

SEQ ID NO: 115584 - DNA, 20 bp, Artificial Sequence
  Description of Artificial Sequence: Synthetic oligonucleotide
  Target: ATXN1; (+) strand; PAM type: NRG; PAM sequence: AAG
gtttcattgctgtcaagaga

SEQ ID NO: 115585 - DNA, 20 bp, Artificial Sequence
  Description of Artificial Sequence: Synthetic oligonucleotide
  Target: ATXN1; (+) strand; PAM type: NRG; PAM sequence: AGG
tttcattgctgtcaagagaa

SEQ ID NO: 115586 - DNA, 20 bp, Artificial Sequence
  Description of Artificial Sequence: Synthetic oligonucleotide
  Target: ATXN1; (+) strand; PAM type: NRG; PAM sequence: AAG
ttgctgtcaagagaaaggta

SEQ ID NO: 115587 - DNA, 20 bp, Artificial Sequence
  Description of Artificial Sequence: Synthetic oligonucleotide
  Target: ATXN1; (+) strand; PAM type: NRG; PAM sequence: AGG
tgctgtcaagagaaaggtaa

SEQ ID NO: 115588 - DNA, 20 bp, Artificial Sequence
  Description of Artificial Sequence: Synthetic oligonucleotide
  Target: ATXN1; (+) strand; PAM type: NRG; PAM sequence: TAG
tgttcaatccatctcccttg

SEQ ID NO: 115589 - DNA, 20 bp, Artificial Sequence
  Description of Artificial Sequence: Synthetic oligonucleotide
  Target: ATXN1; (+) strand; PAM type: NRG; PAM sequence: CAG
caatccatctcccttgtaga

SEQ ID NO: 115590 - DNA, 20 bp, Artificial Sequence
  Description of Artificial Sequence: Synthetic oligonucleotide
  Target: ATXN1; (+) strand; PAM type: NRG; PAM sequence: TAG
tgtagacagtaaattttaat

SEQ ID NO: 115591 - DNA, 20 bp, Artificial Sequence
  Description of Artificial Sequence: Synthetic oligonucleotide
  Target: ATXN1; (+) strand; PAM type: NRG; PAM sequence: TAG
aaattttaattagttttaat

SEQ ID NO: 115592 - DNA, 20 bp, Artificial Sequence
  Description of Artificial Sequence: Synthetic oligonucleotide
  Target: ATXN1; (+) strand; PAM type: NRG; PAM sequence: GAG
aattagttttaattagaaat

SEQ ID NO: 115593 - DNA, 20 bp, Artificial Sequence
  Description of Artificial Sequence: Synthetic oligonucleotide
  Target: ATXN1; (+) strand; PAM type: NRG; PAM sequence: AAG
tagttttaattagaaatgag

SEQ ID NO: 115594 - DNA, 20 bp, Artificial Sequence
  Description of Artificial Sequence: Synthetic oligonucleotide
  Target: ATXN1; (+) strand; PAM type: NRG; PAM sequence: AAG
gtcctacacctcatctctac

SEQ ID NO: 115595 - DNA, 20 bp, Artificial Sequence
  Description of Artificial Sequence: Synthetic oligonucleotide
  Target: ATXN1; (+) strand; PAM type: NRG; PAM sequence: AAG
caagtctcctgaaacatacc

SEQ ID NO: 115596 - DNA, 20 bp, Artificial Sequence
  Description of Artificial Sequence: Synthetic oligonucleotide
  Target: ATXN1; (+) strand; PAM type: NRG; PAM sequence: TAG
accaagatattgtctttctg

SEQ ID NO: 115597 - DNA, 20 bp, Artificial Sequence
  Description of Artificial Sequence: Synthetic oligonucleotide
  Target: ATXN1; (+) strand; PAM type: NRG; PAM sequence: CAG
atattgtctttctgtagact

SEQ ID NO: 115598 - DNA, 20 bp, Artificial Sequence
  Description of Artificial Sequence: Synthetic oligonucleotide
  Target: ATXN1; (+) strand; PAM type: NRG; PAM sequence: GAG
attgtctttctgtagactca

SEQ ID NO: 115599 - DNA, 20 bp, Artificial Sequence
  Description of Artificial Sequence: Synthetic oligonucleotide
  Target: ATXN1; (+) strand; PAM type: NRG; PAM sequence: CAG
agactcagagcacgtataat

SEQ ID NO: 115600 - DNA, 20 bp, Artificial Sequence
  Description of Artificial Sequence: Synthetic oligonucleotide
  Target: ATXN1; (+) strand; PAM type: NRG; PAM sequence: TGG
agcacgtataatcagataac

SEQ ID NO: 115601 - DNA, 20 bp, Artificial Sequence
  Description of Artificial Sequence: Synthetic oligonucleotide
  Target: ATXN1; (+) strand; PAM type: NRG; PAM sequence: AAG
ttatattgtatattttatcc

SEQ ID NO: 115602 - DNA, 20 bp, Artificial Sequence
  Description of Artificial Sequence: Synthetic oligonucleotide
  Target: ATXN1; (+) strand; PAM type: NRG; PAM sequence: CAG
atgatttatacctataaatc

SEQ ID NO: 115603 - DNA, 20 bp, Artificial Sequence
  Description of Artificial Sequence: Synthetic oligonucleotide
  Target: ATXN1; (+) strand; PAM type: NRG; PAM sequence: CAG
tttatacctataaatccagc

SEQ ID NO: 115604 - DNA, 20 bp, Artificial Sequence
  Description of Artificial Sequence: Synthetic oligonucleotide
  Target: ATXN1; (+) strand; PAM type: NRG; PAM sequence: AGG
ttatacctataaatccagcc

SEQ ID NO: 115605 - DNA, 20 bp, Artificial Sequence
  Description of Artificial Sequence: Synthetic oligonucleotide
  Target: ATXN1; (+) strand; PAM type: NRG; PAM sequence: GAG
atacctataaatccagccag

SEQ ID NO: 115606 - DNA, 20 bp, Artificial Sequence
  Description of Artificial Sequence: Synthetic oligonucleotide
  Target: ATXN1; (+) strand; PAM type: NRG; PAM sequence: AGG
tacctataaatccagccagg

SEQ ID NO: 115607 - DNA, 20 bp, Artificial Sequence
  Description of Artificial Sequence: Synthetic oligonucleotide
  Target: ATXN1; (+) strand; PAM type: NRG; PAM sequence: CAG
aaatccagccaggaggatct

SEQ ID NO: 115608 - DNA, 20 bp, Artificial Sequence
  Description of Artificial Sequence: Synthetic oligonucleotide
  Target: ATXN1; (+) strand; PAM type: NRG; PAM sequence: GAG
gatctcagaataatatttat

SEQ ID NO: 115609 - DNA, 20 bp, Artificial Sequence
  Description of Artificial Sequence: Synthetic oligonucleotide
  Target: ATXN1; (+) strand; PAM type: NRG; PAM sequence: TAG
tcagaataatatttatgaga

SEQ ID NO: 115610 - DNA, 20 bp, Artificial Sequence
  Description of Artificial Sequence: Synthetic oligonucleotide
  Target: ATXN1; (+) strand; PAM type: NRG; PAM sequence: TAG
tgagatagactgaaatttaa

SEQ ID NO: 115611 - DNA, 20 bp, Artificial Sequence
  Description of Artificial Sequence: Synthetic oligonucleotide
  Target: ATXN1; (+) strand; PAM type: NRG; PAM sequence: AAG
atttaatagcaacacttctt

SEQ ID NO: 115612 - DNA, 20 bp, Artificial Sequence
  Description of Artificial Sequence: Synthetic oligonucleotide
  Target: ATXN1; (+) strand; PAM type: NRG; PAM sequence: TAG
taatagcaacacttcttaag

SEQ ID NO: 115613 - DNA, 20 bp, Artificial Sequence
  Description of Artificial Sequence: Synthetic oligonucleotide
  Target: ATXN1; (+) strand; PAM type: NRG; PAM sequence: TGG
agcaacacttcttaagtaga

SEQ ID NO: 115614 - DNA, 20 bp, Artificial Sequence
  Description of Artificial Sequence: Synthetic oligonucleotide
  Target: ATXN1; (+) strand; PAM type: NRG; PAM sequence: AAG
tcttaagtagatggactatc

SEQ ID NO: 115615 - DNA, 20 bp, Artificial Sequence
  Description of Artificial Sequence: Synthetic oligonucleotide
  Target: ATXN1; (+) strand; PAM type: NRG; PAM sequence: CAG
tcaagaaactcttaaaataa

SEQ ID NO: 115616 - DNA, 20 bp, Artificial Sequence
  Description of Artificial Sequence: Synthetic oligonucleotide
  Target: ATXN1; (+) strand; PAM type: NRG; PAM sequence: AAG
aaaataacagaatgaaaaat

SEQ ID NO: 115617 - DNA, 20 bp, Artificial Sequence
  Description of Artificial Sequence: Synthetic oligonucleotide
  Target: ATXN1; (+) strand; PAM type: NRG; PAM sequence: AGG
aaataacagaatgaaaaata

SEQ ID NO: 115618 - DNA, 20 bp, Artificial Sequence
  Description of Artificial Sequence: Synthetic oligonucleotide
  Target: ATXN1; (+) strand; PAM type: NRG; PAM sequence: TAG
taacagaatgaaaaataagg

SEQ ID NO: 115619 - DNA, 20 bp, Artificial Sequence
  Description of Artificial Sequence: Synthetic oligonucleotide
  Target: ATXN1; (+) strand; PAM type: NRG; PAM sequence: TGG
cagaatgaaaaataaggtag

SEQ ID NO: 115620 - DNA, 20 bp, Artificial Sequence
  Description of Artificial Sequence: Synthetic oligonucleotide
  Target: ATXN1; (+) strand; PAM type: NRG; PAM sequence: AAG
aaggtagtggctctgtatat

SEQ ID NO: 115621 - DNA, 20 bp, Artificial Sequence
  Description of Artificial Sequence: Synthetic oligonucleotide
  Target: ATXN1; (+) strand; PAM type: NRG; PAM sequence: CAG
gctctgtatataagccccgt

SEQ ID NO: 115622 - DNA, 20 bp, Artificial Sequence
  Description of Artificial Sequence: Synthetic oligonucleotide
  Target: ATXN1; (+) strand; PAM type: NRG; PAM sequence: CAG
tgtatataagccccgtcagc

SEQ ID NO: 115623 - DNA, 20 bp, Artificial Sequence
  Description of Artificial Sequence: Synthetic oligonucleotide
  Target: ATXN1; (+) strand; PAM type: NRG; PAM sequence: CGG
aagccccgtcagccagtaca

SEQ ID NO: 115624 - DNA, 20 bp, Artificial Sequence
  Description of Artificial Sequence: Synthetic oligonucleotide
  Target: ATXN1; (+) strand; PAM type: NRG; PAM sequence: GGG
agccccgtcagccagtacac

SEQ ID NO: 115625 - DNA, 20 bp, Artificial Sequence
  Description of Artificial Sequence: Synthetic oligonucleotide
  Target: ATXN1; (+) strand; PAM type: NRG; PAM sequence: GAG
ccccgtcagccagtacacgg

SEQ ID NO: 115626 - DNA, 20 bp, Artificial Sequence
  Description of Artificial Sequence: Synthetic oligonucleotide
  Target: ATXN1; (+) strand; PAM type: NRG; PAM sequence: AGG
cccgtcagccagtacacggg

SEQ ID NO: 115627 - DNA, 20 bp, Artificial Sequence
  Description of Artificial Sequence: Synthetic oligonucleotide
  Target: ATXN1; (+) strand; PAM type: NRG; PAM sequence: AAG
tactcgatcaatgccaaatg

SEQ ID NO: 115628 - DNA, 20 bp, Artificial Sequence
  Description of Artificial Sequence: Synthetic oligonucleotide
  Target: ATXN1; (+) strand; PAM type: NRG; PAM sequence: AGG
actcgatcaatgccaaatga

SEQ ID NO: 115629 - DNA, 20 bp, Artificial Sequence
  Description of Artificial Sequence: Synthetic oligonucleotide
  Target: ATXN1; (+) strand; PAM type: NRG; PAM sequence: GAG
tcgatcaatgccaaatgaag

SEQ ID NO: 115630 - DNA, 20 bp, Artificial Sequence
  Description of Artificial Sequence: Synthetic oligonucleotide
  Target: ATXN1; (+) strand; PAM type: NRG; PAM sequence: AAG
aaatgaaggagtgacttcgt

SEQ ID NO: 115631 - DNA, 20 bp, Artificial Sequence
  Description of Artificial Sequence: Synthetic oligonucleotide
  Target: ATXN1; (+) strand; PAM type: NRG; PAM sequence: GAG
atgaaggagtgacttcgtaa

SEQ ID NO: 115632 - DNA, 20 bp, Artificial Sequence
  Description of Artificial Sequence: Synthetic oligonucleotide
  Target: ATXN1; (+) strand; PAM type: NRG; PAM sequence: AGG
tgaaggagtgacttcgtaag

SEQ ID NO: 115633 - DNA, 20 bp, Artificial Sequence
  Description of Artificial Sequence: Synthetic oligonucleotide
  Target: ATXN1; (+) strand; PAM type: NRG; PAM sequence: GGG
gaaggagtgacttcgtaaga

SEQ ID NO: 115634 - DNA, 20 bp, Artificial Sequence
  Description of Artificial Sequence: Synthetic oligonucleotide
  Target: ATXN1; (+) strand; PAM type: NRG; PAM sequence: AAG
gtgacttcgtaagagggact

SEQ ID NO: 115635 - DNA, 20 bp, Artificial Sequence
  Description of Artificial Sequence: Synthetic oligonucleotide
  Target: ATXN1; (+) strand; PAM type: NRG; PAM sequence: AAG
acttcgtaagagggactaag

SEQ ID NO: 115636 - DNA, 20 bp, Artificial Sequence
  Description of Artificial Sequence: Synthetic oligonucleotide
  Target: ATXN1; (+) strand; PAM type: NRG; PAM sequence: AAG
gagggactaagaagcaattc

SEQ ID NO: 115637 - DNA, 20 bp, Artificial Sequence
  Description of Artificial Sequence: Synthetic oligonucleotide
  Target: ATXN1; (+) strand; PAM type: NRG; PAM sequence: TGG
agcaattcaagttgctattc

SEQ ID NO: 115638 - DNA, 20 bp, Artificial Sequence
  Description of Artificial Sequence: Synthetic oligonucleotide
  Target: ATXN1; (+) strand; PAM type: NRG; PAM sequence: AAG
tattctggaatctcttgtgt

SEQ ID NO: 115639 - DNA, 20 bp, Artificial Sequence
  Description of Artificial Sequence: Synthetic oligonucleotide
  Target: ATXN1; (+) strand; PAM type: NRG; PAM sequence: TGG
ctggaatctcttgtgtaaga

SEQ ID NO: 115640 - DNA, 20 bp, Artificial Sequence
  Description of Artificial Sequence: Synthetic oligonucleotide
  Target: ATXN1; (+) strand; PAM type: NRG; PAM sequence: GGG
tggaatctcttgtgtaagat

SEQ ID NO: 115641 - DNA, 20 bp, Artificial Sequence
  Description of Artificial Sequence: Synthetic oligonucleotide
  Target: ATXN1; (+) strand; PAM type: NRG; PAM sequence: AAG
tcttgtgtaagatgggaatc

SEQ ID NO: 115642 - DNA, 20 bp, Artificial Sequence
  Description of Artificial Sequence: Synthetic oligonucleotide
  Target: ATXN1; (+) strand; PAM type: NRG; PAM sequence: CAG
aagatgggaatcaagtctaa

SEQ ID NO: 115643 - DNA, 20 bp, Artificial Sequence
  Description of Artificial Sequence: Synthetic oligonucleotide
  Target: ATXN1; (+) strand; PAM type: NRG; PAM sequence: GAG
gatgggaatcaagtctaaca

SEQ ID NO: 115644 - DNA, 20 bp, Artificial Sequence
  Description of Artificial Sequence: Synthetic oligonucleotide
  Target: ATXN1; (+) strand; PAM type: NRG; PAM sequence: TAG
aagtctaacagagtcattaa

SEQ ID NO: 115645 - DNA, 20 bp, Artificial Sequence
  Description of Artificial Sequence: Synthetic oligonucleotide
  Target: ATXN1; (+) strand; PAM type: NRG; PAM sequence: AAG
agtcattaatagaatttaat

SEQ ID NO: 115646 - DNA, 20 bp, Artificial Sequence
  Description of Artificial Sequence: Synthetic oligonucleotide
  Target: ATXN1; (+) strand; PAM type: NRG; PAM sequence: AGG
gtcattaatagaatttaata

SEQ ID NO: 115647 - DNA, 20 bp, Artificial Sequence
  Description of Artificial Sequence: Synthetic oligonucleotide
  Target: ATXN1; (+) strand; PAM type: NRG; PAM sequence: AAG
ttaatagaatttaataagga

SEQ ID NO: 115648 - DNA, 20 bp, Artificial Sequence
  Description of Artificial Sequence: Synthetic oligonucleotide
  Target: ATXN1; (+) strand; PAM type: NRG; PAM sequence: AAG
ttaataaggaaagcttccaa

SEQ ID NO: 115649 - DNA, 20 bp, Artificial Sequence
  Description of Artificial Sequence: Synthetic oligonucleotide
  Target: ATXN1; (+) strand; PAM type: NRG; PAM sequence: GAG
aataaggaaagcttccaaaa

SEQ ID NO: 115650 - DNA, 20 bp, Artificial Sequence
  Description of Artificial Sequence: Synthetic oligonucleotide
  Target: ATXN1; (+) strand; PAM type: NRG; PAM sequence: AGG
ataaggaaagcttccaaaag

SEQ ID NO: 115651 - DNA, 20 bp, Artificial Sequence
  Description of Artificial Sequence: Synthetic oligonucleotide
  Target: ATXN1; (+) strand; PAM type: NRG; PAM sequence: AAG
ttccaaaagaggaaactcca

SEQ ID NO: 115652 - DNA, 20 bp, Artificial Sequence
  Description of Artificial Sequence: Synthetic oligonucleotide
  Target: ATXN1; (+) strand; PAM type: NRG; PAM sequence: CAG
cctttcattactgaatttct

SEQ ID NO: 115653 - DNA, 20 bp, Artificial Sequence
  Description of Artificial Sequence: Synthetic oligonucleotide
  Target: ATXN1; (+) strand; PAM type: NRG; PAM sequence: CAG
tactgaatttctcagattct

SEQ ID NO: 115654 - DNA, 20 bp, Artificial Sequence
  Description of Artificial Sequence: Synthetic oligonucleotide
  Target: ATXN1; (+) strand; PAM type: NRG; PAM sequence: TGG
tgaatttctcagattctcag

SEQ ID NO: 115655 - DNA, 20 bp, Artificial Sequence
  Description of Artificial Sequence: Synthetic oligonucleotide
  Target: ATXN1; (+) strand; PAM type: NRG; PAM sequence: CAG
ggatctaaatttaaactgca

SEQ ID NO: 115656 - DNA, 20 bp, Artificial Sequence
  Description of Artificial Sequence: Synthetic oligonucleotide
  Target: ATXN1; (+) strand; PAM type: NRG; PAM sequence: AGG
gatctaaatttaaactgcac

SEQ ID NO: 115657 - DNA, 20 bp, Artificial Sequence
  Description of Artificial Sequence: Synthetic oligonucleotide
  Target: ATXN1; (+) strand; PAM type: NRG; PAM sequence: AAG
atttaaactgcacaggaaac

SEQ ID NO: 115658 - DNA, 20 bp, Artificial Sequence
  Description of Artificial Sequence: Synthetic oligonucleotide
  Target: ATXN1; (+) strand; PAM type: NRG; PAM sequence: AGG
tttaaactgcacaggaaaca

SEQ ID NO: 115659 - DNA, 20 bp, Artificial Sequence
  Description of Artificial Sequence: Synthetic oligonucleotide
  Target: ATXN1; (+) strand; PAM type: NRG; PAM sequence: AAG
gaaacaaggccctttgtcaa

SEQ ID NO: 115660 - DNA, 20 bp, Artificial Sequence
  Description of Artificial Sequence: Synthetic oligonucleotide
  Target: ATXN1; (+) strand; PAM type: NRG; PAM sequence: AGG
aaacaaggccctttgtcaaa

SEQ ID NO: 115661 - DNA, 20 bp, Artificial Sequence
  Description of Artificial Sequence: Synthetic oligonucleotide
  Target: ATXN1; (+) strand; PAM type: NRG; PAM sequence: AAG
ctaaatctaacctacactat

SEQ ID NO: 115662 - DNA, 20 bp, Artificial Sequence
  Description of Artificial Sequence: Synthetic oligonucleotide
  Target: ATXN1; (+) strand; PAM type: NRG; PAM sequence: AAG
aatctaacctacactataag

SEQ ID NO: 115663 - DNA, 20 bp, Artificial Sequence
  Description of Artificial Sequence: Synthetic oligonucleotide
  Target: ATXN1; (+) strand; PAM type: NRG; PAM sequence: AAG
atcctgtgttccatgttatg

SEQ ID NO: 115664 - DNA, 20 bp, Artificial Sequence
  Description of Artificial Sequence: Synthetic oligonucleotide
  Target: ATXN1; (+) strand; PAM type: NRG; PAM sequence: AGG
tcctgtgttccatgttatga

SEQ ID NO: 115665 - DNA, 20 bp, Artificial Sequence
  Description of Artificial Sequence: Synthetic oligonucleotide
  Target: ATXN1; (+) strand; PAM type: NRG; PAM sequence: GGG
cctgtgttccatgttatgaa

SEQ ID NO: 115666 - DNA, 20 bp, Artificial Sequence
  Description of Artificial Sequence: Synthetic oligonucleotide
  Target: ATXN1; (+) strand; PAM type: NRG; PAM sequence: AAG
ccatgttatgaagggcctcc

SEQ ID NO: 115667 - DNA, 20 bp, Artificial Sequence
  Description of Artificial Sequence: Synthetic oligonucleotide
  Target: ATXN1; (+) strand; PAM type: NRG; PAM sequence: AAG
agggcctccaagaatttaaa

SEQ ID NO: 115668 - DNA, 20 bp, Artificial Sequence
  Description of Artificial Sequence: Synthetic oligonucleotide
  Target: ATXN1; (+) strand; PAM type: NRG; PAM sequence: AGG
gggcctccaagaatttaaaa

SEQ ID NO: 115669 - DNA, 20 bp, Artificial Sequence
  Description of Artificial Sequence: Synthetic oligonucleotide
  Target: ATXN1; (+) strand; PAM type: NRG; PAM sequence: TAG
agaatttaaaaaggacaaaa

SEQ ID NO: 115670 - DNA, 20 bp, Artificial Sequence
  Description of Artificial Sequence: Synthetic oligonucleotide
  Target: ATXN1; (+) strand; PAM type: NRG; PAM sequence: AAG
taaaaaggacaaaatagaaa

SEQ ID NO: 115671 - DNA, 20 bp, Artificial Sequence
  Description of Artificial Sequence: Synthetic oligonucleotide
  Target: ATXN1; (+) strand; PAM type: NRG; PAM sequence: CAG
aaaggacaaaatagaaaaag

SEQ ID NO: 115672 - DNA, 20 bp, Artificial Sequence
  Description of Artificial Sequence: Synthetic oligonucleotide
  Target: ATXN1; (+) strand; PAM type: NRG; PAM sequence: GAG
aggacaaaatagaaaaagca

SEQ ID NO: 115673 - DNA, 20 bp, Artificial Sequence
  Description of Artificial Sequence: Synthetic oligonucleotide
  Target: ATXN1; (+) strand; PAM type: NRG; PAM sequence: GAG
gacaaaatagaaaaagcaga

SEQ ID NO: 115674 - DNA, 20 bp, Artificial Sequence
  Description of Artificial Sequence: Synthetic oligonucleotide
  Target: ATXN1; (+) strand; PAM type: NRG; PAM sequence: TAG
aaaagcagagagttccttta

SEQ ID NO: 115675 - DNA, 20 bp, Artificial Sequence
  Description of Artificial Sequence: Synthetic oligonucleotide
  Target: ATXN1; (+) strand; PAM type: NRG; PAM sequence: TAG
tcctttatagtattactatc

SEQ ID NO: 115676 - DNA, 20 bp, Artificial Sequence
  Description of Artificial Sequence: Synthetic oligonucleotide
  Target: ATXN1; (+) strand; PAM type: NRG; PAM sequence: AAG
tattactatctagctactaa

SEQ ID NO: 115677 - DNA, 20 bp, Artificial Sequence
  Description of Artificial Sequence: Synthetic oligonucleotide
  Target: ATXN1; (+) strand; PAM type: NRG; PAM sequence: AAG
tctagctactaaaagccaaa

SEQ ID NO: 115678 - DNA, 20 bp, Artificial Sequence
  Description of Artificial Sequence: Synthetic oligonucleotide
  Target: ATXN1; (+) strand; PAM type: NRG; PAM sequence: TGG
aaagaaaaatgtgatgtcaa

SEQ ID NO: 115679 - DNA, 20 bp, Artificial Sequence
  Description of Artificial Sequence: Synthetic oligonucleotide
  Target: ATXN1; (+) strand; PAM type: NRG; PAM sequence: TGG
atgtgatgtcaatggcaatt

SEQ ID NO: 115680 - DNA, 20 bp, Artificial Sequence
  Description of Artificial Sequence: Synthetic oligonucleotide
  Target: ATXN1; (+) strand; PAM type: NRG; PAM sequence: AAG
atttggcaactacatttgta

SEQ ID NO: 115681 - DNA, 20 bp, Artificial Sequence
  Description of Artificial Sequence: Synthetic oligonucleotide
  Target: ATXN1; (+) strand; PAM type: NRG; PAM sequence: AAG
tacatttgtaaagttataac

SEQ ID NO: 115682 - DNA, 20 bp, Artificial Sequence
  Description of Artificial Sequence: Synthetic oligonucleotide
  Target: ATXN1; (+) strand; PAM type: NRG; PAM sequence: CAG
agttataacaagccaatttt

SEQ ID NO: 115683 - DNA, 20 bp, Artificial Sequence
  Description of Artificial Sequence: Synthetic oligonucleotide
  Target: ATXN1; (+) strand; PAM type: NRG; PAM sequence: GAG
ttataacaagccaattttca

SEQ ID NO: 115684 - DNA, 20 bp, Artificial Sequence
  Description of Artificial Sequence: Synthetic oligonucleotide
  Target: ATXN1; (+) strand; PAM type: NRG; PAM sequence: TAG
aacaagccaattttcagagc

SEQ ID NO: 115685 - DNA, 20 bp, Artificial Sequence
  Description of Artificial Sequence: Synthetic oligonucleotide
  Target: ATXN1; (+) strand; PAM type: NRG; PAM sequence: GAG
caagccaattttcagagcta

SEQ ID NO: 115686 - DNA, 20 bp, Artificial Sequence
  Description of Artificial Sequence: Synthetic oligonucleotide
  Target: ATXN1; (+) strand; PAM type: NRG; PAM sequence: CGG
gagctagagacttcttttcg

SEQ ID NO: 115687 - DNA, 20 bp, Artificial Sequence
  Description of Artificial Sequence: Synthetic oligonucleotide
  Target: ATXN1; (+) strand; PAM type: NRG; PAM sequence: GGG
agctagagacttcttttcgc

SEQ ID NO: 115688 - DNA, 20 bp, Artificial Sequence
  Description of Artificial Sequence: Synthetic oligonucleotide
  Target: ATXN1; (+) strand; PAM type: NRG; PAM sequence: GGG
gctagagacttcttttcgcg

SEQ ID NO: 115689 - DNA, 20 bp, Artificial Sequence
  Description of Artificial Sequence: Synthetic oligonucleotide
  Target: ATXN1; (+) strand; PAM type: NRG; PAM sequence: GGG
ctagagacttcttttcgcgg

SEQ ID NO: 115690 - DNA, 20 bp, Artificial Sequence
  Description of Artificial Sequence: Synthetic oligonucleotide
  Target: ATXN1; (+) strand; PAM type: NRG; PAM sequence: GGG
tagagacttcttttcgcggg

SEQ ID NO: 115691 - DNA, 20 bp, Artificial Sequence
  Description of Artificial Sequence: Synthetic oligonucleotide
  Target: ATXN1; (+) strand; PAM type: NRG; PAM sequence: GGG
agagacttcttttcgcgggg

SEQ ID NO: 115692 - DNA, 20 bp, Artificial Sequence
  Description of Artificial Sequence: Synthetic oligonucleotide
  Target: ATXN1; (+) strand; PAM type: NRG; PAM sequence: GGG
gagacttcttttcgcggggg

SEQ ID NO: 115693 - DNA, 20 bp, Artificial Sequence
  Description of Artificial Sequence: Synthetic oligonucleotide
  Target: ATXN1; (+) strand; PAM type: NRG; PAM sequence: GGG
agacttcttttcgcgggggg

SEQ ID NO: 115694 - DNA, 20 bp, Artificial Sequence
  Description of Artificial Sequence: Synthetic oligonucleotide
  Target: ATXN1; (+) strand; PAM type: NRG; PAM sequence: GGG
gacttcttttcgcggggggg

SEQ ID NO: 115695 - DNA, 20 bp, Artificial Sequence
  Description of Artificial Sequence: Synthetic oligonucleotide
  Target: ATXN1; (+) strand; PAM type: NRG; PAM sequence: GGG
acttcttttcgcgggggggg

SEQ ID NO: 115696 - DNA, 20 bp, Artificial Sequence
  Description of Artificial Sequence: Synthetic oligonucleotide
  Target: ATXN1; (+) strand; PAM type: NRG; PAM sequence: GGG
cttcttttcgcggggggggg

SEQ ID NO: 115697 - DNA, 20 bp, Artificial Sequence
  Description of Artificial Sequence: Synthetic oligonucleotide
  Target: ATXN1; (+) strand; PAM type: NRG; PAM sequence: GGG
ttcttttcgcgggggggggg

SEQ ID NO: 115698 - DNA, 20 bp, Artificial Sequence
  Description of Artificial Sequence: Synthetic oligonucleotide
  Target: ATXN1; (+) strand; PAM type: NRG; PAM sequence: GGG
tcttttcgcggggggggggg

SEQ ID NO: 115699 - DNA, 20 bp, Artificial Sequence
  Description of Artificial Sequence: Synthetic oligonucleotide
  Target: ATXN1; (+) strand; PAM type: NRG; PAM sequence: GGG
cttttcgcgggggggggggg

SEQ ID NO: 115700 - DNA, 20 bp, Artificial Sequence
  Description of Artificial Sequence: Synthetic oligonucleotide
  Target: ATXN1; (+) strand; PAM type: NRG; PAM sequence: GGG
ttttcgcggggggggggggg

SEQ ID NO: 115701 - DNA, 20 bp, Artificial Sequence
  Description of Artificial Sequence: Synthetic oligonucleotide
  Target: ATXN1; (+) strand; PAM type: NRG; PAM sequence: GGG
tttcgcgggggggggggggg

SEQ ID NO: 115702 - DNA, 20 bp, Artificial Sequence
  Description of Artificial Sequence: Synthetic oligonucleotide
  Target: ATXN1; (+) strand; PAM type: NRG; PAM sequence: GGG
ttcgcggggggggggggggg

SEQ ID NO: 115703 - DNA, 20 bp, Artificial Sequence
  Description of Artificial Sequence: Synthetic oligonucleotide
  Target: ATXN1; (+) strand; PAM type: NRG; PAM sequence: GGG
tcgcgggggggggggggggg

SEQ ID NO: 115704 - DNA, 20 bp, Artificial Sequence
  Description of Artificial Sequence: Synthetic oligonucleotide
  Target: ATXN1; (+) strand; PAM type: NRG; PAM sequence: GGG
cgcggggggggggggggggg

SEQ ID NO: 115705 - DNA, 20 bp, Artificial Sequence
  Description of Artificial Sequence: Synthetic oligonucleotide
  Target: ATXN1; (+) strand; PAM type: NRG; PAM sequence: GGG
gcgggggggggggggggggg

SEQ ID NO: 115706 - DNA, 20 bp, Artificial Sequence
  Description of Artificial Sequence: Synthetic oligonucleotide
  Target: ATXN1; (+) strand; PAM type: NRG; PAM sequence: GGG
cggggggggggggggggggg

SEQ ID NO: 115707 - DNA, 20 bp, Artificial Sequence
  Description of Artificial Sequence: Synthetic oligonucleotide
  Target: ATXN1; (+) strand; PAM type: NRG; PAM sequence: CGG
gggggggggggggggggggg

SEQ ID NO: 115708 - DNA, 20 bp, Artificial Sequence
  Description of Artificial Sequence: Synthetic oligonucleotide
  Target: ATXN1; (+) strand; PAM type: NRG; PAM sequence: GGG
gggggggggggggggggggc

SEQ ID NO: 115709 - DNA, 20 bp, Artificial Sequence
  Description of Artificial Sequence: Synthetic oligonucleotide
  Target: ATXN1; (+) strand; PAM type: NRG; PAM sequence: GGG
ggggggggggggggggggcg

SEQ ID NO: 115710 - DNA, 20 bp, Artificial Sequence
  Description of Artificial Sequence: Synthetic oligonucleotide
  Target: ATXN1; (+) strand; PAM type: NRG; PAM sequence: CGG
ggggggggggggggcggggc

SEQ ID NO: 115711 - DNA, 20 bp, Artificial Sequence
  Description of Artificial Sequence: Synthetic oligonucleotide
  Target: ATXN1; (+) strand; PAM type: NRG; PAM sequence: GGG
gggggggggggggcggggcc

SEQ ID NO: 115712 - DNA, 20 bp, Artificial Sequence
  Description of Artificial Sequence: Synthetic oligonucleotide
  Target: ATXN1; (+) strand; PAM type: NRG; PAM sequence: GGG
ggggggggggggcggggccg

SEQ ID NO: 115713 - DNA, 20 bp, Artificial Sequence
  Description of Artificial Sequence: Synthetic oligonucleotide
  Target: ATXN1; (+) strand; PAM type: NRG; PAM sequence: GGG
gggggggggggcggggccgg

SEQ ID NO: 115714 - DNA, 20 bp, Artificial Sequence
  Description of Artificial Sequence: Synthetic oligonucleotide
  Target: ATXN1; (+) strand; PAM type: NRG; PAM sequence: CGG
ggggggggcggggccggggg

SEQ ID NO: 115715 - DNA, 20 bp, Artificial Sequence
  Description of Artificial Sequence: Synthetic oligonucleotide
  Target: ATXN1; (+) strand; PAM type: NRG; PAM sequence: GGG
gggggggcggggccgggggc

SEQ ID NO: 115716 - DNA, 20 bp, Artificial Sequence
  Description of Artificial Sequence: Synthetic oligonucleotide
  Target: ATXN1; (+) strand; PAM type: NRG; PAM sequence: GGG
ggggggcggggccgggggcg

SEQ ID NO: 115717 - DNA, 20 bp, Artificial Sequence
  Description of Artificial Sequence: Synthetic oligonucleotide
  Target: ATXN1; (+) strand; PAM type: NRG; PAM sequence: CGG
gggcggggccgggggcgggg

SEQ ID NO: 115718 - DNA, 20 bp, Artificial Sequence
  Description of Artificial Sequence: Synthetic oligonucleotide
  Target: ATXN1; (+) strand; PAM type: NRG; PAM sequence: GGG
ggcggggccgggggcggggc

SEQ ID NO: 115719 - DNA, 20 bp, Artificial Sequence
  Description of Artificial Sequence: Synthetic oligonucleotide
  Target: ATXN1; (+) strand; PAM type: NRG; PAM sequence: AAG
gccgggggcggggcgggaat

SEQ ID NO: 115720 - DNA, 20 bp, Artificial Sequence
  Description of Artificial Sequence: Synthetic oligonucleotide
  Target: ATXN1; (+) strand; PAM type: NRG; PAM sequence: AGG
ccgggggcggggcgggaata

SEQ ID NO: 115721 - DNA, 20 bp, Artificial Sequence
  Description of Artificial Sequence: Synthetic oligonucleotide
  Target: ATXN1; (+) strand; PAM type: NRG; PAM sequence: GGG
cgggggcggggcgggaataa

SEQ ID NO: 115722 - DNA, 20 bp, Artificial Sequence
  Description of Artificial Sequence: Synthetic oligonucleotide
  Target: ATXN1; (+) strand; PAM type: NRG; PAM sequence: TGG
ggcggggcgggaataagggt

SEQ ID NO: 115723 - DNA, 20 bp, Artificial Sequence
  Description of Artificial Sequence: Synthetic oligonucleotide
  Target: ATXN1; (+) strand; PAM type: NRG; PAM sequence: GGG
gcggggcgggaataagggtt

SEQ ID NO: 115724 - DNA, 20 bp, Artificial Sequence
  Description of Artificial Sequence: Synthetic oligonucleotide
  Target: ATXN1; (+) strand; PAM type: NRG; PAM sequence: GGG
cggggcgggaataagggttg

SEQ ID NO: 115725 - DNA, 20 bp, Artificial Sequence
  Description of Artificial Sequence: Synthetic oligonucleotide
  Target: ATXN1; (+) strand; PAM type: NRG; PAM sequence: TGG
ggcgggaataagggttgggg

SEQ ID NO: 115726 - DNA, 20 bp, Artificial Sequence
  Description of Artificial Sequence: Synthetic oligonucleotide
  Target: ATXN1; (+) strand; PAM type: NRG; PAM sequence: GGG
gcgggaataagggttggggt

SEQ ID NO: 115727 - DNA, 20 bp, Artificial Sequence
  Description of Artificial Sequence: Synthetic oligonucleotide
  Target: ATXN1; (+) strand; PAM type: NRG; PAM sequence: GGG
cgggaataagggttggggtg

SEQ ID NO: 115728 - DNA, 20 bp, Artificial Sequence
  Description of Artificial Sequence: Synthetic oligonucleotide
  Target: ATXN1; (+) strand; PAM type: NRG; PAM sequence: TGG
gaataagggttggggtgggg

SEQ ID NO: 115729 - DNA, 20 bp, Artificial Sequence
  Description of Artificial Sequence: Synthetic oligonucleotide
  Target: ATXN1; (+) strand; PAM type: NRG; PAM sequence: GGG
aataagggttggggtggggt

SEQ ID NO: 115730 - DNA, 20 bp, Artificial Sequence
  Description of Artificial Sequence: Synthetic oligonucleotide
  Target: ATXN1; (+) strand; PAM type: NRG; PAM sequence: GGG
ataagggttggggtggggtg

SEQ ID NO: 115731 - DNA, 20 bp, Artificial Sequence
  Description of Artificial Sequence: Synthetic oligonucleotide
  Target: ATXN1; (+) strand; PAM type: NRG; PAM sequence: CAG
tggggtggggatgctgacat

SEQ ID NO: 115732 - DNA, 20 bp, Artificial Sequence
  Description of Artificial Sequence: Synthetic oligonucleotide
  Target: ATXN1; (+) strand; PAM type: NRG; PAM sequence: CAG
gctgacatcagaatgtgtac

SEQ ID NO: 115733 - DNA, 20 bp, Artificial Sequence
  Description of Artificial Sequence: Synthetic oligonucleotide
  Target: ATXN1; (+) strand; PAM type: NRG; PAM sequence: GAG
tgacatcagaatgtgtacca

SEQ ID NO: 115734 - DNA, 20 bp, Artificial Sequence
  Description of Artificial Sequence: Synthetic oligonucleotide
  Target: ATXN1; (+) strand; PAM type: NRG; PAM sequence: CAG
gaatgtgtaccagagtgact

SEQ ID NO: 115735 - DNA, 20 bp, Artificial Sequence
  Description of Artificial Sequence: Synthetic oligonucleotide
  Target: ATXN1; (+) strand; PAM type: NRG; PAM sequence: AGG
aatgtgtaccagagtgactc

SEQ ID NO: 115736 - DNA, 20 bp, Artificial Sequence
  Description of Artificial Sequence: Synthetic oligonucleotide
  Target: ATXN1; (+) strand; PAM type: NRG; PAM sequence: GGG
atgtgtaccagagtgactca

SEQ ID NO: 115737 - DNA, 20 bp, Artificial Sequence
  Description of Artificial Sequence: Synthetic oligonucleotide
  Target: ATXN1; (+) strand; PAM type: NRG; PAM sequence: GGG
tgtgtaccagagtgactcag

SEQ ID NO: 115738 - DNA, 20 bp, Artificial Sequence
  Description of Artificial Sequence: Synthetic oligonucleotide
  Target: ATXN1; (+) strand; PAM type: NRG; PAM sequence: CAG
gtgactcaggggtttttttt

SEQ ID NO: 115739 - DNA, 20 bp, Artificial Sequence
  Description of Artificial Sequence: Synthetic oligonucleotide
  Target: ATXN1; (+) strand; PAM type: NRG; PAM sequence: CAG
caggggttttttttcagcct

SEQ ID NO: 115740 - DNA, 20 bp, Artificial Sequence
  Description of Artificial Sequence: Synthetic oligonucleotide
  Target: ATXN1; (+) strand; PAM type: NRG; PAM sequence: GAG
ggggttttttttcagcctca

SEQ ID NO: 115741 - DNA, 20 bp, Artificial Sequence
  Description of Artificial Sequence: Synthetic oligonucleotide
  Target: ATXN1; (+) strand; PAM type: NRG; PAM sequence: CAG
cctcagagctaccatttact

SEQ ID NO: 115742 - DNA, 20 bp, Artificial Sequence
  Description of Artificial Sequence: Synthetic oligonucleotide
  Target: ATXN1; (+) strand; PAM type: NRG; PAM sequence: CAG
gctaccatttactcagcgtc

SEQ ID NO: 115743 - DNA, 20 bp, Artificial Sequence
  Description of Artificial Sequence: Synthetic oligonucleotide
  Target: ATXN1; (+) strand; PAM type: NRG; PAM sequence: AAG
cagcgtccagcgtcctaacc

SEQ ID NO: 115744 - DNA, 20 bp, Artificial Sequence
  Description of Artificial Sequence: Synthetic oligonucleotide
  Target: ATXN1; (+) strand; PAM type: NRG; PAM sequence: TAG
aattgtgtcttttgatgaat

SEQ ID NO: 115745 - DNA, 20 bp, Artificial Sequence
  Description of Artificial Sequence: Synthetic oligonucleotide
  Target: ATXN1; (+) strand; PAM type: NRG; PAM sequence: TAG
tgtgtcttttgatgaattag

SEQ ID NO: 115746 - DNA, 20 bp, Artificial Sequence
  Description of Artificial Sequence: Synthetic oligonucleotide
  Target: ATXN1; (+) strand; PAM type: NRG; PAM sequence: TGG
gtcttttgatgaattagtag

SEQ ID NO: 115747 - DNA, 20 bp, Artificial Sequence
  Description of Artificial Sequence: Synthetic oligonucleotide
  Target: ATXN1; (+) strand; PAM type: NRG; PAM sequence: TGG
tttgatgaattagtagtggt

SEQ ID NO: 115748 - DNA, 20 bp, Artificial Sequence
  Description of Artificial Sequence: Synthetic oligonucleotide
  Target: ATXN1; (+) strand; PAM type: NRG; PAM sequence: TGG
ggtttcatactgtgttaatt

SEQ ID NO: 115749 - DNA, 20 bp, Artificial Sequence
  Description of Artificial Sequence: Synthetic oligonucleotide
  Target: ATXN1; (+) strand; PAM type: NRG; PAM sequence: AAG
catactgtgttaatttggaa

SEQ ID NO: 115750 - DNA, 20 bp, Artificial Sequence
  Description of Artificial Sequence: Synthetic oligonucleotide
  Target: ATXN1; (+) strand; PAM type: NRG; PAM sequence: GAG
tgttaaacaaataaaaaatt

SEQ ID NO: 115751 - DNA, 20 bp, Artificial Sequence
  Description of Artificial Sequence: Synthetic oligonucleotide
  Target: ATXN1; (+) strand; PAM type: NRG; PAM sequence: AAG
tgagcttgttttgtttttca

SEQ ID NO: 115752 - DNA, 20 bp, Artificial Sequence
  Description of Artificial Sequence: Synthetic oligonucleotide
  Target: ATXN1; (+) strand; PAM type: NRG; PAM sequence: TAG
ttgtttttcaaagcactttg

SEQ ID NO: 115753 - DNA, 20 bp, Artificial Sequence
  Description of Artificial Sequence: Synthetic oligonucleotide
  Target: ATXN1; (+) strand; PAM type: NRG; PAM sequence: AAG
gtagttttcttgtccctaaa

SEQ ID NO: 115754 - DNA, 20 bp, Artificial Sequence
  Description of Artificial Sequence: Synthetic oligonucleotide
  Target: ATXN1; (+) strand; PAM type: NRG; PAM sequence: AAG
aaatcaaacttttcattttg

SEQ ID NO: 115755 - DNA, 20 bp, Artificial Sequence
  Description of Artificial Sequence: Synthetic oligonucleotide
  Target: ATXN1; (+) strand; PAM type: NRG; PAM sequence: GAG
cttttcattttgaagtattt

SEQ ID NO: 115756 - DNA, 20 bp, Artificial Sequence
  Description of Artificial Sequence: Synthetic oligonucleotide
  Target: ATXN1; (+) strand; PAM type: NRG; PAM sequence: AGG
ttttcattttgaagtatttg

SEQ ID NO: 115757 - DNA, 20 bp, Artificial Sequence
  Description of Artificial Sequence: Synthetic oligonucleotide
  Target: ATXN1; (+) strand; PAM type: NRG; PAM sequence: CAG
gaagtatttgaggtttaatc

SEQ ID NO: 115758 - DNA, 20 bp, Artificial Sequence
  Description of Artificial Sequence: Synthetic oligonucleotide
  Target: ATXN1; (+) strand; PAM type: NRG; PAM sequence: GAG
agtatttgaggtttaatcca

SEQ ID NO: 115759 - DNA, 20 bp, Artificial Sequence
  Description of Artificial Sequence: Synthetic oligonucleotide
  Target: ATXN1; (+) strand; PAM type: NRG; PAM sequence: AGG
gtatttgaggtttaatccag

SEQ ID NO: 115760 - DNA, 20 bp, Artificial Sequence
  Description of Artificial Sequence: Synthetic oligonucleotide
  Target: ATXN1; (+) strand; PAM type: NRG; PAM sequence: TAG
tgaggtttaatccagaggca

SEQ ID NO: 115761 - DNA, 20 bp, Artificial Sequence
  Description of Artificial Sequence: Synthetic oligonucleotide
  Target: ATXN1; (+) strand; PAM type: NRG; PAM sequence: TAG
taatccagaggcatagtatt

SEQ ID NO: 115762 - DNA, 20 bp, Artificial Sequence
  Description of Artificial Sequence: Synthetic oligonucleotide
  Target: ATXN1; (+) strand; PAM type: NRG; PAM sequence: CAG
tccagaggcatagtatttag

SEQ ID NO: 115763 - DNA, 20 bp, Artificial Sequence
  Description of Artificial Sequence: Synthetic oligonucleotide
  Target: ATXN1; (+) strand; PAM type: NRG; PAM sequence: AAG
tttagcagaaacatcttctc

SEQ ID NO: 115764 - DNA, 20 bp, Artificial Sequence
  Description of Artificial Sequence: Synthetic oligonucleotide
  Target: ATXN1; (+) strand; PAM type: NRG; PAM sequence: AAG
caagcactattaaaaaatta

SEQ ID NO: 115765 - DNA, 20 bp, Artificial Sequence
  Description of Artificial Sequence: Synthetic oligonucleotide
  Target: ATXN1; (+) strand; PAM type: NRG; PAM sequence: TGG
gcactattaaaaaattaaag

SEQ ID NO: 115766 - DNA, 20 bp, Artificial Sequence
  Description of Artificial Sequence: Synthetic oligonucleotide
  Target: ATXN1; (+) strand; PAM type: NRG; PAM sequence: GGG
cactattaaaaaattaaagt

SEQ ID NO: 115767 - DNA, 20 bp, Artificial Sequence
  Description of Artificial Sequence: Synthetic oligonucleotide
  Target: ATXN1; (+) strand; PAM type: NRG; PAM sequence: GGG
actattaaaaaattaaagtg

SEQ ID NO: 115768 - DNA, 20 bp, Artificial Sequence
  Description of Artificial Sequence: Synthetic oligonucleotide
  Target: ATXN1; (+) strand; PAM type: NRG; PAM sequence: CAG
ttaaaaaattaaagtggggc

SEQ ID NO: 115769 - DNA, 20 bp, Artificial Sequence
  Description of Artificial Sequence: Synthetic oligonucleotide
  Target: ATXN1; (+) strand; PAM type: NRG; PAM sequence: AGG
taaaaaattaaagtggggcc

SEQ ID NO: 115770 - DNA, 20 bp, Artificial Sequence
  Description of Artificial Sequence: Synthetic oligonucleotide
  Target: ATXN1; (+) strand; PAM type: NRG; PAM sequence: CAG
aattaaagtggggccaggca

SEQ ID NO: 115771 - DNA, 20 bp, Artificial Sequence
  Description of Artificial Sequence: Synthetic oligonucleotide
  Target: ATXN1; (+) strand; PAM type: NRG; PAM sequence: TGG
taaagtggggccaggcacag

SEQ ID NO: 115772 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctgtaatcc

SEQ ID NO: 115773 - DNA, 20 bp, Artificial Sequence
  Description of Artificial Sequence: Synthetic oligonucleotide
  Target: ATXN1; (+) strand; PAM type: NRG; PAM sequence: TGG
gcctgtaatcccagcacttt

SEQ ID NO: 115774 - DNA, 20 bp, Artificial Sequence
  Description of Artificial Sequence: Synthetic oligonucleotide
  Target: ATXN1; (+) strand; PAM type: NRG; PAM sequence: GGG
cctgtaatcccagcactttt

SEQ ID NO: 115775 - DNA, 20 bp, Artificial Sequence
  Description of Artificial Sequence: Synthetic oligonucleotide
  Target: ATXN1; (+) strand; PAM type: NRG; PAM sequence: GAG
tgtaatcccagcacttttgg

SEQ ID NO: 115776 - DNA, 20 bp, Artificial Sequence
  Description of Artificial Sequence: Synthetic oligonucleotide
  Target: ATXN1; (+) strand; PAM type: NRG; PAM sequence: AGG
gtaatcccagcacttttggg

SEQ ID NO: 115777 - DNA, 20 bp, Artificial Sequence
  Description of Artificial Sequence: Synthetic oligonucleotide
  Target: ATXN1; (+) strand; PAM type: NRG; PAM sequence: AAG
ccagcacttttgggaggctg

SEQ ID NO: 115778 - DNA, 20 bp, Artificial Sequence
  Description of Artificial Sequence: Synthetic oligonucleotide
  Target: ATXN1; (+) strand; PAM type: NRG; PAM sequence: TGG
gcacttttgggaggctgaag

SEQ ID NO: 115779 - DNA, 20 bp, Artificial Sequence
  Description of Artificial Sequence: Synthetic oligonucleotide
  Target: ATXN1; (+) strand; PAM type: NRG; PAM sequence: GGG
cacttttgggaggctgaagt

SEQ ID NO: 115780 - DNA, 20 bp, Artificial Sequence
  Description of Artificial Sequence: Synthetic oligonucleotide
  Target: ATXN1; (+) strand; PAM type: NRG; PAM sequence: CAG
ttttgggaggctgaagtggg

SEQ ID NO: 115781 - DNA, 20 bp, Artificial Sequence
  Description of Artificial Sequence: Synthetic oligonucleotide
  Target: ATXN1; (+) strand; PAM type: NRG; PAM sequence: GAG
ctgaagtgggcagatcatct

SEQ ID NO: 115782 - DNA, 20 bp, Artificial Sequence
  Description of Artificial Sequence: Synthetic oligonucleotide
  Target: ATXN1; (+) strand; PAM type: NRG; PAM sequence: AGG
tgaagtgggcagatcatctg

SEQ ID NO: 115783 - DNA, 20 bp, Artificial Sequence
  Description of Artificial Sequence: Synthetic oligonucleotide
  Target: ATXN1; (+) strand; PAM type: NRG; PAM sequence: CGG
gtgggcagatcatctgaggt

SEQ ID NO: 115784 - DNA, 20 bp, Artificial Sequence
  Description of Artificial Sequence: Synthetic oligonucleotide
  Target: ATXN1; (+) strand; PAM type: NRG; PAM sequence: AAG
ggcagatcatctgaggtcgg

SEQ ID NO: 115785 - DNA, 20 bp, Artificial Sequence
  Description of Artificial Sequence: Synthetic oligonucleotide
  Target: ATXN1; (+) strand; PAM type: NRG; PAM sequence: GAG
tcatctgaggtcggaagttc

SEQ ID NO: 115786 - DNA, 20 bp, Artificial Sequence
  Description of Artificial Sequence: Synthetic oligonucleotide
  Target: ATXN1; (+) strand; PAM type: NRG; PAM sequence: CAG
tgaggtcggaagttcgagac

SEQ ID NO: 115787 - DNA, 20 bp, Artificial Sequence
  Description of Artificial Sequence: Synthetic oligonucleotide
  Target: ATXN1; (+) strand; PAM type: NRG; PAM sequence: TGG
tcggaagttcgagaccagcc

SEQ ID NO: 115788 - DNA, 20 bp, Artificial Sequence
  Description of Artificial Sequence: Synthetic oligonucleotide
  Target: ATXN1; (+) strand; PAM type: NRG; PAM sequence: GGG
cggaagttcgagaccagcct

SEQ ID NO: 115789 - DNA, 20 bp, Artificial Sequence
  Description of Artificial Sequence: Synthetic oligonucleotide
  Target: ATXN1; (+) strand; PAM type: NRG; PAM sequence: TGG
cgagaccagcctgggcaaca

SEQ ID NO: 115790 - DNA, 20 bp, Artificial Sequence
  Description of Artificial Sequence: Synthetic oligonucleotide
  Target: ATXN1; (+) strand; PAM type: NRG; PAM sequence: TAG
tttaccaaaaatacaaaaat

SEQ ID NO: 115791 - DNA, 20 bp, Artificial Sequence
  Description of Artificial Sequence: Synthetic oligonucleotide
  Target: ATXN1; (+) strand; PAM type: NRG; PAM sequence: AGG
ttaccaaaaatacaaaaatt

SEQ ID NO: 115792 - DNA, 20 bp, Artificial Sequence
  Description of Artificial Sequence: Synthetic oligonucleotide
  Target: ATXN1; (+) strand; PAM type: NRG; PAM sequence: TGG
ccaaaaatacaaaaattagg

SEQ ID NO: 115793 - DNA, 20 bp, Artificial Sequence
  Description of Artificial Sequence: Synthetic oligonucleotide
  Target: ATXN1; (+) strand; PAM type: NRG; PAM sequence: GGG
caaaaatacaaaaattaggt

SEQ ID NO: 115794 - DNA, 20 bp, Artificial Sequence
  Description of Artificial Sequence: Synthetic oligonucleotide
  Target: ATXN1; (+) strand; PAM type: NRG; PAM sequence: TGG
caaaaattaggtgggtgtga

SEQ ID NO: 115795 - DNA, 20 bp, Artificial Sequence
  Description of Artificial Sequence: Synthetic oligonucleotide
  Target: ATXN1; (+) strand; PAM type: NRG; PAM sequence: TAG
aaattaggtgggtgtgatgg

SEQ ID NO: 115796 - DNA, 20 bp, Artificial Sequence
  Description of Artificial Sequence: Synthetic oligonucleotide
  Target: ATXN1; (+) strand; PAM type: NRG; PAM sequence: AGG
aattaggtgggtgtgatggt

SEQ ID NO: 115797 - DNA, 20 bp, Artificial Sequence
  Description of Artificial Sequence: Synthetic oligonucleotide
  Target: ATXN1; (+) strand; PAM type: NRG; PAM sequence: CAG
atggtaggcacctgtaatcc

SEQ ID NO: 115798 - DNA, 20 bp, Artificial Sequence
  Description of Artificial Sequence: Synthetic oligonucleotide
  Target: ATXN1; (+) strand; PAM type: NRG; PAM sequence: CGG
cacctgtaatcccagctact

SEQ ID NO: 115799 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccagctactc

SEQ ID NO: 115800 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctactcgg

SEQ ID NO: 115801 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctactcggg

SEQ ID NO: 115802 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcgggaggct

SEQ ID NO: 115803 - DNA, 20 bp, Artificial Sequence
  Description of Artificial Sequence: Synthetic oligonucleotide
  Target: ATXN1; (+) strand; PAM type: NRG; PAM sequence: AGG
cccagctactcgggaggctg

SEQ ID NO: 115804 - DNA, 20 bp, Artificial Sequence
  Description of Artificial Sequence: Synthetic oligonucleotide
  Target: ATXN1; (+) strand; PAM type: NRG; PAM sequence: CAG
agctactcgggaggctgagg

SEQ ID NO: 115805 - DNA, 20 bp, Artificial Sequence
  Description of Artificial Sequence: Synthetic oligonucleotide
  Target: ATXN1; (+) strand; PAM type: NRG; PAM sequence: AGG
gctactcgggaggctgaggc

SEQ ID NO: 115806 - DNA, 20 bp, Artificial Sequence
  Description of Artificial Sequence: Synthetic oligonucleotide
  Target: ATXN1; (+) strand; PAM type: NRG; PAM sequence: GAG
tactcgggaggctgaggcag

SEQ ID NO: 115807 - DNA, 20 bp, Artificial Sequence
  Description of Artificial Sequence: Synthetic oligonucleotide
  Target: ATXN1; (+) strand; PAM type: NRG; PAM sequence: CGG
gcaggagaatcacttgaacc

SEQ ID NO: 115808 - DNA, 20 bp, Artificial Sequence
  Description of Artificial Sequence: Synthetic oligonucleotide
  Target: ATXN1; (+) strand; PAM type: NRG; PAM sequence: GGG
caggagaatcacttgaaccc

SEQ ID NO: 115809 - DNA, 20 bp, Artificial Sequence
  Description of Artificial Sequence: Synthetic oligonucleotide
  Target: ATXN1; (+) strand; PAM type: NRG; PAM sequence: GAG
ggagaatcacttgaacccgg

SEQ ID NO: 115810 - DNA, 20 bp, Artificial Sequence
  Description of Artificial Sequence: Synthetic oligonucleotide
  Target: ATXN1; (+) strand; PAM type: NRG; PAM sequence: AGG
gagaatcacttgaacccggg

SEQ ID NO: 115811 - DNA, 20 bp, Artificial Sequence
  Description of Artificial Sequence: Synthetic oligonucleotide
  Target: ATXN1; (+) strand; PAM type: NRG; PAM sequence: CGG
aatcacttgaacccgggagg

SEQ ID NO: 115812 - DNA, 20 bp, Artificial Sequence
  Description of Artificial Sequence: Synthetic oligonucleotide
  Target: ATXN1; (+) strand; PAM type: NRG; PAM sequence: GAG
tcacttgaacccgggaggcg

SEQ ID NO: 115813 - DNA, 20 bp, Artificial Sequence
  Description of Artificial Sequence: Synthetic oligonucleotide
  Target: ATXN1; (+) strand; PAM type: NRG; PAM sequence: AGG
cacttgaacccgggaggcgg

SEQ ID NO: 115814 - DNA, 20 bp, Artificial Sequence
  Description of Artificial Sequence: Synthetic oligonucleotide
  Target: ATXN1; (+) strand; PAM type: NRG; PAM sequence: CAG
aacccgggaggcggaggttg

SEQ ID NO: 115815 - DNA, 20 bp, Artificial Sequence
  Description of Artificial Sequence: Synthetic oligonucleotide
  Target: ATXN1; (+) strand; PAM type: NRG; PAM sequence: GAG
cgggaggcggaggttgcagt

SEQ ID NO: 115816 - DNA, 20 bp, Artificial Sequence
  Description of Artificial Sequence: Synthetic oligonucleotide
  Target: ATXN1; (+) strand; PAM type: NRG; PAM sequence: GAG
ggcggaggttgcagtgagct

SEQ ID NO: 115817 - DNA, 20 bp, Artificial Sequence
  Description of Artificial Sequence: Synthetic oligonucleotide
  Target: ATXN1; (+) strand; PAM type: NRG; PAM sequence: CGG
gaggttgcagtgagctgaga

SEQ ID NO: 115818 - DNA, 20 bp, Artificial Sequence
  Description of Artificial Sequence: Synthetic oligonucleotide
  Target: ATXN1; (+) strand; PAM type: NRG; PAM sequence: CAG
gagacggtgccattgcactc

SEQ ID NO: 115819 - DNA, 20 bp, Artificial Sequence
  Description of Artificial Sequence: Synthetic oligonucleotide
  Target: ATXN1; (+) strand; PAM type: NRG; PAM sequence: TGG
ggtgccattgcactccagcc

SEQ ID NO: 115820 - DNA, 20 bp, Artificial Sequence
  Description of Artificial Sequence: Synthetic oligonucleotide
  Target: ATXN1; (+) strand; PAM type: NRG; PAM sequence: GGG
gtgccattgcactccagcct

SEQ ID NO: 115821 - DNA, 20 bp, Artificial Sequence
  Description of Artificial Sequence: Synthetic oligonucleotide
  Target: ATXN1; (+) strand; PAM type: NRG; PAM sequence: GGG
tgccattgcactccagcctg

SEQ ID NO: 115822 - DNA, 20 bp, Artificial Sequence
  Description of Artificial Sequence: Synthetic oligonucleotide
  Target: ATXN1; (+) strand; PAM type: NRG; PAM sequence: GGG
gccattgcactccagcctgg

SEQ ID NO: 115823 - DNA, 20 bp, Artificial Sequence
  Description of Artificial Sequence: Synthetic oligonucleotide
  Target: ATXN1; (+) strand; PAM type: NRG; PAM sequence: AAG
tgcactccagcctgggggac

SEQ ID NO: 115824 - DNA, 20 bp, Artificial Sequence
  Description of Artificial Sequence: Synthetic oligonucleotide
  Target: ATXN1; (+) strand; PAM type: NRG; PAM sequence: GAG
cactccagcctgggggacaa

SEQ ID NO: 115825 - DNA, 20 bp, Artificial Sequence
  Description of Artificial Sequence: Synthetic oligonucleotide
  Target: ATXN1; (+) strand; PAM type: NRG; PAM sequence: AAG
ccagcctgggggacaagagc

SEQ ID NO: 115826 - DNA, 20 bp, Artificial Sequence
  Description of Artificial Sequence: Synthetic oligonucleotide
  Target: ATXN1; (+) strand; PAM type: NRG; PAM sequence: AAG
tcaaaaaaaaaaaaaaattg

SEQ ID NO: 115827 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaaaaaaaattgaag

SEQ ID NO: 115828 - DNA, 20 bp, Artificial Sequence
  Description of Artificial Sequence: Synthetic oligonucleotide
  Target: ATXN1; (+) strand; PAM type: NRG; PAM sequence: GGG
aaaaaaaaaaaaattgaagt

SEQ ID NO: 115829 - DNA, 20 bp, Artificial Sequence
  Description of Artificial Sequence: Synthetic oligonucleotide
  Target: ATXN1; (+) strand; PAM type: NRG; PAM sequence: GGG
aaaaaaaaaaaattgaagtg

SEQ ID NO: 115830 - DNA, 20 bp, Artificial Sequence
  Description of Artificial Sequence: Synthetic oligonucleotide
  Target: ATXN1; (+) strand; PAM type: NRG; PAM sequence: CAG
aaaaaaaattgaagtggggc

SEQ ID NO: 115831 - DNA, 20 bp, Artificial Sequence
  Description of Artificial Sequence: Synthetic oligonucleotide
  Target: ATXN1; (+) strand; PAM type: NRG; PAM sequence: AGG
aaaaaaattgaagtggggcc

SEQ ID NO: 115832 - DNA, 20 bp, Artificial Sequence
  Description of Artificial Sequence: Synthetic oligonucleotide
  Target: ATXN1; (+) strand; PAM type: NRG; PAM sequence: CGG
aattgaagtggggccaggtg

SEQ ID NO: 115833 - DNA, 20 bp, Artificial Sequence
  Description of Artificial Sequence: Synthetic oligonucleotide
  Target: ATXN1; (+) strand; PAM type: NRG; PAM sequence: TGG
tgaagtggggccaggtgcgg

SEQ ID NO: 115834 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgtaatcc

SEQ ID NO: 115835 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagcactt

SEQ ID NO: 115836 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 115837 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 115838 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 115839 - DNA, 20 bp, Artificial Sequence
  Description of Artificial Sequence: Synthetic oligonucleotide
  Target: ATXN1; (+) strand; PAM type: NRG; PAM sequence: TGG
agcactttgggaggtctaaa

SEQ ID NO: 115840 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggtctaaat

SEQ ID NO: 115841 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggtctaaatggg

SEQ ID NO: 115842 - DNA, 20 bp, Artificial Sequence
  Description of Artificial Sequence: Synthetic oligonucleotide
  Target: ATXN1; (+) strand; PAM type: NRG; PAM sequence: CAG
atgggtggatcgcttgaacc

SEQ ID NO: 115843 - DNA, 20 bp, Artificial Sequence
  Description of Artificial Sequence: Synthetic oligonucleotide
  Target: ATXN1; (+) strand; PAM type: NRG; PAM sequence: AGG
tgggtggatcgcttgaaccc

SEQ ID NO: 115844 - DNA, 20 bp, Artificial Sequence
  Description of Artificial Sequence: Synthetic oligonucleotide
  Target: ATXN1; (+) strand; PAM type: NRG; PAM sequence: GAG
ggtggatcgcttgaacccag

SEQ ID NO: 115845 - DNA, 20 bp, Artificial Sequence
  Description of Artificial Sequence: Synthetic oligonucleotide
  Target: ATXN1; (+) strand; PAM type: NRG; PAM sequence: CAG
cgcttgaacccaggagtctc

SEQ ID NO: 115846 - DNA, 20 bp, Artificial Sequence
  Description of Artificial Sequence: Synthetic oligonucleotide
  Target: ATXN1; (+) strand; PAM type: NRG; PAM sequence: TGG
gaacccaggagtctccagcc

SEQ ID NO: 115847 - DNA, 20 bp, Artificial Sequence
  Description of Artificial Sequence: Synthetic oligonucleotide
  Target: ATXN1; (+) strand; PAM type: NRG; PAM sequence: GGG
aacccaggagtctccagcct

SEQ ID NO: 115848 - DNA, 20 bp, Artificial Sequence
  Description of Artificial Sequence: Synthetic oligonucleotide
  Target: ATXN1; (+) strand; PAM type: NRG; PAM sequence: TGG
agtctccagcctgggcaaca

SEQ ID NO: 115849 - DNA, 20 bp, Artificial Sequence
  Description of Artificial Sequence: Synthetic oligonucleotide
  Target: ATXN1; (+) strand; PAM type: NRG; PAM sequence: TAG
ctaccaaaaatacaaaaaat

SEQ ID NO: 115850 - DNA, 20 bp, Artificial Sequence
  Description of Artificial Sequence: Synthetic oligonucleotide
  Target: ATXN1; (+) strand; PAM type: NRG; PAM sequence: CAG
caaaaatacaaaaaattagc

SEQ ID NO: 115851 - DNA, 20 bp, Artificial Sequence
  Description of Artificial Sequence: Synthetic oligonucleotide
  Target: ATXN1; (+) strand; PAM type: NRG; PAM sequence: AGG
aaaaatacaaaaaattagcc

SEQ ID NO: 115852 - DNA, 20 bp, Artificial Sequence
  Description of Artificial Sequence: Synthetic oligonucleotide
  Target: ATXN1; (+) strand; PAM type: NRG; PAM sequence: TGG
tacaaaaaattagccaggcg

SEQ ID NO: 115853 - DNA, 20 bp, Artificial Sequence
  Description of Artificial Sequence: Synthetic oligonucleotide
  Target: ATXN1; (+) strand; PAM type: NRG; PAM sequence: TGG
aaaaaattagccaggcgtgg

SEQ ID NO: 115854 - DNA, 20 bp, Artificial Sequence
  Description of Artificial Sequence: Synthetic oligonucleotide
  Target: ATXN1; (+) strand; PAM type: NRG; PAM sequence: CAG
gtggtggcacattcttacca

SEQ ID NO: 115855 - DNA, 20 bp, Artificial Sequence
  Description of Artificial Sequence: Synthetic oligonucleotide
  Target: ATXN1; (+) strand; PAM type: NRG; PAM sequence: GAG
ggtggcacattcttaccaca

SEQ ID NO: 115856 - DNA, 20 bp, Artificial Sequence
  Description of Artificial Sequence: Synthetic oligonucleotide
  Target: ATXN1; (+) strand; PAM type: NRG; PAM sequence: CAG
acagagacatgcccccaaaa

SEQ ID NO: 115857 - DNA, 20 bp, Artificial Sequence
  Description of Artificial Sequence: Synthetic oligonucleotide
  Target: ATXN1; (+) strand; PAM type: NRG; PAM sequence: AAG
tgaaaactttgatatttcaa

SEQ ID NO: 115858 - DNA, 20 bp, Artificial Sequence
  Description of Artificial Sequence: Synthetic oligonucleotide
  Target: ATXN1; (+) strand; PAM type: NRG; PAM sequence: GAG
aaaactttgatatttcaaaa

SEQ ID NO: 115859 - DNA, 20 bp, Artificial Sequence
  Description of Artificial Sequence: Synthetic oligonucleotide
  Target: ATXN1; (+) strand; PAM type: NRG; PAM sequence: AAG
tgatatttcaaaagagctaa

SEQ ID NO: 115860 - DNA, 20 bp, Artificial Sequence
  Description of Artificial Sequence: Synthetic oligonucleotide
  Target: ATXN1; (+) strand; PAM type: NRG; PAM sequence: GAG
caaaagagctaaaagaaaat

SEQ ID NO: 115861 - DNA, 20 bp, Artificial Sequence
  Description of Artificial Sequence: Synthetic oligonucleotide
  Target: ATXN1; (+) strand; PAM type: NRG; PAM sequence: AGG
aaaagagctaaaagaaaatg

SEQ ID NO: 115862 - DNA, 20 bp, Artificial Sequence
  Description of Artificial Sequence: Synthetic oligonucleotide
  Target: ATXN1; (+) strand; PAM type: NRG; PAM sequence: AAG
agagctaaaagaaaatgagg

SEQ ID NO: 115863 - DNA, 20 bp, Artificial Sequence
  Description of Artificial Sequence: Synthetic oligonucleotide
  Target: ATXN1; (+) strand; PAM type: NRG; PAM sequence: AAG
ctaaaagaaaatgaggaagt

SEQ ID NO: 115864 - DNA, 20 bp, Artificial Sequence
  Description of Artificial Sequence: Synthetic oligonucleotide
  Target: ATXN1; (+) strand; PAM type: NRG; PAM sequence: AAG
aaagaaaatgaggaagtaag

SEQ ID NO: 115865 - DNA, 20 bp, Artificial Sequence
  Description of Artificial Sequence: Synthetic oligonucleotide
  Target: ATXN1; (+) strand; PAM type: NRG; PAM sequence: GAG
agaaaatgaggaagtaagaa

SEQ ID NO: 115866 - DNA, 20 bp, Artificial Sequence
  Description of Artificial Sequence: Synthetic oligonucleotide
  Target: ATXN1; (+) strand; PAM type: NRG; PAM sequence: AAG
tgaggaagtaagaagagata

SEQ ID NO: 115867 - DNA, 20 bp, Artificial Sequence
  Description of Artificial Sequence: Synthetic oligonucleotide
  Target: ATXN1; (+) strand; PAM type: NRG; PAM sequence: AGG
gaggaagtaagaagagataa

SEQ ID NO: 115868 - DNA, 20 bp, Artificial Sequence
  Description of Artificial Sequence: Synthetic oligonucleotide
  Target: ATXN1; (+) strand; PAM type: NRG; PAM sequence: CAG
ctaatcccaataaaaacatt

SEQ ID NO: 115869 - DNA, 20 bp, Artificial Sequence
  Description of Artificial Sequence: Synthetic oligonucleotide
  Target: ATXN1; (+) strand; PAM type: NRG; PAM sequence: AAG
aataaaaacattcagaaatg

SEQ ID NO: 115870 - DNA, 20 bp, Artificial Sequence
  Description of Artificial Sequence: Synthetic oligonucleotide
  Target: ATXN1; (+) strand; PAM type: NRG; PAM sequence: TGG
acattcagaaatgaagtgat

SEQ ID NO: 115871 - DNA, 20 bp, Artificial Sequence
  Description of Artificial Sequence: Synthetic oligonucleotide
  Target: ATXN1; (+) strand; PAM type: NRG; PAM sequence: GAG
attcagaaatgaagtgattg

SEQ ID NO: 115872 - DNA, 20 bp, Artificial Sequence
  Description of Artificial Sequence: Synthetic oligonucleotide
  Target: ATXN1; (+) strand; PAM type: NRG; PAM sequence: TAG
aagtgattggagaaaacaaa

SEQ ID NO: 115873 - DNA, 20 bp, Artificial Sequence
  Description of Artificial Sequence: Synthetic oligonucleotide
  Target: ATXN1; (+) strand; PAM type: NRG; PAM sequence: TGG
gattggagaaaacaaatagt

SEQ ID NO: 115874 - DNA, 20 bp, Artificial Sequence
  Description of Artificial Sequence: Synthetic oligonucleotide
  Target: ATXN1; (+) strand; PAM type: NRG; PAM sequence: TAG
ggagaaaacaaatagttgga

SEQ ID NO: 115875 - DNA, 20 bp, Artificial Sequence
  Description of Artificial Sequence: Synthetic oligonucleotide
  Target: ATXN1; (+) strand; PAM type: NRG; PAM sequence: GAG
agaaaacaaatagttggata

SEQ ID NO: 115876 - DNA, 20 bp, Artificial Sequence
  Description of Artificial Sequence: Synthetic oligonucleotide
  Target: ATXN1; (+) strand; PAM type: NRG; PAM sequence: GAG
aaaacaaatagttggataga

SEQ ID NO: 115877 - DNA, 20 bp, Artificial Sequence
  Description of Artificial Sequence: Synthetic oligonucleotide
  Target: ATXN1; (+) strand; PAM type: NRG; PAM sequence: GAG
aacaaatagttggatagaga

SEQ ID NO: 115878 - DNA, 20 bp, Artificial Sequence
  Description of Artificial Sequence: Synthetic oligonucleotide
  Target: ATXN1; (+) strand; PAM type: NRG; PAM sequence: AGG
acaaatagttggatagagag

SEQ ID NO: 115879 - DNA, 20 bp, Artificial Sequence
  Description of Artificial Sequence: Synthetic oligonucleotide
  Target: ATXN1; (+) strand; PAM type: NRG; PAM sequence: AAG
agttggatagagagaggcaa

SEQ ID NO: 115880 - DNA, 20 bp, Artificial Sequence
  Description of Artificial Sequence: Synthetic oligonucleotide
  Target: ATXN1; (+) strand; PAM type: NRG; PAM sequence: TGG
tagagagaggcaaaagaacg

SEQ ID NO: 115881 - DNA, 20 bp, Artificial Sequence
  Description of Artificial Sequence: Synthetic oligonucleotide
  Target: ATXN1; (+) strand; PAM type: NRG; PAM sequence: GGG
agagagaggcaaaagaacgt

SEQ ID NO: 115882 - DNA, 20 bp, Artificial Sequence
  Description of Artificial Sequence: Synthetic oligonucleotide
  Target: ATXN1; (+) strand; PAM type: NRG; PAM sequence: AAG
agaggcaaaagaacgtggga

SEQ ID NO: 115883 - DNA, 20 bp, Artificial Sequence
  Description of Artificial Sequence: Synthetic oligonucleotide
  Target: ATXN1; (+) strand; PAM type: NRG; PAM sequence: AAG
agaacgtgggaaagaatttg

SEQ ID NO: 115884 - DNA, 20 bp, Artificial Sequence
  Description of Artificial Sequence: Synthetic oligonucleotide
  Target: ATXN1; (+) strand; PAM type: NRG; PAM sequence: AAG
tgggaaagaatttgaagtaa

SEQ ID NO: 115885 - DNA, 20 bp, Artificial Sequence
  Description of Artificial Sequence: Synthetic oligonucleotide
  Target: ATXN1; (+) strand; PAM type: NRG; PAM sequence: TAG
aaaaaaaaaaaaccattttc

SEQ ID NO: 115886 - DNA, 20 bp, Artificial Sequence
  Description of Artificial Sequence: Synthetic oligonucleotide
  Target: ATXN1; (+) strand; PAM type: NRG; PAM sequence: AAG
aaaaaaccattttctagatg

SEQ ID NO: 115887 - DNA, 20 bp, Artificial Sequence
  Description of Artificial Sequence: Synthetic oligonucleotide
  Target: ATXN1; (+) strand; PAM type: NRG; PAM sequence: AAG
tttctagatgaagaccaaat

SEQ ID NO: 115888 - DNA, 20 bp, Artificial Sequence
  Description of Artificial Sequence: Synthetic oligonucleotide
  Target: ATXN1; (+) strand; PAM type: NRG; PAM sequence: AAG
ctagatgaagaccaaataag

SEQ ID NO: 115889 - DNA, 20 bp, Artificial Sequence
  Description of Artificial Sequence: Synthetic oligonucleotide
  Target: ATXN1; (+) strand; PAM type: NRG; PAM sequence: AGG
tagatgaagaccaaataaga

SEQ ID NO: 115890 - DNA, 20 bp, Artificial Sequence
  Description of Artificial Sequence: Synthetic oligonucleotide
  Target: ATXN1; (+) strand; PAM type: NRG; PAM sequence: AAG
gaccaaataagaaggaacac

SEQ ID NO: 115891 - DNA, 20 bp, Artificial Sequence
  Description of Artificial Sequence: Synthetic oligonucleotide
  Target: ATXN1; (+) strand; PAM type: NRG; PAM sequence: GAG
ccaaataagaaggaacacaa

SEQ ID NO: 115892 - DNA, 20 bp, Artificial Sequence
  Description of Artificial Sequence: Synthetic oligonucleotide
  Target: ATXN1; (+) strand; PAM type: NRG; PAM sequence: AGG
caaataagaaggaacacaag

SEQ ID NO: 115893 - DNA, 20 bp, Artificial Sequence
  Description of Artificial Sequence: Synthetic oligonucleotide
  Target: ATXN1; (+) strand; PAM type: NRG; PAM sequence: GGG
aaataagaaggaacacaaga

SEQ ID NO: 115894 - DNA, 20 bp, Artificial Sequence
  Description of Artificial Sequence: Synthetic oligonucleotide
  Target: ATXN1; (+) strand; PAM type: NRG; PAM sequence: TAG
ggaatacatacatacacctt

SEQ ID NO: 115895 - DNA, 20 bp, Artificial Sequence
  Description of Artificial Sequence: Synthetic oligonucleotide
  Target: ATXN1; (+) strand; PAM type: NRG; PAM sequence: CAG
catacatacacctttagtcc

SEQ ID NO: 115896 - DNA, 20 bp, Artificial Sequence
  Description of Artificial Sequence: Synthetic oligonucleotide
  Target: ATXN1; (+) strand; PAM type: NRG; PAM sequence: TGG
cacctttagtcccagctact

SEQ ID NO: 115897 - DNA, 20 bp, Artificial Sequence
  Description of Artificial Sequence: Synthetic oligonucleotide
  Target: ATXN1; (+) strand; PAM type: NRG; PAM sequence: GGG
acctttagtcccagctactt

SEQ ID NO: 115898 - DNA, 20 bp, Artificial Sequence
  Description of Artificial Sequence: Synthetic oligonucleotide
  Target: ATXN1; (+) strand; PAM type: NRG; PAM sequence: GAG
ctttagtcccagctacttgg

SEQ ID NO: 115899 - DNA, 20 bp, Artificial Sequence
  Description of Artificial Sequence: Synthetic oligonucleotide
  Target: ATXN1; (+) strand; PAM type: NRG; PAM sequence: AGG
tttagtcccagctacttggg

SEQ ID NO: 115900 - DNA, 20 bp, Artificial Sequence
  Description of Artificial Sequence: Synthetic oligonucleotide
  Target: ATXN1; (+) strand; PAM type: NRG; PAM sequence: AAG
tcccagctacttgggaggct

SEQ ID NO: 115901 - DNA, 20 bp, Artificial Sequence
  Description of Artificial Sequence: Synthetic oligonucleotide
  Target: ATXN1; (+) strand; PAM type: NRG; PAM sequence: AGG
cccagctacttgggaggcta

SEQ ID NO: 115902 - DNA, 20 bp, Artificial Sequence
  Description of Artificial Sequence: Synthetic oligonucleotide
  Target: ATXN1; (+) strand; PAM type: NRG; PAM sequence: TGG
agctacttgggaggctaagg

SEQ ID NO: 115903 - DNA, 20 bp, Artificial Sequence
  Description of Artificial Sequence: Synthetic oligonucleotide
  Target: ATXN1; (+) strand; PAM type: NRG; PAM sequence: GGG
gctacttgggaggctaaggt

SEQ ID NO: 115904 - DNA, 20 bp, Artificial Sequence
  Description of Artificial Sequence: Synthetic oligonucleotide
  Target: ATXN1; (+) strand; PAM type: NRG; PAM sequence: CAG
gtgggatgattgcttgaacc

SEQ ID NO: 115905 - DNA, 20 bp, Artificial Sequence
  Description of Artificial Sequence: Synthetic oligonucleotide
  Target: ATXN1; (+) strand; PAM type: NRG; PAM sequence: AGG
tgggatgattgcttgaaccc

SEQ ID NO: 115906 - DNA, 20 bp, Artificial Sequence
  Description of Artificial Sequence: Synthetic oligonucleotide
  Target: ATXN1; (+) strand; PAM type: NRG; PAM sequence: GAG
ggatgattgcttgaacccag

SEQ ID NO: 115907 - DNA, 20 bp, Artificial Sequence
  Description of Artificial Sequence: Synthetic oligonucleotide
  Target: ATXN1; (+) strand; PAM type: NRG; PAM sequence: CAG
gattgcttgaacccaggagc

SEQ ID NO: 115908 - DNA, 20 bp, Artificial Sequence
  Description of Artificial Sequence: Synthetic oligonucleotide
  Target: ATXN1; (+) strand; PAM type: NRG; PAM sequence: GAG
ttgcttgaacccaggagcca

SEQ ID NO: 115909 - DNA, 20 bp, Artificial Sequence
  Description of Artificial Sequence: Synthetic oligonucleotide
  Target: ATXN1; (+) strand; PAM type: NRG; PAM sequence: AGG
tgcttgaacccaggagccag

SEQ ID NO: 115910 - DNA, 20 bp, Artificial Sequence
  Description of Artificial Sequence: Synthetic oligonucleotide
  Target: ATXN1; (+) strand; PAM type: NRG; PAM sequence: CAG
aacccaggagccagaggttg

SEQ ID NO: 115911 - DNA, 20 bp, Artificial Sequence
  Description of Artificial Sequence: Synthetic oligonucleotide
  Target: ATXN1; (+) strand; PAM type: NRG; PAM sequence: GAG
caggagccagaggttgcagt

SEQ ID NO: 115912 - DNA, 20 bp, Artificial Sequence
  Description of Artificial Sequence: Synthetic oligonucleotide
  Target: ATXN1; (+) strand; PAM type: NRG; PAM sequence: TAG
gaggttgcagtgagccaaaa

SEQ ID NO: 115913 - DNA, 20 bp, Artificial Sequence
  Description of Artificial Sequence: Synthetic oligonucleotide
  Target: ATXN1; (+) strand; PAM type: NRG; PAM sequence: TGG
agcaccactgcactccaacc

SEQ ID NO: 115914 - DNA, 20 bp, Artificial Sequence
  Description of Artificial Sequence: Synthetic oligonucleotide
  Target: ATXN1; (+) strand; PAM type: NRG; PAM sequence: GGG
gcaccactgcactccaacct

SEQ ID NO: 115915 - DNA, 20 bp, Artificial Sequence
  Description of Artificial Sequence: Synthetic oligonucleotide
  Target: ATXN1; (+) strand; PAM type: NRG; PAM sequence: CAG
ctgcactccaacctgggaaa

SEQ ID NO: 115916 - DNA, 20 bp, Artificial Sequence
  Description of Artificial Sequence: Synthetic oligonucleotide
  Target: ATXN1; (+) strand; PAM type: NRG; PAM sequence: GAG
gcactccaacctgggaaaca

SEQ ID NO: 115917 - DNA, 20 bp, Artificial Sequence
  Description of Artificial Sequence: Synthetic oligonucleotide
  Target: ATXN1; (+) strand; PAM type: NRG; PAM sequence: GAG
tccaacctgggaaacagagt

SEQ ID NO: 115918 - DNA, 20 bp, Artificial Sequence
  Description of Artificial Sequence: Synthetic oligonucleotide
  Target: ATXN1; (+) strand; PAM type: NRG; PAM sequence: AAG
accctgtcttaaaaaaaaaa

SEQ ID NO: 115919 - DNA, 20 bp, Artificial Sequence
  Description of Artificial Sequence: Synthetic oligonucleotide
  Target: ATXN1; (+) strand; PAM type: NRG; PAM sequence: AAG
gtcttaaaaaaaaaaaagaa

SEQ ID NO: 115920 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaagaaaagaa

SEQ ID NO: 115921 - DNA, 20 bp, Artificial Sequence
  Description of Artificial Sequence: Synthetic oligonucleotide
  Target: ATXN1; (+) strand; PAM type: NRG; PAM sequence: AAG
gaaaagaaaagaaaaaatta

SEQ ID NO: 115922 - DNA, 20 bp, Artificial Sequence
  Description of Artificial Sequence: Synthetic oligonucleotide
  Target: ATXN1; (+) strand; PAM type: NRG; PAM sequence: CGG
aagaaaagaaaaaattaaag

SEQ ID NO: 115923 - DNA, 20 bp, Artificial Sequence
  Description of Artificial Sequence: Synthetic oligonucleotide
  Target: ATXN1; (+) strand; PAM type: NRG; PAM sequence: GGG
agaaaagaaaaaattaaagc

SEQ ID NO: 115924 - DNA, 20 bp, Artificial Sequence
  Description of Artificial Sequence: Synthetic oligonucleotide
  Target: ATXN1; (+) strand; PAM type: NRG; PAM sequence: CAG
aaaaaattaaagcgggaatt

SEQ ID NO: 115925 - DNA, 20 bp, Artificial Sequence
  Description of Artificial Sequence: Synthetic oligonucleotide
  Target: ATXN1; (+) strand; PAM type: NRG; PAM sequence: AGG
aaaaattaaagcgggaattc

SEQ ID NO: 115926 - DNA, 20 bp, Artificial Sequence
  Description of Artificial Sequence: Synthetic oligonucleotide
  Target: ATXN1; (+) strand; PAM type: NRG; PAM sequence: GGG
aaaattaaagcgggaattca

SEQ ID NO: 115927 - DNA, 20 bp, Artificial Sequence
  Description of Artificial Sequence: Synthetic oligonucleotide
  Target: ATXN1; (+) strand; PAM type: NRG; PAM sequence: AAG
attaaagcgggaattcaggg

SEQ ID NO: 115928 - DNA, 20 bp, Artificial Sequence
  Description of Artificial Sequence: Synthetic oligonucleotide
  Target: ATXN1; (+) strand; PAM type: NRG; PAM sequence: TGG
cgggaattcagggaagatga

SEQ ID NO: 115929 - DNA, 20 bp, Artificial Sequence
  Description of Artificial Sequence: Synthetic oligonucleotide
  Target: ATXN1; (+) strand; PAM type: NRG; PAM sequence: CAG
ttcagggaagatgatggcac

SEQ ID NO: 115930 - DNA, 20 bp, Artificial Sequence
  Description of Artificial Sequence: Synthetic oligonucleotide
  Target: ATXN1; (+) strand; PAM type: NRG; PAM sequence: AAG
agatgatggcaccagtgtca

SEQ ID NO: 115931 - DNA, 20 bp, Artificial Sequence
  Description of Artificial Sequence: Synthetic oligonucleotide
  Target: ATXN1; (+) strand; PAM type: NRG; PAM sequence: AGG
gatgatggcaccagtgtcaa

SEQ ID NO: 115932 - DNA, 20 bp, Artificial Sequence
  Description of Artificial Sequence: Synthetic oligonucleotide
  Target: ATXN1; (+) strand; PAM type: NRG; PAM sequence: TAG
gatggcaccagtgtcaaagg

SEQ ID NO: 115933 - DNA, 20 bp, Artificial Sequence
  Description of Artificial Sequence: Synthetic oligonucleotide
  Target: ATXN1; (+) strand; PAM type: NRG; PAM sequence: CAG
caccagtgtcaaaggtagca

SEQ ID NO: 115934 - DNA, 20 bp, Artificial Sequence
  Description of Artificial Sequence: Synthetic oligonucleotide
  Target: ATXN1; (+) strand; PAM type: NRG; PAM sequence: CAG
cacagtttaaaaaaattttt

SEQ ID NO: 115935 - DNA, 20 bp, Artificial Sequence
  Description of Artificial Sequence: Synthetic oligonucleotide
  Target: ATXN1; (+) strand; PAM type: NRG; PAM sequence: CAG
cctgccctcctcctccctgc

SEQ ID NO: 115936 - DNA, 20 bp, Artificial Sequence
  Description of Artificial Sequence: Synthetic oligonucleotide
  Target: ATXN1; (+) strand; PAM type: NRG; PAM sequence: TAG
ctcctccctgccagtaacaa

SEQ ID NO: 115937 - DNA, 20 bp, Artificial Sequence
  Description of Artificial Sequence: Synthetic oligonucleotide
  Target: ATXN1; (+) strand; PAM type: NRG; PAM sequence: CAG
agcaatgataacaacaaaaa

SEQ ID NO: 115938 - DNA, 20 bp, Artificial Sequence
  Description of Artificial Sequence: Synthetic oligonucleotide
  Target: ATXN1; (+) strand; PAM type: NRG; PAM sequence: GAG
caatgataacaacaaaaaca

SEQ ID NO: 115939 - DNA, 20 bp, Artificial Sequence
  Description of Artificial Sequence: Synthetic oligonucleotide
  Target: ATXN1; (+) strand; PAM type: NRG; PAM sequence: TGG
aacaacaaaaacagagaaat

SEQ ID NO: 115940 - DNA, 20 bp, Artificial Sequence
  Description of Artificial Sequence: Synthetic oligonucleotide
  Target: ATXN1; (+) strand; PAM type: NRG; PAM sequence: CAG
acagagaaattggaattaca

SEQ ID NO: 115941 - DNA, 20 bp, Artificial Sequence
  Description of Artificial Sequence: Synthetic oligonucleotide
  Target: ATXN1; (+) strand; PAM type: NRG; PAM sequence: TGG
attacacagccaaaaaccca

SEQ ID NO: 115942 - DNA, 20 bp, Artificial Sequence
  Description of Artificial Sequence: Synthetic oligonucleotide
  Target: ATXN1; (+) strand; PAM type: NRG; PAM sequence: AAG
aaaaacccatggaccacatc

SEQ ID NO: 115943 - DNA, 20 bp, Artificial Sequence
  Description of Artificial Sequence: Synthetic oligonucleotide
  Target: ATXN1; (+) strand; PAM type: NRG; PAM sequence: GAG
ggaccacatcaagacaaaat

SEQ ID NO: 115944 - DNA, 20 bp, Artificial Sequence
  Description of Artificial Sequence: Synthetic oligonucleotide
  Target: ATXN1; (+) strand; PAM type: NRG; PAM sequence: AGG
gaccacatcaagacaaaatg

SEQ ID NO: 115945 - DNA, 20 bp, Artificial Sequence
  Description of Artificial Sequence: Synthetic oligonucleotide
  Target: ATXN1; (+) strand; PAM type: NRG; PAM sequence: TAG
gacaaaatgaggttactgtg

SEQ ID NO: 115946 - DNA, 20 bp, Artificial Sequence
  Description of Artificial Sequence: Synthetic oligonucleotide
  Target: ATXN1; (+) strand; PAM type: NRG; PAM sequence: AAG
ctgtgtagtccataaacctg

SEQ ID NO: 115947 - DNA, 20 bp, Artificial Sequence
  Description of Artificial Sequence: Synthetic oligonucleotide
  Target: ATXN1; (+) strand; PAM type: NRG; PAM sequence: CAG
gtagtccataaacctgaaga

SEQ ID NO: 115948 - DNA, 20 bp, Artificial Sequence
  Description of Artificial Sequence: Synthetic oligonucleotide
  Target: ATXN1; (+) strand; PAM type: NRG; PAM sequence: AGG
tagtccataaacctgaagac

SEQ ID NO: 115949 - DNA, 20 bp, Artificial Sequence
  Description of Artificial Sequence: Synthetic oligonucleotide
  Target: ATXN1; (+) strand; PAM type: NRG; PAM sequence: TGG
cataaacctgaagacaggaa

SEQ ID NO: 115950 - DNA, 20 bp, Artificial Sequence
  Description of Artificial Sequence: Synthetic oligonucleotide
  Target: ATXN1; (+) strand; PAM type: NRG; PAM sequence: GGG
ataaacctgaagacaggaat

SEQ ID NO: 115951 - DNA, 20 bp, Artificial Sequence
  Description of Artificial Sequence: Synthetic oligonucleotide
  Target: ATXN1; (+) strand; PAM type: NRG; PAM sequence: TGG
cctgaagacaggaatgggtg

SEQ ID NO: 115952 - DNA, 20 bp, Artificial Sequence
  Description of Artificial Sequence: Synthetic oligonucleotide
  Target: ATXN1; (+) strand; PAM type: NRG; PAM sequence: TAG
gggtgtggccgaaccattta

SEQ ID NO: 115953 - DNA, 20 bp, Artificial Sequence
  Description of Artificial Sequence: Synthetic oligonucleotide
  Target: ATXN1; (+) strand; PAM type: NRG; PAM sequence: CAG
ggccgaaccatttatagtga

SEQ ID NO: 115954 - DNA, 20 bp, Artificial Sequence
  Description of Artificial Sequence: Synthetic oligonucleotide
  Target: ATXN1; (+) strand; PAM type: NRG; PAM sequence: GAG
ccgaaccatttatagtgaca

SEQ ID NO: 115955 - DNA, 20 bp, Artificial Sequence
  Description of Artificial Sequence: Synthetic oligonucleotide
  Target: ATXN1; (+) strand; PAM type: NRG; PAM sequence: CAG
accatttatagtgacagagc

SEQ ID NO: 115956 - DNA, 20 bp, Artificial Sequence
  Description of Artificial Sequence: Synthetic oligonucleotide
  Target: ATXN1; (+) strand; PAM type: NRG; PAM sequence: AGG
ccatttatagtgacagagcc

SEQ ID NO: 115957 - DNA, 20 bp, Artificial Sequence
  Description of Artificial Sequence: Synthetic oligonucleotide
  Target: ATXN1; (+) strand; PAM type: NRG; PAM sequence: CAG
tttatagtgacagagccagg

SEQ ID NO: 115958 - DNA, 20 bp, Artificial Sequence
  Description of Artificial Sequence: Synthetic oligonucleotide
  Target: ATXN1; (+) strand; PAM type: NRG; PAM sequence: AAG
atagtgacagagccaggcag

SEQ ID NO: 115959 - DNA, 20 bp, Artificial Sequence
  Description of Artificial Sequence: Synthetic oligonucleotide
  Target: ATXN1; (+) strand; PAM type: NRG; PAM sequence: AAG
ggcagaagcaatatctgtgc

SEQ ID NO: 115960 - DNA, 20 bp, Artificial Sequence
  Description of Artificial Sequence: Synthetic oligonucleotide
  Target: ATXN1; (+) strand; PAM type: NRG; PAM sequence: GAG
cagaagcaatatctgtgcaa

SEQ ID NO: 115961 - DNA, 20 bp, Artificial Sequence
  Description of Artificial Sequence: Synthetic oligonucleotide
  Target: ATXN1; (+) strand; PAM type: NRG; PAM sequence: AAG
agcaatatctgtgcaagaga

SEQ ID NO: 115962 - DNA, 20 bp, Artificial Sequence
  Description of Artificial Sequence: Synthetic oligonucleotide
  Target: ATXN1; (+) strand; PAM type: NRG; PAM sequence: TGG
atatctgtgcaagagaaagt

SEQ ID NO: 115963 - DNA, 20 bp, Artificial Sequence
  Description of Artificial Sequence: Synthetic oligonucleotide
  Target: ATXN1; (+) strand; PAM type: NRG; PAM sequence: GAG
atctgtgcaagagaaagttg

SEQ ID NO: 115964 - DNA, 20 bp, Artificial Sequence
  Description of Artificial Sequence: Synthetic oligonucleotide
  Target: ATXN1; (+) strand; PAM type: NRG; PAM sequence: AGG
tctgtgcaagagaaagttgg

SEQ ID NO: 115965 - DNA, 20 bp, Artificial Sequence
  Description of Artificial Sequence: Synthetic oligonucleotide
  Target: ATXN1; (+) strand; PAM type: NRG; PAM sequence: GAG
tgtgcaagagaaagttggag

SEQ ID NO: 115966 - DNA, 20 bp, Artificial Sequence
  Description of Artificial Sequence: Synthetic oligonucleotide
  Target: ATXN1; (+) strand; PAM type: NRG; PAM sequence: GAG
tgcaagagaaagttggagga

SEQ ID NO: 115967 - DNA, 20 bp, Artificial Sequence
  Description of Artificial Sequence: Synthetic oligonucleotide
  Target: ATXN1; (+) strand; PAM type: NRG; PAM sequence: AGG
gcaagagaaagttggaggag

SEQ ID NO: 115968 - DNA, 20 bp, Artificial Sequence
  Description of Artificial Sequence: Synthetic oligonucleotide
  Target: ATXN1; (+) strand; PAM type: NRG; PAM sequence: CAG
agagaaagttggaggagagg

SEQ ID NO: 115969 - DNA, 20 bp, Artificial Sequence
  Description of Artificial Sequence: Synthetic oligonucleotide
  Target: ATXN1; (+) strand; PAM type: NRG; PAM sequence: TGG
gaaagttggaggagaggcag

SEQ ID NO: 115970 - DNA, 20 bp, Artificial Sequence
  Description of Artificial Sequence: Synthetic oligonucleotide
  Target: ATXN1; (+) strand; PAM type: NRG; PAM sequence: GGG
aaagttggaggagaggcagt

SEQ ID NO: 115971 - DNA, 20 bp, Artificial Sequence
  Description of Artificial Sequence: Synthetic oligonucleotide
  Target: ATXN1; (+) strand; PAM type: NRG; PAM sequence: AAG
ggagaggcagtgggcatctg

SEQ ID NO: 115972 - DNA, 20 bp, Artificial Sequence
  Description of Artificial Sequence: Synthetic oligonucleotide
  Target: ATXN1; (+) strand; PAM type: NRG; PAM sequence: AGG
gagaggcagtgggcatctga

SEQ ID NO: 115973 - DNA, 20 bp, Artificial Sequence
  Description of Artificial Sequence: Synthetic oligonucleotide
  Target: ATXN1; (+) strand; PAM type: NRG; PAM sequence: TGG
cagtgggcatctgaaggttt

SEQ ID NO: 115974 - DNA, 20 bp, Artificial Sequence
  Description of Artificial Sequence: Synthetic oligonucleotide
  Target: ATXN1; (+) strand; PAM type: NRG; PAM sequence: CGG
atctgaaggttttggcacaa

SEQ ID NO: 115975 - DNA, 20 bp, Artificial Sequence
  Description of Artificial Sequence: Synthetic oligonucleotide
  Target: ATXN1; (+) strand; PAM type: NRG; PAM sequence: GGG
tctgaaggttttggcacaac

SEQ ID NO: 115976 - DNA, 20 bp, Artificial Sequence
  Description of Artificial Sequence: Synthetic oligonucleotide
  Target: ATXN1; (+) strand; PAM type: NRG; PAM sequence: AAG
ttttggcacaacgggctccc

SEQ ID NO: 115977 - DNA, 20 bp, Artificial Sequence
  Description of Artificial Sequence: Synthetic oligonucleotide
  Target: ATXN1; (+) strand; PAM type: NRG; PAM sequence: AAG
aacgggctcccaagcttcca

SEQ ID NO: 115978 - DNA, 20 bp, Artificial Sequence
  Description of Artificial Sequence: Synthetic oligonucleotide
  Target: ATXN1; (+) strand; PAM type: NRG; PAM sequence: AGG
acgggctcccaagcttccaa

SEQ ID NO: 115979 - DNA, 20 bp, Artificial Sequence
  Description of Artificial Sequence: Synthetic oligonucleotide
  Target: ATXN1; (+) strand; PAM type: NRG; PAM sequence: CGG
caagcttccaaaggtcctta

SEQ ID NO: 115980 - DNA, 20 bp, Artificial Sequence
  Description of Artificial Sequence: Synthetic oligonucleotide
  Target: ATXN1; (+) strand; PAM type: NRG; PAM sequence: CGG
ttccaaaggtccttacggca

SEQ ID NO: 115981 - DNA, 20 bp, Artificial Sequence
  Description of Artificial Sequence: Synthetic oligonucleotide
  Target: ATXN1; (+) strand; PAM type: NRG; PAM sequence: CAG
aaaggtccttacggcacggt

SEQ ID NO: 115982 - DNA, 20 bp, Artificial Sequence
  Description of Artificial Sequence: Synthetic oligonucleotide
  Target: ATXN1; (+) strand; PAM type: NRG; PAM sequence: CAG
ggtccttacggcacggtcag

SEQ ID NO: 115983 - DNA, 20 bp, Artificial Sequence
  Description of Artificial Sequence: Synthetic oligonucleotide
  Target: ATXN1; (+) strand; PAM type: NRG; PAM sequence: AGG
gtccttacggcacggtcagc

SEQ ID NO: 115984 - DNA, 20 bp, Artificial Sequence
  Description of Artificial Sequence: Synthetic oligonucleotide
  Target: ATXN1; (+) strand; PAM type: NRG; PAM sequence: GGG
tccttacggcacggtcagca

SEQ ID NO: 115985 - DNA, 20 bp, Artificial Sequence
  Description of Artificial Sequence: Synthetic oligonucleotide
  Target: ATXN1; (+) strand; PAM type: NRG; PAM sequence: TGG
ttacggcacggtcagcaggg

SEQ ID NO: 115986 - DNA, 20 bp, Artificial Sequence
  Description of Artificial Sequence: Synthetic oligonucleotide
  Target: ATXN1; (+) strand; PAM type: NRG; PAM sequence: GAG
ggcacggtcagcagggtggt

SEQ ID NO: 115987 - DNA, 20 bp, Artificial Sequence
  Description of Artificial Sequence: Synthetic oligonucleotide
  Target: ATXN1; (+) strand; PAM type: NRG; PAM sequence: GAG
gcagggtggtgagctatttt

SEQ ID NO: 115988 - DNA, 20 bp, Artificial Sequence
  Description of Artificial Sequence: Synthetic oligonucleotide
  Target: ATXN1; (+) strand; PAM type: NRG; PAM sequence: CAG
gtggtgagctattttgagca

SEQ ID NO: 115989 - DNA, 20 bp, Artificial Sequence
  Description of Artificial Sequence: Synthetic oligonucleotide
  Target: ATXN1; (+) strand; PAM type: NRG; PAM sequence: CAG
gtgagctattttgagcacag

SEQ ID NO: 115990 - DNA, 20 bp, Artificial Sequence
  Description of Artificial Sequence: Synthetic oligonucleotide
  Target: ATXN1; (+) strand; PAM type: NRG; PAM sequence: TGG
tttgagcacagcagcatcat

SEQ ID NO: 115991 - DNA, 20 bp, Artificial Sequence
  Description of Artificial Sequence: Synthetic oligonucleotide
  Target: ATXN1; (+) strand; PAM type: NRG; PAM sequence: AAG
agcacagcagcatcattggc

SEQ ID NO: 115992 - DNA, 20 bp, Artificial Sequence
  Description of Artificial Sequence: Synthetic oligonucleotide
  Target: ATXN1; (+) strand; PAM type: NRG; PAM sequence: AGG
gcacagcagcatcattggca

SEQ ID NO: 115993 - DNA, 20 bp, Artificial Sequence
  Description of Artificial Sequence: Synthetic oligonucleotide
  Target: ATXN1; (+) strand; PAM type: NRG; PAM sequence: GGG
cacagcagcatcattggcaa

SEQ ID NO: 115994 - DNA, 20 bp, Artificial Sequence
  Description of Artificial Sequence: Synthetic oligonucleotide
  Target: ATXN1; (+) strand; PAM type: NRG; PAM sequence: GGG
acagcagcatcattggcaag

SEQ ID NO: 115995 - DNA, 20 bp, Artificial Sequence
  Description of Artificial Sequence: Synthetic oligonucleotide
  Target: ATXN1; (+) strand; PAM type: NRG; PAM sequence: CAG
atcattggcaaggggtcctg

SEQ ID NO: 115996 - DNA, 20 bp, Artificial Sequence
  Description of Artificial Sequence: Synthetic oligonucleotide
  Target: ATXN1; (+) strand; PAM type: NRG; PAM sequence: TGG
gtcctgcagaatccaattca

SEQ ID NO: 115997 - DNA, 20 bp, Artificial Sequence
  Description of Artificial Sequence: Synthetic oligonucleotide
  Target: ATXN1; (+) strand; PAM type: NRG; PAM sequence: GGG
tcctgcagaatccaattcat

SEQ ID NO: 115998 - DNA, 20 bp, Artificial Sequence
  Description of Artificial Sequence: Synthetic oligonucleotide
  Target: ATXN1; (+) strand; PAM type: NRG; PAM sequence: GGG
cctgcagaatccaattcatg

SEQ ID NO: 115999 - DNA, 20 bp, Artificial Sequence
  Description of Artificial Sequence: Synthetic oligonucleotide
  Target: ATXN1; (+) strand; PAM type: NRG; PAM sequence: GAG
cagaatccaattcatggggt

SEQ ID NO: 116000 - DNA, 20 bp, Artificial Sequence
  Description of Artificial Sequence: Synthetic oligonucleotide
  Target: ATXN1; (+) strand; PAM type: NRG; PAM sequence: AGG
agaatccaattcatggggtg

SEQ ID NO: 116001 - DNA, 20 bp, Artificial Sequence
  Description of Artificial Sequence: Synthetic oligonucleotide
  Target: ATXN1; (+) strand; PAM type: NRG; PAM sequence: GGG
gaatccaattcatggggtga

SEQ ID NO: 116002 - DNA, 20 bp, Artificial Sequence
  Description of Artificial Sequence: Synthetic oligonucleotide
  Target: ATXN1; (+) strand; PAM type: NRG; PAM sequence: AAG
ccaattcatggggtgagggc

SEQ ID NO: 116003 - DNA, 20 bp, Artificial Sequence
  Description of Artificial Sequence: Synthetic oligonucleotide
  Target: ATXN1; (+) strand; PAM type: NRG; PAM sequence: AGG
caattcatggggtgagggca

SEQ ID NO: 116004 - DNA, 20 bp, Artificial Sequence
  Description of Artificial Sequence: Synthetic oligonucleotide
  Target: ATXN1; (+) strand; PAM type: NRG; PAM sequence: TGG
ggggtgagggcaaggaaccc

SEQ ID NO: 116005 - DNA, 20 bp, Artificial Sequence
  Description of Artificial Sequence: Synthetic oligonucleotide
  Target: ATXN1; (+) strand; PAM type: NRG; PAM sequence: GGG
gggtgagggcaaggaaccct

SEQ ID NO: 116006 - DNA, 20 bp, Artificial Sequence
  Description of Artificial Sequence: Synthetic oligonucleotide
  Target: ATXN1; (+) strand; PAM type: NRG; PAM sequence: AAG
tgagggcaaggaaccctggg

SEQ ID NO: 116007 - DNA, 20 bp, Artificial Sequence
  Description of Artificial Sequence: Synthetic oligonucleotide
  Target: ATXN1; (+) strand; PAM type: NRG; PAM sequence: AGG
gagggcaaggaaccctggga

SEQ ID NO: 116008 - DNA, 20 bp, Artificial Sequence
  Description of Artificial Sequence: Synthetic oligonucleotide
  Target: ATXN1; (+) strand; PAM type: NRG; PAM sequence: GAG
aaggaaccctgggaaggtct

SEQ ID NO: 116009 - DNA, 20 bp, Artificial Sequence
  Description of Artificial Sequence: Synthetic oligonucleotide
  Target: ATXN1; (+) strand; PAM type: NRG; PAM sequence: AGG
aggaaccctgggaaggtctg

SEQ ID NO: 116010 - DNA, 20 bp, Artificial Sequence
  Description of Artificial Sequence: Synthetic oligonucleotide
  Target: ATXN1; (+) strand; PAM type: NRG; PAM sequence: TAG
ctgggaaggtctgaggtgct

SEQ ID NO: 116011 - DNA, 20 bp, Artificial Sequence
  Description of Artificial Sequence: Synthetic oligonucleotide
  Target: ATXN1; (+) strand; PAM type: NRG; PAM sequence: AGG
tgggaaggtctgaggtgctt

SEQ ID NO: 116012 - DNA, 20 bp, Artificial Sequence
  Description of Artificial Sequence: Synthetic oligonucleotide
  Target: ATXN1; (+) strand; PAM type: NRG; PAM sequence: CGG
tctgaggtgcttaggtgtta

SEQ ID NO: 116013 - DNA, 20 bp, Artificial Sequence
  Description of Artificial Sequence: Synthetic oligonucleotide
  Target: ATXN1; (+) strand; PAM type: NRG; PAM sequence: GAG
tgaggtgcttaggtgttacg

SEQ ID NO: 116014 - DNA, 20 bp, Artificial Sequence
  Description of Artificial Sequence: Synthetic oligonucleotide
  Target: ATXN1; (+) strand; PAM type: NRG; PAM sequence: CAG
gtgcttaggtgttacggagc

SEQ ID NO: 116015 - DNA, 20 bp, Artificial Sequence
  Description of Artificial Sequence: Synthetic oligonucleotide
  Target: ATXN1; (+) strand; PAM type: NRG; PAM sequence: AGG
tgcttaggtgttacggagcc

SEQ ID NO: 116016 - DNA, 20 bp, Artificial Sequence
  Description of Artificial Sequence: Synthetic oligonucleotide
  Target: ATXN1; (+) strand; PAM type: NRG; PAM sequence: GGG
gcttaggtgttacggagcca

SEQ ID NO: 116017 - DNA, 20 bp, Artificial Sequence
  Description of Artificial Sequence: Synthetic oligonucleotide
  Target: ATXN1; (+) strand; PAM type: NRG; PAM sequence: GAG
tacggagccagggcactctt

SEQ ID NO: 116018 - DNA, 20 bp, Artificial Sequence
  Description of Artificial Sequence: Synthetic oligonucleotide
  Target: ATXN1; (+) strand; PAM type: NRG; PAM sequence: AAG
ctcttgagaccaacaaatct

SEQ ID NO: 116019 - DNA, 20 bp, Artificial Sequence
  Description of Artificial Sequence: Synthetic oligonucleotide
  Target: ATXN1; (+) strand; PAM type: NRG; PAM sequence: GAG
ttccacgaccaaatcacctt

SEQ ID NO: 116020 - DNA, 20 bp, Artificial Sequence
  Description of Artificial Sequence: Synthetic oligonucleotide
  Target: ATXN1; (+) strand; PAM type: NRG; PAM sequence: AAG
cacgaccaaatcaccttgag

SEQ ID NO: 116021 - DNA, 20 bp, Artificial Sequence
  Description of Artificial Sequence: Synthetic oligonucleotide
  Target: ATXN1; (+) strand; PAM type: NRG; PAM sequence: GAG
caccttgagaagaaactttt

SEQ ID NO: 116022 - DNA, 20 bp, Artificial Sequence
  Description of Artificial Sequence: Synthetic oligonucleotide
  Target: ATXN1; (+) strand; PAM type: NRG; PAM sequence: GAG
ccttgagaagaaacttttga

SEQ ID NO: 116023 - DNA, 20 bp, Artificial Sequence
  Description of Artificial Sequence: Synthetic oligonucleotide
  Target: ATXN1; (+) strand; PAM type: NRG; PAM sequence: CAG
tgagaagaaacttttgagag

SEQ ID NO: 116024 - DNA, 20 bp, Artificial Sequence
  Description of Artificial Sequence: Synthetic oligonucleotide
  Target: ATXN1; (+) strand; PAM type: NRG; PAM sequence: TGG
agcagaatctaaatcgaaca

SEQ ID NO: 116025 - DNA, 20 bp, Artificial Sequence
  Description of Artificial Sequence: Synthetic oligonucleotide
  Target: ATXN1; (+) strand; PAM type: NRG; PAM sequence: CAG
agaatctaaatcgaacatgg

SEQ ID NO: 116026 - DNA, 20 bp, Artificial Sequence
  Description of Artificial Sequence: Synthetic oligonucleotide
  Target: ATXN1; (+) strand; PAM type: NRG; PAM sequence: TAG
cgaacatggcagtaataatt

SEQ ID NO: 116027 - DNA, 20 bp, Artificial Sequence
  Description of Artificial Sequence: Synthetic oligonucleotide
  Target: ATXN1; (+) strand; PAM type: NRG; PAM sequence: AAG
tggcagtaataatttagcca

SEQ ID NO: 116028 - DNA, 20 bp, Artificial Sequence
  Description of Artificial Sequence: Synthetic oligonucleotide
  Target: ATXN1; (+) strand; PAM type: NRG; PAM sequence: AAG
gtaataatttagccaaagtg

SEQ ID NO: 116029 - DNA, 20 bp, Artificial Sequence
  Description of Artificial Sequence: Synthetic oligonucleotide
  Target: ATXN1; (+) strand; PAM type: NRG; PAM sequence: AGG
taataatttagccaaagtga

SEQ ID NO: 116030 - DNA, 20 bp, Artificial Sequence
  Description of Artificial Sequence: Synthetic oligonucleotide
  Target: ATXN1; (+) strand; PAM type: NRG; PAM sequence: GGG
aataatttagccaaagtgaa

SEQ ID NO: 116031 - DNA, 20 bp, Artificial Sequence
  Description of Artificial Sequence: Synthetic oligonucleotide
  Target: ATXN1; (+) strand; PAM type: NRG; PAM sequence: GAG
taatttagccaaagtgaagg

SEQ ID NO: 116032 - DNA, 20 bp, Artificial Sequence
  Description of Artificial Sequence: Synthetic oligonucleotide
  Target: ATXN1; (+) strand; PAM type: NRG; PAM sequence: AGG
aatttagccaaagtgaaggg

SEQ ID NO: 116033 - DNA, 20 bp, Artificial Sequence
  Description of Artificial Sequence: Synthetic oligonucleotide
  Target: ATXN1; (+) strand; PAM type: NRG; PAM sequence: GGG
atttagccaaagtgaaggga

SEQ ID NO: 116034 - DNA, 20 bp, Artificial Sequence
  Description of Artificial Sequence: Synthetic oligonucleotide
  Target: ATXN1; (+) strand; PAM type: NRG; PAM sequence: GGG
tttagccaaagtgaagggag

SEQ ID NO: 116035 - DNA, 20 bp, Artificial Sequence
  Description of Artificial Sequence: Synthetic oligonucleotide
  Target: ATXN1; (+) strand; PAM type: NRG; PAM sequence: GGG
ttagccaaagtgaagggagg

SEQ ID NO: 116036 - DNA, 20 bp, Artificial Sequence
  Description of Artificial Sequence: Synthetic oligonucleotide
  Target: ATXN1; (+) strand; PAM type: NRG; PAM sequence: CAG
gccaaagtgaagggaggggg

SEQ ID NO: 116037 - DNA, 20 bp, Artificial Sequence
  Description of Artificial Sequence: Synthetic oligonucleotide
  Target: ATXN1; (+) strand; PAM type: NRG; PAM sequence: AAG
tgaagggagggggcagatcc

SEQ ID NO: 116038 - DNA, 20 bp, Artificial Sequence
  Description of Artificial Sequence: Synthetic oligonucleotide
  Target: ATXN1; (+) strand; PAM type: NRG; PAM sequence: AAG
ggagggggcagatccaagtg

SEQ ID NO: 116039 - DNA, 20 bp, Artificial Sequence
  Description of Artificial Sequence: Synthetic oligonucleotide
  Target: ATXN1; (+) strand; PAM type: NRG; PAM sequence: AGG
gagggggcagatccaagtga

SEQ ID NO: 116040 - DNA, 20 bp, Artificial Sequence
  Description of Artificial Sequence: Synthetic oligonucleotide
  Target: ATXN1; (+) strand; PAM type: NRG; PAM sequence: GGG
agggggcagatccaagtgaa

SEQ ID NO: 116041 - DNA, 20 bp, Artificial Sequence
  Description of Artificial Sequence: Synthetic oligonucleotide
  Target: ATXN1; (+) strand; PAM type: NRG; PAM sequence: GAG
ggggcagatccaagtgaagg

SEQ ID NO: 116042 - DNA, 20 bp, Artificial Sequence
  Description of Artificial Sequence: Synthetic oligonucleotide
  Target: ATXN1; (+) strand; PAM type: NRG; PAM sequence: AGG
gggcagatccaagtgaaggg

SEQ ID NO: 116043 - DNA, 20 bp, Artificial Sequence
  Description of Artificial Sequence: Synthetic oligonucleotide
  Target: ATXN1; (+) strand; PAM type: NRG; PAM sequence: CAG
cagatccaagtgaagggagg

SEQ ID NO: 116044 - DNA, 20 bp, Artificial Sequence
  Description of Artificial Sequence: Synthetic oligonucleotide
  Target: ATXN1; (+) strand; PAM type: NRG; PAM sequence: GAG
gatccaagtgaagggaggca

SEQ ID NO: 116045 - DNA, 20 bp, Artificial Sequence
  Description of Artificial Sequence: Synthetic oligonucleotide
  Target: ATXN1; (+) strand; PAM type: NRG; PAM sequence: AAG
ccaagtgaagggaggcagag

SEQ ID NO: 116046 - DNA, 20 bp, Artificial Sequence
  Description of Artificial Sequence: Synthetic oligonucleotide
  Target: ATXN1; (+) strand; PAM type: NRG; PAM sequence: AAG
gaagggaggcagagaagacg

SEQ ID NO: 116047 - DNA, 20 bp, Artificial Sequence
  Description of Artificial Sequence: Synthetic oligonucleotide
  Target: ATXN1; (+) strand; PAM type: NRG; PAM sequence: AAG
gaggcagagaagacgaagct

SEQ ID NO: 116048 - DNA, 20 bp, Artificial Sequence
  Description of Artificial Sequence: Synthetic oligonucleotide
  Target: ATXN1; (+) strand; PAM type: NRG; PAM sequence: TAG
aagacgaagctaagaaaata

SEQ ID NO: 116049 - DNA, 20 bp, Artificial Sequence
  Description of Artificial Sequence: Synthetic oligonucleotide
  Target: ATXN1; (+) strand; PAM type: NRG; PAM sequence: AGG
agacgaagctaagaaaatat

SEQ ID NO: 116050 - DNA, 20 bp, Artificial Sequence
  Description of Artificial Sequence: Synthetic oligonucleotide
  Target: ATXN1; (+) strand; PAM type: NRG; PAM sequence: TGG
ataggccttattttattcca

SEQ ID NO: 116051 - DNA, 20 bp, Artificial Sequence
  Description of Artificial Sequence: Synthetic oligonucleotide
  Target: ATXN1; (+) strand; PAM type: NRG; PAM sequence: CAG
attttattccatggaaacaa

SEQ ID NO: 116052 - DNA, 20 bp, Artificial Sequence
  Description of Artificial Sequence: Synthetic oligonucleotide
  Target: ATXN1; (+) strand; PAM type: NRG; PAM sequence: AAG
ttattccatggaaacaacag

SEQ ID NO: 116053 - DNA, 20 bp, Artificial Sequence
  Description of Artificial Sequence: Synthetic oligonucleotide
  Target: ATXN1; (+) strand; PAM type: NRG; PAM sequence: CGG
tccatggaaacaacagaaga

SEQ ID NO: 116054 - DNA, 20 bp, Artificial Sequence
  Description of Artificial Sequence: Synthetic oligonucleotide
  Target: ATXN1; (+) strand; PAM type: NRG; PAM sequence: GAG
catggaaacaacagaagacg

SEQ ID NO: 116055 - DNA, 20 bp, Artificial Sequence
  Description of Artificial Sequence: Synthetic oligonucleotide
  Target: ATXN1; (+) strand; PAM type: NRG; PAM sequence: TGG
caacagaagacggagttcta

SEQ ID NO: 116056 - DNA, 20 bp, Artificial Sequence
  Description of Artificial Sequence: Synthetic oligonucleotide
  Target: ATXN1; (+) strand; PAM type: NRG; PAM sequence: TAG
gaagacggagttctatggcc

SEQ ID NO: 116057 - DNA, 20 bp, Artificial Sequence
  Description of Artificial Sequence: Synthetic oligonucleotide
  Target: ATXN1; (+) strand; PAM type: NRG; PAM sequence: TAG
gagttctatggcctagacac

SEQ ID NO: 116058 - DNA, 20 bp, Artificial Sequence
  Description of Artificial Sequence: Synthetic oligonucleotide
  Target: ATXN1; (+) strand; PAM type: NRG; PAM sequence: TGG
agacactagaaaatattttc

SEQ ID NO: 116059 - DNA, 20 bp, Artificial Sequence
  Description of Artificial Sequence: Synthetic oligonucleotide
  Target: ATXN1; (+) strand; PAM type: NRG; PAM sequence: AAG
tcccttatccctaaaaatac

SEQ ID NO: 116060 - DNA, 20 bp, Artificial Sequence
  Description of Artificial Sequence: Synthetic oligonucleotide
  Target: ATXN1; (+) strand; PAM type: NRG; PAM sequence: GAG
aactcattccacttaaaaat

SEQ ID NO: 116061 - DNA, 20 bp, Artificial Sequence
  Description of Artificial Sequence: Synthetic oligonucleotide
  Target: ATXN1; (+) strand; PAM type: NRG; PAM sequence: TAG
cttaaaaatgagtaacaaaa

SEQ ID NO: 116062 - DNA, 20 bp, Artificial Sequence
  Description of Artificial Sequence: Synthetic oligonucleotide
  Target: ATXN1; (+) strand; PAM type: NRG; PAM sequence: AGG
ttaaaaatgagtaacaaaat

SEQ ID NO: 116063 - DNA, 20 bp, Artificial Sequence
  Description of Artificial Sequence: Synthetic oligonucleotide
  Target: ATXN1; (+) strand; PAM type: NRG; PAM sequence: TGG
tgagtaacaaaataggattg

SEQ ID NO: 116064 - DNA, 20 bp, Artificial Sequence
  Description of Artificial Sequence: Synthetic oligonucleotide
  Target: ATXN1; (+) strand; PAM type: NRG; PAM sequence: CAG
aataggattgtggtcaaata

SEQ ID NO: 116065 - DNA, 20 bp, Artificial Sequence
  Description of Artificial Sequence: Synthetic oligonucleotide
  Target: ATXN1; (+) strand; PAM type: NRG; PAM sequence: CAG
ttgtggtcaaatacagtgca

SEQ ID NO: 116066 - DNA, 20 bp, Artificial Sequence
  Description of Artificial Sequence: Synthetic oligonucleotide
  Target: ATXN1; (+) strand; PAM type: NRG; PAM sequence: AAG
atacagtgcacagttattat

SEQ ID NO: 116067 - DNA, 20 bp, Artificial Sequence
  Description of Artificial Sequence: Synthetic oligonucleotide
  Target: ATXN1; (+) strand; PAM type: NRG; PAM sequence: AAG
cagtgcacagttattataag

SEQ ID NO: 116068 - DNA, 20 bp, Artificial Sequence
  Description of Artificial Sequence: Synthetic oligonucleotide
  Target: ATXN1; (+) strand; PAM type: NRG; PAM sequence: CAG
gttattataagaagaaaaat

SEQ ID NO: 116069 - DNA, 20 bp, Artificial Sequence
  Description of Artificial Sequence: Synthetic oligonucleotide
  Target: ATXN1; (+) strand; PAM type: NRG; PAM sequence: GAG
tattataagaagaaaaatca

SEQ ID NO: 116070 - DNA, 20 bp, Artificial Sequence
  Description of Artificial Sequence: Synthetic oligonucleotide
  Target: ATXN1; (+) strand; PAM type: NRG; PAM sequence: TAG
tataagaagaaaaatcagag

SEQ ID NO: 116071 - DNA, 20 bp, Artificial Sequence
  Description of Artificial Sequence: Synthetic oligonucleotide
  Target: ATXN1; (+) strand; PAM type: NRG; PAM sequence: CAG
tcagagtagcattcttacca

SEQ ID NO: 116072 - DNA, 20 bp, Artificial Sequence
  Description of Artificial Sequence: Synthetic oligonucleotide
  Target: ATXN1; (+) strand; PAM type: NRG; PAM sequence: GAG
agagtagcattcttaccaca

SEQ ID NO: 116073 - DNA, 20 bp, Artificial Sequence
  Description of Artificial Sequence: Synthetic oligonucleotide
  Target: ATXN1; (+) strand; PAM type: NRG; PAM sequence: CAG
acagagacatgcccccaaaa

SEQ ID NO: 116074 - DNA, 20 bp, Artificial Sequence
  Description of Artificial Sequence: Synthetic oligonucleotide
  Target: ATXN1; (+) strand; PAM type: NRG; PAM sequence: AAG
tgaaaactttaatatttcaa

SEQ ID NO: 116075 - DNA, 20 bp, Artificial Sequence
  Description of Artificial Sequence: Synthetic oligonucleotide
  Target: ATXN1; (+) strand; PAM type: NRG; PAM sequence: GAG
aaaactttaatatttcaaaa

SEQ ID NO: 116076 - DNA, 20 bp, Artificial Sequence
  Description of Artificial Sequence: Synthetic oligonucleotide
  Target: ATXN1; (+) strand; PAM type: NRG; PAM sequence: AAG
taatatttcaaaagagctaa

SEQ ID NO: 116077 - DNA, 20 bp, Artificial Sequence
  Description of Artificial Sequence: Synthetic oligonucleotide
  Target: ATXN1; (+) strand; PAM type: NRG; PAM sequence: GAG
caaaagagctaaaagaaaat

SEQ ID NO: 116078 - DNA, 20 bp, Artificial Sequence
  Description of Artificial Sequence: Synthetic oligonucleotide
  Target: ATXN1; (+) strand; PAM type: NRG; PAM sequence: AGG
aaaagagctaaaagaaaatg

SEQ ID NO: 116079 - DNA, 20 bp, Artificial Sequence
  Description of Artificial Sequence: Synthetic oligonucleotide
  Target: ATXN1; (+) strand; PAM type: NRG; PAM sequence: CAG
agagctaaaagaaaatgagg

SEQ ID NO: 116080 - DNA, 20 bp, Artificial Sequence
  Description of Artificial Sequence: Synthetic oligonucleotide
  Target: ATXN1; (+) strand; PAM type: NRG; PAM sequence: AAG
ctaaaagaaaatgaggcagt

SEQ ID NO: 116081 - DNA, 20 bp, Artificial Sequence
  Description of Artificial Sequence: Synthetic oligonucleotide
  Target: ATXN1; (+) strand; PAM type: NRG; PAM sequence: AAG
aaagaaaatgaggcagtaag

SEQ ID NO: 116082 - DNA, 20 bp, Artificial Sequence
  Description of Artificial Sequence: Synthetic oligonucleotide
  Target: ATXN1; (+) strand; PAM type: NRG; PAM sequence: GAG
agaaaatgaggcagtaagaa

SEQ ID NO: 116083 - DNA, 20 bp, Artificial Sequence
  Description of Artificial Sequence: Synthetic oligonucleotide
  Target: ATXN1; (+) strand; PAM type: NRG; PAM sequence: AAG
tgaggcagtaagaagagata

SEQ ID NO: 116084 - DNA, 20 bp, Artificial Sequence
  Description of Artificial Sequence: Synthetic oligonucleotide
  Target: ATXN1; (+) strand; PAM type: NRG; PAM sequence: AGG
gaggcagtaagaagagataa

SEQ ID NO: 116085 - DNA, 20 bp, Artificial Sequence
  Description of Artificial Sequence: Synthetic oligonucleotide
  Target: ATXN1; (+) strand; PAM type: NRG; PAM sequence: CAG
ctaatcccaataaaaacatt

SEQ ID NO: 116086 - DNA, 20 bp, Artificial Sequence
  Description of Artificial Sequence: Synthetic oligonucleotide
  Target: ATXN1; (+) strand; PAM type: NRG; PAM sequence: AAG
aataaaaacattcagaaatg

SEQ ID NO: 116087 - DNA, 20 bp, Artificial Sequence
  Description of Artificial Sequence: Synthetic oligonucleotide
  Target: ATXN1; (+) strand; PAM type: NRG; PAM sequence: TGG
acattcagaaatgaagtgat

SEQ ID NO: 116088 - DNA, 20 bp, Artificial Sequence
  Description of Artificial Sequence: Synthetic oligonucleotide
  Target: ATXN1; (+) strand; PAM type: NRG; PAM sequence: GAG
attcagaaatgaagtgattg

SEQ ID NO: 116089 - DNA, 20 bp, Artificial Sequence
  Description of Artificial Sequence: Synthetic oligonucleotide
  Target: ATXN1; (+) strand; PAM type: NRG; PAM sequence: AAG
gaaatgaagtgattggagaa

SEQ ID NO: 116090 - DNA, 20 bp, Artificial Sequence
  Description of Artificial Sequence: Synthetic oligonucleotide
  Target: ATXN1; (+) strand; PAM type: NRG; PAM sequence: TAG
aagtgattggagaaaagaaa

SEQ ID NO: 116091 - DNA, 20 bp, Artificial Sequence
  Description of Artificial Sequence: Synthetic oligonucleotide
  Target: ATXN1; (+) strand; PAM type: NRG; PAM sequence: TGG
gattggagaaaagaaatagt

SEQ ID NO: 116092 - DNA, 20 bp, Artificial Sequence
  Description of Artificial Sequence: Synthetic oligonucleotide
  Target: ATXN1; (+) strand; PAM type: NRG; PAM sequence: TAG
ggagaaaagaaatagttgga

SEQ ID NO: 116093 - DNA, 20 bp, Artificial Sequence
  Description of Artificial Sequence: Synthetic oligonucleotide
  Target: ATXN1; (+) strand; PAM type: NRG; PAM sequence: GAG
agaaaagaaatagttggata

SEQ ID NO: 116094 - DNA, 20 bp, Artificial Sequence
  Description of Artificial Sequence: Synthetic oligonucleotide
  Target: ATXN1; (+) strand; PAM type: NRG; PAM sequence: GAG
aaaagaaatagttggataga

SEQ ID NO: 116095 - DNA, 20 bp, Artificial Sequence
  Description of Artificial Sequence: Synthetic oligonucleotide
  Target: ATXN1; (+) strand; PAM type: NRG; PAM sequence: GAG
aagaaatagttggatagaga

SEQ ID NO: 116096 - DNA, 20 bp, Artificial Sequence
  Description of Artificial Sequence: Synthetic oligonucleotide
  Target: ATXN1; (+) strand; PAM type: NRG; PAM sequence: AGG
agaaatagttggatagagag

SEQ ID NO: 116097 - DNA, 20 bp, Artificial Sequence
  Description of Artificial Sequence: Synthetic oligonucleotide
  Target: ATXN1; (+) strand; PAM type: NRG; PAM sequence: AAG
agttggatagagagaggcaa

SEQ ID NO: 116098 - DNA, 20 bp, Artificial Sequence
  Description of Artificial Sequence: Synthetic oligonucleotide
  Target: ATXN1; (+) strand; PAM type: NRG; PAM sequence: TGG
tagagagaggcaaaagaacg

SEQ ID NO: 116099 - DNA, 20 bp, Artificial Sequence
  Description of Artificial Sequence: Synthetic oligonucleotide
  Target: ATXN1; (+) strand; PAM type: NRG; PAM sequence: GGG
agagagaggcaaaagaacgt

SEQ ID NO: 116100 - DNA, 20 bp, Artificial Sequence
  Description of Artificial Sequence: Synthetic oligonucleotide
  Target: ATXN1; (+) strand; PAM type: NRG; PAM sequence: AAG
agaggcaaaagaacgtggga

SEQ ID NO: 116101 - DNA, 20 bp, Artificial Sequence
  Description of Artificial Sequence: Synthetic oligonucleotide
  Target: ATXN1; (+) strand; PAM type: NRG; PAM sequence: AAG
agaacgtgggaaagaatttg

SEQ ID NO: 116102 - DNA, 20 bp, Artificial Sequence
  Description of Artificial Sequence: Synthetic oligonucleotide
  Target: ATXN1; (+) strand; PAM type: NRG; PAM sequence: AAG
gaatttgaagaaaacgaaaa

SEQ ID NO: 116103 - DNA, 20 bp, Artificial Sequence
  Description of Artificial Sequence: Synthetic oligonucleotide
  Target: ATXN1; (+) strand; PAM type: NRG; PAM sequence: TAG
aaaaaagaaaatccattttc

SEQ ID NO: 116104 - DNA, 20 bp, Artificial Sequence
  Description of Artificial Sequence: Synthetic oligonucleotide
  Target: ATXN1; (+) strand; PAM type: NRG; PAM sequence: AAG
gaaaatccattttctagatg

SEQ ID NO: 116105 - DNA, 20 bp, Artificial Sequence
  Description of Artificial Sequence: Synthetic oligonucleotide
  Target: ATXN1; (+) strand; PAM type: NRG; PAM sequence: AAG
tttctagatgaagaccaaat

SEQ ID NO: 116106 - DNA, 20 bp, Artificial Sequence
  Description of Artificial Sequence: Synthetic oligonucleotide
  Target: ATXN1; (+) strand; PAM type: NRG; PAM sequence: AAG
ctagatgaagaccaaataag

SEQ ID NO: 116107 - DNA, 20 bp, Artificial Sequence
  Description of Artificial Sequence: Synthetic oligonucleotide
  Target: ATXN1; (+) strand; PAM type: NRG; PAM sequence: AGG
tagatgaagaccaaataaga

SEQ ID NO: 116108 - DNA, 20 bp, Artificial Sequence
  Description of Artificial Sequence: Synthetic oligonucleotide
  Target: ATXN1; (+) strand; PAM type: NRG; PAM sequence: AAG
gaccaaataagaaggaacac

SEQ ID NO: 116109 - DNA, 20 bp, Artificial Sequence
  Description of Artificial Sequence: Synthetic oligonucleotide
  Target: ATXN1; (+) strand; PAM type: NRG; PAM sequence: GAG
ccaaataagaaggaacacaa

SEQ ID NO: 116110 - DNA, 20 bp, Artificial Sequence
  Description of Artificial Sequence: Synthetic oligonucleotide
  Target: ATXN1; (+) strand; PAM type: NRG; PAM sequence: AGG
caaataagaaggaacacaag

SEQ ID NO: 116111 - DNA, 20 bp, Artificial Sequence
  Description of Artificial Sequence: Synthetic oligonucleotide
  Target: ATXN1; (+) strand; PAM type: NRG; PAM sequence: GGG
aaataagaaggaacacaaga

SEQ ID NO: 116112 - DNA, 20 bp, Artificial Sequence
  Description of Artificial Sequence: Synthetic oligonucleotide
  Target: ATXN1; (+) strand; PAM type: NRG; PAM sequence: CAG
acaagagggaatacatacaa

SEQ ID NO: 116113 - DNA, 20 bp, Artificial Sequence
  Description of Artificial Sequence: Synthetic oligonucleotide
  Target: ATXN1; (+) strand; PAM type: NRG; PAM sequence: GAG
acatacaacagataatcttt

SEQ ID NO: 116114 - DNA, 20 bp, Artificial Sequence
  Description of Artificial Sequence: Synthetic oligonucleotide
  Target: ATXN1; (+) strand; PAM type: NRG; PAM sequence: AGG
catacaacagataatctttg

SEQ ID NO: 116115 - DNA, 20 bp, Artificial Sequence
  Description of Artificial Sequence: Synthetic oligonucleotide
  Target: ATXN1; (+) strand; PAM type: NRG; PAM sequence: GAG
tacaacagataatctttgag

SEQ ID NO: 116116 - DNA, 20 bp, Artificial Sequence
  Description of Artificial Sequence: Synthetic oligonucleotide
  Target: ATXN1; (+) strand; PAM type: NRG; PAM sequence: TAG
ctttgaggagtgctaaaaaa

SEQ ID NO: 116117 - DNA, 20 bp, Artificial Sequence
  Description of Artificial Sequence: Synthetic oligonucleotide
  Target: ATXN1; (+) strand; PAM type: NRG; PAM sequence: AAG
gaggagtgctaaaaaataga

SEQ ID NO: 116118 - DNA, 20 bp, Artificial Sequence
  Description of Artificial Sequence: Synthetic oligonucleotide
  Target: ATXN1; (+) strand; PAM type: NRG; PAM sequence: AGG
aggagtgctaaaaaatagaa

SEQ ID NO: 116119 - DNA, 20 bp, Artificial Sequence
  Description of Artificial Sequence: Synthetic oligonucleotide
  Target: ATXN1; (+) strand; PAM type: NRG; PAM sequence: GAG
gagtgctaaaaaatagaaag

SEQ ID NO: 116120 - DNA, 20 bp, Artificial Sequence
  Description of Artificial Sequence: Synthetic oligonucleotide
  Target: ATXN1; (+) strand; PAM type: NRG; PAM sequence: AAG
gctaaaaaatagaaaggaga

SEQ ID NO: 116121 - DNA, 20 bp, Artificial Sequence
  Description of Artificial Sequence: Synthetic oligonucleotide
  Target: ATXN1; (+) strand; PAM type: NRG; PAM sequence: AAG
agaaagtgttaaacatcaaa

SEQ ID NO: 116122 - DNA, 20 bp, Artificial Sequence
  Description of Artificial Sequence: Synthetic oligonucleotide
  Target: ATXN1; (+) strand; PAM type: NRG; PAM sequence: GAG
gttaaacatcaaaaagaaat

SEQ ID NO: 116123 - DNA, 20 bp, Artificial Sequence
  Description of Artificial Sequence: Synthetic oligonucleotide
  Target: ATXN1; (+) strand; PAM type: NRG; PAM sequence: AGG
ttaaacatcaaaaagaaatg

SEQ ID NO: 116124 - DNA, 20 bp, Artificial Sequence
  Description of Artificial Sequence: Synthetic oligonucleotide
  Target: ATXN1; (+) strand; PAM type: NRG; PAM sequence: AAG
acatcaaaaagaaatgagga

SEQ ID NO: 116125 - DNA, 20 bp, Artificial Sequence
  Description of Artificial Sequence: Synthetic oligonucleotide
  Target: ATXN1; (+) strand; PAM type: NRG; PAM sequence: TAG
aaaagaaatgaggaaagaaa

SEQ ID NO: 116126 - DNA, 20 bp, Artificial Sequence
  Description of Artificial Sequence: Synthetic oligonucleotide
  Target: ATXN1; (+) strand; PAM type: NRG; PAM sequence: AAG
tgaggaaagaaatagaattc

SEQ ID NO: 116127 - DNA, 20 bp, Artificial Sequence
  Description of Artificial Sequence: Synthetic oligonucleotide
  Target: ATXN1; (+) strand; PAM type: NRG; PAM sequence: GAG
aggaaagaaatagaattcaa

SEQ ID NO: 116128 - DNA, 20 bp, Artificial Sequence
  Description of Artificial Sequence: Synthetic oligonucleotide
  Target: ATXN1; (+) strand; PAM type: NRG; PAM sequence: AAG
aagaaatagaattcaagaga

SEQ ID NO: 116129 - DNA, 20 bp, Artificial Sequence
  Description of Artificial Sequence: Synthetic oligonucleotide
  Target: ATXN1; (+) strand; PAM type: NRG; PAM sequence: CAG
tagaattcaagagaaagact

SEQ ID NO: 116130 - DNA, 20 bp, Artificial Sequence
  Description of Artificial Sequence: Synthetic oligonucleotide
  Target: ATXN1; (+) strand; PAM type: NRG; PAM sequence: AAG
ttcaagagaaagactcagaa

SEQ ID NO: 116131 - DNA, 20 bp, Artificial Sequence
  Description of Artificial Sequence: Synthetic oligonucleotide
  Target: ATXN1; (+) strand; PAM type: NRG; PAM sequence: AGG
tcaagagaaagactcagaaa

SEQ ID NO: 116132 - DNA, 20 bp, Artificial Sequence
  Description of Artificial Sequence: Synthetic oligonucleotide
  Target: ATXN1; (+) strand; PAM type: NRG; PAM sequence: GAG
aagactcagaaaaggaacat

SEQ ID NO: 116133 - DNA, 20 bp, Artificial Sequence
  Description of Artificial Sequence: Synthetic oligonucleotide
  Target: ATXN1; (+) strand; PAM type: NRG; PAM sequence: AAG
tcagaaaaggaacatgagca

SEQ ID NO: 116134 - DNA, 20 bp, Artificial Sequence
  Description of Artificial Sequence: Synthetic oligonucleotide
  Target: ATXN1; (+) strand; PAM type: NRG; PAM sequence: AAG
acccaacataacactgtaat

SEQ ID NO: 116135 - DNA, 20 bp, Artificial Sequence
  Description of Artificial Sequence: Synthetic oligonucleotide
  Target: ATXN1; (+) strand; PAM type: NRG; PAM sequence: GAG
ccaacataacactgtaataa

SEQ ID NO: 116136 - DNA, 20 bp, Artificial Sequence
  Description of Artificial Sequence: Synthetic oligonucleotide
  Target: ATXN1; (+) strand; PAM type: NRG; PAM sequence: AAG
cactgtaataagagcctttg

SEQ ID NO: 116137 - DNA, 20 bp, Artificial Sequence
  Description of Artificial Sequence: Synthetic oligonucleotide
  Target: ATXN1; (+) strand; PAM type: NRG; PAM sequence: AAG
tgtaataagagcctttgaag

SEQ ID NO: 116138 - DNA, 20 bp, Artificial Sequence
  Description of Artificial Sequence: Synthetic oligonucleotide
  Target: ATXN1; (+) strand; PAM type: NRG; PAM sequence: AAG
taagagcctttgaagaagaa

SEQ ID NO: 116139 - DNA, 20 bp, Artificial Sequence
  Description of Artificial Sequence: Synthetic oligonucleotide
  Target: ATXN1; (+) strand; PAM type: NRG; PAM sequence: CAG
aagaagaaaagcaataaaaa

SEQ ID NO: 116140 - DNA, 20 bp, Artificial Sequence
  Description of Artificial Sequence: Synthetic oligonucleotide
  Target: ATXN1; (+) strand; PAM type: NRG; PAM sequence: AAG
aatgcttaaaatcgtgactg

SEQ ID NO: 116141 - DNA, 20 bp, Artificial Sequence
  Description of Artificial Sequence: Synthetic oligonucleotide
  Target: ATXN1; (+) strand; PAM type: NRG; PAM sequence: TAG
cgtgactgaagcacaaattc

SEQ ID NO: 116142 - DNA, 20 bp, Artificial Sequence
  Description of Artificial Sequence: Synthetic oligonucleotide
  Target: ATXN1; (+) strand; PAM type: NRG; PAM sequence: AAG
gactgaagcacaaattctag

SEQ ID NO: 116143 - DNA, 20 bp, Artificial Sequence
  Description of Artificial Sequence: Synthetic oligonucleotide
  Target: ATXN1; (+) strand; PAM type: NRG; PAM sequence: TAG
tgaagcacaaattctagaag

SEQ ID NO: 116144 - DNA, 20 bp, Artificial Sequence
  Description of Artificial Sequence: Synthetic oligonucleotide
  Target: ATXN1; (+) strand; PAM type: NRG; PAM sequence: AAG
acaaattctagaagtagaaa

SEQ ID NO: 116145 - DNA, 20 bp, Artificial Sequence
  Description of Artificial Sequence: Synthetic oligonucleotide
  Target: ATXN1; (+) strand; PAM type: NRG; PAM sequence: CAG
gatttgaaactatatattga

SEQ ID NO: 116146 - DNA, 20 bp, Artificial Sequence
  Description of Artificial Sequence: Synthetic oligonucleotide
  Target: ATXN1; (+) strand; PAM type: NRG; PAM sequence: TGG
gacagaatactccatgcacc

SEQ ID NO: 116147 - DNA, 20 bp, Artificial Sequence
  Description of Artificial Sequence: Synthetic oligonucleotide
  Target: ATXN1; (+) strand; PAM type: NRG; PAM sequence: TAG
tgcacctggaaaaactgacc

SEQ ID NO: 116148 - DNA, 20 bp, Artificial Sequence
  Description of Artificial Sequence: Synthetic oligonucleotide
  Target: ATXN1; (+) strand; PAM type: NRG; PAM sequence: AGG
gcacctggaaaaactgacct

SEQ ID NO: 116149 - DNA, 20 bp, Artificial Sequence
  Description of Artificial Sequence: Synthetic oligonucleotide
  Target: ATXN1; (+) strand; PAM type: NRG; PAM sequence: AAG
ctggaaaaactgacctagga

SEQ ID NO: 116150 - DNA, 20 bp, Artificial Sequence
  Description of Artificial Sequence: Synthetic oligonucleotide
  Target: ATXN1; (+) strand; PAM type: NRG; PAM sequence: TGG
gaaaacaaaaaaaaattctt

SEQ ID NO: 116151 - DNA, 20 bp, Artificial Sequence
  Description of Artificial Sequence: Synthetic oligonucleotide
  Target: ATXN1; (+) strand; PAM type: NRG; PAM sequence: CAG
aaaaaaattctttggacact

SEQ ID NO: 116152 - DNA, 20 bp, Artificial Sequence
  Description of Artificial Sequence: Synthetic oligonucleotide
  Target: ATXN1; (+) strand; PAM type: NRG; PAM sequence: AGG
aaaaaattctttggacactc

SEQ ID NO: 116153 - DNA, 20 bp, Artificial Sequence
  Description of Artificial Sequence: Synthetic oligonucleotide
  Target: ATXN1; (+) strand; PAM type: NRG; PAM sequence: GAG
gacactcaggtaaaatgact

SEQ ID NO: 116154 - DNA, 20 bp, Artificial Sequence
  Description of Artificial Sequence: Synthetic oligonucleotide
  Target: ATXN1; (+) strand; PAM type: NRG; PAM sequence: AAG
aaaatgactgagttacctat

SEQ ID NO: 116155 - DNA, 20 bp, Artificial Sequence
  Description of Artificial Sequence: Synthetic oligonucleotide
  Target: ATXN1; (+) strand; PAM type: NRG; PAM sequence: AGG
aaatgactgagttacctata

SEQ ID NO: 116156 - DNA, 20 bp, Artificial Sequence
  Description of Artificial Sequence: Synthetic oligonucleotide
  Target: ATXN1; (+) strand; PAM type: NRG; PAM sequence: GGG
aatgactgagttacctataa

SEQ ID NO: 116157 - DNA, 20 bp, Artificial Sequence
  Description of Artificial Sequence: Synthetic oligonucleotide
  Target: ATXN1; (+) strand; PAM type: NRG; PAM sequence: CAG
actgagttacctataaggga

SEQ ID NO: 116158 - DNA, 20 bp, Artificial Sequence
  Description of Artificial Sequence: Synthetic oligonucleotide
  Target: ATXN1; (+) strand; PAM type: NRG; PAM sequence: TAG
acctataagggacagaaaat

SEQ ID NO: 116159 - DNA, 20 bp, Artificial Sequence
  Description of Artificial Sequence: Synthetic oligonucleotide
  Target: ATXN1; (+) strand; PAM type: NRG; PAM sequence: GAG
ctataagggacagaaaatta

SEQ ID NO: 116160 - DNA, 20 bp, Artificial Sequence
  Description of Artificial Sequence: Synthetic oligonucleotide
  Target: ATXN1; (+) strand; PAM type: NRG; PAM sequence: AAG
agagtgtcacccgatttttc

SEQ ID NO: 116161 - DNA, 20 bp, Artificial Sequence
  Description of Artificial Sequence: Synthetic oligonucleotide
  Target: ATXN1; (+) strand; PAM type: NRG; PAM sequence: GAG
agtgtcacccgatttttcaa

SEQ ID NO: 116162 - DNA, 20 bp, Artificial Sequence
  Description of Artificial Sequence: Synthetic oligonucleotide
  Target: ATXN1; (+) strand; PAM type: NRG; PAM sequence: CAG
tcacccgatttttcaagagc

SEQ ID NO: 116163 - DNA, 20 bp, Artificial Sequence
  Description of Artificial Sequence: Synthetic oligonucleotide
  Target: ATXN1; (+) strand; PAM type: NRG; PAM sequence: AGG
cacccgatttttcaagagcc

SEQ ID NO: 116164 - DNA, 20 bp, Artificial Sequence
  Description of Artificial Sequence: Synthetic oligonucleotide
  Target: ATXN1; (+) strand; PAM type: NRG; PAM sequence: AAG
agagccaggcttcatgctaa

SEQ ID NO: 116165 - DNA, 20 bp, Artificial Sequence
  Description of Artificial Sequence: Synthetic oligonucleotide
  Target: ATXN1; (+) strand; PAM type: NRG; PAM sequence: CAG
ccaggcttcatgctaaaagt

SEQ ID NO: 116166 - DNA, 20 bp, Artificial Sequence
  Description of Artificial Sequence: Synthetic oligonucleotide
  Target: ATXN1; (+) strand; PAM type: NRG; PAM sequence: TAG
ggcttcatgctaaaagtcag

SEQ ID NO: 116167 - DNA, 20 bp, Artificial Sequence
  Description of Artificial Sequence: Synthetic oligonucleotide
  Target: ATXN1; (+) strand; PAM type: NRG; PAM sequence: CAG
aaagtcagtagcgtgacact

SEQ ID NO: 116168 - DNA, 20 bp, Artificial Sequence
  Description of Artificial Sequence: Synthetic oligonucleotide
  Target: ATXN1; (+) strand; PAM type: NRG; PAM sequence: AGG
aagtcagtagcgtgacactc

SEQ ID NO: 116169 - DNA, 20 bp, Artificial Sequence
  Description of Artificial Sequence: Synthetic oligonucleotide
  Target: ATXN1; (+) strand; PAM type: NRG; PAM sequence: AAG
cagtagcgtgacactcagga

SEQ ID NO: 116170 - DNA, 20 bp, Artificial Sequence
  Description of Artificial Sequence: Synthetic oligonucleotide
  Target: ATXN1; (+) strand; PAM type: NRG; PAM sequence: AAG
gacactcaggaaagacaact

SEQ ID NO: 116171 - DNA, 20 bp, Artificial Sequence
  Description of Artificial Sequence: Synthetic oligonucleotide
  Target: ATXN1; (+) strand; PAM type: NRG; PAM sequence: AAG
tcaggaaagacaactaagcc

SEQ ID NO: 116172 - DNA, 20 bp, Artificial Sequence
  Description of Artificial Sequence: Synthetic oligonucleotide
  Target: ATXN1; (+) strand; PAM type: NRG; PAM sequence: AGG
caggaaagacaactaagcca

SEQ ID NO: 116173 - DNA, 20 bp, Artificial Sequence
  Description of Artificial Sequence: Synthetic oligonucleotide
  Target: ATXN1; (+) strand; PAM type: NRG; PAM sequence: CAG
taagccaaggatcttatacc

SEQ ID NO: 116174 - DNA, 20 bp, Artificial Sequence
  Description of Artificial Sequence: Synthetic oligonucleotide
  Target: ATXN1; (+) strand; PAM type: NRG; PAM sequence: CAG
acccagccaaaatgatcttc

SEQ ID NO: 116175 - DNA, 20 bp, Artificial Sequence
  Description of Artificial Sequence: Synthetic oligonucleotide
  Target: ATXN1; (+) strand; PAM type: NRG; PAM sequence: AAG
acaatctgttatgaatatgc

SEQ ID NO: 116176 - DNA, 20 bp, Artificial Sequence
  Description of Artificial Sequence: Synthetic oligonucleotide
  Target: ATXN1; (+) strand; PAM type: NRG; PAM sequence: AGG
caatctgttatgaatatgca

SEQ ID NO: 116177 - DNA, 20 bp, Artificial Sequence
  Description of Artificial Sequence: Synthetic oligonucleotide
  Target: ATXN1; (+) strand; PAM type: NRG; PAM sequence: AAG
ttatgaatatgcaaggaccc

SEQ ID NO: 116178 - DNA, 20 bp, Artificial Sequence
  Description of Artificial Sequence: Synthetic oligonucleotide
  Target: ATXN1; (+) strand; PAM type: NRG; PAM sequence: AGG
tatgaatatgcaaggaccca

SEQ ID NO: 116179 - DNA, 20 bp, Artificial Sequence
  Description of Artificial Sequence: Synthetic oligonucleotide
  Target: ATXN1; (+) strand; PAM type: NRG; PAM sequence: CAG
gacccaaggaatattgttcg

SEQ ID NO: 116180 - DNA, 20 bp, Artificial Sequence
  Description of Artificial Sequence: Synthetic oligonucleotide
  Target: ATXN1; (+) strand; PAM type: NRG; PAM sequence: TAG
atattgttcgcagaaaccct

SEQ ID NO: 116181 - DNA, 20 bp, Artificial Sequence
  Description of Artificial Sequence: Synthetic oligonucleotide
  Target: ATXN1; (+) strand; PAM type: NRG; PAM sequence: AAG
agaaacccttagtaatctgc

SEQ ID NO: 116182 - DNA, 20 bp, Artificial Sequence
  Description of Artificial Sequence: Synthetic oligonucleotide
  Target: ATXN1; (+) strand; PAM type: NRG; PAM sequence: AGG
gaaacccttagtaatctgca

SEQ ID NO: 116183 - DNA, 20 bp, Artificial Sequence
  Description of Artificial Sequence: Synthetic oligonucleotide
  Target: ATXN1; (+) strand; PAM type: NRG; PAM sequence: GGG
aaacccttagtaatctgcaa

SEQ ID NO: 116184 - DNA, 20 bp, Artificial Sequence
  Description of Artificial Sequence: Synthetic oligonucleotide
  Target: ATXN1; (+) strand; PAM type: NRG; PAM sequence: GAG
acccttagtaatctgcaagg

SEQ ID NO: 116185 - DNA, 20 bp, Artificial Sequence
  Description of Artificial Sequence: Synthetic oligonucleotide
  Target: ATXN1; (+) strand; PAM type: NRG; PAM sequence: AAG
cttagtaatctgcaagggag

SEQ ID NO: 116186 - DNA, 20 bp, Artificial Sequence
  Description of Artificial Sequence: Synthetic oligonucleotide
  Target: ATXN1; (+) strand; PAM type: NRG; PAM sequence: GAG
tagtaatctgcaagggagaa

SEQ ID NO: 116187 - DNA, 20 bp, Artificial Sequence
  Description of Artificial Sequence: Synthetic oligonucleotide
  Target: ATXN1; (+) strand; PAM type: NRG; PAM sequence: CAG
aatctgcaagggagaagagt

SEQ ID NO: 116188 - DNA, 20 bp, Artificial Sequence
  Description of Artificial Sequence: Synthetic oligonucleotide
  Target: ATXN1; (+) strand; PAM type: NRG; PAM sequence: AGG
atctgcaagggagaagagtc

SEQ ID NO: 116189 - DNA, 20 bp, Artificial Sequence
  Description of Artificial Sequence: Synthetic oligonucleotide
  Target: ATXN1; (+) strand; PAM type: NRG; PAM sequence: CAG
agggagaagagtcaggcaac

SEQ ID NO: 116190 - DNA, 20 bp, Artificial Sequence
  Description of Artificial Sequence: Synthetic oligonucleotide
  Target: ATXN1; (+) strand; PAM type: NRG; PAM sequence: TGG
gaagagtcaggcaaccagtc

SEQ ID NO: 116191 - DNA, 20 bp, Artificial Sequence
  Description of Artificial Sequence: Synthetic oligonucleotide
  Target: ATXN1; (+) strand; PAM type: NRG; PAM sequence: TGG
agtcaggcaaccagtctggc

SEQ ID NO: 116192 - DNA, 20 bp, Artificial Sequence
  Description of Artificial Sequence: Synthetic oligonucleotide
  Target: ATXN1; (+) strand; PAM type: NRG; PAM sequence: AAG
aggcaaccagtctggctgga

SEQ ID NO: 116193 - DNA, 20 bp, Artificial Sequence
  Description of Artificial Sequence: Synthetic oligonucleotide
  Target: ATXN1; (+) strand; PAM type: NRG; PAM sequence: AGG
ggcaaccagtctggctggaa

SEQ ID NO: 116194 - DNA, 20 bp, Artificial Sequence
  Description of Artificial Sequence: Synthetic oligonucleotide
  Target: ATXN1; (+) strand; PAM type: NRG; PAM sequence: AAG
gctggaaaggcactgataca

SEQ ID NO: 116195 - DNA, 20 bp, Artificial Sequence
  Description of Artificial Sequence: Synthetic oligonucleotide
  Target: ATXN1; (+) strand; PAM type: NRG; PAM sequence: TGG
aaaggcactgatacaaagac

SEQ ID NO: 116196 - DNA, 20 bp, Artificial Sequence
  Description of Artificial Sequence: Synthetic oligonucleotide
  Target: ATXN1; (+) strand; PAM type: NRG; PAM sequence: GGG
aaggcactgatacaaagact

SEQ ID NO: 116197 - DNA, 20 bp, Artificial Sequence
  Description of Artificial Sequence: Synthetic oligonucleotide
  Target: ATXN1; (+) strand; PAM type: NRG; PAM sequence: GAG
cactgatacaaagactgggt

SEQ ID NO: 116198 - DNA, 20 bp, Artificial Sequence
  Description of Artificial Sequence: Synthetic oligonucleotide
  Target: ATXN1; (+) strand; PAM type: NRG; PAM sequence: CAG
gtgagcatttaacacataat

SEQ ID NO: 116199 - DNA, 20 bp, Artificial Sequence
  Description of Artificial Sequence: Synthetic oligonucleotide
  Target: ATXN1; (+) strand; PAM type: NRG; PAM sequence: TAG
atttaacacataatcagctg

SEQ ID NO: 116200 - DNA, 20 bp, Artificial Sequence
  Description of Artificial Sequence: Synthetic oligonucleotide
  Target: ATXN1; (+) strand; PAM type: NRG; PAM sequence: AGG
tttaacacataatcagctgt

SEQ ID NO: 116201 - DNA, 20 bp, Artificial Sequence
  Description of Artificial Sequence: Synthetic oligonucleotide
  Target: ATXN1; (+) strand; PAM type: NRG; PAM sequence: AAG
agctgtaggtctgttactga

SEQ ID NO: 116202 - DNA, 20 bp, Artificial Sequence
  Description of Artificial Sequence: Synthetic oligonucleotide
  Target: ATXN1; (+) strand; PAM type: NRG; PAM sequence: AAG
tgttactgaaagatgattac

SEQ ID NO: 116203 - DNA, 20 bp, Artificial Sequence
  Description of Artificial Sequence: Synthetic oligonucleotide
  Target: ATXN1; (+) strand; PAM type: NRG; PAM sequence: AGG
gttactgaaagatgattaca

SEQ ID NO: 116204 - DNA, 20 bp, Artificial Sequence
  Description of Artificial Sequence: Synthetic oligonucleotide
  Target: ATXN1; (+) strand; PAM type: NRG; PAM sequence: TAG
caaggaaacaatattacata

SEQ ID NO: 116205 - DNA, 20 bp, Artificial Sequence
  Description of Artificial Sequence: Synthetic oligonucleotide
  Target: ATXN1; (+) strand; PAM type: NRG; PAM sequence: CAG
gaaacaatattacatatagc

SEQ ID NO: 116206 - DNA, 20 bp, Artificial Sequence
  Description of Artificial Sequence: Synthetic oligonucleotide
  Target: ATXN1; (+) strand; PAM type: NRG; PAM sequence: TAG
gactatgtgccctgacaata

SEQ ID NO: 116207 - DNA, 20 bp, Artificial Sequence
  Description of Artificial Sequence: Synthetic oligonucleotide
  Target: ATXN1; (+) strand; PAM type: NRG; PAM sequence: TAG
atgtgccctgacaatataga

SEQ ID NO: 116208 - DNA, 20 bp, Artificial Sequence
  Description of Artificial Sequence: Synthetic oligonucleotide
  Target: ATXN1; (+) strand; PAM type: NRG; PAM sequence: CGG
aatgattaaaaaaaaacacg

SEQ ID NO: 116209 - DNA, 20 bp, Artificial Sequence
  Description of Artificial Sequence: Synthetic oligonucleotide
  Target: ATXN1; (+) strand; PAM type: NRG; PAM sequence: GGG
atgattaaaaaaaaacacgc

SEQ ID NO: 116210 - DNA, 20 bp, Artificial Sequence
  Description of Artificial Sequence: Synthetic oligonucleotide
  Target: ATXN1; (+) strand; PAM type: NRG; PAM sequence: AAG
attaaaaaaaaacacgcggg

SEQ ID NO: 116211 - DNA, 20 bp, Artificial Sequence
  Description of Artificial Sequence: Synthetic oligonucleotide
  Target: ATXN1; (+) strand; PAM type: NRG; PAM sequence: AAG
aacacgcgggaagaatatga

SEQ ID NO: 116212 - DNA, 20 bp, Artificial Sequence
  Description of Artificial Sequence: Synthetic oligonucleotide
  Target: ATXN1; (+) strand; PAM type: NRG; PAM sequence: AGG
acacgcgggaagaatatgaa

SEQ ID NO: 116213 - DNA, 20 bp, Artificial Sequence
  Description of Artificial Sequence: Synthetic oligonucleotide
  Target: ATXN1; (+) strand; PAM type: NRG; PAM sequence: TAG
cgaaaataatctcactaaca

SEQ ID NO: 116214 - DNA, 20 bp, Artificial Sequence
  Description of Artificial Sequence: Synthetic oligonucleotide
  Target: ATXN1; (+) strand; PAM type: NRG; PAM sequence: AAG
atctcactaacatagatgtt

SEQ ID NO: 116215 - DNA, 20 bp, Artificial Sequence
  Description of Artificial Sequence: Synthetic oligonucleotide
  Target: ATXN1; (+) strand; PAM type: NRG; PAM sequence: TGG
tcactaacatagatgttaag

SEQ ID NO: 116216 - DNA, 20 bp, Artificial Sequence
  Description of Artificial Sequence: Synthetic oligonucleotide
  Target: ATXN1; (+) strand; PAM type: NRG; PAM sequence: GGG
cactaacatagatgttaagt

SEQ ID NO: 116217 - DNA, 20 bp, Artificial Sequence
  Description of Artificial Sequence: Synthetic oligonucleotide
  Target: ATXN1; (+) strand; PAM type: NRG; PAM sequence: GAG
ctaacatagatgttaagtgg

SEQ ID NO: 116218 - DNA, 20 bp, Artificial Sequence
  Description of Artificial Sequence: Synthetic oligonucleotide
  Target: ATXN1; (+) strand; PAM type: NRG; PAM sequence: AAG
tagatgttaagtgggagtaa

SEQ ID NO: 116219 - DNA, 20 bp, Artificial Sequence
  Description of Artificial Sequence: Synthetic oligonucleotide
  Target: ATXN1; (+) strand; PAM type: NRG; PAM sequence: AGG
agatgttaagtgggagtaaa

SEQ ID NO: 116220 - DNA, 20 bp, Artificial Sequence
  Description of Artificial Sequence: Synthetic oligonucleotide
  Target: ATXN1; (+) strand; PAM type: NRG; PAM sequence: TAG
tattaccttaaatcaaatta

SEQ ID NO: 116221 - DNA, 20 bp, Artificial Sequence
  Description of Artificial Sequence: Synthetic oligonucleotide
  Target: ATXN1; (+) strand; PAM type: NRG; PAM sequence: CAG
accttaaatcaaattatagc

SEQ ID NO: 116222 - DNA, 20 bp, Artificial Sequence
  Description of Artificial Sequence: Synthetic oligonucleotide
  Target: ATXN1; (+) strand; PAM type: NRG; PAM sequence: GAG
cttaaatcaaattatagcca

SEQ ID NO: 116223 - DNA, 20 bp, Artificial Sequence
  Description of Artificial Sequence: Synthetic oligonucleotide
  Target: ATXN1; (+) strand; PAM type: NRG; PAM sequence: AAG
aaatcaaattatagccagag

SEQ ID NO: 116224 - DNA, 20 bp, Artificial Sequence
  Description of Artificial Sequence: Synthetic oligonucleotide
  Target: ATXN1; (+) strand; PAM type: NRG; PAM sequence: AAG
ttatagccagagaagaaaat

SEQ ID NO: 116225 - DNA, 20 bp, Artificial Sequence
  Description of Artificial Sequence: Synthetic oligonucleotide
  Target: ATXN1; (+) strand; PAM type: NRG; PAM sequence: AAG
agccagagaagaaaataaga

SEQ ID NO: 116226 - DNA, 20 bp, Artificial Sequence
  Description of Artificial Sequence: Synthetic oligonucleotide
  Target: ATXN1; (+) strand; PAM type: NRG; PAM sequence: AAG
agagaagaaaataagaaaga

SEQ ID NO: 116227 - DNA, 20 bp, Artificial Sequence
  Description of Artificial Sequence: Synthetic oligonucleotide
  Target: ATXN1; (+) strand; PAM type: NRG; PAM sequence: AGG
gagaagaaaataagaaagaa

SEQ ID NO: 116228 - DNA, 20 bp, Artificial Sequence
  Description of Artificial Sequence: Synthetic oligonucleotide
  Target: ATXN1; (+) strand; PAM type: NRG; PAM sequence: GGG
agaagaaaataagaaagaaa

SEQ ID NO: 116229 - DNA, 20 bp, Artificial Sequence
  Description of Artificial Sequence: Synthetic oligonucleotide
  Target: ATXN1; (+) strand; PAM type: NRG; PAM sequence: AAG
aataagaaagaaagggtact

SEQ ID NO: 116230 - DNA, 20 bp, Artificial Sequence
  Description of Artificial Sequence: Synthetic oligonucleotide
  Target: ATXN1; (+) strand; PAM type: NRG; PAM sequence: CAG
ctaagaatttcaaaatcact

SEQ ID NO: 116231 - DNA, 20 bp, Artificial Sequence
  Description of Artificial Sequence: Synthetic oligonucleotide
  Target: ATXN1; (+) strand; PAM type: NRG; PAM sequence: GAG
aagaatttcaaaatcactca

SEQ ID NO: 116232 - DNA, 20 bp, Artificial Sequence
  Description of Artificial Sequence: Synthetic oligonucleotide
  Target: ATXN1; (+) strand; PAM type: NRG; PAM sequence: TGG
atttcaaaatcactcagagt

SEQ ID NO: 116233 - DNA, 20 bp, Artificial Sequence
  Description of Artificial Sequence: Synthetic oligonucleotide
  Target: ATXN1; (+) strand; PAM type: NRG; PAM sequence: CAG
agttggaaaccaataaacaa

SEQ ID NO: 116234 - DNA, 20 bp, Artificial Sequence
  Description of Artificial Sequence: Synthetic oligonucleotide
  Target: ATXN1; (+) strand; PAM type: NRG; PAM sequence: AAG
gaaaccaataaacaacagct

SEQ ID NO: 116235 - DNA, 20 bp, Artificial Sequence
  Description of Artificial Sequence: Synthetic oligonucleotide
  Target: ATXN1; (+) strand; PAM type: NRG; PAM sequence: AAG
caataaacaacagctaagaa

SEQ ID NO: 116236 - DNA, 20 bp, Artificial Sequence
  Description of Artificial Sequence: Synthetic oligonucleotide
  Target: ATXN1; (+) strand; PAM type: NRG; PAM sequence: TGG
aacaacagctaagaaaagtt

SEQ ID NO: 116237 - DNA, 20 bp, Artificial Sequence
  Description of Artificial Sequence: Synthetic oligonucleotide
  Target: ATXN1; (+) strand; PAM type: NRG; PAM sequence: GGG
acaacagctaagaaaagttt

SEQ ID NO: 116238 - DNA, 20 bp, Artificial Sequence
  Description of Artificial Sequence: Synthetic oligonucleotide
  Target: ATXN1; (+) strand; PAM type: NRG; PAM sequence: GGG
caacagctaagaaaagtttg

SEQ ID NO: 116239 - DNA, 20 bp, Artificial Sequence
  Description of Artificial Sequence: Synthetic oligonucleotide
  Target: ATXN1; (+) strand; PAM type: NRG; PAM sequence: GGG
aacagctaagaaaagtttgg

SEQ ID NO: 116240 - DNA, 20 bp, Artificial Sequence
  Description of Artificial Sequence: Synthetic oligonucleotide
  Target: ATXN1; (+) strand; PAM type: NRG; PAM sequence: AAG
ctaagaaaagtttgggggat

SEQ ID NO: 116241 - DNA, 20 bp, Artificial Sequence
  Description of Artificial Sequence: Synthetic oligonucleotide
  Target: ATXN1; (+) strand; PAM type: NRG; PAM sequence: AAG
agaaaagtttgggggataag

SEQ ID NO: 116242 - DNA, 20 bp, Artificial Sequence
  Description of Artificial Sequence: Synthetic oligonucleotide
  Target: ATXN1; (+) strand; PAM type: NRG; PAM sequence: AGG
gaaaagtttgggggataaga

SEQ ID NO: 116243 - DNA, 20 bp, Artificial Sequence
  Description of Artificial Sequence: Synthetic oligonucleotide
  Target: ATXN1; (+) strand; PAM type: NRG; PAM sequence: GGG
aaaagtttgggggataagaa

SEQ ID NO: 116244 - DNA, 20 bp, Artificial Sequence
  Description of Artificial Sequence: Synthetic oligonucleotide
  Target: ATXN1; (+) strand; PAM type: NRG; PAM sequence: AAG
gataagaagggtaccatatt

SEQ ID NO: 116245 - DNA, 20 bp, Artificial Sequence
  Description of Artificial Sequence: Synthetic oligonucleotide
  Target: ATXN1; (+) strand; PAM type: NRG; PAM sequence: AGG
ataagaagggtaccatatta

SEQ ID NO: 116246 - DNA, 20 bp, Artificial Sequence
  Description of Artificial Sequence: Synthetic oligonucleotide
  Target: ATXN1; (+) strand; PAM type: NRG; PAM sequence: TGG
attattctaaacatttttac

SEQ ID NO: 116247 - DNA, 20 bp, Artificial Sequence
  Description of Artificial Sequence: Synthetic oligonucleotide
  Target: ATXN1; (+) strand; PAM type: NRG; PAM sequence: AAG
attctaaacatttttactgg

SEQ ID NO: 116248 - DNA, 20 bp, Artificial Sequence
  Description of Artificial Sequence: Synthetic oligonucleotide
  Target: ATXN1; (+) strand; PAM type: NRG; PAM sequence: AGG
ttctaaacatttttactgga

SEQ ID NO: 116249 - DNA, 20 bp, Artificial Sequence
  Description of Artificial Sequence: Synthetic oligonucleotide
  Target: ATXN1; (+) strand; PAM type: NRG; PAM sequence: TGG
aaacatttttactggaaggc

SEQ ID NO: 116250 - DNA, 20 bp, Artificial Sequence
  Description of Artificial Sequence: Synthetic oligonucleotide
  Target: ATXN1; (+) strand; PAM type: NRG; PAM sequence: GGG
aacatttttactggaaggct

SEQ ID NO: 116251 - DNA, 20 bp, Artificial Sequence
  Description of Artificial Sequence: Synthetic oligonucleotide
  Target: ATXN1; (+) strand; PAM type: NRG; PAM sequence: TGG
ttttactggaaggctgggca

SEQ ID NO: 116252 - DNA, 20 bp, Artificial Sequence
  Description of Artificial Sequence: Synthetic oligonucleotide
  Target: ATXN1; (+) strand; PAM type: NRG; PAM sequence: TGG
tactggaaggctgggcatgg

SEQ ID NO: 116253 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatcccaacactt

SEQ ID NO: 116254 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccaacacttt

SEQ ID NO: 116255 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccaacactttgg

SEQ ID NO: 116256 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccaacactttggg

SEQ ID NO: 116257 - DNA, 20 bp, Artificial Sequence
  Description of Artificial Sequence: Synthetic oligonucleotide
  Target: ATXN1; (+) strand; PAM type: NRG; PAM sequence: AAG
tcccaacactttgggaggcc

SEQ ID NO: 116258 - DNA, 20 bp, Artificial Sequence
  Description of Artificial Sequence: Synthetic oligonucleotide
  Target: ATXN1; (+) strand; PAM type: NRG; PAM sequence: AGG
cccaacactttgggaggcca

SEQ ID NO: 116259 - DNA, 20 bp, Artificial Sequence
  Description of Artificial Sequence: Synthetic oligonucleotide
  Target: ATXN1; (+) strand; PAM type: NRG; PAM sequence: CGG
aacactttgggaggccaagg

SEQ ID NO: 116260 - DNA, 20 bp, Artificial Sequence
  Description of Artificial Sequence: Synthetic oligonucleotide
  Target: ATXN1; (+) strand; PAM type: NRG; PAM sequence: GGG
acactttgggaggccaaggc

SEQ ID NO: 116261 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccaaggcggg

SEQ ID NO: 116262 - DNA, 20 bp, Artificial Sequence
  Description of Artificial Sequence: Synthetic oligonucleotide
  Target: ATXN1; (+) strand; PAM type: NRG; PAM sequence: GAG
ccaaggcgggtggatcactt

SEQ ID NO: 116263 - DNA, 20 bp, Artificial Sequence
  Description of Artificial Sequence: Synthetic oligonucleotide
  Target: ATXN1; (+) strand; PAM type: NRG; PAM sequence: AGG
caaggcgggtggatcacttg

SEQ ID NO: 116264 - DNA, 20 bp, Artificial Sequence
  Description of Artificial Sequence: Synthetic oligonucleotide
  Target: ATXN1; (+) strand; PAM type: NRG; PAM sequence: CAG
gcgggtggatcacttgaggc

SEQ ID NO: 116265 - DNA, 20 bp, Artificial Sequence
  Description of Artificial Sequence: Synthetic oligonucleotide
  Target: ATXN1; (+) strand; PAM type: NRG; PAM sequence: AGG
cgggtggatcacttgaggcc

SEQ ID NO: 116266 - DNA, 20 bp, Artificial Sequence
  Description of Artificial Sequence: Synthetic oligonucleotide
  Target: ATXN1; (+) strand; PAM type: NRG; PAM sequence: GAG
tcacttgaggccaggaactt

SEQ ID NO: 116267 - DNA, 20 bp, Artificial Sequence
  Description of Artificial Sequence: Synthetic oligonucleotide
  Target: ATXN1; (+) strand; PAM type: NRG; PAM sequence: TAG
tgaggccaggaacttgagac

SEQ ID NO: 116268 - DNA, 20 bp, Artificial Sequence
  Description of Artificial Sequence: Synthetic oligonucleotide
  Target: ATXN1; (+) strand; PAM type: NRG; PAM sequence: TGG
ccaggaacttgagactagcc

SEQ ID NO: 116269 - DNA, 20 bp, Artificial Sequence
  Description of Artificial Sequence: Synthetic oligonucleotide
  Target: ATXN1; (+) strand; PAM type: NRG; PAM sequence: TGG
tgagactagcctggccaaca

SEQ ID NO: 116270 - DNA, 20 bp, Artificial Sequence
  Description of Artificial Sequence: Synthetic oligonucleotide
  Target: ATXN1; (+) strand; PAM type: NRG; PAM sequence: TGG
ccaaaaatccaaaaattacc

SEQ ID NO: 116271 - DNA, 20 bp, Artificial Sequence
  Description of Artificial Sequence: Synthetic oligonucleotide
  Target: ATXN1; (+) strand; PAM type: NRG; PAM sequence: TGG
atccaaaaattacctggtcg

SEQ ID NO: 116272 - DNA, 20 bp, Artificial Sequence
  Description of Artificial Sequence: Synthetic oligonucleotide
  Target: ATXN1; (+) strand; PAM type: NRG; PAM sequence: TGG
caaaaattacctggtcgtgg

SEQ ID NO: 116273 - DNA, 20 bp, Artificial Sequence
  Description of Artificial Sequence: Synthetic oligonucleotide
  Target: ATXN1; (+) strand; PAM type: NRG; PAM sequence: CAG
cacctgtaatcccatctact

SEQ ID NO: 116274 - DNA, 20 bp, Artificial Sequence
  Description of Artificial Sequence: Synthetic oligonucleotide
  Target: ATXN1; (+) strand; PAM type: NRG; PAM sequence: AGG
acctgtaatcccatctactc

SEQ ID NO: 116275 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccatctactcag

SEQ ID NO: 116276 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccatctactcagg

SEQ ID NO: 116277 - DNA, 20 bp, Artificial Sequence
  Description of Artificial Sequence: Synthetic oligonucleotide
  Target: ATXN1; (+) strand; PAM type: NRG; PAM sequence: GAG
tcccatctactcaggaggct

SEQ ID NO: 116278 - DNA, 20 bp, Artificial Sequence
  Description of Artificial Sequence: Synthetic oligonucleotide
  Target: ATXN1; (+) strand; PAM type: NRG; PAM sequence: AGG
cccatctactcaggaggctg

SEQ ID NO: 116279 - DNA, 20 bp, Artificial Sequence
  Description of Artificial Sequence: Synthetic oligonucleotide
  Target: ATXN1; (+) strand; PAM type: NRG; PAM sequence: GAG
tactcaggaggctgaggcac

SEQ ID NO: 116280 - DNA, 20 bp, Artificial Sequence
  Description of Artificial Sequence: Synthetic oligonucleotide
  Target: ATXN1; (+) strand; PAM type: NRG; PAM sequence: CAG
gcacgagaattgcttaaacc

SEQ ID NO: 116281 - DNA, 20 bp, Artificial Sequence
  Description of Artificial Sequence: Synthetic oligonucleotide
  Target: ATXN1; (+) strand; PAM type: NRG; PAM sequence: AGG
cacgagaattgcttaaaccc

SEQ ID NO: 116282 - DNA, 20 bp, Artificial Sequence
  Description of Artificial Sequence: Synthetic oligonucleotide
  Target: ATXN1; (+) strand; PAM type: NRG; PAM sequence: GAG
cgagaattgcttaaacccag

SEQ ID NO: 116283 - DNA, 20 bp, Artificial Sequence
  Description of Artificial Sequence: Synthetic oligonucleotide
  Target: ATXN1; (+) strand; PAM type: NRG; PAM sequence: AGG
gagaattgcttaaacccagg

SEQ ID NO: 116284 - DNA, 20 bp, Artificial Sequence
  Description of Artificial Sequence: Synthetic oligonucleotide
  Target: ATXN1; (+) strand; PAM type: NRG; PAM sequence: GGG
agaattgcttaaacccagga

SEQ ID NO: 116285 - DNA, 20 bp, Artificial Sequence
  Description of Artificial Sequence: Synthetic oligonucleotide
  Target: ATXN1; (+) strand; PAM type: NRG; PAM sequence: GAG
ttgcttaaacccaggagggt

SEQ ID NO: 116286 - DNA, 20 bp, Artificial Sequence
  Description of Artificial Sequence: Synthetic oligonucleotide
  Target: ATXN1; (+) strand; PAM type: NRG; PAM sequence: AGG
tgcttaaacccaggagggtg

SEQ ID NO: 116287 - DNA, 20 bp, Artificial Sequence
  Description of Artificial Sequence: Synthetic oligonucleotide
  Target: ATXN1; (+) strand; PAM type: NRG; PAM sequence: CAG
aacccaggagggtgaggctg

SEQ ID NO: 116288 - DNA, 20 bp, Artificial Sequence
  Description of Artificial Sequence: Synthetic oligonucleotide
  Target: ATXN1; (+) strand; PAM type: NRG; PAM sequence: GAG
caggagggtgaggctgcagt

SEQ ID NO: 116289 - DNA, 20 bp, Artificial Sequence
  Description of Artificial Sequence: Synthetic oligonucleotide
  Target: ATXN1; (+) strand; PAM type: NRG; PAM sequence: AAG
gggtgaggctgcagtgagcc

SEQ ID NO: 116290 - DNA, 20 bp, Artificial Sequence
  Description of Artificial Sequence: Synthetic oligonucleotide
  Target: ATXN1; (+) strand; PAM type: NRG; PAM sequence: TGG
gaggctgcagtgagccaaga

SEQ ID NO: 116291 - DNA, 20 bp, Artificial Sequence
  Description of Artificial Sequence: Synthetic oligonucleotide
  Target: ATXN1; (+) strand; PAM type: NRG; PAM sequence: CAG
aagatggtgccactgctctc

SEQ ID NO: 116292 - DNA, 20 bp, Artificial Sequence
  Description of Artificial Sequence: Synthetic oligonucleotide
  Target: ATXN1; (+) strand; PAM type: NRG; PAM sequence: CGG
ggtgccactgctctccagcc

SEQ ID NO: 116293 - DNA, 20 bp, Artificial Sequence
  Description of Artificial Sequence: Synthetic oligonucleotide
  Target: ATXN1; (+) strand; PAM type: NRG; PAM sequence: GGG
gtgccactgctctccagccc

SEQ ID NO: 116294 - DNA, 20 bp, Artificial Sequence
  Description of Artificial Sequence: Synthetic oligonucleotide
  Target: ATXN1; (+) strand; PAM type: NRG; PAM sequence: CAG
ctgctctccagcccgggtga

SEQ ID NO: 116295 - DNA, 20 bp, Artificial Sequence
  Description of Artificial Sequence: Synthetic oligonucleotide
  Target: ATXN1; (+) strand; PAM type: NRG; PAM sequence: GAG
gctctccagcccgggtgaca

SEQ ID NO: 116296 - DNA, 20 bp, Artificial Sequence
  Description of Artificial Sequence: Synthetic oligonucleotide
  Target: ATXN1; (+) strand; PAM type: NRG; PAM sequence: AAG
tccagcccgggtgacagagc

SEQ ID NO: 116297 - DNA, 20 bp, Artificial Sequence
  Description of Artificial Sequence: Synthetic oligonucleotide
  Target: ATXN1; (+) strand; PAM type: NRG; PAM sequence: AGG
ccagcccgggtgacagagca

SEQ ID NO: 116298 - DNA, 20 bp, Artificial Sequence
  Description of Artificial Sequence: Synthetic oligonucleotide
  Target: ATXN1; (+) strand; PAM type: NRG; PAM sequence: TGG
ccgggtgacagagcaaggct

SEQ ID NO: 116299 - DNA, 20 bp, Artificial Sequence
  Description of Artificial Sequence: Synthetic oligonucleotide
  Target: ATXN1; (+) strand; PAM type: NRG; PAM sequence: TGG
tgacagagcaaggcttggtc

SEQ ID NO: 116300 - DNA, 20 bp, Artificial Sequence
  Description of Artificial Sequence: Synthetic oligonucleotide
  Target: ATXN1; (+) strand; PAM type: NRG; PAM sequence: TAG
aaacaaacaaacaaaaaaaa

SEQ ID NO: 116301 - DNA, 20 bp, Artificial Sequence
  Description of Artificial Sequence: Synthetic oligonucleotide
  Target: ATXN1; (+) strand; PAM type: NRG; PAM sequence: CGG
caaacaaacaaaaaaaatag

SEQ ID NO: 116302 - DNA, 20 bp, Artificial Sequence
  Description of Artificial Sequence: Synthetic oligonucleotide
  Target: ATXN1; (+) strand; PAM type: NRG; PAM sequence: GGG
aaacaaacaaaaaaaatagc

SEQ ID NO: 116303 - DNA, 20 bp, Artificial Sequence
  Description of Artificial Sequence: Synthetic oligonucleotide
  Target: ATXN1; (+) strand; PAM type: NRG; PAM sequence: TGG
aacaaaaaaaatagcgggca

SEQ ID NO: 116304 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaatagcgggcatgg

SEQ ID NO: 116305 - DNA, 20 bp, Artificial Sequence
  Description of Artificial Sequence: Synthetic oligonucleotide
  Target: ATXN1; (+) strand; PAM type: NRG; PAM sequence: GGG
aaaaaaatagcgggcatggt

SEQ ID NO: 116306 - DNA, 20 bp, Artificial Sequence
  Description of Artificial Sequence: Synthetic oligonucleotide
  Target: ATXN1; (+) strand; PAM type: NRG; PAM sequence: GGG
aaaaaatagcgggcatggtg

SEQ ID NO: 116307 - DNA, 20 bp, Artificial Sequence
  Description of Artificial Sequence: Synthetic oligonucleotide
  Target: ATXN1; (+) strand; PAM type: NRG; PAM sequence: TAG
ggcatggtggggcacacctg

SEQ ID NO: 116308 - DNA, 20 bp, Artificial Sequence
  Description of Artificial Sequence: Synthetic oligonucleotide
  Target: ATXN1; (+) strand; PAM type: NRG; PAM sequence: CAG
gtggggcacacctgtagtcc

SEQ ID NO: 116309 - DNA, 20 bp, Artificial Sequence
  Description of Artificial Sequence: Synthetic oligonucleotide
  Target: ATXN1; (+) strand; PAM type: NRG; PAM sequence: TGG
cacctgtagtcccagctact

SEQ ID NO: 116310 - DNA, 20 bp, Artificial Sequence
  Description of Artificial Sequence: Synthetic oligonucleotide
  Target: ATXN1; (+) strand; PAM type: NRG; PAM sequence: GGG
acctgtagtcccagctactt

SEQ ID NO: 116311 - DNA, 20 bp, Artificial Sequence
  Description of Artificial Sequence: Synthetic oligonucleotide
  Target: ATXN1; (+) strand; PAM type: NRG; PAM sequence: GGG
cctgtagtcccagctacttg

SEQ ID NO: 116312 - DNA, 20 bp, Artificial Sequence
  Description of Artificial Sequence: Synthetic oligonucleotide
  Target: ATXN1; (+) strand; PAM type: NRG; PAM sequence: GGG
ctgtagtcccagctacttgg

SEQ ID NO: 116313 - DNA, 20 bp, Artificial Sequence
  Description of Artificial Sequence: Synthetic oligonucleotide
  Target: ATXN1; (+) strand; PAM type: NRG; PAM sequence: GGG
tgtagtcccagctacttggg

SEQ ID NO: 116314 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttggggggct

SEQ ID NO: 116315 - DNA, 20 bp, Artificial Sequence
  Description of Artificial Sequence: Synthetic oligonucleotide
  Target: ATXN1; (+) strand; PAM type: NRG; PAM sequence: AGG
cccagctacttggggggctg

SEQ ID NO: 116316 - DNA, 20 bp, Artificial Sequence
  Description of Artificial Sequence: Synthetic oligonucleotide
  Target: ATXN1; (+) strand; PAM type: NRG; PAM sequence: CAG
agctacttggggggctgagg

SEQ ID NO: 116317 - DNA, 20 bp, Artificial Sequence
  Description of Artificial Sequence: Synthetic oligonucleotide
  Target: ATXN1; (+) strand; PAM type: NRG; PAM sequence: AAG
tacttggggggctgaggcag

SEQ ID NO: 116318 - DNA, 20 bp, Artificial Sequence
  Description of Artificial Sequence: Synthetic oligonucleotide
  Target: ATXN1; (+) strand; PAM type: NRG; PAM sequence: AGG
acttggggggctgaggcaga

SEQ ID NO: 116319 - DNA, 20 bp, Artificial Sequence
  Description of Artificial Sequence: Synthetic oligonucleotide
  Target: ATXN1; (+) strand; PAM type: NRG; PAM sequence: AAG
ctgaggcagaaggattgctt

SEQ ID NO: 116320 - DNA, 20 bp, Artificial Sequence
  Description of Artificial Sequence: Synthetic oligonucleotide
  Target: ATXN1; (+) strand; PAM type: NRG; PAM sequence: AAG
cagaaggattgcttaagcct

SEQ ID NO: 116321 - DNA, 20 bp, Artificial Sequence
  Description of Artificial Sequence: Synthetic oligonucleotide
  Target: ATXN1; (+) strand; PAM type: NRG; PAM sequence: GAG
gaaggattgcttaagcctaa

SEQ ID NO: 116322 - DNA, 20 bp, Artificial Sequence
  Description of Artificial Sequence: Synthetic oligonucleotide
  Target: ATXN1; (+) strand; PAM type: NRG; PAM sequence: AAG
ttgcttaagcctaagagttc

SEQ ID NO: 116323 - DNA, 20 bp, Artificial Sequence
  Description of Artificial Sequence: Synthetic oligonucleotide
  Target: ATXN1; (+) strand; PAM type: NRG; PAM sequence: AGG
tgcttaagcctaagagttca

SEQ ID NO: 116324 - DNA, 20 bp, Artificial Sequence
  Description of Artificial Sequence: Synthetic oligonucleotide
  Target: ATXN1; (+) strand; PAM type: NRG; PAM sequence: CAG
agcctaagagttcaaggctg

SEQ ID NO: 116325 - DNA, 20 bp, Artificial Sequence
  Description of Artificial Sequence: Synthetic oligonucleotide
  Target: ATXN1; (+) strand; PAM type: NRG; PAM sequence: GAG
taagagttcaaggctgcagt

SEQ ID NO: 116326 - DNA, 20 bp, Artificial Sequence
  Description of Artificial Sequence: Synthetic oligonucleotide
  Target: ATXN1; (+) strand; PAM type: NRG; PAM sequence: AAG
gttcaaggctgcagtgagcc

SEQ ID NO: 116327 - DNA, 20 bp, Artificial Sequence
  Description of Artificial Sequence: Synthetic oligonucleotide
  Target: ATXN1; (+) strand; PAM type: NRG; PAM sequence: CAG
aagactgtaccactgtactc

SEQ ID NO: 116328 - DNA, 20 bp, Artificial Sequence
  Description of Artificial Sequence: Synthetic oligonucleotide
  Target: ATXN1; (+) strand; PAM type: NRG; PAM sequence: TGG
tgtaccactgtactccagcc

SEQ ID NO: 116329 - DNA, 20 bp, Artificial Sequence
  Description of Artificial Sequence: Synthetic oligonucleotide
  Target: ATXN1; (+) strand; PAM type: NRG; PAM sequence: GGG
gtaccactgtactccagcct

SEQ ID NO: 116330 - DNA, 20 bp, Artificial Sequence
  Description of Artificial Sequence: Synthetic oligonucleotide
  Target: ATXN1; (+) strand; PAM type: NRG; PAM sequence: AAG
gtactccagcctgggtgaca

SEQ ID NO: 116331 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggtgacaaagt

SEQ ID NO: 116332 - DNA, 20 bp, Artificial Sequence
  Description of Artificial Sequence: Synthetic oligonucleotide
  Target: ATXN1; (+) strand; PAM type: NRG; PAM sequence: TGG
aaataaataaataaatctat

SEQ ID NO: 116333 - DNA, 20 bp, Artificial Sequence
  Description of Artificial Sequence: Synthetic oligonucleotide
  Target: ATXN1; (+) strand; PAM type: NRG; PAM sequence: GAG
ataaataaataaatctattg

SEQ ID NO: 116334 - DNA, 20 bp, Artificial Sequence
  Description of Artificial Sequence: Synthetic oligonucleotide
  Target: ATXN1; (+) strand; PAM type: NRG; PAM sequence: TAG
aaaaaaaaaacctacctaaa

SEQ ID NO: 116335 - DNA, 20 bp, Artificial Sequence
  Description of Artificial Sequence: Synthetic oligonucleotide
  Target: ATXN1; (+) strand; PAM type: NRG; PAM sequence: AAG
attgcttataataaaaatga

SEQ ID NO: 116336 - DNA, 20 bp, Artificial Sequence
  Description of Artificial Sequence: Synthetic oligonucleotide
  Target: ATXN1; (+) strand; PAM type: NRG; PAM sequence: TGG
atgaaagatatgcctaaaaa

SEQ ID NO: 116337 - DNA, 20 bp, Artificial Sequence
  Description of Artificial Sequence: Synthetic oligonucleotide
  Target: ATXN1; (+) strand; PAM type: NRG; PAM sequence: AAG
atatgcctaaaaatggtaaa

SEQ ID NO: 116338 - DNA, 20 bp, Artificial Sequence
  Description of Artificial Sequence: Synthetic oligonucleotide
  Target: ATXN1; (+) strand; PAM type: NRG; PAM sequence: AGG
tatgcctaaaaatggtaaaa

SEQ ID NO: 116339 - DNA, 20 bp, Artificial Sequence
  Description of Artificial Sequence: Synthetic oligonucleotide
  Target: ATXN1; (+) strand; PAM type: NRG; PAM sequence: GAG
tgcctaaaaatggtaaaaag

SEQ ID NO: 116340 - DNA, 20 bp, Artificial Sequence
  Description of Artificial Sequence: Synthetic oligonucleotide
  Target: ATXN1; (+) strand; PAM type: NRG; PAM sequence: AAG
atggtaaaaaggagaaaata

SEQ ID NO: 116341 - DNA, 20 bp, Artificial Sequence
  Description of Artificial Sequence: Synthetic oligonucleotide
  Target: ATXN1; (+) strand; PAM type: NRG; PAM sequence: CAG
gtaaaaaggagaaaataaag

SEQ ID NO: 116342 - DNA, 20 bp, Artificial Sequence
  Description of Artificial Sequence: Synthetic oligonucleotide
  Target: ATXN1; (+) strand; PAM type: NRG; PAM sequence: CAG
aaaggagaaaataaagcaga

SEQ ID NO: 116343 - DNA, 20 bp, Artificial Sequence
  Description of Artificial Sequence: Synthetic oligonucleotide
  Target: ATXN1; (+) strand; PAM type: NRG; PAM sequence: AGG
aaggagaaaataaagcagac

SEQ ID NO: 116344 - DNA, 20 bp, Artificial Sequence
  Description of Artificial Sequence: Synthetic oligonucleotide
  Target: ATXN1; (+) strand; PAM type: NRG; PAM sequence: AAG
aataaagcagacaggcatga

SEQ ID NO: 116345 - DNA, 20 bp, Artificial Sequence
  Description of Artificial Sequence: Synthetic oligonucleotide
  Target: ATXN1; (+) strand; PAM type: NRG; PAM sequence: CAG
aagcagacaggcatgaaaga

SEQ ID NO: 116346 - DNA, 20 bp, Artificial Sequence
  Description of Artificial Sequence: Synthetic oligonucleotide
  Target: ATXN1; (+) strand; PAM type: NRG; PAM sequence: TGG
aacgacttcaccttgttttg

SEQ ID NO: 116347 - DNA, 20 bp, Artificial Sequence
  Description of Artificial Sequence: Synthetic oligonucleotide
  Target: ATXN1; (+) strand; PAM type: NRG; PAM sequence: GGG
acgacttcaccttgttttgt

SEQ ID NO: 116348 - DNA, 20 bp, Artificial Sequence
  Description of Artificial Sequence: Synthetic oligonucleotide
  Target: ATXN1; (+) strand; PAM type: NRG; PAM sequence: CAG
ttgttttgtgggttttgttt

SEQ ID NO: 116349 - DNA, 20 bp, Artificial Sequence
  Description of Artificial Sequence: Synthetic oligonucleotide
  Target: ATXN1; (+) strand; PAM type: NRG; PAM sequence: AGG
tgttttgtgggttttgtttc

SEQ ID NO: 116350 - DNA, 20 bp, Artificial Sequence
  Description of Artificial Sequence: Synthetic oligonucleotide
  Target: ATXN1; (+) strand; PAM type: NRG; PAM sequence: AAG
tttttatataattattgaac

SEQ ID NO: 116351 - DNA, 20 bp, Artificial Sequence
  Description of Artificial Sequence: Synthetic oligonucleotide
  Target: ATXN1; (+) strand; PAM type: NRG; PAM sequence: AAG
gaacaagaatcacttttcaa

SEQ ID NO: 116352 - DNA, 20 bp, Artificial Sequence
  Description of Artificial Sequence: Synthetic oligonucleotide
  Target: ATXN1; (+) strand; PAM type: NRG; PAM sequence: TAG
atcacttttcaaaagcctct

SEQ ID NO: 116353 - DNA, 20 bp, Artificial Sequence
  Description of Artificial Sequence: Synthetic oligonucleotide
  Target: ATXN1; (+) strand; PAM type: NRG; PAM sequence: AGG
tcacttttcaaaagcctctt

SEQ ID NO: 116354 - DNA, 20 bp, Artificial Sequence
  Description of Artificial Sequence: Synthetic oligonucleotide
  Target: ATXN1; (+) strand; PAM type: NRG; PAM sequence: AAG
cttttcaaaagcctcttagg

SEQ ID NO: 116355 - DNA, 20 bp, Artificial Sequence
  Description of Artificial Sequence: Synthetic oligonucleotide
  Target: ATXN1; (+) strand; PAM type: NRG; PAM sequence: AAG
tcttaggaagtctcaaatta

SEQ ID NO: 116356 - DNA, 20 bp, Artificial Sequence
  Description of Artificial Sequence: Synthetic oligonucleotide
  Target: ATXN1; (+) strand; PAM type: NRG; PAM sequence: AAG
aggaagtctcaaattaaagt

SEQ ID NO: 116357 - DNA, 20 bp, Artificial Sequence
  Description of Artificial Sequence: Synthetic oligonucleotide
  Target: ATXN1; (+) strand; PAM type: NRG; PAM sequence: CAG
agtgaactcaaatgtatatc

SEQ ID NO: 116358 - DNA, 20 bp, Artificial Sequence
  Description of Artificial Sequence: Synthetic oligonucleotide
  Target: ATXN1; (+) strand; PAM type: NRG; PAM sequence: TGG
tcaaatgtatatccagttat

SEQ ID NO: 116359 - DNA, 20 bp, Artificial Sequence
  Description of Artificial Sequence: Synthetic oligonucleotide
  Target: ATXN1; (+) strand; PAM type: NRG; PAM sequence: CAG
cagttattggcataaacaca

SEQ ID NO: 116360 - DNA, 20 bp, Artificial Sequence
  Description of Artificial Sequence: Synthetic oligonucleotide
  Target: ATXN1; (+) strand; PAM type: NRG; PAM sequence: TAG
gtaatgtaattgtccatctc

SEQ ID NO: 116361 - DNA, 20 bp, Artificial Sequence
  Description of Artificial Sequence: Synthetic oligonucleotide
  Target: ATXN1; (+) strand; PAM type: NRG; PAM sequence: CAG
gtaattgtccatctctagcc

SEQ ID NO: 116362 - DNA, 20 bp, Artificial Sequence
  Description of Artificial Sequence: Synthetic oligonucleotide
  Target: ATXN1; (+) strand; PAM type: NRG; PAM sequence: TGG
attgtccatctctagcccag

SEQ ID NO: 116363 - DNA, 20 bp, Artificial Sequence
  Description of Artificial Sequence: Synthetic oligonucleotide
  Target: ATXN1; (+) strand; PAM type: NRG; PAM sequence: CAG
aaaaaaaccttaaacatttt

SEQ ID NO: 116364 - DNA, 20 bp, Artificial Sequence
  Description of Artificial Sequence: Synthetic oligonucleotide
  Target: ATXN1; (+) strand; PAM type: NRG; PAM sequence: AAG
aaaccttaaacattttcagt

SEQ ID NO: 116365 - DNA, 20 bp, Artificial Sequence
  Description of Artificial Sequence: Synthetic oligonucleotide
  Target: ATXN1; (+) strand; PAM type: NRG; PAM sequence: TGG
gcatattgttgcaatgtcac

SEQ ID NO: 116366 - DNA, 20 bp, Artificial Sequence
  Description of Artificial Sequence: Synthetic oligonucleotide
  Target: ATXN1; (+) strand; PAM type: NRG; PAM sequence: CGG
atgtcactggcatttttgtt

SEQ ID NO: 116367 - DNA, 20 bp, Artificial Sequence
  Description of Artificial Sequence: Synthetic oligonucleotide
  Target: ATXN1; (+) strand; PAM type: NRG; PAM sequence: AAG
ttttgttcggaaattattgc

SEQ ID NO: 116368 - DNA, 20 bp, Artificial Sequence
  Description of Artificial Sequence: Synthetic oligonucleotide
  Target: ATXN1; (+) strand; PAM type: NRG; PAM sequence: TAG
ttcggaaattattgcaagtg

SEQ ID NO: 116369 - DNA, 20 bp, Artificial Sequence
  Description of Artificial Sequence: Synthetic oligonucleotide
  Target: ATXN1; (+) strand; PAM type: NRG; PAM sequence: TGG
aaattattgcaagtgtagtg

SEQ ID NO: 116370 - DNA, 20 bp, Artificial Sequence
  Description of Artificial Sequence: Synthetic oligonucleotide
  Target: ATXN1; (+) strand; PAM type: NRG; PAM sequence: GGG
aattattgcaagtgtagtgt

SEQ ID NO: 116371 - DNA, 20 bp, Artificial Sequence
  Description of Artificial Sequence: Synthetic oligonucleotide
  Target: ATXN1; (+) strand; PAM type: NRG; PAM sequence: GAG
ttattgcaagtgtagtgtgg

SEQ ID NO: 116372 - DNA, 20 bp, Artificial Sequence
  Description of Artificial Sequence: Synthetic oligonucleotide
  Target: ATXN1; (+) strand; PAM type: NRG; PAM sequence: AAG
tgcaagtgtagtgtgggaga

SEQ ID NO: 116373 - DNA, 20 bp, Artificial Sequence
  Description of Artificial Sequence: Synthetic oligonucleotide
  Target: ATXN1; (+) strand; PAM type: NRG; PAM sequence: GAG
tagtgtgggagaaagtaaat

SEQ ID NO: 116374 - DNA, 20 bp, Artificial Sequence
  Description of Artificial Sequence: Synthetic oligonucleotide
  Target: ATXN1; (+) strand; PAM type: NRG; PAM sequence: TGG
agtaaatgagtaaattgtgt

SEQ ID NO: 116375 - DNA, 20 bp, Artificial Sequence
  Description of Artificial Sequence: Synthetic oligonucleotide
  Target: ATXN1; (+) strand; PAM type: NRG; PAM sequence: GAG
tgagtaaattgtgttggtgt

SEQ ID NO: 116376 - DNA, 20 bp, Artificial Sequence
  Description of Artificial Sequence: Synthetic oligonucleotide
  Target: ATXN1; (+) strand; PAM type: NRG; PAM sequence: GAG
taaattgtgttggtgtgagt

SEQ ID NO: 116377 - DNA, 20 bp, Artificial Sequence
  Description of Artificial Sequence: Synthetic oligonucleotide
  Target: ATXN1; (+) strand; PAM type: NRG; PAM sequence: CAG
tgagtgagaactgctatttt

SEQ ID NO: 116378 - DNA, 20 bp, Artificial Sequence
  Description of Artificial Sequence: Synthetic oligonucleotide
  Target: ATXN1; (+) strand; PAM type: NRG; PAM sequence: GAG
agaactgctattttcagttt

SEQ ID NO: 116379 - DNA, 20 bp, Artificial Sequence
  Description of Artificial Sequence: Synthetic oligonucleotide
  Target: ATXN1; (+) strand; PAM type: NRG; PAM sequence: GAG
aactgctattttcagtttga

SEQ ID NO: 116380 - DNA, 20 bp, Artificial Sequence
  Description of Artificial Sequence: Synthetic oligonucleotide
  Target: ATXN1; (+) strand; PAM type: NRG; PAM sequence: AAG
gctattttcagtttgagaga

SEQ ID NO: 116381 - DNA, 20 bp, Artificial Sequence
  Description of Artificial Sequence: Synthetic oligonucleotide
  Target: ATXN1; (+) strand; PAM type: NRG; PAM sequence: AAG
atactgatgtaaaatgaatg

SEQ ID NO: 116382 - DNA, 20 bp, Artificial Sequence
  Description of Artificial Sequence: Synthetic oligonucleotide
  Target: ATXN1; (+) strand; PAM type: NRG; PAM sequence: AAG
gatgtaaaatgaatgaagtt

SEQ ID NO: 116383 - DNA, 20 bp, Artificial Sequence
  Description of Artificial Sequence: Synthetic oligonucleotide
  Target: ATXN1; (+) strand; PAM type: NRG; PAM sequence: AAG
aaatgaatgaagttaagtaa

SEQ ID NO: 116384 - DNA, 20 bp, Artificial Sequence
  Description of Artificial Sequence: Synthetic oligonucleotide
  Target: ATXN1; (+) strand; PAM type: NRG; PAM sequence: TGG
gaagttaagtaaaagccttg

SEQ ID NO: 116385 - DNA, 20 bp, Artificial Sequence
  Description of Artificial Sequence: Synthetic oligonucleotide
  Target: ATXN1; (+) strand; PAM type: NRG; PAM sequence: CAG
gtaaaagccttgtggcacat

SEQ ID NO: 116386 - DNA, 20 bp, Artificial Sequence
  Description of Artificial Sequence: Synthetic oligonucleotide
  Target: ATXN1; (+) strand; PAM type: NRG; PAM sequence: GAG
gcacatcagtataaactcat

SEQ ID NO: 116387 - DNA, 20 bp, Artificial Sequence
  Description of Artificial Sequence: Synthetic oligonucleotide
  Target: ATXN1; (+) strand; PAM type: NRG; PAM sequence: AGG
cacatcagtataaactcatg

SEQ ID NO: 116388 - DNA, 20 bp, Artificial Sequence
  Description of Artificial Sequence: Synthetic oligonucleotide
  Target: ATXN1; (+) strand; PAM type: NRG; PAM sequence: CGG
ccttaaaaaatacgtacaca

SEQ ID NO: 116389 - DNA, 20 bp, Artificial Sequence
  Description of Artificial Sequence: Synthetic oligonucleotide
  Target: ATXN1; (+) strand; PAM type: NRG; PAM sequence: CAG
aaaaaatacgtacacacggc

SEQ ID NO: 116390 - DNA, 20 bp, Artificial Sequence
  Description of Artificial Sequence: Synthetic oligonucleotide
  Target: ATXN1; (+) strand; PAM type: NRG; PAM sequence: AGG
aaaaatacgtacacacggcc

SEQ ID NO: 116391 - DNA, 20 bp, Artificial Sequence
  Description of Artificial Sequence: Synthetic oligonucleotide
  Target: ATXN1; (+) strand; PAM type: NRG; PAM sequence: TGG
gtacacacggccaggcacga

SEQ ID NO: 116392 - DNA, 20 bp, Artificial Sequence
  Description of Artificial Sequence: Synthetic oligonucleotide
  Target: ATXN1; (+) strand; PAM type: NRG; PAM sequence: CAG
atggctcatgcctgtaatcc

SEQ ID NO: 116393 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagcactt

SEQ ID NO: 116394 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 116395 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 116396 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 116397 - DNA, 20 bp, Artificial Sequence
  Description of Artificial Sequence: Synthetic oligonucleotide
  Target: ATXN1; (+) strand; PAM type: NRG; PAM sequence: AAG
tcccagcactttgggaggcc

SEQ ID NO: 116398 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggcca

SEQ ID NO: 116399 - DNA, 20 bp, Artificial Sequence
  Description of Artificial Sequence: Synthetic oligonucleotide
  Target: ATXN1; (+) strand; PAM type: NRG; PAM sequence: GAG
cagcactttgggaggccaag

SEQ ID NO: 116400 - DNA, 20 bp, Artificial Sequence
  Description of Artificial Sequence: Synthetic oligonucleotide
  Target: ATXN1; (+) strand; PAM type: NRG; PAM sequence: AGG
agcactttgggaggccaagg

SEQ ID NO: 116401 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccaagga

SEQ ID NO: 116402 - DNA, 20 bp, Artificial Sequence
  Description of Artificial Sequence: Synthetic oligonucleotide
  Target: ATXN1; (+) strand; PAM type: NRG; PAM sequence: AAG
ggccaaggagggccgatcac

SEQ ID NO: 116403 - DNA, 20 bp, Artificial Sequence
  Description of Artificial Sequence: Synthetic oligonucleotide
  Target: ATXN1; (+) strand; PAM type: NRG; PAM sequence: AGG
gccaaggagggccgatcaca

SEQ ID NO: 116404 - DNA, 20 bp, Artificial Sequence
  Description of Artificial Sequence: Synthetic oligonucleotide
  Target: ATXN1; (+) strand; PAM type: NRG; PAM sequence: CAG
aggagggccgatcacaaggt

SEQ ID NO: 116405 - DNA, 20 bp, Artificial Sequence
  Description of Artificial Sequence: Synthetic oligonucleotide
  Target: ATXN1; (+) strand; PAM type: NRG; PAM sequence: AGG
ggagggccgatcacaaggtc

SEQ ID NO: 116406 - DNA, 20 bp, Artificial Sequence
  Description of Artificial Sequence: Synthetic oligonucleotide
  Target: ATXN1; (+) strand; PAM type: NRG; PAM sequence: GAG
agggccgatcacaaggtcag

SEQ ID NO: 116407 - DNA, 20 bp, Artificial Sequence
  Description of Artificial Sequence: Synthetic oligonucleotide
  Target: ATXN1; (+) strand; PAM type: NRG; PAM sequence: GAG
gatcacaaggtcaggagatc

SEQ ID NO: 116408 - DNA, 20 bp, Artificial Sequence
  Description of Artificial Sequence: Synthetic oligonucleotide
  Target: ATXN1; (+) strand; PAM type: NRG; PAM sequence: TGG
tcaggagatcgagaccatcc

SEQ ID NO: 116409 - DNA, 20 bp, Artificial Sequence
  Description of Artificial Sequence: Synthetic oligonucleotide
  Target: ATXN1; (+) strand; PAM type: NRG; PAM sequence: CAG
cgagaccatcctggctaaca

SEQ ID NO: 116410 - DNA, 20 bp, Artificial Sequence
  Description of Artificial Sequence: Synthetic oligonucleotide
  Target: ATXN1; (+) strand; PAM type: NRG; PAM sequence: CAG
aaccccgtctctactaaaaa

SEQ ID NO: 116411 - DNA, 20 bp, Artificial Sequence
  Description of Artificial Sequence: Synthetic oligonucleotide
  Target: ATXN1; (+) strand; PAM type: NRG; PAM sequence: AAG
cgtctctactaaaaacagaa

SEQ ID NO: 116412 - DNA, 20 bp, Artificial Sequence
  Description of Artificial Sequence: Synthetic oligonucleotide
  Target: ATXN1; (+) strand; PAM type: NRG; PAM sequence: TAG
ctactaaaaacagaaaagat

SEQ ID NO: 116413 - DNA, 20 bp, Artificial Sequence
  Description of Artificial Sequence: Synthetic oligonucleotide
  Target: ATXN1; (+) strand; PAM type: NRG; PAM sequence: CAG
taaaaacagaaaagattagc

SEQ ID NO: 116414 - DNA, 20 bp, Artificial Sequence
  Description of Artificial Sequence: Synthetic oligonucleotide
  Target: ATXN1; (+) strand; PAM type: NRG; PAM sequence: AGG
aaaaacagaaaagattagcc

SEQ ID NO: 116415 - DNA, 20 bp, Artificial Sequence
  Description of Artificial Sequence: Synthetic oligonucleotide
  Target: ATXN1; (+) strand; PAM type: NRG; PAM sequence: TGG
cagaaaagattagccaggcg

SEQ ID NO: 116416 - DNA, 20 bp, Artificial Sequence
  Description of Artificial Sequence: Synthetic oligonucleotide
  Target: ATXN1; (+) strand; PAM type: NRG; PAM sequence: TGG
aaaagattagccaggcgtgg

SEQ ID NO: 116417 - DNA, 20 bp, Artificial Sequence
  Description of Artificial Sequence: Synthetic oligonucleotide
  Target: ATXN1; (+) strand; PAM type: NRG; PAM sequence: CGG
agattagccaggcgtggtgg

SEQ ID NO: 116418 - DNA, 20 bp, Artificial Sequence
  Description of Artificial Sequence: Synthetic oligonucleotide
  Target: ATXN1; (+) strand; PAM type: NRG; PAM sequence: GGG
gattagccaggcgtggtggc

SEQ ID NO: 116419 - DNA, 20 bp, Artificial Sequence
  Description of Artificial Sequence: Synthetic oligonucleotide
  Target: ATXN1; (+) strand; PAM type: NRG; PAM sequence: TAG
ggcgtggtggcgggcgcctg

SEQ ID NO: 116420 - DNA, 20 bp, Artificial Sequence
  Description of Artificial Sequence: Synthetic oligonucleotide
  Target: ATXN1; (+) strand; PAM type: NRG; PAM sequence: CAG
gtggcgggcgcctgtagtcc

SEQ ID NO: 116421 - DNA, 20 bp, Artificial Sequence
  Description of Artificial Sequence: Synthetic oligonucleotide
  Target: ATXN1; (+) strand; PAM type: NRG; PAM sequence: CGG
cgcctgtagtcccagctact

SEQ ID NO: 116422 - DNA, 20 bp, Artificial Sequence
  Description of Artificial Sequence: Synthetic oligonucleotide
  Target: ATXN1; (+) strand; PAM type: NRG; PAM sequence: GGG
gcctgtagtcccagctactc

SEQ ID NO: 116423 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagctactcgg

SEQ ID NO: 116424 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagctactcggg

SEQ ID NO: 116425 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcgggaggct

SEQ ID NO: 116426 - DNA, 20 bp, Artificial Sequence
  Description of Artificial Sequence: Synthetic oligonucleotide
  Target: ATXN1; (+) strand; PAM type: NRG; PAM sequence: AGG
cccagctactcgggaggctg

SEQ ID NO: 116427 - DNA, 20 bp, Artificial Sequence
  Description of Artificial Sequence: Synthetic oligonucleotide
  Target: ATXN1; (+) strand; PAM type: NRG; PAM sequence: CAG
agctactcgggaggctgagg

SEQ ID NO: 116428 - DNA, 20 bp, Artificial Sequence
  Description of Artificial Sequence: Synthetic oligonucleotide
  Target: ATXN1; (+) strand; PAM type: NRG; PAM sequence: AGG
gctactcgggaggctgaggc

SEQ ID NO: 116429 - DNA, 20 bp, Artificial Sequence
  Description of Artificial Sequence: Synthetic oligonucleotide
  Target: ATXN1; (+) strand; PAM type: NRG; PAM sequence: GAG
tactcgggaggctgaggcag

SEQ ID NO: 116430 - DNA, 20 bp, Artificial Sequence
  Description of Artificial Sequence: Synthetic oligonucleotide
  Target: ATXN1; (+) strand; PAM type: NRG; PAM sequence: TGG
gggaggctgaggcaggagaa

SEQ ID NO: 116431 - DNA, 20 bp, Artificial Sequence
  Description of Artificial Sequence: Synthetic oligonucleotide
  Target: ATXN1; (+) strand; PAM type: NRG; PAM sequence: TGG
gcaggagaatggcgtgaacc

SEQ ID NO: 116432 - DNA, 20 bp, Artificial Sequence
  Description of Artificial Sequence: Synthetic oligonucleotide
  Target: ATXN1; (+) strand; PAM type: NRG; PAM sequence: GGG
caggagaatggcgtgaacct

SEQ ID NO: 116433 - DNA, 20 bp, Artificial Sequence
  Description of Artificial Sequence: Synthetic oligonucleotide
  Target: ATXN1; (+) strand; PAM type: NRG; PAM sequence: GAG
ggagaatggcgtgaacctgg

SEQ ID NO: 116434 - DNA, 20 bp, Artificial Sequence
  Description of Artificial Sequence: Synthetic oligonucleotide
  Target: ATXN1; (+) strand; PAM type: NRG; PAM sequence: AGG
gagaatggcgtgaacctggg

SEQ ID NO: 116435 - DNA, 20 bp, Artificial Sequence
  Description of Artificial Sequence: Synthetic oligonucleotide
  Target: ATXN1; (+) strand; PAM type: NRG; PAM sequence: TGG
aatggcgtgaacctgggagg

SEQ ID NO: 116436 - DNA, 20 bp, Artificial Sequence
  Description of Artificial Sequence: Synthetic oligonucleotide
  Target: ATXN1; (+) strand; PAM type: NRG; PAM sequence: GAG
tggcgtgaacctgggaggtg

SEQ ID NO: 116437 - DNA, 20 bp, Artificial Sequence
  Description of Artificial Sequence: Synthetic oligonucleotide
  Target: ATXN1; (+) strand; PAM type: NRG; PAM sequence: CAG
aacctgggaggtggagcttg

SEQ ID NO: 116438 - DNA, 20 bp, Artificial Sequence
  Description of Artificial Sequence: Synthetic oligonucleotide
  Target: ATXN1; (+) strand; PAM type: NRG; PAM sequence: GAG
tgggaggtggagcttgcagt

SEQ ID NO: 116439 - DNA, 20 bp, Artificial Sequence
  Description of Artificial Sequence: Synthetic oligonucleotide
  Target: ATXN1; (+) strand; PAM type: NRG; PAM sequence: GAG
ggtggagcttgcagtgagcc

SEQ ID NO: 116440 - DNA, 20 bp, Artificial Sequence
  Description of Artificial Sequence: Synthetic oligonucleotide
  Target: ATXN1; (+) strand; PAM type: NRG; PAM sequence: CAG
gagattgcgccactgcattc

SEQ ID NO: 116441 - DNA, 20 bp, Artificial Sequence
  Description of Artificial Sequence: Synthetic oligonucleotide
  Target: ATXN1; (+) strand; PAM type: NRG; PAM sequence: TGG
tgcgccactgcattccagcc

SEQ ID NO: 116442 - DNA, 20 bp, Artificial Sequence
  Description of Artificial Sequence: Synthetic oligonucleotide
  Target: ATXN1; (+) strand; PAM type: NRG; PAM sequence: GGG
gcgccactgcattccagcct

SEQ ID NO: 116443 - DNA, 20 bp, Artificial Sequence
  Description of Artificial Sequence: Synthetic oligonucleotide
  Target: ATXN1; (+) strand; PAM type: NRG; PAM sequence: CAG
ctgcattccagcctgggcga

SEQ ID NO: 116444 - DNA, 20 bp, Artificial Sequence
  Description of Artificial Sequence: Synthetic oligonucleotide
  Target: ATXN1; (+) strand; PAM type: NRG; PAM sequence: GAG
gcattccagcctgggcgaca

SEQ ID NO: 116445 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggcgacagagc

SEQ ID NO: 116446 - DNA, 20 bp, Artificial Sequence
  Description of Artificial Sequence: Synthetic oligonucleotide
  Target: ATXN1; (+) strand; PAM type: NRG; PAM sequence: AGG
ccagcctgggcgacagagcg

SEQ ID NO: 116447 - DNA, 20 bp, Artificial Sequence
  Description of Artificial Sequence: Synthetic oligonucleotide
  Target: ATXN1; (+) strand; PAM type: NRG; PAM sequence: AAG
gtctcaaaaaaaaaaaaaaa

SEQ ID NO: 116448 - DNA, 20 bp, Artificial Sequence
  Description of Artificial Sequence: Synthetic oligonucleotide
  Target: ATXN1; (+) strand; PAM type: NRG; PAM sequence: TAG
aatcgatctatatctatatc

SEQ ID NO: 116449 - DNA, 20 bp, Artificial Sequence
  Description of Artificial Sequence: Synthetic oligonucleotide
  Target: ATXN1; (+) strand; PAM type: NRG; PAM sequence: GAG
tcgatctatatctatatcta

SEQ ID NO: 116450 - DNA, 20 bp, Artificial Sequence
  Description of Artificial Sequence: Synthetic oligonucleotide
  Target: ATXN1; (+) strand; PAM type: NRG; PAM sequence: GAG
gatctatatctatatctaga

SEQ ID NO: 116451 - DNA, 20 bp, Artificial Sequence
  Description of Artificial Sequence: Synthetic oligonucleotide
  Target: ATXN1; (+) strand; PAM type: NRG; PAM sequence: CAG
tatctatatctagagagaca

SEQ ID NO: 116452 - DNA, 20 bp, Artificial Sequence
  Description of Artificial Sequence: Synthetic oligonucleotide
  Target: ATXN1; (+) strand; PAM type: NRG; PAM sequence: TGG
agacacagatttcctatcac

SEQ ID NO: 116453 - DNA, 20 bp, Artificial Sequence
  Description of Artificial Sequence: Synthetic oligonucleotide
  Target: ATXN1; (+) strand; PAM type: NRG; PAM sequence: TGG
ctatcactggctgtgtccac

SEQ ID NO: 116454 - DNA, 20 bp, Artificial Sequence
  Description of Artificial Sequence: Synthetic oligonucleotide
  Target: ATXN1; (+) strand; PAM type: NRG; PAM sequence: AAG
cactggctgtgtccactgga

SEQ ID NO: 116455 - DNA, 20 bp, Artificial Sequence
  Description of Artificial Sequence: Synthetic oligonucleotide
  Target: ATXN1; (+) strand; PAM type: NRG; PAM sequence: AGG
actggctgtgtccactggaa

SEQ ID NO: 116456 - DNA, 20 bp, Artificial Sequence
  Description of Artificial Sequence: Synthetic oligonucleotide
  Target: ATXN1; (+) strand; PAM type: NRG; PAM sequence: CAG
aggaaaaacaatattcaacc

SEQ ID NO: 116457 - DNA, 20 bp, Artificial Sequence
  Description of Artificial Sequence: Synthetic oligonucleotide
  Target: ATXN1; (+) strand; PAM type: NRG; PAM sequence: GAG
aaaacaatattcaacccagt

SEQ ID NO: 116458 - DNA, 20 bp, Artificial Sequence
  Description of Artificial Sequence: Synthetic oligonucleotide
  Target: ATXN1; (+) strand; PAM type: NRG; PAM sequence: CAG
aatattcaacccagtgagaa

SEQ ID NO: 116459 - DNA, 20 bp, Artificial Sequence
  Description of Artificial Sequence: Synthetic oligonucleotide
  Target: ATXN1; (+) strand; PAM type: NRG; PAM sequence: TGG
cccagtgagaacagttcccc

SEQ ID NO: 116460 - DNA, 20 bp, Artificial Sequence
  Description of Artificial Sequence: Synthetic oligonucleotide
  Target: ATXN1; (+) strand; PAM type: NRG; PAM sequence: GGG
ccagtgagaacagttcccct

SEQ ID NO: 116461 - DNA, 20 bp, Artificial Sequence
  Description of Artificial Sequence: Synthetic oligonucleotide
  Target: ATXN1; (+) strand; PAM type: NRG; PAM sequence: GGG
cagtgagaacagttcccctg

SEQ ID NO: 116462 - DNA, 20 bp, Artificial Sequence
  Description of Artificial Sequence: Synthetic oligonucleotide
  Target: ATXN1; (+) strand; PAM type: NRG; PAM sequence: CAG
agaacagttcccctggggcc

SEQ ID NO: 116463 - DNA, 20 bp, Artificial Sequence
  Description of Artificial Sequence: Synthetic oligonucleotide
  Target: ATXN1; (+) strand; PAM type: NRG; PAM sequence: TGG
ttcccctggggcccagtctt

SEQ ID NO: 116464 - DNA, 20 bp, Artificial Sequence
  Description of Artificial Sequence: Synthetic oligonucleotide
  Target: ATXN1; (+) strand; PAM type: NRG; PAM sequence: AAG
caaatatcatttctcactga

SEQ ID NO: 116465 - DNA, 20 bp, Artificial Sequence
  Description of Artificial Sequence: Synthetic oligonucleotide
  Target: ATXN1; (+) strand; PAM type: NRG; PAM sequence: CAG
catttctcactgaaagaaac

SEQ ID NO: 116466 - DNA, 20 bp, Artificial Sequence
  Description of Artificial Sequence: Synthetic oligonucleotide
  Target: ATXN1; (+) strand; PAM type: NRG; PAM sequence: AGG
atttctcactgaaagaaacc

SEQ ID NO: 116467 - DNA, 20 bp, Artificial Sequence
  Description of Artificial Sequence: Synthetic oligonucleotide
  Target: ATXN1; (+) strand; PAM type: NRG; PAM sequence: TGG
tgaaagaaaccaggtctcct

SEQ ID NO: 116468 - DNA, 20 bp, Artificial Sequence
  Description of Artificial Sequence: Synthetic oligonucleotide
  Target: ATXN1; (+) strand; PAM type: NRG; PAM sequence: AAG
aaccaggtctccttggaaaa

SEQ ID NO: 116469 - DNA, 20 bp, Artificial Sequence
  Description of Artificial Sequence: Synthetic oligonucleotide
  Target: ATXN1; (+) strand; PAM type: NRG; PAM sequence: CAG
ccttggaaaaaagctgatcc

SEQ ID NO: 116470 - DNA, 20 bp, Artificial Sequence
  Description of Artificial Sequence: Synthetic oligonucleotide
  Target: ATXN1; (+) strand; PAM type: NRG; PAM sequence: GAG
ttggaaaaaagctgatccca

SEQ ID NO: 116471 - DNA, 20 bp, Artificial Sequence
  Description of Artificial Sequence: Synthetic oligonucleotide
  Target: ATXN1; (+) strand; PAM type: NRG; PAM sequence: AAG
aaaaagctgatcccagagct

SEQ ID NO: 116472 - DNA, 20 bp, Artificial Sequence
  Description of Artificial Sequence: Synthetic oligonucleotide
  Target: ATXN1; (+) strand; PAM type: NRG; PAM sequence: AGG
aaaagctgatcccagagcta

SEQ ID NO: 116473 - DNA, 20 bp, Artificial Sequence
  Description of Artificial Sequence: Synthetic oligonucleotide
  Target: ATXN1; (+) strand; PAM type: NRG; PAM sequence: AAG
gctgatcccagagctaaggc

SEQ ID NO: 116474 - DNA, 20 bp, Artificial Sequence
  Description of Artificial Sequence: Synthetic oligonucleotide
  Target: ATXN1; (+) strand; PAM type: NRG; PAM sequence: AAG
agctaaggcaagaaatgtac

SEQ ID NO: 116475 - DNA, 20 bp, Artificial Sequence
  Description of Artificial Sequence: Synthetic oligonucleotide
  Target: ATXN1; (+) strand; PAM type: NRG; PAM sequence: GAG
aggcaagaaatgtacaagat

SEQ ID NO: 116476 - DNA, 20 bp, Artificial Sequence
  Description of Artificial Sequence: Synthetic oligonucleotide
  Target: ATXN1; (+) strand; PAM type: NRG; PAM sequence: TGG
agaaatgtacaagatgagcc

SEQ ID NO: 116477 - DNA, 20 bp, Artificial Sequence
  Description of Artificial Sequence: Synthetic oligonucleotide
  Target: ATXN1; (+) strand; PAM type: NRG; PAM sequence: TAG
tacaagatgagcctggaaca

SEQ ID NO: 116478 - DNA, 20 bp, Artificial Sequence
  Description of Artificial Sequence: Synthetic oligonucleotide
  Target: ATXN1; (+) strand; PAM type: NRG; PAM sequence: TAG
cctggaacatagtgttatac

SEQ ID NO: 116479 - DNA, 20 bp, Artificial Sequence
  Description of Artificial Sequence: Synthetic oligonucleotide
  Target: ATXN1; (+) strand; PAM type: NRG; PAM sequence: AAG
gaacatagtgttatactaga

SEQ ID NO: 116480 - DNA, 20 bp, Artificial Sequence
  Description of Artificial Sequence: Synthetic oligonucleotide
  Target: ATXN1; (+) strand; PAM type: NRG; PAM sequence: AAG
atagtgttatactagaaagc

SEQ ID NO: 116481 - DNA, 20 bp, Artificial Sequence
  Description of Artificial Sequence: Synthetic oligonucleotide
  Target: ATXN1; (+) strand; PAM type: NRG; PAM sequence: AAG
agaaagcaagaaaactatca

SEQ ID NO: 116482 - DNA, 20 bp, Artificial Sequence
  Description of Artificial Sequence: Synthetic oligonucleotide
  Target: ATXN1; (+) strand; PAM type: NRG; PAM sequence: CAG
agcaagaaaactatcaaaga

SEQ ID NO: 116483 - DNA, 20 bp, Artificial Sequence
  Description of Artificial Sequence: Synthetic oligonucleotide
  Target: ATXN1; (+) strand; PAM type: NRG; PAM sequence: CAG
agaaaactatcaaagacagc

SEQ ID NO: 116484 - DNA, 20 bp, Artificial Sequence
  Description of Artificial Sequence: Synthetic oligonucleotide
  Target: ATXN1; (+) strand; PAM type: NRG; PAM sequence: TGG
ctatcaaagacagccagtat

SEQ ID NO: 116485 - DNA, 20 bp, Artificial Sequence
  Description of Artificial Sequence: Synthetic oligonucleotide
  Target: ATXN1; (+) strand; PAM type: NRG; PAM sequence: AAG
gacagccagtattggattaa

SEQ ID NO: 116486 - DNA, 20 bp, Artificial Sequence
  Description of Artificial Sequence: Synthetic oligonucleotide
  Target: ATXN1; (+) strand; PAM type: NRG; PAM sequence: AGG
acagccagtattggattaaa

SEQ ID NO: 116487 - DNA, 20 bp, Artificial Sequence
  Description of Artificial Sequence: Synthetic oligonucleotide
  Target: ATXN1; (+) strand; PAM type: NRG; PAM sequence: CAG
agtattggattaaaaggact

SEQ ID NO: 116488 - DNA, 20 bp, Artificial Sequence
  Description of Artificial Sequence: Synthetic oligonucleotide
  Target: ATXN1; (+) strand; PAM type: NRG; PAM sequence: TAG
attggattaaaaggactcag

SEQ ID NO: 116489 - DNA, 20 bp, Artificial Sequence
  Description of Artificial Sequence: Synthetic oligonucleotide
  Target: ATXN1; (+) strand; PAM type: NRG; PAM sequence: TAG
gactcagtagccaaactgaa

SEQ ID NO: 116490 - DNA, 20 bp, Artificial Sequence
  Description of Artificial Sequence: Synthetic oligonucleotide
  Target: ATXN1; (+) strand; PAM type: NRG; PAM sequence: AGG
actcagtagccaaactgaat

SEQ ID NO: 116491 - DNA, 20 bp, Artificial Sequence
  Description of Artificial Sequence: Synthetic oligonucleotide
  Target: ATXN1; (+) strand; PAM type: NRG; PAM sequence: CAG
ctgaataggatcccaatgct

SEQ ID NO: 116492 - DNA, 20 bp, Artificial Sequence
  Description of Artificial Sequence: Synthetic oligonucleotide
  Target: ATXN1; (+) strand; PAM type: NRG; PAM sequence: CAG
ataggatcccaatgctcaga

SEQ ID NO: 116493 - DNA, 20 bp, Artificial Sequence
  Description of Artificial Sequence: Synthetic oligonucleotide
  Target: ATXN1; (+) strand; PAM type: NRG; PAM sequence: AGG
taggatcccaatgctcagac

SEQ ID NO: 116494 - DNA, 20 bp, Artificial Sequence
  Description of Artificial Sequence: Synthetic oligonucleotide
  Target: ATXN1; (+) strand; PAM type: NRG; PAM sequence: GGG
aggatcccaatgctcagaca

SEQ ID NO: 116495 - DNA, 20 bp, Artificial Sequence
  Description of Artificial Sequence: Synthetic oligonucleotide
  Target: ATXN1; (+) strand; PAM type: NRG; PAM sequence: GGG
ggatcccaatgctcagacag

SEQ ID NO: 116496 - DNA, 20 bp, Artificial Sequence
  Description of Artificial Sequence: Synthetic oligonucleotide
  Target: ATXN1; (+) strand; PAM type: NRG; PAM sequence: AAG
gggaccatctgaacatgaaa

SEQ ID NO: 116497 - DNA, 20 bp, Artificial Sequence
  Description of Artificial Sequence: Synthetic oligonucleotide
  Target: ATXN1; (+) strand; PAM type: NRG; PAM sequence: AGG
ggaccatctgaacatgaaaa

SEQ ID NO: 116498 - DNA, 20 bp, Artificial Sequence
  Description of Artificial Sequence: Synthetic oligonucleotide
  Target: ATXN1; (+) strand; PAM type: NRG; PAM sequence: GGG
gaccatctgaacatgaaaaa

SEQ ID NO: 116499 - DNA, 20 bp, Artificial Sequence
  Description of Artificial Sequence: Synthetic oligonucleotide
  Target: ATXN1; (+) strand; PAM type: NRG; PAM sequence: TGG
aaaaagggtaatcactgtca

SEQ ID NO: 116500 - DNA, 20 bp, Artificial Sequence
  Description of Artificial Sequence: Synthetic oligonucleotide
  Target: ATXN1; (+) strand; PAM type: NRG; PAM sequence: CAG
tgtcatggactgaaacacaa

SEQ ID NO: 116501 - DNA, 20 bp, Artificial Sequence
  Description of Artificial Sequence: Synthetic oligonucleotide
  Target: ATXN1; (+) strand; PAM type: NRG; PAM sequence: CAG
tgctgcaatctatgaattta

SEQ ID NO: 116502 - DNA, 20 bp, Artificial Sequence
  Description of Artificial Sequence: Synthetic oligonucleotide
  Target: ATXN1; (+) strand; PAM type: NRG; PAM sequence: CAG
acagtcatgctttcaaaaca

SEQ ID NO: 116503 - DNA, 20 bp, Artificial Sequence
  Description of Artificial Sequence: Synthetic oligonucleotide
  Target: ATXN1; (+) strand; PAM type: NRG; PAM sequence: TGG
gctttcaaaacacagtgact

SEQ ID NO: 116504 - DNA, 20 bp, Artificial Sequence
  Description of Artificial Sequence: Synthetic oligonucleotide
  Target: ATXN1; (+) strand; PAM type: NRG; PAM sequence: TAG
cttggtttgacactgtgaac

SEQ ID NO: 116505 - DNA, 20 bp, Artificial Sequence
  Description of Artificial Sequence: Synthetic oligonucleotide
  Target: ATXN1; (+) strand; PAM type: NRG; PAM sequence: TGG
actagctgtatcgtgcaaat

SEQ ID NO: 116506 - DNA, 20 bp, Artificial Sequence
  Description of Artificial Sequence: Synthetic oligonucleotide
  Target: ATXN1; (+) strand; PAM type: NRG; PAM sequence: TAG
gtatcgtgcaaattggtaaa

SEQ ID NO: 116507 - DNA, 20 bp, Artificial Sequence
  Description of Artificial Sequence: Synthetic oligonucleotide
  Target: ATXN1; (+) strand; PAM type: NRG; PAM sequence: CAG
cgtgcaaattggtaaataga

SEQ ID NO: 116508 - DNA, 20 bp, Artificial Sequence
  Description of Artificial Sequence: Synthetic oligonucleotide
  Target: ATXN1; (+) strand; PAM type: NRG; PAM sequence: TAG
attggtaaatagacagaatc

SEQ ID NO: 116509 - DNA, 20 bp, Artificial Sequence
  Description of Artificial Sequence: Synthetic oligonucleotide
  Target: ATXN1; (+) strand; PAM type: NRG; PAM sequence: AAG
tgcttttcctacaaaacctg

SEQ ID NO: 116510 - DNA, 20 bp, Artificial Sequence
  Description of Artificial Sequence: Synthetic oligonucleotide
  Target: ATXN1; (+) strand; PAM type: NRG; PAM sequence: CGG
tcctacaaaacctgaagcac

SEQ ID NO: 116511 - DNA, 20 bp, Artificial Sequence
  Description of Artificial Sequence: Synthetic oligonucleotide
  Target: ATXN1; (+) strand; PAM type: NRG; PAM sequence: GGG
cctacaaaacctgaagcacc

SEQ ID NO: 116512 - DNA, 20 bp, Artificial Sequence
  Description of Artificial Sequence: Synthetic oligonucleotide
  Target: ATXN1; (+) strand; PAM type: NRG; PAM sequence: TAG
acaaaacctgaagcaccggg

SEQ ID NO: 116513 - DNA, 20 bp, Artificial Sequence
  Description of Artificial Sequence: Synthetic oligonucleotide
  Target: ATXN1; (+) strand; PAM type: NRG; PAM sequence: CAG
agcaccgggtagataaatta

SEQ ID NO: 116514 - DNA, 20 bp, Artificial Sequence
  Description of Artificial Sequence: Synthetic oligonucleotide
  Target: ATXN1; (+) strand; PAM type: NRG; PAM sequence: AAG
ggtagataaattacagatgc

SEQ ID NO: 116515 - DNA, 20 bp, Artificial Sequence
  Description of Artificial Sequence: Synthetic oligonucleotide
  Target: ATXN1; (+) strand; PAM type: NRG; PAM sequence: AGG
gtagataaattacagatgca

SEQ ID NO: 116516 - DNA, 20 bp, Artificial Sequence
  Description of Artificial Sequence: Synthetic oligonucleotide
  Target: ATXN1; (+) strand; PAM type: NRG; PAM sequence: GAG
agataaattacagatgcaag

SEQ ID NO: 116517 - DNA, 20 bp, Artificial Sequence
  Description of Artificial Sequence: Synthetic oligonucleotide
  Target: ATXN1; (+) strand; PAM type: NRG; PAM sequence: TAG
aacaaatgaacaaataataa

SEQ ID NO: 116518 - DNA, 20 bp, Artificial Sequence
  Description of Artificial Sequence: Synthetic oligonucleotide
  Target: ATXN1; (+) strand; PAM type: NRG; PAM sequence: TAG
tgaacaaataataatagaat

SEQ ID NO: 116519 - DNA, 20 bp, Artificial Sequence
  Description of Artificial Sequence: Synthetic oligonucleotide
  Target: ATXN1; (+) strand; PAM type: NRG; PAM sequence: CAG
ccctgataaatttatgaatt

SEQ ID NO: 116520 - DNA, 20 bp, Artificial Sequence
  Description of Artificial Sequence: Synthetic oligonucleotide
  Target: ATXN1; (+) strand; PAM type: NRG; PAM sequence: CAG
aaatttatgaattcagatga

SEQ ID NO: 116521 - DNA, 20 bp, Artificial Sequence
  Description of Artificial Sequence: Synthetic oligonucleotide
  Target: ATXN1; (+) strand; PAM type: NRG; PAM sequence: AAG
gatgacagtctcactgcaaa

SEQ ID NO: 116522 - DNA, 20 bp, Artificial Sequence
  Description of Artificial Sequence: Synthetic oligonucleotide
  Target: ATXN1; (+) strand; PAM type: NRG; PAM sequence: GAG
tgacagtctcactgcaaaaa

SEQ ID NO: 116523 - DNA, 20 bp, Artificial Sequence
  Description of Artificial Sequence: Synthetic oligonucleotide
  Target: ATXN1; (+) strand; PAM type: NRG; PAM sequence: AAG
ccaccaaccattacctcctg

SEQ ID NO: 116524 - DNA, 20 bp, Artificial Sequence
  Description of Artificial Sequence: Synthetic oligonucleotide
  Target: ATXN1; (+) strand; PAM type: NRG; PAM sequence: AGG
caccaaccattacctcctga

SEQ ID NO: 116525 - DNA, 20 bp, Artificial Sequence
  Description of Artificial Sequence: Synthetic oligonucleotide
  Target: ATXN1; (+) strand; PAM type: NRG; PAM sequence: AAG
acaacacaacaccaactatg

SEQ ID NO: 116526 - DNA, 20 bp, Artificial Sequence
  Description of Artificial Sequence: Synthetic oligonucleotide
  Target: ATXN1; (+) strand; PAM type: NRG; PAM sequence: CAG
acacaacaccaactatgaag

SEQ ID NO: 116527 - DNA, 20 bp, Artificial Sequence
  Description of Artificial Sequence: Synthetic oligonucleotide
  Target: ATXN1; (+) strand; PAM type: NRG; PAM sequence: CAG
aacaccaactatgaagcagt

SEQ ID NO: 116528 - DNA, 20 bp, Artificial Sequence
  Description of Artificial Sequence: Synthetic oligonucleotide
  Target: ATXN1; (+) strand; PAM type: NRG; PAM sequence: AGG
acaccaactatgaagcagtc

SEQ ID NO: 116529 - DNA, 20 bp, Artificial Sequence
  Description of Artificial Sequence: Synthetic oligonucleotide
  Target: ATXN1; (+) strand; PAM type: NRG; PAM sequence: AAG
aactatgaagcagtcaggca

SEQ ID NO: 116530 - DNA, 20 bp, Artificial Sequence
  Description of Artificial Sequence: Synthetic oligonucleotide
  Target: ATXN1; (+) strand; PAM type: NRG; PAM sequence: AAG
tgaagcagtcaggcaaagca

SEQ ID NO: 116531 - DNA, 20 bp, Artificial Sequence
  Description of Artificial Sequence: Synthetic oligonucleotide
  Target: ATXN1; (+) strand; PAM type: NRG; PAM sequence: TAG
agcaaacaaaacaatgcctc

SEQ ID NO: 116532 - DNA, 20 bp, Artificial Sequence
  Description of Artificial Sequence: Synthetic oligonucleotide
  Target: ATXN1; (+) strand; PAM type: NRG; PAM sequence: TAG
acaatgcctctagaacttcc

SEQ ID NO: 116533 - DNA, 20 bp, Artificial Sequence
  Description of Artificial Sequence: Synthetic oligonucleotide
  Target: ATXN1; (+) strand; PAM type: NRG; PAM sequence: AAG
agaacttcctagcaattccc

SEQ ID NO: 116534 - DNA, 20 bp, Artificial Sequence
  Description of Artificial Sequence: Synthetic oligonucleotide
  Target: ATXN1; (+) strand; PAM type: NRG; PAM sequence: CAG
ctagcaattcccaagaaatt

SEQ ID NO: 116535 - DNA, 20 bp, Artificial Sequence
  Description of Artificial Sequence: Synthetic oligonucleotide
  Target: ATXN1; (+) strand; PAM type: NRG; PAM sequence: AGG
tagcaattcccaagaaattc

SEQ ID NO: 116536 - DNA, 20 bp, Artificial Sequence
  Description of Artificial Sequence: Synthetic oligonucleotide
  Target: ATXN1; (+) strand; PAM type: NRG; PAM sequence: GAG
gcaattcccaagaaattcag

SEQ ID NO: 116537 - DNA, 20 bp, Artificial Sequence
  Description of Artificial Sequence: Synthetic oligonucleotide
  Target: ATXN1; (+) strand; PAM type: NRG; PAM sequence: CAG
ttcccaagaaattcaggaga

SEQ ID NO: 116538 - DNA, 20 bp, Artificial Sequence
  Description of Artificial Sequence: Synthetic oligonucleotide
  Target: ATXN1; (+) strand; PAM type: NRG; PAM sequence: GAG
cccaagaaattcaggagaca

SEQ ID NO: 116539 - DNA, 20 bp, Artificial Sequence
  Description of Artificial Sequence: Synthetic oligonucleotide
  Target: ATXN1; (+) strand; PAM type: NRG; PAM sequence: AGG
ccaagaaattcaggagacag

SEQ ID NO: 116540 - DNA, 20 bp, Artificial Sequence
  Description of Artificial Sequence: Synthetic oligonucleotide
  Target: ATXN1; (+) strand; PAM type: NRG; PAM sequence: GGG
caagaaattcaggagacaga

SEQ ID NO: 116541 - DNA, 20 bp, Artificial Sequence
  Description of Artificial Sequence: Synthetic oligonucleotide
  Target: ATXN1; (+) strand; PAM type: NRG; PAM sequence: TAG
aggagacagagggacatgct

SEQ ID NO: 116542 - DNA, 20 bp, Artificial Sequence
  Description of Artificial Sequence: Synthetic oligonucleotide
  Target: ATXN1; (+) strand; PAM type: NRG; PAM sequence: TGG
acatgcttagcaacaccaca

SEQ ID NO: 116543 - DNA, 20 bp, Artificial Sequence
  Description of Artificial Sequence: Synthetic oligonucleotide
  Target: ATXN1; (+) strand; PAM type: NRG; PAM sequence: GAG
atgcttagcaacaccacatg

SEQ ID NO: 116544 - DNA, 20 bp, Artificial Sequence
  Description of Artificial Sequence: Synthetic oligonucleotide
  Target: ATXN1; (+) strand; PAM type: NRG; PAM sequence: AGG
tgcttagcaacaccacatgg

SEQ ID NO: 116545 - DNA, 20 bp, Artificial Sequence
  Description of Artificial Sequence: Synthetic oligonucleotide
  Target: ATXN1; (+) strand; PAM type: NRG; PAM sequence: CAG
tggaggcaatcatccaaacc

SEQ ID NO: 116546 - DNA, 20 bp, Artificial Sequence
  Description of Artificial Sequence: Synthetic oligonucleotide
  Target: ATXN1; (+) strand; PAM type: NRG; PAM sequence: CGG
ggcaatcatccaaacccaga

SEQ ID NO: 116547 - DNA, 20 bp, Artificial Sequence
  Description of Artificial Sequence: Synthetic oligonucleotide
  Target: ATXN1; (+) strand; PAM type: NRG; PAM sequence: GGG
gcaatcatccaaacccagac

SEQ ID NO: 116548 - DNA, 20 bp, Artificial Sequence
  Description of Artificial Sequence: Synthetic oligonucleotide
  Target: ATXN1; (+) strand; PAM type: NRG; PAM sequence: TGG
atcatccaaacccagacggg

SEQ ID NO: 116549 - DNA, 20 bp, Artificial Sequence
  Description of Artificial Sequence: Synthetic oligonucleotide
  Target: ATXN1; (+) strand; PAM type: NRG; PAM sequence: GGG
tcatccaaacccagacgggt

SEQ ID NO: 116550 - DNA, 20 bp, Artificial Sequence
  Description of Artificial Sequence: Synthetic oligonucleotide
  Target: ATXN1; (+) strand; PAM type: NRG; PAM sequence: CAG
agacgggtgggaaattctac

SEQ ID NO: 116551 - DNA, 20 bp, Artificial Sequence
  Description of Artificial Sequence: Synthetic oligonucleotide
  Target: ATXN1; (+) strand; PAM type: NRG; PAM sequence: TGG
gggaaattctaccagacaaa

SEQ ID NO: 116552 - DNA, 20 bp, Artificial Sequence
  Description of Artificial Sequence: Synthetic oligonucleotide
  Target: ATXN1; (+) strand; PAM type: NRG; PAM sequence: TGG
attctaccagacaaatggtc

SEQ ID NO: 116553 - DNA, 20 bp, Artificial Sequence
  Description of Artificial Sequence: Synthetic oligonucleotide
  Target: ATXN1; (+) strand; PAM type: NRG; PAM sequence: CAG
caaatggtctggtttctcaa

SEQ ID NO: 116554 - DNA, 20 bp, Artificial Sequence
  Description of Artificial Sequence: Synthetic oligonucleotide
  Target: ATXN1; (+) strand; PAM type: NRG; PAM sequence: AAG
aaaaactgcaaaataaaaaa

SEQ ID NO: 116555 - DNA, 20 bp, Artificial Sequence
  Description of Artificial Sequence: Synthetic oligonucleotide
  Target: ATXN1; (+) strand; PAM type: NRG; PAM sequence: TAG
tgcaaaataaaaaaaagaca

SEQ ID NO: 116556 - DNA, 20 bp, Artificial Sequence
  Description of Artificial Sequence: Synthetic oligonucleotide
  Target: ATXN1; (+) strand; PAM type: NRG; PAM sequence: AGG
gcaaaataaaaaaaagacat

SEQ ID NO: 116557 - DNA, 20 bp, Artificial Sequence
  Description of Artificial Sequence: Synthetic oligonucleotide
  Target: ATXN1; (+) strand; PAM type: NRG; PAM sequence: GAG
aaaaagacataggtgatacc

SEQ ID NO: 116558 - DNA, 20 bp, Artificial Sequence
  Description of Artificial Sequence: Synthetic oligonucleotide
  Target: ATXN1; (+) strand; PAM type: NRG; PAM sequence: TAG
aagacataggtgataccgag

SEQ ID NO: 116559 - DNA, 20 bp, Artificial Sequence
  Description of Artificial Sequence: Synthetic oligonucleotide
  Target: ATXN1; (+) strand; PAM type: NRG; PAM sequence: AAG
ggtgataccgagtagtgtaa

SEQ ID NO: 116560 - DNA, 20 bp, Artificial Sequence
  Description of Artificial Sequence: Synthetic oligonucleotide
  Target: ATXN1; (+) strand; PAM type: NRG; PAM sequence: GAG
tgataccgagtagtgtaaaa

SEQ ID NO: 116561 - DNA, 20 bp, Artificial Sequence
  Description of Artificial Sequence: Synthetic oligonucleotide
  Target: ATXN1; (+) strand; PAM type: NRG; PAM sequence: AGG
gataccgagtagtgtaaaag

SEQ ID NO: 116562 - DNA, 20 bp, Artificial Sequence
  Description of Artificial Sequence: Synthetic oligonucleotide
  Target: ATXN1; (+) strand; PAM type: NRG; PAM sequence: TAG
cgagtagtgtaaaagaggtt

SEQ ID NO: 116563 - DNA, 20 bp, Artificial Sequence
  Description of Artificial Sequence: Synthetic oligonucleotide
  Target: ATXN1; (+) strand; PAM type: NRG; PAM sequence: AGG
gagtagtgtaaaagaggttt

SEQ ID NO: 116564 - DNA, 20 bp, Artificial Sequence
  Description of Artificial Sequence: Synthetic oligonucleotide
  Target: ATXN1; (+) strand; PAM type: NRG; PAM sequence: GAG
gtagtgtaaaagaggtttag

SEQ ID NO: 116565 - DNA, 20 bp, Artificial Sequence
  Description of Artificial Sequence: Synthetic oligonucleotide
  Target: ATXN1; (+) strand; PAM type: NRG; PAM sequence: TGG
agaccgaaatgacctttatt

SEQ ID NO: 116566 - DNA, 20 bp, Artificial Sequence
  Description of Artificial Sequence: Synthetic oligonucleotide
  Target: ATXN1; (+) strand; PAM type: NRG; PAM sequence: TGG
aatgacctttatttggatct

SEQ ID NO: 116567 - DNA, 20 bp, Artificial Sequence
  Description of Artificial Sequence: Synthetic oligonucleotide
  Target: ATXN1; (+) strand; PAM type: NRG; PAM sequence: AAG
ataaaataaaacttattaat

SEQ ID NO: 116568 - DNA, 20 bp, Artificial Sequence
  Description of Artificial Sequence: Synthetic oligonucleotide
  Target: ATXN1; (+) strand; PAM type: NRG; PAM sequence: TAG
aaacttattaataagtcaat

SEQ ID NO: 116569 - DNA, 20 bp, Artificial Sequence
  Description of Artificial Sequence: Synthetic oligonucleotide
  Target: ATXN1; (+) strand; PAM type: NRG; PAM sequence: AGG
aacttattaataagtcaatt

SEQ ID NO: 116570 - DNA, 20 bp, Artificial Sequence
  Description of Artificial Sequence: Synthetic oligonucleotide
  Target: ATXN1; (+) strand; PAM type: NRG; PAM sequence: CGG
taggaaaatatgaatactga

SEQ ID NO: 116571 - DNA, 20 bp, Artificial Sequence
  Description of Artificial Sequence: Synthetic oligonucleotide
  Target: ATXN1; (+) strand; PAM type: NRG; PAM sequence: GGG
aggaaaatatgaatactgac

SEQ ID NO: 116572 - DNA, 20 bp, Artificial Sequence
  Description of Artificial Sequence: Synthetic oligonucleotide
  Target: ATXN1; (+) strand; PAM type: NRG; PAM sequence: GAG
acgggatatttgatgatatt

SEQ ID NO: 116573 - DNA, 20 bp, Artificial Sequence
  Description of Artificial Sequence: Synthetic oligonucleotide
  Target: ATXN1; (+) strand; PAM type: NRG; PAM sequence: TGG
atgactgttaatgcattttt

SEQ ID NO: 116574 - DNA, 20 bp, Artificial Sequence
  Description of Artificial Sequence: Synthetic oligonucleotide
  Target: ATXN1; (+) strand; PAM type: NRG; PAM sequence: TAG
ttggtgtgatgatgatgttg

SEQ ID NO: 116575 - DNA, 20 bp, Artificial Sequence
  Description of Artificial Sequence: Synthetic oligonucleotide
  Target: ATXN1; (+) strand; PAM type: NRG; PAM sequence: GAG
atgatgttgtagttgtgtat

SEQ ID NO: 116576 - DNA, 20 bp, Artificial Sequence
  Description of Artificial Sequence: Synthetic oligonucleotide
  Target: ATXN1; (+) strand; PAM type: NRG; PAM sequence: AAG
atgttgtagttgtgtatgag

SEQ ID NO: 116577 - DNA, 20 bp, Artificial Sequence
  Description of Artificial Sequence: Synthetic oligonucleotide
  Target: ATXN1; (+) strand; PAM type: NRG; PAM sequence: AAG
ttgtagttgtgtatgagaag

SEQ ID NO: 116578 - DNA, 20 bp, Artificial Sequence
  Description of Artificial Sequence: Synthetic oligonucleotide
  Target: ATXN1; (+) strand; PAM type: NRG; PAM sequence: TAG
agaagaatcctaatcattta

SEQ ID NO: 116579 - DNA, 20 bp, Artificial Sequence
  Description of Artificial Sequence: Synthetic oligonucleotide
  Target: ATXN1; (+) strand; PAM type: NRG; PAM sequence: TAG
atcctaatcatttatagaaa

SEQ ID NO: 116580 - DNA, 20 bp, Artificial Sequence
  Description of Artificial Sequence: Synthetic oligonucleotide
  Target: ATXN1; (+) strand; PAM type: NRG; PAM sequence: TAG
agaaatagtaaaatatttta

SEQ ID NO: 116581 - DNA, 20 bp, Artificial Sequence
  Description of Artificial Sequence: Synthetic oligonucleotide
  Target: ATXN1; (+) strand; PAM type: NRG; PAM sequence: GAG
aaatattttatagatatttt

SEQ ID NO: 116582 - DNA, 20 bp, Artificial Sequence
  Description of Artificial Sequence: Synthetic oligonucleotide
  Target: ATXN1; (+) strand; PAM type: NRG; PAM sequence: CAG
ttatagatattttgagtcaa

SEQ ID NO: 116583 - DNA, 20 bp, Artificial Sequence
  Description of Artificial Sequence: Synthetic oligonucleotide
  Target: ATXN1; (+) strand; PAM type: NRG; PAM sequence: AAG
gtcaacagcaatctgttatg

SEQ ID NO: 116584 - DNA, 20 bp, Artificial Sequence
  Description of Artificial Sequence: Synthetic oligonucleotide
  Target: ATXN1; (+) strand; PAM type: NRG; PAM sequence: AAG
gcaatctgttatgaagatgc

SEQ ID NO: 116585 - DNA, 20 bp, Artificial Sequence
  Description of Artificial Sequence: Synthetic oligonucleotide
  Target: ATXN1; (+) strand; PAM type: NRG; PAM sequence: AGG
caatctgttatgaagatgca

SEQ ID NO: 116586 - DNA, 20 bp, Artificial Sequence
  Description of Artificial Sequence: Synthetic oligonucleotide
  Target: ATXN1; (+) strand; PAM type: NRG; PAM sequence: CAG
tgttatgaagatgcaaggtc

SEQ ID NO: 116587 - DNA, 20 bp, Artificial Sequence
  Description of Artificial Sequence: Synthetic oligonucleotide
  Target: ATXN1; (+) strand; PAM type: NRG; PAM sequence: AGG
gttatgaagatgcaaggtcc

SEQ ID NO: 116588 - DNA, 20 bp, Artificial Sequence
  Description of Artificial Sequence: Synthetic oligonucleotide
  Target: ATXN1; (+) strand; PAM type: NRG; PAM sequence: GGG
ttatgaagatgcaaggtcca

SEQ ID NO: 116589 - DNA, 20 bp, Artificial Sequence
  Description of Artificial Sequence: Synthetic oligonucleotide
  Target: ATXN1; (+) strand; PAM type: NRG; PAM sequence: TGG
gtccagggaatactgttatt

SEQ ID NO: 116590 - DNA, 20 bp, Artificial Sequence
  Description of Artificial Sequence: Synthetic oligonucleotide
  Target: ATXN1; (+) strand; PAM type: NRG; PAM sequence: CAG
gaatttgcttcaaaataatc

SEQ ID NO: 116591 - DNA, 20 bp, Artificial Sequence
  Description of Artificial Sequence: Synthetic oligonucleotide
  Target: ATXN1; (+) strand; PAM type: NRG; PAM sequence: AGG
aatttgcttcaaaataatcc

SEQ ID NO: 116592 - DNA, 20 bp, Artificial Sequence
  Description of Artificial Sequence: Synthetic oligonucleotide
  Target: ATXN1; (+) strand; PAM type: NRG; PAM sequence: CAG
gcttcaaaataatccaggtg

SEQ ID NO: 116593 - DNA, 20 bp, Artificial Sequence
  Description of Artificial Sequence: Synthetic oligonucleotide
  Target: ATXN1; (+) strand; PAM type: NRG; PAM sequence: GAG
ttcaaaataatccaggtgca

SEQ ID NO: 116594 - DNA, 20 bp, Artificial Sequence
  Description of Artificial Sequence: Synthetic oligonucleotide
  Target: ATXN1; (+) strand; PAM type: NRG; PAM sequence: AGG
tcaaaataatccaggtgcag

SEQ ID NO: 116595 - DNA, 20 bp, Artificial Sequence
  Description of Artificial Sequence: Synthetic oligonucleotide
  Target: ATXN1; (+) strand; PAM type: NRG; PAM sequence: TGG
aaataatccaggtgcagagg

SEQ ID NO: 116596 - DNA, 20 bp, Artificial Sequence
  Description of Artificial Sequence: Synthetic oligonucleotide
  Target: ATXN1; (+) strand; PAM type: NRG; PAM sequence: GAG
ataatccaggtgcagaggtg

SEQ ID NO: 116597 - DNA, 20 bp, Artificial Sequence
  Description of Artificial Sequence: Synthetic oligonucleotide
  Target: ATXN1; (+) strand; PAM type: NRG; PAM sequence: TAG
atccaggtgcagaggtggag

SEQ ID NO: 116598 - DNA, 20 bp, Artificial Sequence
  Description of Artificial Sequence: Synthetic oligonucleotide
  Target: ATXN1; (+) strand; PAM type: NRG; PAM sequence: GAG
ccaggtgcagaggtggagta

SEQ ID NO: 116599 - DNA, 20 bp, Artificial Sequence
  Description of Artificial Sequence: Synthetic oligonucleotide
  Target: ATXN1; (+) strand; PAM type: NRG; PAM sequence: TGG
tggagtagagaaaacgatgt

SEQ ID NO: 116600 - DNA, 20 bp, Artificial Sequence
  Description of Artificial Sequence: Synthetic oligonucleotide
  Target: ATXN1; (+) strand; PAM type: NRG; PAM sequence: TGG
atgttggctctgctgctgaa

SEQ ID NO: 116601 - DNA, 20 bp, Artificial Sequence
  Description of Artificial Sequence: Synthetic oligonucleotide
  Target: ATXN1; (+) strand; PAM type: NRG; PAM sequence: GGG
tgttggctctgctgctgaat

SEQ ID NO: 116602 - DNA, 20 bp, Artificial Sequence
  Description of Artificial Sequence: Synthetic oligonucleotide
  Target: ATXN1; (+) strand; PAM type: NRG; PAM sequence: GGG
gttggctctgctgctgaatg

SEQ ID NO: 116603 - DNA, 20 bp, Artificial Sequence
  Description of Artificial Sequence: Synthetic oligonucleotide
  Target: ATXN1; (+) strand; PAM type: NRG; PAM sequence: TGG
ggctctgctgctgaatgggg

SEQ ID NO: 116604 - DNA, 20 bp, Artificial Sequence
  Description of Artificial Sequence: Synthetic oligonucleotide
  Target: ATXN1; (+) strand; PAM type: NRG; PAM sequence: TGG
tctgctgctgaatggggtgg

SEQ ID NO: 116605 - DNA, 20 bp, Artificial Sequence
  Description of Artificial Sequence: Synthetic oligonucleotide
  Target: ATXN1; (+) strand; PAM type: NRG; PAM sequence: GGG
ctgctgctgaatggggtggt

SEQ ID NO: 116606 - DNA, 20 bp, Artificial Sequence
  Description of Artificial Sequence: Synthetic oligonucleotide
  Target: ATXN1; (+) strand; PAM type: NRG; PAM sequence: GGG
tgctgctgaatggggtggtg

SEQ ID NO: 116607 - DNA, 20 bp, Artificial Sequence
  Description of Artificial Sequence: Synthetic oligonucleotide
  Target: ATXN1; (+) strand; PAM type: NRG; PAM sequence: AAG
tgaatggggtggtggggcaa

SEQ ID NO: 116608 - DNA, 20 bp, Artificial Sequence
  Description of Artificial Sequence: Synthetic oligonucleotide
  Target: ATXN1; (+) strand; PAM type: NRG; PAM sequence: AAG
ttgatatttctttttttttt

SEQ ID NO: 116609 - DNA, 20 bp, Artificial Sequence
  Description of Artificial Sequence: Synthetic oligonucleotide
  Target: ATXN1; (+) strand; PAM type: NRG; PAM sequence: AAG
ttatattattattatacttt

SEQ ID NO: 116610 - DNA, 20 bp, Artificial Sequence
  Description of Artificial Sequence: Synthetic oligonucleotide
  Target: ATXN1; (+) strand; PAM type: NRG; PAM sequence: TAG
tattattatactttaagttt

SEQ ID NO: 116611 - DNA, 20 bp, Artificial Sequence
  Description of Artificial Sequence: Synthetic oligonucleotide
  Target: ATXN1; (+) strand; PAM type: NRG; PAM sequence: AGG
attattatactttaagtttt

SEQ ID NO: 116612 - DNA, 20 bp, Artificial Sequence
  Description of Artificial Sequence: Synthetic oligonucleotide
  Target: ATXN1; (+) strand; PAM type: NRG; PAM sequence: GGG
ttattatactttaagtttta

SEQ ID NO: 116613 - DNA, 20 bp, Artificial Sequence
  Description of Artificial Sequence: Synthetic oligonucleotide
  Target: ATXN1; (+) strand; PAM type: NRG; PAM sequence: CAG
gggtacatgtgcacaatgtg

SEQ ID NO: 116614 - DNA, 20 bp, Artificial Sequence
  Description of Artificial Sequence: Synthetic oligonucleotide
  Target: ATXN1; (+) strand; PAM type: NRG; PAM sequence: AGG
ggtacatgtgcacaatgtgc

SEQ ID NO: 116615 - DNA, 20 bp, Artificial Sequence
  Description of Artificial Sequence: Synthetic oligonucleotide
  Target: ATXN1; (+) strand; PAM type: NRG; PAM sequence: TAG
catgtgcacaatgtgcaggt

SEQ ID NO: 116616 - DNA, 20 bp, Artificial Sequence
  Description of Artificial Sequence: Synthetic oligonucleotide
  Target: ATXN1; (+) strand; PAM type: NRG; PAM sequence: TGG
tatgtatacatgtgccatgc

SEQ ID NO: 116617 - DNA, 20 bp, Artificial Sequence
  Description of Artificial Sequence: Synthetic oligonucleotide
  Target: ATXN1; (+) strand; PAM type: NRG; PAM sequence: TAG
gcacccattacctcgtcatc

SEQ ID NO: 116618 - DNA, 20 bp, Artificial Sequence
  Description of Artificial Sequence: Synthetic oligonucleotide
  Target: ATXN1; (+) strand; PAM type: NRG; PAM sequence: TAG
attacctcgtcatctagcat

SEQ ID NO: 116619 - DNA, 20 bp, Artificial Sequence
  Description of Artificial Sequence: Synthetic oligonucleotide
  Target: ATXN1; (+) strand; PAM type: NRG; PAM sequence: AGG
ttacctcgtcatctagcatt

SEQ ID NO: 116620 - DNA, 20 bp, Artificial Sequence
  Description of Artificial Sequence: Synthetic oligonucleotide
  Target: ATXN1; (+) strand; PAM type: NRG; PAM sequence: CAG
cccctccccccaccccacaa

SEQ ID NO: 116621 - DNA, 20 bp, Artificial Sequence
  Description of Artificial Sequence: Synthetic oligonucleotide
  Target: ATXN1; (+) strand; PAM type: NRG; PAM sequence: CAG
ccccaccccacaacagtccc

SEQ ID NO: 116622 - DNA, 20 bp, Artificial Sequence
  Description of Artificial Sequence: Synthetic oligonucleotide
  Target: ATXN1; (+) strand; PAM type: NRG; PAM sequence: GAG
ccaccccacaacagtcccca

SEQ ID NO: 116623 - DNA, 20 bp, Artificial Sequence
  Description of Artificial Sequence: Synthetic oligonucleotide
  Target: ATXN1; (+) strand; PAM type: NRG; PAM sequence: GAG
attgttcaattcccatctat

SEQ ID NO: 116624 - DNA, 20 bp, Artificial Sequence
  Description of Artificial Sequence: Synthetic oligonucleotide
  Target: ATXN1; (+) strand; PAM type: NRG; PAM sequence: GAG
ttcaattcccatctatgagt

SEQ ID NO: 116625 - DNA, 20 bp, Artificial Sequence
  Description of Artificial Sequence: Synthetic oligonucleotide
  Target: ATXN1; (+) strand; PAM type: NRG; PAM sequence: CGG
catctatgagtgagaacatg

SEQ ID NO: 116626 - DNA, 20 bp, Artificial Sequence
  Description of Artificial Sequence: Synthetic oligonucleotide
  Target: ATXN1; (+) strand; PAM type: NRG; PAM sequence: TGG
gagtgagaacatgcggtgtt

SEQ ID NO: 116627 - DNA, 20 bp, Artificial Sequence
  Description of Artificial Sequence: Synthetic oligonucleotide
  Target: ATXN1; (+) strand; PAM type: NRG; PAM sequence: TAG
ttggttttttgtccttgtga

SEQ ID NO: 116628 - DNA, 20 bp, Artificial Sequence
  Description of Artificial Sequence: Synthetic oligonucleotide
  Target: ATXN1; (+) strand; PAM type: NRG; PAM sequence: GAG
tgtccttgtgatagtttact

SEQ ID NO: 116629 - DNA, 20 bp, Artificial Sequence
  Description of Artificial Sequence: Synthetic oligonucleotide
  Target: ATXN1; (+) strand; PAM type: NRG; PAM sequence: AAG
atttcatccatgtccctaca

SEQ ID NO: 116630 - DNA, 20 bp, Artificial Sequence
  Description of Artificial Sequence: Synthetic oligonucleotide
  Target: ATXN1; (+) strand; PAM type: NRG; PAM sequence: AGG
tttcatccatgtccctacaa

SEQ ID NO: 116631 - DNA, 20 bp, Artificial Sequence
  Description of Artificial Sequence: Synthetic oligonucleotide
  Target: ATXN1; (+) strand; PAM type: NRG; PAM sequence: TGG
cgtgaactcatcatttttta

SEQ ID NO: 116632 - DNA, 20 bp, Artificial Sequence
  Description of Artificial Sequence: Synthetic oligonucleotide
  Target: ATXN1; (+) strand; PAM type: NRG; PAM sequence: TAG
catcattttttatggctgca

SEQ ID NO: 116633 - DNA, 20 bp, Artificial Sequence
  Description of Artificial Sequence: Synthetic oligonucleotide
  Target: ATXN1; (+) strand; PAM type: NRG; PAM sequence: TGG
tatggctgcatagtattcca

SEQ ID NO: 116634 - DNA, 20 bp, Artificial Sequence
  Description of Artificial Sequence: Synthetic oligonucleotide
  Target: ATXN1; (+) strand; PAM type: NRG; PAM sequence: CAG
tgtgccacattttcttaatc

SEQ ID NO: 116635 - DNA, 20 bp, Artificial Sequence
  Description of Artificial Sequence: Synthetic oligonucleotide
  Target: ATXN1; (+) strand; PAM type: NRG; PAM sequence: TGG
ttaatccagtctatcattgt

SEQ ID NO: 116636 - DNA, 20 bp, Artificial Sequence
  Description of Artificial Sequence: Synthetic oligonucleotide
  Target: ATXN1; (+) strand; PAM type: NRG; PAM sequence: TGG
gtctatcattgttggacatt

SEQ ID NO: 116637 - DNA, 20 bp, Artificial Sequence
  Description of Artificial Sequence: Synthetic oligonucleotide
  Target: ATXN1; (+) strand; PAM type: NRG; PAM sequence: GGG
tctatcattgttggacattt

SEQ ID NO: 116638 - DNA, 20 bp, Artificial Sequence
  Description of Artificial Sequence: Synthetic oligonucleotide
  Target: ATXN1; (+) strand; PAM type: NRG; PAM sequence: TGG
tcattgttggacatttgggt

SEQ ID NO: 116639 - DNA, 20 bp, Artificial Sequence
  Description of Artificial Sequence: Synthetic oligonucleotide
  Target: ATXN1; (+) strand; PAM type: NRG; PAM sequence: AAG
tggacatttgggttggttcc

SEQ ID NO: 116640 - DNA, 20 bp, Artificial Sequence
  Description of Artificial Sequence: Synthetic oligonucleotide
  Target: ATXN1; (+) strand; PAM type: NRG; PAM sequence: TAG
caagtctttgctattgtgaa

SEQ ID NO: 116641 - DNA, 20 bp, Artificial Sequence
  Description of Artificial Sequence: Synthetic oligonucleotide
  Target: ATXN1; (+) strand; PAM type: NRG; PAM sequence: CAG
atgtgcatgtgtctttattg

SEQ ID NO: 116642 - DNA, 20 bp, Artificial Sequence
  Description of Artificial Sequence: Synthetic oligonucleotide
  Target: ATXN1; (+) strand; PAM type: NRG; PAM sequence: TAG
ctttattgcagcatgattta

SEQ ID NO: 116643 - DNA, 20 bp, Artificial Sequence
  Description of Artificial Sequence: Synthetic oligonucleotide
  Target: ATXN1; (+) strand; PAM type: NRG; PAM sequence: TGG
cagcatgatttatagtcctt

SEQ ID NO: 116644 - DNA, 20 bp, Artificial Sequence
  Description of Artificial Sequence: Synthetic oligonucleotide
  Target: ATXN1; (+) strand; PAM type: NRG; PAM sequence: GGG
agcatgatttatagtccttt

SEQ ID NO: 116645 - DNA, 20 bp, Artificial Sequence
  Description of Artificial Sequence: Synthetic oligonucleotide
  Target: ATXN1; (+) strand; PAM type: NRG; PAM sequence: CAG
tagtcctttgggtatatacc

SEQ ID NO: 116646 - DNA, 20 bp, Artificial Sequence
  Description of Artificial Sequence: Synthetic oligonucleotide
  Target: ATXN1; (+) strand; PAM type: NRG; PAM sequence: TGG
tttgggtatatacccagtaa

SEQ ID NO: 116647 - DNA, 20 bp, Artificial Sequence
  Description of Artificial Sequence: Synthetic oligonucleotide
  Target: ATXN1; (+) strand; PAM type: NRG; PAM sequence: GGG
ttgggtatatacccagtaat

SEQ ID NO: 116648 - DNA, 20 bp, Artificial Sequence
  Description of Artificial Sequence: Synthetic oligonucleotide
  Target: ATXN1; (+) strand; PAM type: NRG; PAM sequence: TGG
gtatatacccagtaatggga

SEQ ID NO: 116649 - DNA, 20 bp, Artificial Sequence
  Description of Artificial Sequence: Synthetic oligonucleotide
  Target: ATXN1; (+) strand; PAM type: NRG; PAM sequence: TGG
atacccagtaatgggatggc

SEQ ID NO: 116650 - DNA, 20 bp, Artificial Sequence
  Description of Artificial Sequence: Synthetic oligonucleotide
  Target: ATXN1; (+) strand; PAM type: NRG; PAM sequence: GGG
tacccagtaatgggatggct

SEQ ID NO: 116651 - DNA, 20 bp, Artificial Sequence
  Description of Artificial Sequence: Synthetic oligonucleotide
  Target: ATXN1; (+) strand; PAM type: NRG; PAM sequence: TGG
aatgggatggctgggtcaaa

SEQ ID NO: 116652 - DNA, 20 bp, Artificial Sequence
  Description of Artificial Sequence: Synthetic oligonucleotide
  Target: ATXN1; (+) strand; PAM type: NRG; PAM sequence: TAG
gctgggtcaaatggtatttc

SEQ ID NO: 116653 - DNA, 20 bp, Artificial Sequence
  Description of Artificial Sequence: Synthetic oligonucleotide
  Target: ATXN1; (+) strand; PAM type: NRG; PAM sequence: TAG
tcaaatggtatttctagttc

SEQ ID NO: 116654 - DNA, 20 bp, Artificial Sequence
  Description of Artificial Sequence: Synthetic oligonucleotide
  Target: ATXN1; (+) strand; PAM type: NRG; PAM sequence: GAG
atttctagttctagatccct

SEQ ID NO: 116655 - DNA, 20 bp, Artificial Sequence
  Description of Artificial Sequence: Synthetic oligonucleotide
  Target: ATXN1; (+) strand; PAM type: NRG; PAM sequence: AGG
tttctagttctagatccctg

SEQ ID NO: 116656 - DNA, 20 bp, Artificial Sequence
  Description of Artificial Sequence: Synthetic oligonucleotide
  Target: ATXN1; (+) strand; PAM type: NRG; PAM sequence: TGG
cgccacactgacttccacaa

SEQ ID NO: 116657 - DNA, 20 bp, Artificial Sequence
  Description of Artificial Sequence: Synthetic oligonucleotide
  Target: ATXN1; (+) strand; PAM type: NRG; PAM sequence: TAG
gacttccacaatggttgaac

SEQ ID NO: 116658 - DNA, 20 bp, Artificial Sequence
  Description of Artificial Sequence: Synthetic oligonucleotide
  Target: ATXN1; (+) strand; PAM type: NRG; PAM sequence: CAG
acaatggttgaactagttta

SEQ ID NO: 116659 - DNA, 20 bp, Artificial Sequence
  Description of Artificial Sequence: Synthetic oligonucleotide
  Target: ATXN1; (+) strand; PAM type: NRG; PAM sequence: CAG
ctagtttacagtcccaccaa

SEQ ID NO: 116660 - DNA, 20 bp, Artificial Sequence
  Description of Artificial Sequence: Synthetic oligonucleotide
  Target: ATXN1; (+) strand; PAM type: NRG; PAM sequence: AAG
cagtcccaccaacagtgtaa

SEQ ID NO: 116661 - DNA, 20 bp, Artificial Sequence
  Description of Artificial Sequence: Synthetic oligonucleotide
  Target: ATXN1; (+) strand; PAM type: NRG; PAM sequence: CAG
ctatttctccacatcctctc

SEQ ID NO: 116662 - DNA, 20 bp, Artificial Sequence
  Description of Artificial Sequence: Synthetic oligonucleotide
  Target: ATXN1; (+) strand; PAM type: NRG; PAM sequence: TGG
ttaatgattgccattctaac

SEQ ID NO: 116663 - DNA, 20 bp, Artificial Sequence
  Description of Artificial Sequence: Synthetic oligonucleotide
  Target: ATXN1; (+) strand; PAM type: NRG; PAM sequence: GAG
attgccattctaactggtgt

SEQ ID NO: 116664 - DNA, 20 bp, Artificial Sequence
  Description of Artificial Sequence: Synthetic oligonucleotide
  Target: ATXN1; (+) strand; PAM type: NRG; PAM sequence: TGG
ccattctaactggtgtgaga

SEQ ID NO: 116665 - DNA, 20 bp, Artificial Sequence
  Description of Artificial Sequence: Synthetic oligonucleotide
  Target: ATXN1; (+) strand; PAM type: NRG; PAM sequence: TGG
tgtgagatggtatctcattg

SEQ ID NO: 116666 - DNA, 20 bp, Artificial Sequence
  Description of Artificial Sequence: Synthetic oligonucleotide
  Target: ATXN1; (+) strand; PAM type: NRG; PAM sequence: TGG
tttgatttgcatttctctga

SEQ ID NO: 116667 - DNA, 20 bp, Artificial Sequence
  Description of Artificial Sequence: Synthetic oligonucleotide
  Target: ATXN1; (+) strand; PAM type: NRG; PAM sequence: CAG
atttgcatttctctgatggc

SEQ ID NO: 116668 - DNA, 20 bp, Artificial Sequence
  Description of Artificial Sequence: Synthetic oligonucleotide
  Target: ATXN1; (+) strand; PAM type: NRG; PAM sequence: GAG
ctctgatggccagtgatgat

SEQ ID NO: 116669 - DNA, 20 bp, Artificial Sequence
  Description of Artificial Sequence: Synthetic oligonucleotide
  Target: ATXN1; (+) strand; PAM type: NRG; PAM sequence: TGG
gcattttttcacgtgtcttt

SEQ ID NO: 116670 - DNA, 20 bp, Artificial Sequence
  Description of Artificial Sequence: Synthetic oligonucleotide
  Target: ATXN1; (+) strand; PAM type: NRG; PAM sequence: GAG
ctgcataaatgtcttctttt

SEQ ID NO: 116671 - DNA, 20 bp, Artificial Sequence
  Description of Artificial Sequence: Synthetic oligonucleotide
  Target: ATXN1; (+) strand; PAM type: NRG; PAM sequence: AAG
cataaatgtcttcttttgag

SEQ ID NO: 116672 - DNA, 20 bp, Artificial Sequence
  Description of Artificial Sequence: Synthetic oligonucleotide
  Target: ATXN1; (+) strand; PAM type: NRG; PAM sequence: AAG
tttgatatttctataacaca

SEQ ID NO: 116673 - DNA, 20 bp, Artificial Sequence
  Description of Artificial Sequence: Synthetic oligonucleotide
  Target: ATXN1; (+) strand; PAM type: NRG; PAM sequence: AAG
atttctataacacaaagtta

SEQ ID NO: 116674 - DNA, 20 bp, Artificial Sequence
  Description of Artificial Sequence: Synthetic oligonucleotide
  Target: ATXN1; (+) strand; PAM type: NRG; PAM sequence: TGG
acacaaagttaaagttcctt

SEQ ID NO: 116675 - DNA, 20 bp, Artificial Sequence
  Description of Artificial Sequence: Synthetic oligonucleotide
  Target: ATXN1; (+) strand; PAM type: NRG; PAM sequence: TGG
ttaaagttcctttggtaatt

SEQ ID NO: 116676 - DNA, 20 bp, Artificial Sequence
  Description of Artificial Sequence: Synthetic oligonucleotide
  Target: ATXN1; (+) strand; PAM type: NRG; PAM sequence: CAG
aagttcctttggtaatttgg

SEQ ID NO: 116677 - DNA, 20 bp, Artificial Sequence
  Description of Artificial Sequence: Synthetic oligonucleotide
  Target: ATXN1; (+) strand; PAM type: NRG; PAM sequence: TGG
ttggcagtgtttctcaaatg

SEQ ID NO: 116678 - DNA, 20 bp, Artificial Sequence
  Description of Artificial Sequence: Synthetic oligonucleotide
  Target: ATXN1; (+) strand; PAM type: NRG; PAM sequence: CAG
ttctcaaatgtggtttccca

SEQ ID NO: 116679 - DNA, 20 bp, Artificial Sequence
  Description of Artificial Sequence: Synthetic oligonucleotide
  Target: ATXN1; (+) strand; PAM type: NRG; PAM sequence: TGG
ggtttcccacagccttcctt

SEQ ID NO: 116680 - DNA, 20 bp, Artificial Sequence
  Description of Artificial Sequence: Synthetic oligonucleotide
  Target: ATXN1; (+) strand; PAM type: NRG; PAM sequence: GGG
gtttcccacagccttccttt

SEQ ID NO: 116681 - DNA, 20 bp, Artificial Sequence
  Description of Artificial Sequence: Synthetic oligonucleotide
  Target: ATXN1; (+) strand; PAM type: NRG; PAM sequence: GGG
tttcccacagccttcctttg

SEQ ID NO: 116682 - DNA, 20 bp, Artificial Sequence
  Description of Artificial Sequence: Synthetic oligonucleotide
  Target: ATXN1; (+) strand; PAM type: NRG; PAM sequence: CAG
aaaattcacattcctgacat

SEQ ID NO: 116683 - DNA, 20 bp, Artificial Sequence
  Description of Artificial Sequence: Synthetic oligonucleotide
  Target: ATXN1; (+) strand; PAM type: NRG; PAM sequence: CGG
attcctgacatcagcttact

SEQ ID NO: 116684 - DNA, 20 bp, Artificial Sequence
  Description of Artificial Sequence: Synthetic oligonucleotide
  Target: ATXN1; (+) strand; PAM type: NRG; PAM sequence: GGG
ttcctgacatcagcttactc

SEQ ID NO: 116685 - DNA, 20 bp, Artificial Sequence
  Description of Artificial Sequence: Synthetic oligonucleotide
  Target: ATXN1; (+) strand; PAM type: NRG; PAM sequence: GGG
tcctgacatcagcttactcg

SEQ ID NO: 116686 - DNA, 20 bp, Artificial Sequence
  Description of Artificial Sequence: Synthetic oligonucleotide
  Target: ATXN1; (+) strand; PAM type: NRG; PAM sequence: AAG
ggggcacttctcaaaattga

SEQ ID NO: 116687 - DNA, 20 bp, Artificial Sequence
  Description of Artificial Sequence: Synthetic oligonucleotide
  Target: ATXN1; (+) strand; PAM type: NRG; PAM sequence: CAG
aattgaaagctgcccaaccc

SEQ ID NO: 116688 - DNA, 20 bp, Artificial Sequence
  Description of Artificial Sequence: Synthetic oligonucleotide
  Target: ATXN1; (+) strand; PAM type: NRG; PAM sequence: CAG
ccaaccccagatttgtgaat

SEQ ID NO: 116689 - DNA, 20 bp, Artificial Sequence
  Description of Artificial Sequence: Synthetic oligonucleotide
  Target: ATXN1; (+) strand; PAM type: NRG; PAM sequence: TGG
gatttgtgaatcagaattcc

SEQ ID NO: 116690 - DNA, 20 bp, Artificial Sequence
  Description of Artificial Sequence: Synthetic oligonucleotide
  Target: ATXN1; (+) strand; PAM type: NRG; PAM sequence: GGG
atttgtgaatcagaattcct

SEQ ID NO: 116691 - DNA, 20 bp, Artificial Sequence
  Description of Artificial Sequence: Synthetic oligonucleotide
  Target: ATXN1; (+) strand; PAM type: NRG; PAM sequence: GAG
ttgtgaatcagaattcctgg

SEQ ID NO: 116692 - DNA, 20 bp, Artificial Sequence
  Description of Artificial Sequence: Synthetic oligonucleotide
  Target: ATXN1; (+) strand; PAM type: NRG; PAM sequence: AAG
aatcagaattcctgggagtg

SEQ ID NO: 116693 - DNA, 20 bp, Artificial Sequence
  Description of Artificial Sequence: Synthetic oligonucleotide
  Target: ATXN1; (+) strand; PAM type: NRG; PAM sequence: CAG
gaattcctgggagtgaagcc

SEQ ID NO: 116694 - DNA, 20 bp, Artificial Sequence
  Description of Artificial Sequence: Synthetic oligonucleotide
  Target: ATXN1; (+) strand; PAM type: NRG; PAM sequence: CAG
agaaaactgtattttacata

SEQ ID NO: 116695 - DNA, 20 bp, Artificial Sequence
  Description of Artificial Sequence: Synthetic oligonucleotide
  Target: ATXN1; (+) strand; PAM type: NRG; PAM sequence: CAG
tgtattttacatacagtatg

SEQ ID NO: 116696 - DNA, 20 bp, Artificial Sequence
  Description of Artificial Sequence: Synthetic oligonucleotide
  Target: ATXN1; (+) strand; PAM type: NRG; PAM sequence: AGG
gtattttacatacagtatgc

SEQ ID NO: 116697 - DNA, 20 bp, Artificial Sequence
  Description of Artificial Sequence: Synthetic oligonucleotide
  Target: ATXN1; (+) strand; PAM type: NRG; PAM sequence: TAG
ttttacatacagtatgcagg

SEQ ID NO: 116698 - DNA, 20 bp, Artificial Sequence
  Description of Artificial Sequence: Synthetic oligonucleotide
  Target: ATXN1; (+) strand; PAM type: NRG; PAM sequence: AGG
tttacatacagtatgcaggt

SEQ ID NO: 116699 - DNA, 20 bp, Artificial Sequence
  Description of Artificial Sequence: Synthetic oligonucleotide
  Target: ATXN1; (+) strand; PAM type: NRG; PAM sequence: TAG
ctgcacactccattttgctt

SEQ ID NO: 116700 - DNA, 20 bp, Artificial Sequence
  Description of Artificial Sequence: Synthetic oligonucleotide
  Target: ATXN1; (+) strand; PAM type: NRG; PAM sequence: AAG
aataaattatttctttttca

SEQ ID NO: 116701 - DNA, 20 bp, Artificial Sequence
  Description of Artificial Sequence: Synthetic oligonucleotide
  Target: ATXN1; (+) strand; PAM type: NRG; PAM sequence: AGG
ataaattatttctttttcaa

SEQ ID NO: 116702 - DNA, 20 bp, Artificial Sequence
  Description of Artificial Sequence: Synthetic oligonucleotide
  Target: ATXN1; (+) strand; PAM type: NRG; PAM sequence: GGG
taaattatttctttttcaaa

SEQ ID NO: 116703 - DNA, 20 bp, Artificial Sequence
  Description of Artificial Sequence: Synthetic oligonucleotide
  Target: ATXN1; (+) strand; PAM type: NRG; PAM sequence: CAG
ttctttttcaaagggtttaa

SEQ ID NO: 116704 - DNA, 20 bp, Artificial Sequence
  Description of Artificial Sequence: Synthetic oligonucleotide
  Target: ATXN1; (+) strand; PAM type: NRG; PAM sequence: AAG
gggtttaacagttaaatcta

SEQ ID NO: 116705 - DNA, 20 bp, Artificial Sequence
  Description of Artificial Sequence: Synthetic oligonucleotide
  Target: ATXN1; (+) strand; PAM type: NRG; PAM sequence: AAG
ctaaagttttttttctatta

SEQ ID NO: 116706 - DNA, 20 bp, Artificial Sequence
  Description of Artificial Sequence: Synthetic oligonucleotide
  Target: ATXN1; (+) strand; PAM type: NRG; PAM sequence: AGG
taaagttttttttctattaa

SEQ ID NO: 116707 - DNA, 20 bp, Artificial Sequence
  Description of Artificial Sequence: Synthetic oligonucleotide
  Target: ATXN1; (+) strand; PAM type: NRG; PAM sequence: CAG
tttctattaaaggaacttta

SEQ ID NO: 116708 - DNA, 20 bp, Artificial Sequence
  Description of Artificial Sequence: Synthetic oligonucleotide
  Target: ATXN1; (+) strand; PAM type: NRG; PAM sequence: TGG
ttctgtaaaatatatcctgt

SEQ ID NO: 116709 - DNA, 20 bp, Artificial Sequence
  Description of Artificial Sequence: Synthetic oligonucleotide
  Target: ATXN1; (+) strand; PAM type: NRG; PAM sequence: AAG
tgttggtgtcatctatcaac

SEQ ID NO: 116710 - DNA, 20 bp, Artificial Sequence
  Description of Artificial Sequence: Synthetic oligonucleotide
  Target: ATXN1; (+) strand; PAM type: NRG; PAM sequence: TAG
gtcatctatcaacaagtaca

SEQ ID NO: 116711 - DNA, 20 bp, Artificial Sequence
  Description of Artificial Sequence: Synthetic oligonucleotide
  Target: ATXN1; (+) strand; PAM type: NRG; PAM sequence: TGG
tagtcttaaaatttttatta

SEQ ID NO: 116712 - DNA, 20 bp, Artificial Sequence
  Description of Artificial Sequence: Synthetic oligonucleotide
  Target: ATXN1; (+) strand; PAM type: NRG; PAM sequence: GGG
agtcttaaaatttttattat

SEQ ID NO: 116713 - DNA, 20 bp, Artificial Sequence
  Description of Artificial Sequence: Synthetic oligonucleotide
  Target: ATXN1; (+) strand; PAM type: NRG; PAM sequence: GAG
tcttaaaatttttattatgg

SEQ ID NO: 116714 - DNA, 20 bp, Artificial Sequence
  Description of Artificial Sequence: Synthetic oligonucleotide
  Target: ATXN1; (+) strand; PAM type: NRG; PAM sequence: AAG
aaaatttttattatgggaga

SEQ ID NO: 116715 - DNA, 20 bp, Artificial Sequence
  Description of Artificial Sequence: Synthetic oligonucleotide
  Target: ATXN1; (+) strand; PAM type: NRG; PAM sequence: AGG
aaatttttattatgggagaa

SEQ ID NO: 116716 - DNA, 20 bp, Artificial Sequence
  Description of Artificial Sequence: Synthetic oligonucleotide
  Target: ATXN1; (+) strand; PAM type: NRG; PAM sequence: GGG
aatttttattatgggagaaa

SEQ ID NO: 116717 - DNA, 20 bp, Artificial Sequence
  Description of Artificial Sequence: Synthetic oligonucleotide
  Target: ATXN1; (+) strand; PAM type: NRG; PAM sequence: CAG
ttattatgggagaaagggat

SEQ ID NO: 116718 - DNA, 20 bp, Artificial Sequence
  Description of Artificial Sequence: Synthetic oligonucleotide
  Target: ATXN1; (+) strand; PAM type: NRG; PAM sequence: CAG
ggatcagaccatactctcta

SEQ ID NO: 116719 - DNA, 20 bp, Artificial Sequence
  Description of Artificial Sequence: Synthetic oligonucleotide
  Target: ATXN1; (+) strand; PAM type: NRG; PAM sequence: GAG
catactctctacagtttgct

SEQ ID NO: 116720 - DNA, 20 bp, Artificial Sequence
  Description of Artificial Sequence: Synthetic oligonucleotide
  Target: ATXN1; (+) strand; PAM type: NRG; PAM sequence: TGG
tctacagtttgctgagcgtg

SEQ ID NO: 116721 - DNA, 20 bp, Artificial Sequence
  Description of Artificial Sequence: Synthetic oligonucleotide
  Target: ATXN1; (+) strand; PAM type: NRG; PAM sequence: TAG
tgagcgtgtggttaataaac

SEQ ID NO: 116722 - DNA, 20 bp, Artificial Sequence
  Description of Artificial Sequence: Synthetic oligonucleotide
  Target: ATXN1; (+) strand; PAM type: NRG; PAM sequence: GAG
agcgtgtggttaataaacta

SEQ ID NO: 116723 - DNA, 20 bp, Artificial Sequence
  Description of Artificial Sequence: Synthetic oligonucleotide
  Target: ATXN1; (+) strand; PAM type: NRG; PAM sequence: AGG
gcgtgtggttaataaactag

SEQ ID NO: 116724 - DNA, 20 bp, Artificial Sequence
  Description of Artificial Sequence: Synthetic oligonucleotide
  Target: ATXN1; (+) strand; PAM type: NRG; PAM sequence: TAG
ggttaataaactagaggaaa

SEQ ID NO: 116725 - DNA, 20 bp, Artificial Sequence
  Description of Artificial Sequence: Synthetic oligonucleotide
  Target: ATXN1; (+) strand; PAM type: NRG; PAM sequence: TAG
ataaactagaggaaatagcc

SEQ ID NO: 116726 - DNA, 20 bp, Artificial Sequence
  Description of Artificial Sequence: Synthetic oligonucleotide
  Target: ATXN1; (+) strand; PAM type: NRG; PAM sequence: GAG
aaactagaggaaatagccta

SEQ ID NO: 116727 - DNA, 20 bp, Artificial Sequence
  Description of Artificial Sequence: Synthetic oligonucleotide
  Target: ATXN1; (+) strand; PAM type: NRG; PAM sequence: TGG
ggaaatagcctagagtaaca

SEQ ID NO: 116728 - DNA, 20 bp, Artificial Sequence
  Description of Artificial Sequence: Synthetic oligonucleotide
  Target: ATXN1; (+) strand; PAM type: NRG; PAM sequence: AAG
agcctagagtaacatggatg

SEQ ID NO: 116729 - DNA, 20 bp, Artificial Sequence
  Description of Artificial Sequence: Synthetic oligonucleotide
  Target: ATXN1; (+) strand; PAM type: NRG; PAM sequence: CAG
gagtaacatggatgaagcta

SEQ ID NO: 116730 - DNA, 20 bp, Artificial Sequence
  Description of Artificial Sequence: Synthetic oligonucleotide
  Target: ATXN1; (+) strand; PAM type: NRG; PAM sequence: TGG
acagaaatgtgccttttgta

SEQ ID NO: 116731 - DNA, 20 bp, Artificial Sequence
  Description of Artificial Sequence: Synthetic oligonucleotide
  Target: ATXN1; (+) strand; PAM type: NRG; PAM sequence: AAG
gaaatgtgccttttgtatgg

SEQ ID NO: 116732 - DNA, 20 bp, Artificial Sequence
  Description of Artificial Sequence: Synthetic oligonucleotide
  Target: ATXN1; (+) strand; PAM type: NRG; PAM sequence: TGG
ttttgtatggaagacatgct

SEQ ID NO: 116733 - DNA, 20 bp, Artificial Sequence
  Description of Artificial Sequence: Synthetic oligonucleotide
  Target: ATXN1; (+) strand; PAM type: NRG; PAM sequence: CAG
atggaagacatgcttggtga

SEQ ID NO: 116734 - DNA, 20 bp, Artificial Sequence
  Description of Artificial Sequence: Synthetic oligonucleotide
  Target: ATXN1; (+) strand; PAM type: NRG; PAM sequence: GAG
ggaagacatgcttggtgaca

SEQ ID NO: 116735 - DNA, 20 bp, Artificial Sequence
  Description of Artificial Sequence: Synthetic oligonucleotide
  Target: ATXN1; (+) strand; PAM type: NRG; PAM sequence: AAG
agacatgcttggtgacagag

SEQ ID NO: 116736 - DNA, 20 bp, Artificial Sequence
  Description of Artificial Sequence: Synthetic oligonucleotide
  Target: ATXN1; (+) strand; PAM type: NRG; PAM sequence: AAG
tgcttggtgacagagaagat

SEQ ID NO: 116737 - DNA, 20 bp, Artificial Sequence
  Description of Artificial Sequence: Synthetic oligonucleotide
  Target: ATXN1; (+) strand; PAM type: NRG; PAM sequence: AAG
ataagtttgcatttttaaaa

SEQ ID NO: 116738 - DNA, 20 bp, Artificial Sequence
  Description of Artificial Sequence: Synthetic oligonucleotide
  Target: ATXN1; (+) strand; PAM type: NRG; PAM sequence: CAG
ttaaaaaagtgatttgaact

SEQ ID NO: 116739 - DNA, 20 bp, Artificial Sequence
  Description of Artificial Sequence: Synthetic oligonucleotide
  Target: ATXN1; (+) strand; PAM type: NRG; PAM sequence: TAG
aagtgatttgaactcagcta

SEQ ID NO: 116740 - DNA, 20 bp, Artificial Sequence
  Description of Artificial Sequence: Synthetic oligonucleotide
  Target: ATXN1; (+) strand; PAM type: NRG; PAM sequence: TAG
tttgaactcagctatagcat

SEQ ID NO: 116741 - DNA, 20 bp, Artificial Sequence
  Description of Artificial Sequence: Synthetic oligonucleotide
  Target: ATXN1; (+) strand; PAM type: NRG; PAM sequence: CAG
atagcattagcatatattcc

SEQ ID NO: 116742 - DNA, 20 bp, Artificial Sequence
  Description of Artificial Sequence: Synthetic oligonucleotide
  Target: ATXN1; (+) strand; PAM type: NRG; PAM sequence: TAG
ccagattatacaactattcc

SEQ ID NO: 116743 - DNA, 20 bp, Artificial Sequence
  Description of Artificial Sequence: Synthetic oligonucleotide
  Target: ATXN1; (+) strand; PAM type: NRG; PAM sequence: AAG
acaactattcctagactcac

SEQ ID NO: 116744 - DNA, 20 bp, Artificial Sequence
  Description of Artificial Sequence: Synthetic oligonucleotide
  Target: ATXN1; (+) strand; PAM type: NRG; PAM sequence: AAG
cacaagcactattttccaaa

SEQ ID NO: 116745 - DNA, 20 bp, Artificial Sequence
  Description of Artificial Sequence: Synthetic oligonucleotide
  Target: ATXN1; (+) strand; PAM type: NRG; PAM sequence: CAG
tgtcccttatccttaacaca

SEQ ID NO: 116746 - DNA, 20 bp, Artificial Sequence
  Description of Artificial Sequence: Synthetic oligonucleotide
  Target: ATXN1; (+) strand; PAM type: NRG; PAM sequence: TAG
aacataattctttctaatga

SEQ ID NO: 116747 - DNA, 20 bp, Artificial Sequence
  Description of Artificial Sequence: Synthetic oligonucleotide
  Target: ATXN1; (+) strand; PAM type: NRG; PAM sequence: TAG
ctaatgatagtgcttatcac

SEQ ID NO: 116748 - DNA, 20 bp, Artificial Sequence
  Description of Artificial Sequence: Synthetic oligonucleotide
  Target: ATXN1; (+) strand; PAM type: NRG; PAM sequence: AAG
atgatagtgcttatcactag

SEQ ID NO: 116749 - DNA, 20 bp, Artificial Sequence
  Description of Artificial Sequence: Synthetic oligonucleotide
  Target: ATXN1; (+) strand; PAM type: NRG; PAM sequence: CAG
tagtgcttatcactagaagc

SEQ ID NO: 116750 - DNA, 20 bp, Artificial Sequence
  Description of Artificial Sequence: Synthetic oligonucleotide
  Target: ATXN1; (+) strand; PAM type: NRG; PAM sequence: GAG
gtgcttatcactagaagcca

SEQ ID NO: 116751 - DNA, 20 bp, Artificial Sequence
  Description of Artificial Sequence: Synthetic oligonucleotide
  Target: ATXN1; (+) strand; PAM type: NRG; PAM sequence: AGG
tgcttatcactagaagccag

SEQ ID NO: 116752 - DNA, 20 bp, Artificial Sequence
  Description of Artificial Sequence: Synthetic oligonucleotide
  Target: ATXN1; (+) strand; PAM type: NRG; PAM sequence: CAG
cagaggcttgttgaatgact

SEQ ID NO: 116753 - DNA, 20 bp, Artificial Sequence
  Description of Artificial Sequence: Synthetic oligonucleotide
  Target: ATXN1; (+) strand; PAM type: NRG; PAM sequence: TGG
gttgaatgactcagtttccc

SEQ ID NO: 116754 - DNA, 20 bp, Artificial Sequence
  Description of Artificial Sequence: Synthetic oligonucleotide
  Target: ATXN1; (+) strand; PAM type: NRG; PAM sequence: AAG
aatgactcagtttccctgga

SEQ ID NO: 116755 - DNA, 20 bp, Artificial Sequence
  Description of Artificial Sequence: Synthetic oligonucleotide
  Target: ATXN1; (+) strand; PAM type: NRG; PAM sequence: TAG
gtttccctggaaagtaaata

SEQ ID NO: 116756 - DNA, 20 bp, Artificial Sequence
  Description of Artificial Sequence: Synthetic oligonucleotide
  Target: ATXN1; (+) strand; PAM type: NRG; PAM sequence: CGG
ggaaagtaaatatagtgtac

SEQ ID NO: 116757 - DNA, 20 bp, Artificial Sequence
  Description of Artificial Sequence: Synthetic oligonucleotide
  Target: ATXN1; (+) strand; PAM type: NRG; PAM sequence: GGG
gaaagtaaatatagtgtacc

SEQ ID NO: 116758 - DNA, 20 bp, Artificial Sequence
  Description of Artificial Sequence: Synthetic oligonucleotide
  Target: ATXN1; (+) strand; PAM type: NRG; PAM sequence: CAG
aatatagtgtaccgggatga

SEQ ID NO: 116759 - DNA, 20 bp, Artificial Sequence
  Description of Artificial Sequence: Synthetic oligonucleotide
  Target: ATXN1; (+) strand; PAM type: NRG; PAM sequence: CAG
gtaccgggatgacagacaat

SEQ ID NO: 116760 - DNA, 20 bp, Artificial Sequence
  Description of Artificial Sequence: Synthetic oligonucleotide
  Target: ATXN1; (+) strand; PAM type: NRG; PAM sequence: CAG
ggatgacagacaatcagaaa

SEQ ID NO: 116761 - DNA, 20 bp, Artificial Sequence
  Description of Artificial Sequence: Synthetic oligonucleotide
  Target: ATXN1; (+) strand; PAM type: NRG; PAM sequence: TAG
caatcagaaacagacatcaa

SEQ ID NO: 116762 - DNA, 20 bp, Artificial Sequence
  Description of Artificial Sequence: Synthetic oligonucleotide
  Target: ATXN1; (+) strand; PAM type: NRG; PAM sequence: AAG
agaaacagacatcaatagca

SEQ ID NO: 116763 - DNA, 20 bp, Artificial Sequence
  Description of Artificial Sequence: Synthetic oligonucleotide
  Target: ATXN1; (+) strand; PAM type: NRG; PAM sequence: AGG
gaaacagacatcaatagcaa

SEQ ID NO: 116764 - DNA, 20 bp, Artificial Sequence
  Description of Artificial Sequence: Synthetic oligonucleotide
  Target: ATXN1; (+) strand; PAM type: NRG; PAM sequence: GAG
tttaattaattaattttttt

SEQ ID NO: 116765 - DNA, 20 bp, Artificial Sequence
  Description of Artificial Sequence: Synthetic oligonucleotide
  Target: ATXN1; (+) strand; PAM type: NRG; PAM sequence: CAG
attaattaatttttttgaga

SEQ ID NO: 116766 - DNA, 20 bp, Artificial Sequence
  Description of Artificial Sequence: Synthetic oligonucleotide
  Target: ATXN1; (+) strand; PAM type: NRG; PAM sequence: AGG
ttaattaatttttttgagac

SEQ ID NO: 116767 - DNA, 20 bp, Artificial Sequence
  Description of Artificial Sequence: Synthetic oligonucleotide
  Target: ATXN1; (+) strand; PAM type: NRG; PAM sequence: GGG
taattaatttttttgagaca

SEQ ID NO: 116768 - DNA, 20 bp, Artificial Sequence
  Description of Artificial Sequence: Synthetic oligonucleotide
  Target: ATXN1; (+) strand; PAM type: NRG; PAM sequence: TAG
tctcgttctgtcacccacgt

SEQ ID NO: 116769 - DNA, 20 bp, Artificial Sequence
  Description of Artificial Sequence: Synthetic oligonucleotide
  Target: ATXN1; (+) strand; PAM type: NRG; PAM sequence: GAG
tcgttctgtcacccacgtta

SEQ ID NO: 116770 - DNA, 20 bp, Artificial Sequence
  Description of Artificial Sequence: Synthetic oligonucleotide
  Target: ATXN1; (+) strand; PAM type: NRG; PAM sequence: CAG
ctgtcacccacgttagagtg

SEQ ID NO: 116771 - DNA, 20 bp, Artificial Sequence
  Description of Artificial Sequence: Synthetic oligonucleotide
  Target: ATXN1; (+) strand; PAM type: NRG; PAM sequence: TGG
tcacccacgttagagtgcag

SEQ ID NO: 116772 - DNA, 20 bp, Artificial Sequence
  Description of Artificial Sequence: Synthetic oligonucleotide
  Target: ATXN1; (+) strand; PAM type: NRG; PAM sequence: CAG
agagtgcagtggcatgatct

SEQ ID NO: 116773 - DNA, 20 bp, Artificial Sequence
  Description of Artificial Sequence: Synthetic oligonucleotide
  Target: ATXN1; (+) strand; PAM type: NRG; PAM sequence: TGG
atctcagcatactgcaacct

SEQ ID NO: 116774 - DNA, 20 bp, Artificial Sequence
  Description of Artificial Sequence: Synthetic oligonucleotide
  Target: ATXN1; (+) strand; PAM type: NRG; PAM sequence: TGG
atactgcaaccttggcctct

SEQ ID NO: 116775 - DNA, 20 bp, Artificial Sequence
  Description of Artificial Sequence: Synthetic oligonucleotide
  Target: ATXN1; (+) strand; PAM type: NRG; PAM sequence: GGG
tactgcaaccttggcctctt

SEQ ID NO: 116776 - DNA, 20 bp, Artificial Sequence
  Description of Artificial Sequence: Synthetic oligonucleotide
  Target: ATXN1; (+) strand; PAM type: NRG; PAM sequence: CAG
ttcaaactattctcctgcct

SEQ ID NO: 116777 - DNA, 20 bp, Artificial Sequence
  Description of Artificial Sequence: Synthetic oligonucleotide
  Target: ATXN1; (+) strand; PAM type: NRG; PAM sequence: GAG
ttctcctgcctcagcctcct

SEQ ID NO: 116778 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcctgag

SEQ ID NO: 116779 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcctgagtagc

SEQ ID NO: 116780 - DNA, 20 bp, Artificial Sequence
  Description of Artificial Sequence: Synthetic oligonucleotide
  Target: ATXN1; (+) strand; PAM type: NRG; PAM sequence: CAG
ctcctgagtagctggtatta

SEQ ID NO: 116781 - DNA, 20 bp, Artificial Sequence
  Description of Artificial Sequence: Synthetic oligonucleotide
  Target: ATXN1; (+) strand; PAM type: NRG; PAM sequence: AGG
tcctgagtagctggtattac

SEQ ID NO: 116782 - DNA, 20 bp, Artificial Sequence
  Description of Artificial Sequence: Synthetic oligonucleotide
  Target: ATXN1; (+) strand; PAM type: NRG; PAM sequence: CAG
acaggtgcccaccacccacc

SEQ ID NO: 116783 - DNA, 20 bp, Artificial Sequence
  Description of Artificial Sequence: Synthetic oligonucleotide
  Target: ATXN1; (+) strand; PAM type: NRG; PAM sequence: TAG
ccagctaatttttgtatttt

SEQ ID NO: 116784 - DNA, 20 bp, Artificial Sequence
  Description of Artificial Sequence: Synthetic oligonucleotide
  Target: ATXN1; (+) strand; PAM type: NRG; PAM sequence: TAG
gctaatttttgtatttttag

SEQ ID NO: 116785 - DNA, 20 bp, Artificial Sequence
  Description of Artificial Sequence: Synthetic oligonucleotide
  Target: ATXN1; (+) strand; PAM type: NRG; PAM sequence: AGG
ctaatttttgtatttttagt

SEQ ID NO: 116786 - DNA, 20 bp, Artificial Sequence
  Description of Artificial Sequence: Synthetic oligonucleotide
  Target: ATXN1; (+) strand; PAM type: NRG; PAM sequence: GGG
taatttttgtatttttagta

SEQ ID NO: 116787 - DNA, 20 bp, Artificial Sequence
  Description of Artificial Sequence: Synthetic oligonucleotide
  Target: ATXN1; (+) strand; PAM type: NRG; PAM sequence: TGG
ttttgtatttttagtaggga

SEQ ID NO: 116788 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtagggat

SEQ ID NO: 116789 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagggatg

SEQ ID NO: 116790 - DNA, 20 bp, Artificial Sequence
  Description of Artificial Sequence: Synthetic oligonucleotide
  Target: ATXN1; (+) strand; PAM type: NRG; PAM sequence: TGG
gggatggggtttcaccatgt

SEQ ID NO: 116791 - DNA, 20 bp, Artificial Sequence
  Description of Artificial Sequence: Synthetic oligonucleotide
  Target: ATXN1; (+) strand; PAM type: NRG; PAM sequence: CAG
tggggtttcaccatgttggc

SEQ ID NO: 116792 - DNA, 20 bp, Artificial Sequence
  Description of Artificial Sequence: Synthetic oligonucleotide
  Target: ATXN1; (+) strand; PAM type: NRG; PAM sequence: AGG
ggggtttcaccatgttggcc

SEQ ID NO: 116793 - DNA, 20 bp, Artificial Sequence
  Description of Artificial Sequence: Synthetic oligonucleotide
  Target: ATXN1; (+) strand; PAM type: NRG; PAM sequence: TGG
ccaggtttgtctcaaactcc

SEQ ID NO: 116794 - DNA, 20 bp, Artificial Sequence
  Description of Artificial Sequence: Synthetic oligonucleotide
  Target: ATXN1; (+) strand; PAM type: NRG; PAM sequence: AAG
tgtctcaaactcctggcctc

SEQ ID NO: 116795 - DNA, 20 bp, Artificial Sequence
  Description of Artificial Sequence: Synthetic oligonucleotide
  Target: ATXN1; (+) strand; PAM type: NRG; PAM sequence: CAG
ctcaagtgatccacctgcct

SEQ ID NO: 116796 - DNA, 20 bp, Artificial Sequence
  Description of Artificial Sequence: Synthetic oligonucleotide
  Target: ATXN1; (+) strand; PAM type: NRG; PAM sequence: AAG
ccacctgcctcagcctccca

SEQ ID NO: 116797 - DNA, 20 bp, Artificial Sequence
  Description of Artificial Sequence: Synthetic oligonucleotide
  Target: ATXN1; (+) strand; PAM type: NRG; PAM sequence: TAG
gcctcagcctcccaaagtgc

SEQ ID NO: 116798 - DNA, 20 bp, Artificial Sequence
  Description of Artificial Sequence: Synthetic oligonucleotide
  Target: ATXN1; (+) strand; PAM type: NRG; PAM sequence: AGG
cctcagcctcccaaagtgct

SEQ ID NO: 116799 - DNA, 20 bp, Artificial Sequence
  Description of Artificial Sequence: Synthetic oligonucleotide
  Target: ATXN1; (+) strand; PAM type: NRG; PAM sequence: TAG
gcctcccaaagtgctaggat

SEQ ID NO: 116800 - DNA, 20 bp, Artificial Sequence
  Description of Artificial Sequence: Synthetic oligonucleotide
  Target: ATXN1; (+) strand; PAM type: NRG; PAM sequence: AAG
tcccaaagtgctaggattag

SEQ ID NO: 116801 - DNA, 20 bp, Artificial Sequence
  Description of Artificial Sequence: Synthetic oligonucleotide
  Target: ATXN1; (+) strand; PAM type: NRG; PAM sequence: TAG
agtgctaggattagaagtgt

SEQ ID NO: 116802 - DNA, 20 bp, Artificial Sequence
  Description of Artificial Sequence: Synthetic oligonucleotide
  Target: ATXN1; (+) strand; PAM type: NRG; PAM sequence: AAG
gcctatttttattttttatc

SEQ ID NO: 116803 - DNA, 20 bp, Artificial Sequence
  Description of Artificial Sequence: Synthetic oligonucleotide
  Target: ATXN1; (+) strand; PAM type: NRG; PAM sequence: AGG
cctatttttattttttatca

SEQ ID NO: 116804 - DNA, 20 bp, Artificial Sequence
  Description of Artificial Sequence: Synthetic oligonucleotide
  Target: ATXN1; (+) strand; PAM type: NRG; PAM sequence: CAG
atttttattttttatcaagg

SEQ ID NO: 116805 - DNA, 20 bp, Artificial Sequence
  Description of Artificial Sequence: Synthetic oligonucleotide
  Target: ATXN1; (+) strand; PAM type: NRG; PAM sequence: CAG
cagaatcgcactatgttgcc

SEQ ID NO: 116806 - DNA, 20 bp, Artificial Sequence
  Description of Artificial Sequence: Synthetic oligonucleotide
  Target: ATXN1; (+) strand; PAM type: NRG; PAM sequence: AGG
agaatcgcactatgttgccc

SEQ ID NO: 116807 - DNA, 20 bp, Artificial Sequence
  Description of Artificial Sequence: Synthetic oligonucleotide
  Target: ATXN1; (+) strand; PAM type: NRG; PAM sequence: TGG
tcgcactatgttgcccaggc

SEQ ID NO: 116808 - DNA, 20 bp, Artificial Sequence
  Description of Artificial Sequence: Synthetic oligonucleotide
  Target: ATXN1; (+) strand; PAM type: NRG; PAM sequence: TGG
ccaggctggttttgaacttc

SEQ ID NO: 116809 - DNA, 20 bp, Artificial Sequence
  Description of Artificial Sequence: Synthetic oligonucleotide
  Target: ATXN1; (+) strand; PAM type: NRG; PAM sequence: AAG
ggttttgaacttctggcgtc

SEQ ID NO: 116810 - DNA, 20 bp, Artificial Sequence
  Description of Artificial Sequence: Synthetic oligonucleotide
  Target: ATXN1; (+) strand; PAM type: NRG; PAM sequence: CGG
gtcaagtgatcctcccacct

SEQ ID NO: 116811 - DNA, 20 bp, Artificial Sequence
  Description of Artificial Sequence: Synthetic oligonucleotide
  Target: ATXN1; (+) strand; PAM type: NRG; PAM sequence: AAG
cctcccacctcggcctccca

SEQ ID NO: 116812 - DNA, 20 bp, Artificial Sequence
  Description of Artificial Sequence: Synthetic oligonucleotide
  Target: ATXN1; (+) strand; PAM type: NRG; PAM sequence: TGG
acctcggcctcccaaagtgc

SEQ ID NO: 116813 - DNA, 20 bp, Artificial Sequence
  Description of Artificial Sequence: Synthetic oligonucleotide
  Target: ATXN1; (+) strand; PAM type: NRG; PAM sequence: GGG
cctcggcctcccaaagtgct

SEQ ID NO: 116814 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 116815 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 116816 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggtgt

SEQ ID NO: 116817 - DNA, 20 bp, Artificial Sequence
  Description of Artificial Sequence: Synthetic oligonucleotide
  Target: ATXN1; (+) strand; PAM type: NRG; PAM sequence: TGG
caggtgtgagctactgcgcc

SEQ ID NO: 116818 - DNA, 20 bp, Artificial Sequence
  Description of Artificial Sequence: Synthetic oligonucleotide
  Target: ATXN1; (+) strand; PAM type: NRG; PAM sequence: TAG
agctactgcgcctggcctaa

SEQ ID NO: 116819 - DNA, 20 bp, Artificial Sequence
  Description of Artificial Sequence: Synthetic oligonucleotide
  Target: ATXN1; (+) strand; PAM type: NRG; PAM sequence: AAG
ctgcgcctggcctaatagca

SEQ ID NO: 116820 - DNA, 20 bp, Artificial Sequence
  Description of Artificial Sequence: Synthetic oligonucleotide
  Target: ATXN1; (+) strand; PAM type: NRG; PAM sequence: AGG
tgcgcctggcctaatagcaa

SEQ ID NO: 116821 - DNA, 20 bp, Artificial Sequence
  Description of Artificial Sequence: Synthetic oligonucleotide
  Target: ATXN1; (+) strand; PAM type: NRG; PAM sequence: TAG
aaaggcgctgataaaaaaaa

SEQ ID NO: 116822 - DNA, 20 bp, Artificial Sequence
  Description of Artificial Sequence: Synthetic oligonucleotide
  Target: ATXN1; (+) strand; PAM type: NRG; PAM sequence: AGG
aaggcgctgataaaaaaaat

SEQ ID NO: 116823 - DNA, 20 bp, Artificial Sequence
  Description of Artificial Sequence: Synthetic oligonucleotide
  Target: ATXN1; (+) strand; PAM type: NRG; PAM sequence: GAG
ggcgctgataaaaaaaatag

SEQ ID NO: 116824 - DNA, 20 bp, Artificial Sequence
  Description of Artificial Sequence: Synthetic oligonucleotide
  Target: ATXN1; (+) strand; PAM type: NRG; PAM sequence: GAG
cgctgataaaaaaaatagga

SEQ ID NO: 116825 - DNA, 20 bp, Artificial Sequence
  Description of Artificial Sequence: Synthetic oligonucleotide
  Target: ATXN1; (+) strand; PAM type: NRG; PAM sequence: CAG
tgataaaaaaaataggagag

SEQ ID NO: 116826 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaataggagagcaga

SEQ ID NO: 116827 - DNA, 20 bp, Artificial Sequence
  Description of Artificial Sequence: Synthetic oligonucleotide
  Target: ATXN1; (+) strand; PAM type: NRG; PAM sequence: AGG
aaaaaaataggagagcagaa

SEQ ID NO: 116828 - DNA, 20 bp, Artificial Sequence
  Description of Artificial Sequence: Synthetic oligonucleotide
  Target: ATXN1; (+) strand; PAM type: NRG; PAM sequence: GGG
aaaaaataggagagcagaaa

SEQ ID NO: 116829 - DNA, 20 bp, Artificial Sequence
  Description of Artificial Sequence: Synthetic oligonucleotide
  Target: ATXN1; (+) strand; PAM type: NRG; PAM sequence: CAG
aataggagagcagaaaggga

SEQ ID NO: 116830 - DNA, 20 bp, Artificial Sequence
  Description of Artificial Sequence: Synthetic oligonucleotide
  Target: ATXN1; (+) strand; PAM type: NRG; PAM sequence: CAG
agagcagaaagggacagaac

SEQ ID NO: 116831 - DNA, 20 bp, Artificial Sequence
  Description of Artificial Sequence: Synthetic oligonucleotide
  Target: ATXN1; (+) strand; PAM type: NRG; PAM sequence: TAG
aaagggacagaaccagcact

SEQ ID NO: 116832 - DNA, 20 bp, Artificial Sequence
  Description of Artificial Sequence: Synthetic oligonucleotide
  Target: ATXN1; (+) strand; PAM type: NRG; PAM sequence: AAG
ggacagaaccagcacttagt

SEQ ID NO: 116833 - DNA, 20 bp, Artificial Sequence
  Description of Artificial Sequence: Synthetic oligonucleotide
  Target: ATXN1; (+) strand; PAM type: NRG; PAM sequence: TAG
agtaagcattactaaaatgc

SEQ ID NO: 116834 - DNA, 20 bp, Artificial Sequence
  Description of Artificial Sequence: Synthetic oligonucleotide
  Target: ATXN1; (+) strand; PAM type: NRG; PAM sequence: TAG
taaaatgctagttacactct

SEQ ID NO: 116835 - DNA, 20 bp, Artificial Sequence
  Description of Artificial Sequence: Synthetic oligonucleotide
  Target: ATXN1; (+) strand; PAM type: NRG; PAM sequence: AAG
aatgctagttacactcttag

SEQ ID NO: 116836 - DNA, 20 bp, Artificial Sequence
  Description of Artificial Sequence: Synthetic oligonucleotide
  Target: ATXN1; (+) strand; PAM type: NRG; PAM sequence: TAG
acactcttagaagctttata

SEQ ID NO: 116837 - DNA, 20 bp, Artificial Sequence
  Description of Artificial Sequence: Synthetic oligonucleotide
  Target: ATXN1; (+) strand; PAM type: NRG; PAM sequence: AGG
cactcttagaagctttatat

SEQ ID NO: 116838 - DNA, 20 bp, Artificial Sequence
  Description of Artificial Sequence: Synthetic oligonucleotide
  Target: ATXN1; (+) strand; PAM type: NRG; PAM sequence: AAG
ttctaatttaatctttattg

SEQ ID NO: 116839 - DNA, 20 bp, Artificial Sequence
  Description of Artificial Sequence: Synthetic oligonucleotide
  Target: ATXN1; (+) strand; PAM type: NRG; PAM sequence: TAG
ttaatctttattgaagcttg

SEQ ID NO: 116840 - DNA, 20 bp, Artificial Sequence
  Description of Artificial Sequence: Synthetic oligonucleotide
  Target: ATXN1; (+) strand; PAM type: NRG; PAM sequence: AAG
tagcttttaaacttatttaa

SEQ ID NO: 116841 - DNA, 20 bp, Artificial Sequence
  Description of Artificial Sequence: Synthetic oligonucleotide
  Target: ATXN1; (+) strand; PAM type: NRG; PAM sequence: AAG
aaacttatttaaaagcccca

SEQ ID NO: 116842 - DNA, 20 bp, Artificial Sequence
  Description of Artificial Sequence: Synthetic oligonucleotide
  Target: ATXN1; (+) strand; PAM type: NRG; PAM sequence: CGG
agccccaaagattctaccaa

SEQ ID NO: 116843 - DNA, 20 bp, Artificial Sequence
  Description of Artificial Sequence: Synthetic oligonucleotide
  Target: ATXN1; (+) strand; PAM type: NRG; PAM sequence: GGG
gccccaaagattctaccaac

SEQ ID NO: 116844 - DNA, 20 bp, Artificial Sequence
  Description of Artificial Sequence: Synthetic oligonucleotide
  Target: ATXN1; (+) strand; PAM type: NRG; PAM sequence: CAG
aagattctaccaacgggctt

SEQ ID NO: 116845 - DNA, 20 bp, Artificial Sequence
  Description of Artificial Sequence: Synthetic oligonucleotide
  Target: ATXN1; (+) strand; PAM type: NRG; PAM sequence: GAG
gattctaccaacgggcttca

SEQ ID NO: 116846 - DNA, 20 bp, Artificial Sequence
  Description of Artificial Sequence: Synthetic oligonucleotide
  Target: ATXN1; (+) strand; PAM type: NRG; PAM sequence: AAG
aaattgaatttctcattatt

SEQ ID NO: 116847 - DNA, 20 bp, Artificial Sequence
  Description of Artificial Sequence: Synthetic oligonucleotide
  Target: ATXN1; (+) strand; PAM type: NRG; PAM sequence: TAG
ttctcattattaagtaactg

SEQ ID NO: 116848 - DNA, 20 bp, Artificial Sequence
  Description of Artificial Sequence: Synthetic oligonucleotide
  Target: ATXN1; (+) strand; PAM type: NRG; PAM sequence: CAG
ttattaagtaactgtagttt

SEQ ID NO: 116849 - DNA, 20 bp, Artificial Sequence
  Description of Artificial Sequence: Synthetic oligonucleotide
  Target: ATXN1; (+) strand; PAM type: NRG; PAM sequence: AAG
aagtaactgtagtttcagaa

SEQ ID NO: 116850 - DNA, 20 bp, Artificial Sequence
  Description of Artificial Sequence: Synthetic oligonucleotide
  Target: ATXN1; (+) strand; PAM type: NRG; PAM sequence: TAG
aaagctctccatgtgccata

SEQ ID NO: 116851 - DNA, 20 bp, Artificial Sequence
  Description of Artificial Sequence: Synthetic oligonucleotide
  Target: ATXN1; (+) strand; PAM type: NRG; PAM sequence: TAG
gctctccatgtgccatatag

SEQ ID NO: 116852 - DNA, 20 bp, Artificial Sequence
  Description of Artificial Sequence: Synthetic oligonucleotide
  Target: ATXN1; (+) strand; PAM type: NRG; PAM sequence: CAG
tagtagaataacacttaatt

SEQ ID NO: 116853 - DNA, 20 bp, Artificial Sequence
  Description of Artificial Sequence: Synthetic oligonucleotide
  Target: ATXN1; (+) strand; PAM type: NRG; PAM sequence: AGG
agtagaataacacttaattc

SEQ ID NO: 116854 - DNA, 20 bp, Artificial Sequence
  Description of Artificial Sequence: Synthetic oligonucleotide
  Target: ATXN1; (+) strand; PAM type: NRG; PAM sequence: GGG
gtagaataacacttaattca

SEQ ID NO: 116855 - DNA, 20 bp, Artificial Sequence
  Description of Artificial Sequence: Synthetic oligonucleotide
  Target: ATXN1; (+) strand; PAM type: NRG; PAM sequence: GGG
tagaataacacttaattcag

SEQ ID NO: 116856 - DNA, 20 bp, Artificial Sequence
  Description of Artificial Sequence: Synthetic oligonucleotide
  Target: ATXN1; (+) strand; PAM type: NRG; PAM sequence: TAG
ataacacttaattcaggggc

SEQ ID NO: 116857 - DNA, 20 bp, Artificial Sequence
  Description of Artificial Sequence: Synthetic oligonucleotide
  Target: ATXN1; (+) strand; PAM type: NRG; PAM sequence: AGG
taacacttaattcaggggct

SEQ ID NO: 116858 - DNA, 20 bp, Artificial Sequence
  Description of Artificial Sequence: Synthetic oligonucleotide
  Target: ATXN1; (+) strand; PAM type: NRG; PAM sequence: GGG
aacacttaattcaggggcta

SEQ ID NO: 116859 - DNA, 20 bp, Artificial Sequence
  Description of Artificial Sequence: Synthetic oligonucleotide
  Target: ATXN1; (+) strand; PAM type: NRG; PAM sequence: AAG
aattcaggggctagggtcta

SEQ ID NO: 116860 - DNA, 20 bp, Artificial Sequence
  Description of Artificial Sequence: Synthetic oligonucleotide
  Target: ATXN1; (+) strand; PAM type: NRG; PAM sequence: CAG
tctaaagttcccacccaatg

SEQ ID NO: 116861 - DNA, 20 bp, Artificial Sequence
  Description of Artificial Sequence: Synthetic oligonucleotide
  Target: ATXN1; (+) strand; PAM type: NRG; PAM sequence: GAG
taaagttcccacccaatgca

SEQ ID NO: 116862 - DNA, 20 bp, Artificial Sequence
  Description of Artificial Sequence: Synthetic oligonucleotide
  Target: ATXN1; (+) strand; PAM type: NRG; PAM sequence: TGG
cccacccaatgcagagtgtg

SEQ ID NO: 116863 - DNA, 20 bp, Artificial Sequence
  Description of Artificial Sequence: Synthetic oligonucleotide
  Target: ATXN1; (+) strand; PAM type: NRG; PAM sequence: GGG
ccacccaatgcagagtgtgt

SEQ ID NO: 116864 - DNA, 20 bp, Artificial Sequence
  Description of Artificial Sequence: Synthetic oligonucleotide
  Target: ATXN1; (+) strand; PAM type: NRG; PAM sequence: AAG
tgcagagtgtgtgggttcaa

SEQ ID NO: 116865 - DNA, 20 bp, Artificial Sequence
  Description of Artificial Sequence: Synthetic oligonucleotide
  Target: ATXN1; (+) strand; PAM type: NRG; PAM sequence: AAG
aaaagtatccttgaaattgt

SEQ ID NO: 116866 - DNA, 20 bp, Artificial Sequence
  Description of Artificial Sequence: Synthetic oligonucleotide
  Target: ATXN1; (+) strand; PAM type: NRG; PAM sequence: AGG
aaagtatccttgaaattgta

SEQ ID NO: 116867 - DNA, 20 bp, Artificial Sequence
  Description of Artificial Sequence: Synthetic oligonucleotide
  Target: ATXN1; (+) strand; PAM type: NRG; PAM sequence: CAG
tgaaattgtaaggtgcaaat

SEQ ID NO: 116868 - DNA, 20 bp, Artificial Sequence
  Description of Artificial Sequence: Synthetic oligonucleotide
  Target: ATXN1; (+) strand; PAM type: NRG; PAM sequence: TGG
aatgcttcctattacattta

SEQ ID NO: 116869 - DNA, 20 bp, Artificial Sequence
  Description of Artificial Sequence: Synthetic oligonucleotide
  Target: ATXN1; (+) strand; PAM type: NRG; PAM sequence: CAG
tacatttatggtaaaaacca

SEQ ID NO: 116870 - DNA, 20 bp, Artificial Sequence
  Description of Artificial Sequence: Synthetic oligonucleotide
  Target: ATXN1; (+) strand; PAM type: NRG; PAM sequence: TGG
tatggtaaaaaccacagtcc

SEQ ID NO: 116871 - DNA, 20 bp, Artificial Sequence
  Description of Artificial Sequence: Synthetic oligonucleotide
  Target: ATXN1; (+) strand; PAM type: NRG; PAM sequence: AAG
ccacagtcctggtccatgtc

SEQ ID NO: 116872 - DNA, 20 bp, Artificial Sequence
  Description of Artificial Sequence: Synthetic oligonucleotide
  Target: ATXN1; (+) strand; PAM type: NRG; PAM sequence: TAG
tcctggtccatgtcaagact

SEQ ID NO: 116873 - DNA, 20 bp, Artificial Sequence
  Description of Artificial Sequence: Synthetic oligonucleotide
  Target: ATXN1; (+) strand; PAM type: NRG; PAM sequence: AAG
tggtccatgtcaagacttag

SEQ ID NO: 116874 - DNA, 20 bp, Artificial Sequence
  Description of Artificial Sequence: Synthetic oligonucleotide
  Target: ATXN1; (+) strand; PAM type: NRG; PAM sequence: AGG
ggtccatgtcaagacttaga

SEQ ID NO: 116875 - DNA, 20 bp, Artificial Sequence
  Description of Artificial Sequence: Synthetic oligonucleotide
  Target: ATXN1; (+) strand; PAM type: NRG; PAM sequence: CAG
ctcctccctatgttctgctc

SEQ ID NO: 116876 - DNA, 20 bp, Artificial Sequence
  Description of Artificial Sequence: Synthetic oligonucleotide
  Target: ATXN1; (+) strand; PAM type: NRG; PAM sequence: TAG
ccctatgttctgctccagca

SEQ ID NO: 116877 - DNA, 20 bp, Artificial Sequence
  Description of Artificial Sequence: Synthetic oligonucleotide
  Target: ATXN1; (+) strand; PAM type: NRG; PAM sequence: TGG
tatgttctgctccagcatag

SEQ ID NO: 116878 - DNA, 20 bp, Artificial Sequence
  Description of Artificial Sequence: Synthetic oligonucleotide
  Target: ATXN1; (+) strand; PAM type: NRG; PAM sequence: CAG
tccacactcccttccacatc

SEQ ID NO: 116879 - DNA, 20 bp, Artificial Sequence
  Description of Artificial Sequence: Synthetic oligonucleotide
  Target: ATXN1; (+) strand; PAM type: NRG; PAM sequence: AGG
ccacactcccttccacatcc

SEQ ID NO: 116880 - DNA, 20 bp, Artificial Sequence
  Description of Artificial Sequence: Synthetic oligonucleotide
  Target: ATXN1; (+) strand; PAM type: NRG; PAM sequence: TGG
tccacatccaggcacaatcc

SEQ ID NO: 116881 - DNA, 20 bp, Artificial Sequence
  Description of Artificial Sequence: Synthetic oligonucleotide
  Target: ATXN1; (+) strand; PAM type: NRG; PAM sequence: TAG
ggcacaatcctggtcctacc

SEQ ID NO: 116882 - DNA, 20 bp, Artificial Sequence
  Description of Artificial Sequence: Synthetic oligonucleotide
  Target: ATXN1; (+) strand; PAM type: NRG; PAM sequence: TGG
tcctacctagaatgctcctc

SEQ ID NO: 116883 - DNA, 20 bp, Artificial Sequence
  Description of Artificial Sequence: Synthetic oligonucleotide
  Target: ATXN1; (+) strand; PAM type: NRG; PAM sequence: GAG
agaatgctcctctggcaaat

SEQ ID NO: 116884 - DNA, 20 bp, Artificial Sequence
  Description of Artificial Sequence: Synthetic oligonucleotide
  Target: ATXN1; (+) strand; PAM type: NRG; PAM sequence: CAG
gcaaatgagttctcttcatt

SEQ ID NO: 116885 - DNA, 20 bp, Artificial Sequence
  Description of Artificial Sequence: Synthetic oligonucleotide
  Target: ATXN1; (+) strand; PAM type: NRG; PAM sequence: AGG
caaatgagttctcttcattc

SEQ ID NO: 116886 - DNA, 20 bp, Artificial Sequence
  Description of Artificial Sequence: Synthetic oligonucleotide
  Target: ATXN1; (+) strand; PAM type: NRG; PAM sequence: TGG
tgctgtgatgtgtccctccc

SEQ ID NO: 116887 - DNA, 20 bp, Artificial Sequence
  Description of Artificial Sequence: Synthetic oligonucleotide
  Target: ATXN1; (+) strand; PAM type: NRG; PAM sequence: AAG
tccctggtcgccttgtctaa

SEQ ID NO: 116888 - DNA, 20 bp, Artificial Sequence
  Description of Artificial Sequence: Synthetic oligonucleotide
  Target: ATXN1; (+) strand; PAM type: NRG; PAM sequence: GAG
cctggtcgccttgtctaaaa

SEQ ID NO: 116889 - DNA, 20 bp, Artificial Sequence
  Description of Artificial Sequence: Synthetic oligonucleotide
  Target: ATXN1; (+) strand; PAM type: NRG; PAM sequence: CAG
ggtcgccttgtctaaaagag

SEQ ID NO: 116890 - DNA, 20 bp, Artificial Sequence
  Description of Artificial Sequence: Synthetic oligonucleotide
  Target: ATXN1; (+) strand; PAM type: NRG; PAM sequence: AGG
gtcgccttgtctaaaagagc

SEQ ID NO: 116891 - DNA, 20 bp, Artificial Sequence
  Description of Artificial Sequence: Synthetic oligonucleotide
  Target: ATXN1; (+) strand; PAM type: NRG; PAM sequence: CAG
attcttctcttcattcatca

SEQ ID NO: 116892 - DNA, 20 bp, Artificial Sequence
  Description of Artificial Sequence: Synthetic oligonucleotide
  Target: ATXN1; (+) strand; PAM type: NRG; PAM sequence: AAG
acagctgatgttacaccaca

SEQ ID NO: 116893 - DNA, 20 bp, Artificial Sequence
  Description of Artificial Sequence: Synthetic oligonucleotide
  Target: ATXN1; (+) strand; PAM type: NRG; PAM sequence: TGG
ttacaccacaaagtccttgt

SEQ ID NO: 116894 - DNA, 20 bp, Artificial Sequence
  Description of Artificial Sequence: Synthetic oligonucleotide
  Target: ATXN1; (+) strand; PAM type: NRG; PAM sequence: TAG
tgttggtttgtttcctgcgc

SEQ ID NO: 116895 - DNA, 20 bp, Artificial Sequence
  Description of Artificial Sequence: Synthetic oligonucleotide
  Target: ATXN1; (+) strand; PAM type: NRG; PAM sequence: CAG
tattcattactgatatatca

SEQ ID NO: 116896 - DNA, 20 bp, Artificial Sequence
  Description of Artificial Sequence: Synthetic oligonucleotide
  Target: ATXN1; (+) strand; PAM type: NRG; PAM sequence: AGG
attcattactgatatatcac

SEQ ID NO: 116897 - DNA, 20 bp, Artificial Sequence
  Description of Artificial Sequence: Synthetic oligonucleotide
  Target: ATXN1; (+) strand; PAM type: NRG; PAM sequence: TGG
tatcacaggtgtacatattt

SEQ ID NO: 116898 - DNA, 20 bp, Artificial Sequence
  Description of Artificial Sequence: Synthetic oligonucleotide
  Target: ATXN1; (+) strand; PAM type: NRG; PAM sequence: GGG
atcacaggtgtacatatttt

SEQ ID NO: 116899 - DNA, 20 bp, Artificial Sequence
  Description of Artificial Sequence: Synthetic oligonucleotide
  Target: ATXN1; (+) strand; PAM type: NRG; PAM sequence: GGG
tcacaggtgtacatattttg

SEQ ID NO: 116900 - DNA, 20 bp, Artificial Sequence
  Description of Artificial Sequence: Synthetic oligonucleotide
  Target: ATXN1; (+) strand; PAM type: NRG; PAM sequence: GGG
cacaggtgtacatattttgg

SEQ ID NO: 116901 - DNA, 20 bp, Artificial Sequence
  Description of Artificial Sequence: Synthetic oligonucleotide
  Target: ATXN1; (+) strand; PAM type: NRG; PAM sequence: AAG
tgtacatattttgggggtac

SEQ ID NO: 116902 - DNA, 20 bp, Artificial Sequence
  Description of Artificial Sequence: Synthetic oligonucleotide
  Target: ATXN1; (+) strand; PAM type: NRG; PAM sequence: CAG
cttcatccttgctcaaactg

SEQ ID NO: 116903 - DNA, 20 bp, Artificial Sequence
  Description of Artificial Sequence: Synthetic oligonucleotide
  Target: ATXN1; (+) strand; PAM type: NRG; PAM sequence: GAG
gctcaaactgcagcacctat

SEQ ID NO: 116904 - DNA, 20 bp, Artificial Sequence
  Description of Artificial Sequence: Synthetic oligonucleotide
  Target: ATXN1; (+) strand; PAM type: NRG; PAM sequence: TAG
actgcagcacctatgagtct

SEQ ID NO: 116905 - DNA, 20 bp, Artificial Sequence
  Description of Artificial Sequence: Synthetic oligonucleotide
  Target: ATXN1; (+) strand; PAM type: NRG; PAM sequence: CAG
agcacctatgagtcttagca

SEQ ID NO: 116906 - DNA, 20 bp, Artificial Sequence
  Description of Artificial Sequence: Synthetic oligonucleotide
  Target: ATXN1; (+) strand; PAM type: NRG; PAM sequence: GAG
cacctatgagtcttagcaca

SEQ ID NO: 116907 - DNA, 20 bp, Artificial Sequence
  Description of Artificial Sequence: Synthetic oligonucleotide
  Target: ATXN1; (+) strand; PAM type: NRG; PAM sequence: AAG
ctatgagtcttagcacagag

SEQ ID NO: 116908 - DNA, 20 bp, Artificial Sequence
  Description of Artificial Sequence: Synthetic oligonucleotide
  Target: ATXN1; (+) strand; PAM type: NRG; PAM sequence: AGG
tatgagtcttagcacagaga

SEQ ID NO: 116909 - DNA, 20 bp, Artificial Sequence
  Description of Artificial Sequence: Synthetic oligonucleotide
  Target: ATXN1; (+) strand; PAM type: NRG; PAM sequence: AAG
gcacagagaaggcactctgt

SEQ ID NO: 116910 - DNA, 20 bp, Artificial Sequence
  Description of Artificial Sequence: Synthetic oligonucleotide
  Target: ATXN1; (+) strand; PAM type: NRG; PAM sequence: TGG
agaaggcactctgtaagtat

SEQ ID NO: 116911 - DNA, 20 bp, Artificial Sequence
  Description of Artificial Sequence: Synthetic oligonucleotide
  Target: ATXN1; (+) strand; PAM type: NRG; PAM sequence: AAG
agtattggctcaataaataa

SEQ ID NO: 116912 - DNA, 20 bp, Artificial Sequence
  Description of Artificial Sequence: Synthetic oligonucleotide
  Target: ATXN1; (+) strand; PAM type: NRG; PAM sequence: AAG
agtgtcttacattgcccaac

SEQ ID NO: 116913 - DNA, 20 bp, Artificial Sequence
  Description of Artificial Sequence: Synthetic oligonucleotide
  Target: ATXN1; (+) strand; PAM type: NRG; PAM sequence: AGG
gtgtcttacattgcccaaca

SEQ ID NO: 116914 - DNA, 20 bp, Artificial Sequence
  Description of Artificial Sequence: Synthetic oligonucleotide
  Target: ATXN1; (+) strand; PAM type: NRG; PAM sequence: CAG
cccaacaaggacactatata

SEQ ID NO: 116915 - DNA, 20 bp, Artificial Sequence
  Description of Artificial Sequence: Synthetic oligonucleotide
  Target: ATXN1; (+) strand; PAM type: NRG; PAM sequence: CAG
tgtgcaacaatgctcacata

SEQ ID NO: 116916 - DNA, 20 bp, Artificial Sequence
  Description of Artificial Sequence: Synthetic oligonucleotide
  Target: ATXN1; (+) strand; PAM type: NRG; PAM sequence: TGG
gcaacaatgctcacatacag

SEQ ID NO: 116917 - DNA, 20 bp, Artificial Sequence
  Description of Artificial Sequence: Synthetic oligonucleotide
  Target: ATXN1; (+) strand; PAM type: NRG; PAM sequence: GAG
agtggaatttgaaaaccact

SEQ ID NO: 116918 - DNA, 20 bp, Artificial Sequence
  Description of Artificial Sequence: Synthetic oligonucleotide
  Target: ATXN1; (+) strand; PAM type: NRG; PAM sequence: TAG
gaatttgaaaaccactgagc

SEQ ID NO: 116919 - DNA, 20 bp, Artificial Sequence
  Description of Artificial Sequence: Synthetic oligonucleotide
  Target: ATXN1; (+) strand; PAM type: NRG; PAM sequence: AGG
aatttgaaaaccactgagct

SEQ ID NO: 116920 - DNA, 20 bp, Artificial Sequence
  Description of Artificial Sequence: Synthetic oligonucleotide
  Target: ATXN1; (+) strand; PAM type: NRG; PAM sequence: AAG
gaaaaccactgagctaggct

SEQ ID NO: 116921 - DNA, 20 bp, Artificial Sequence
  Description of Artificial Sequence: Synthetic oligonucleotide
  Target: ATXN1; (+) strand; PAM type: NRG; PAM sequence: AGG
aaaaccactgagctaggcta

SEQ ID NO: 116922 - DNA, 20 bp, Artificial Sequence
  Description of Artificial Sequence: Synthetic oligonucleotide
  Target: ATXN1; (+) strand; PAM type: NRG; PAM sequence: AAG
actgagctaggctaaggccc

SEQ ID NO: 116923 - DNA, 20 bp, Artificial Sequence
  Description of Artificial Sequence: Synthetic oligonucleotide
  Target: ATXN1; (+) strand; PAM type: NRG; PAM sequence: GAG
tgagctaggctaaggcccaa

SEQ ID NO: 116924 - DNA, 20 bp, Artificial Sequence
  Description of Artificial Sequence: Synthetic oligonucleotide
  Target: ATXN1; (+) strand; PAM type: NRG; PAM sequence: AGG
gagctaggctaaggcccaag

SEQ ID NO: 116925 - DNA, 20 bp, Artificial Sequence
  Description of Artificial Sequence: Synthetic oligonucleotide
  Target: ATXN1; (+) strand; PAM type: NRG; PAM sequence: AAG
taggctaaggcccaagagga

SEQ ID NO: 116926 - DNA, 20 bp, Artificial Sequence
  Description of Artificial Sequence: Synthetic oligonucleotide
  Target: ATXN1; (+) strand; PAM type: NRG; PAM sequence: CAG
cccaagaggaaagcctacat

SEQ ID NO: 116927 - DNA, 20 bp, Artificial Sequence
  Description of Artificial Sequence: Synthetic oligonucleotide
  Target: ATXN1; (+) strand; PAM type: NRG; PAM sequence: TGG
gcctacatcagatctgtgtc

SEQ ID NO: 116928 - DNA, 20 bp, Artificial Sequence
  Description of Artificial Sequence: Synthetic oligonucleotide
  Target: ATXN1; (+) strand; PAM type: NRG; PAM sequence: TAG
cactgcacctttgatgtccc

SEQ ID NO: 116929 - DNA, 20 bp, Artificial Sequence
  Description of Artificial Sequence: Synthetic oligonucleotide
  Target: ATXN1; (+) strand; PAM type: NRG; PAM sequence: CAG
tgcacctttgatgtccctag

SEQ ID NO: 116930 - DNA, 20 bp, Artificial Sequence
  Description of Artificial Sequence: Synthetic oligonucleotide
  Target: ATXN1; (+) strand; PAM type: NRG; PAM sequence: GAG
cacctttgatgtccctagca

SEQ ID NO: 116931 - DNA, 20 bp, Artificial Sequence
  Description of Artificial Sequence: Synthetic oligonucleotide
  Target: ATXN1; (+) strand; PAM type: NRG; PAM sequence: AAG
tgatgtccctagcagagatc

SEQ ID NO: 116932 - DNA, 20 bp, Artificial Sequence
  Description of Artificial Sequence: Synthetic oligonucleotide
  Target: ATXN1; (+) strand; PAM type: NRG; PAM sequence: AAG
caagcttttttgcttgcatg

SEQ ID NO: 116933 - DNA, 20 bp, Artificial Sequence
  Description of Artificial Sequence: Synthetic oligonucleotide
  Target: ATXN1; (+) strand; PAM type: NRG; PAM sequence: AGG
aagcttttttgcttgcatga

SEQ ID NO: 116934 - DNA, 20 bp, Artificial Sequence
  Description of Artificial Sequence: Synthetic oligonucleotide
  Target: ATXN1; (+) strand; PAM type: NRG; PAM sequence: GGG
agcttttttgcttgcatgaa

SEQ ID NO: 116935 - DNA, 20 bp, Artificial Sequence
  Description of Artificial Sequence: Synthetic oligonucleotide
  Target: ATXN1; (+) strand; PAM type: NRG; PAM sequence: TAG
ttttcttaactccattttgt

SEQ ID NO: 116936 - DNA, 20 bp, Artificial Sequence
  Description of Artificial Sequence: Synthetic oligonucleotide
  Target: ATXN1; (+) strand; PAM type: NRG; PAM sequence: AAG
cttaactccattttgttagt

SEQ ID NO: 116937 - DNA, 20 bp, Artificial Sequence
  Description of Artificial Sequence: Synthetic oligonucleotide
  Target: ATXN1; (+) strand; PAM type: NRG; PAM sequence: AGG
ttaactccattttgttagta

SEQ ID NO: 116938 - DNA, 20 bp, Artificial Sequence
  Description of Artificial Sequence: Synthetic oligonucleotide
  Target: ATXN1; (+) strand; PAM type: NRG; PAM sequence: AAG
tagtaaggctctacatcttc

SEQ ID NO: 116939 - DNA, 20 bp, Artificial Sequence
  Description of Artificial Sequence: Synthetic oligonucleotide
  Target: ATXN1; (+) strand; PAM type: NRG; PAM sequence: GAG
ttatttgttgctgttgttgt

SEQ ID NO: 116940 - DNA, 20 bp, Artificial Sequence
  Description of Artificial Sequence: Synthetic oligonucleotide
  Target: ATXN1; (+) strand; PAM type: NRG; PAM sequence: AGG
tatttgttgctgttgttgtg

SEQ ID NO: 116941 - DNA, 20 bp, Artificial Sequence
  Description of Artificial Sequence: Synthetic oligonucleotide
  Target: ATXN1; (+) strand; PAM type: NRG; PAM sequence: GGG
atttgttgctgttgttgtga

SEQ ID NO: 116942 - DNA, 20 bp, Artificial Sequence
  Description of Artificial Sequence: Synthetic oligonucleotide
  Target: ATXN1; (+) strand; PAM type: NRG; PAM sequence: AAG
tgctgttgttgtgagggtta

SEQ ID NO: 116943 - DNA, 20 bp, Artificial Sequence
  Description of Artificial Sequence: Synthetic oligonucleotide
  Target: ATXN1; (+) strand; PAM type: NRG; PAM sequence: AGG
gctgttgttgtgagggttaa

SEQ ID NO: 116944 - DNA, 20 bp, Artificial Sequence
  Description of Artificial Sequence: Synthetic oligonucleotide
  Target: ATXN1; (+) strand; PAM type: NRG; PAM sequence: GGG
ctgttgttgtgagggttaaa

SEQ ID NO: 116945 - DNA, 20 bp, Artificial Sequence
  Description of Artificial Sequence: Synthetic oligonucleotide
  Target: ATXN1; (+) strand; PAM type: NRG; PAM sequence: GGG
tgttgttgtgagggttaaag

SEQ ID NO: 116946 - DNA, 20 bp, Artificial Sequence
  Description of Artificial Sequence: Synthetic oligonucleotide
  Target: ATXN1; (+) strand; PAM type: NRG; PAM sequence: TAG
gttgtgagggttaaagggga

SEQ ID NO: 116947 - DNA, 20 bp, Artificial Sequence
  Description of Artificial Sequence: Synthetic oligonucleotide
  Target: ATXN1; (+) strand; PAM type: NRG; PAM sequence: AAG
tgagggttaaaggggatagc

SEQ ID NO: 116948 - DNA, 20 bp, Artificial Sequence
  Description of Artificial Sequence: Synthetic oligonucleotide
  Target: ATXN1; (+) strand; PAM type: NRG; PAM sequence: GAG
agggttaaaggggatagcaa

SEQ ID NO: 116949 - DNA, 20 bp, Artificial Sequence
  Description of Artificial Sequence: Synthetic oligonucleotide
  Target: ATXN1; (+) strand; PAM type: NRG; PAM sequence: AAG
ggatagcaagagttcttctg

SEQ ID NO: 116950 - DNA, 20 bp, Artificial Sequence
  Description of Artificial Sequence: Synthetic oligonucleotide
  Target: ATXN1; (+) strand; PAM type: NRG; PAM sequence: TAG
agcaagagttcttctgaagt

SEQ ID NO: 116951 - DNA, 20 bp, Artificial Sequence
  Description of Artificial Sequence: Synthetic oligonucleotide
  Target: ATXN1; (+) strand; PAM type: NRG; PAM sequence: TAG
ttcttctgaagttagattct

SEQ ID NO: 116952 - DNA, 20 bp, Artificial Sequence
  Description of Artificial Sequence: Synthetic oligonucleotide
  Target: ATXN1; (+) strand; PAM type: NRG; PAM sequence: TGG
atcaaatgtaacttccatcc

SEQ ID NO: 116953 - DNA, 20 bp, Artificial Sequence
  Description of Artificial Sequence: Synthetic oligonucleotide
  Target: ATXN1; (+) strand; PAM type: NRG; PAM sequence: TGG
ggcattgccacaactactaa

SEQ ID NO: 116954 - DNA, 20 bp, Artificial Sequence
  Description of Artificial Sequence: Synthetic oligonucleotide
  Target: ATXN1; (+) strand; PAM type: NRG; PAM sequence: GGG
gcattgccacaactactaat

SEQ ID NO: 116955 - DNA, 20 bp, Artificial Sequence
  Description of Artificial Sequence: Synthetic oligonucleotide
  Target: ATXN1; (+) strand; PAM type: NRG; PAM sequence: CAG
tgccacaactactaatgggc

SEQ ID NO: 116956 - DNA, 20 bp, Artificial Sequence
  Description of Artificial Sequence: Synthetic oligonucleotide
  Target: ATXN1; (+) strand; PAM type: NRG; PAM sequence: CAG
aatgggccagaccatactgc

SEQ ID NO: 116957 - DNA, 20 bp, Artificial Sequence
  Description of Artificial Sequence: Synthetic oligonucleotide
  Target: ATXN1; (+) strand; PAM type: NRG; PAM sequence: AGG
atgggccagaccatactgcc

SEQ ID NO: 116958 - DNA, 20 bp, Artificial Sequence
  Description of Artificial Sequence: Synthetic oligonucleotide
  Target: ATXN1; (+) strand; PAM type: NRG; PAM sequence: TAG
accatactgccaggcttgtg

SEQ ID NO: 116959 - DNA, 20 bp, Artificial Sequence
  Description of Artificial Sequence: Synthetic oligonucleotide
  Target: ATXN1; (+) strand; PAM type: NRG; PAM sequence: AAG
cttgtgtagatctcaaaata

SEQ ID NO: 116960 - DNA, 20 bp, Artificial Sequence
  Description of Artificial Sequence: Synthetic oligonucleotide
  Target: ATXN1; (+) strand; PAM type: NRG; PAM sequence: AGG
ttgtgtagatctcaaaataa

SEQ ID NO: 116961 - DNA, 20 bp, Artificial Sequence
  Description of Artificial Sequence: Synthetic oligonucleotide
  Target: ATXN1; (+) strand; PAM type: NRG; PAM sequence: CAG
ataaaggtatcccgtcatct

SEQ ID NO: 116962 - DNA, 20 bp, Artificial Sequence
  Description of Artificial Sequence: Synthetic oligonucleotide
  Target: ATXN1; (+) strand; PAM type: NRG; PAM sequence: CAG
ctcagtgacatcctgtttct

SEQ ID NO: 116963 - DNA, 20 bp, Artificial Sequence
  Description of Artificial Sequence: Synthetic oligonucleotide
  Target: ATXN1; (+) strand; PAM type: NRG; PAM sequence: AGG
tcagtgacatcctgtttctc

SEQ ID NO: 116964 - DNA, 20 bp, Artificial Sequence
  Description of Artificial Sequence: Synthetic oligonucleotide
  Target: ATXN1; (+) strand; PAM type: NRG; PAM sequence: TAG
gtgacatcctgtttctcagg

SEQ ID NO: 116965 - DNA, 20 bp, Artificial Sequence
  Description of Artificial Sequence: Synthetic oligonucleotide
  Target: ATXN1; (+) strand; PAM type: NRG; PAM sequence: AAG
catcctgtttctcaggtaga

SEQ ID NO: 116966 - DNA, 20 bp, Artificial Sequence
  Description of Artificial Sequence: Synthetic oligonucleotide
  Target: ATXN1; (+) strand; PAM type: NRG; PAM sequence: AGG
atcctgtttctcaggtagaa

SEQ ID NO: 116967 - DNA, 20 bp, Artificial Sequence
  Description of Artificial Sequence: Synthetic oligonucleotide
  Target: ATXN1; (+) strand; PAM type: NRG; PAM sequence: TAG
tttctcaggtagaaaggttg

SEQ ID NO: 116968 - DNA, 20 bp, Artificial Sequence
  Description of Artificial Sequence: Synthetic oligonucleotide
  Target: ATXN1; (+) strand; PAM type: NRG; PAM sequence: AAG
ttttttaaacatataaactt

SEQ ID NO: 116969 - DNA, 20 bp, Artificial Sequence
  Description of Artificial Sequence: Synthetic oligonucleotide
  Target: ATXN1; (+) strand; PAM type: NRG; PAM sequence: AAG
ccacttgcatgaaatttcac

SEQ ID NO: 116970 - DNA, 20 bp, Artificial Sequence
  Description of Artificial Sequence: Synthetic oligonucleotide
  Target: ATXN1; (+) strand; PAM type: NRG; PAM sequence: GAG
ttgcatgaaatttcacaagt

SEQ ID NO: 116971 - DNA, 20 bp, Artificial Sequence
  Description of Artificial Sequence: Synthetic oligonucleotide
  Target: ATXN1; (+) strand; PAM type: NRG; PAM sequence: TAG
aatttcacaagtgagcaccc

SEQ ID NO: 116972 - DNA, 20 bp, Artificial Sequence
  Description of Artificial Sequence: Synthetic oligonucleotide
  Target: ATXN1; (+) strand; PAM type: NRG; PAM sequence: CAG
cacaagtgagcaccctagta

SEQ ID NO: 116973 - DNA, 20 bp, Artificial Sequence
  Description of Artificial Sequence: Synthetic oligonucleotide
  Target: ATXN1; (+) strand; PAM type: NRG; PAM sequence: GAG
tgagcaccctagtacagcat

SEQ ID NO: 116974 - DNA, 20 bp, Artificial Sequence
  Description of Artificial Sequence: Synthetic oligonucleotide
  Target: ATXN1; (+) strand; PAM type: NRG; PAM sequence: TGG
agtacagcatgagtgtatca

SEQ ID NO: 116975 - DNA, 20 bp, Artificial Sequence
  Description of Artificial Sequence: Synthetic oligonucleotide
  Target: ATXN1; (+) strand; PAM type: NRG; PAM sequence: CGG
agtgtatcatggacaattaa

SEQ ID NO: 116976 - DNA, 20 bp, Artificial Sequence
  Description of Artificial Sequence: Synthetic oligonucleotide
  Target: ATXN1; (+) strand; PAM type: NRG; PAM sequence: AAG
atcatggacaattaacggcc

SEQ ID NO: 116977 - DNA, 20 bp, Artificial Sequence
  Description of Artificial Sequence: Synthetic oligonucleotide
  Target: ATXN1; (+) strand; PAM type: NRG; PAM sequence: CAG
ggacaattaacggccaagac

SEQ ID NO: 116978 - DNA, 20 bp, Artificial Sequence
  Description of Artificial Sequence: Synthetic oligonucleotide
  Target: ATXN1; (+) strand; PAM type: NRG; PAM sequence: GAG
aagaccagacaaaacaccct

SEQ ID NO: 116979 - DNA, 20 bp, Artificial Sequence
  Description of Artificial Sequence: Synthetic oligonucleotide
  Target: ATXN1; (+) strand; PAM type: NRG; PAM sequence: CAG
acaccctgagttcttgtcct

SEQ ID NO: 116980 - DNA, 20 bp, Artificial Sequence
  Description of Artificial Sequence: Synthetic oligonucleotide
  Target: ATXN1; (+) strand; PAM type: NRG; PAM sequence: TGG
ttcttgtcctcagtgaattt

SEQ ID NO: 116981 - DNA, 20 bp, Artificial Sequence
  Description of Artificial Sequence: Synthetic oligonucleotide
  Target: ATXN1; (+) strand; PAM type: NRG; PAM sequence: TAG
gtatgtaataaataaacatg

SEQ ID NO: 116982 - DNA, 20 bp, Artificial Sequence
  Description of Artificial Sequence: Synthetic oligonucleotide
  Target: ATXN1; (+) strand; PAM type: NRG; PAM sequence: TGG
aataaacatgtagtataaaa

SEQ ID NO: 116983 - DNA, 20 bp, Artificial Sequence
  Description of Artificial Sequence: Synthetic oligonucleotide
  Target: ATXN1; (+) strand; PAM type: NRG; PAM sequence: TGG
gtgtaataaaattaaattat

SEQ ID NO: 116984 - DNA, 20 bp, Artificial Sequence
  Description of Artificial Sequence: Synthetic oligonucleotide
  Target: ATXN1; (+) strand; PAM type: NRG; PAM sequence: CAG
aattattggcattaaactgt

SEQ ID NO: 116985 - DNA, 20 bp, Artificial Sequence
  Description of Artificial Sequence: Synthetic oligonucleotide
  Target: ATXN1; (+) strand; PAM type: NRG; PAM sequence: TGG
tgtcagacataccatgctta

SEQ ID NO: 116986 - DNA, 20 bp, Artificial Sequence
  Description of Artificial Sequence: Synthetic oligonucleotide
  Target: ATXN1; (+) strand; PAM type: NRG; PAM sequence: TAG
cagacataccatgcttatgg

SEQ ID NO: 116987 - DNA, 20 bp, Artificial Sequence
  Description of Artificial Sequence: Synthetic oligonucleotide
  Target: ATXN1; (+) strand; PAM type: NRG; PAM sequence: CAG
atgcttatggtagccaatgt

SEQ ID NO: 116988 - DNA, 20 bp, Artificial Sequence
  Description of Artificial Sequence: Synthetic oligonucleotide
  Target: ATXN1; (+) strand; PAM type: NRG; PAM sequence: GAG
gcttatggtagccaatgtca

SEQ ID NO: 116989 - DNA, 20 bp, Artificial Sequence
  Description of Artificial Sequence: Synthetic oligonucleotide
  Target: ATXN1; (+) strand; PAM type: NRG; PAM sequence: AAG
aatgtcagagattaaatcta

SEQ ID NO: 116990 - DNA, 20 bp, Artificial Sequence
  Description of Artificial Sequence: Synthetic oligonucleotide
  Target: ATXN1; (+) strand; PAM type: NRG; PAM sequence: AAG
agagattaaatctaaagttc

SEQ ID NO: 116991 - DNA, 20 bp, Artificial Sequence
  Description of Artificial Sequence: Synthetic oligonucleotide
  Target: ATXN1; (+) strand; PAM type: NRG; PAM sequence: TGG
ttaaatctaaagttcaagat

SEQ ID NO: 116992 - DNA, 20 bp, Artificial Sequence
  Description of Artificial Sequence: Synthetic oligonucleotide
  Target: ATXN1; (+) strand; PAM type: NRG; PAM sequence: AAG
aagattggacccaccatgca

SEQ ID NO: 116993 - DNA, 20 bp, Artificial Sequence
  Description of Artificial Sequence: Synthetic oligonucleotide
  Target: ATXN1; (+) strand; PAM type: NRG; PAM sequence: AAG
tggacccaccatgcaaagca

SEQ ID NO: 116994 - DNA, 20 bp, Artificial Sequence
  Description of Artificial Sequence: Synthetic oligonucleotide
  Target: ATXN1; (+) strand; PAM type: NRG; PAM sequence: AAG
tttcttccttctaaaattga

SEQ ID NO: 116995 - DNA, 20 bp, Artificial Sequence
  Description of Artificial Sequence: Synthetic oligonucleotide
  Target: ATXN1; (+) strand; PAM type: NRG; PAM sequence: GAG
tcttccttctaaaattgaaa

SEQ ID NO: 116996 - DNA, 20 bp, Artificial Sequence
  Description of Artificial Sequence: Synthetic oligonucleotide
  Target: ATXN1; (+) strand; PAM type: NRG; PAM sequence: GAG
cttctaaaattgaaagagat

SEQ ID NO: 116997 - DNA, 20 bp, Artificial Sequence
  Description of Artificial Sequence: Synthetic oligonucleotide
  Target: ATXN1; (+) strand; PAM type: NRG; PAM sequence: CAG
gaaagagatgagccctccct

SEQ ID NO: 116998 - DNA, 20 bp, Artificial Sequence
  Description of Artificial Sequence: Synthetic oligonucleotide
  Target: ATXN1; (+) strand; PAM type: NRG; PAM sequence: AGG
aaagagatgagccctccctc

SEQ ID NO: 116999 - DNA, 20 bp, Artificial Sequence
  Description of Artificial Sequence: Synthetic oligonucleotide
  Target: ATXN1; (+) strand; PAM type: NRG; PAM sequence: GAG
gagccctccctcaggcttat

SEQ ID NO: 117000 - DNA, 20 bp, Artificial Sequence
  Description of Artificial Sequence: Synthetic oligonucleotide
  Target: ATXN1; (+) strand; PAM type: NRG; PAM sequence: AAG
tcttcttcttcttgtttttt

SEQ ID NO: 117001 - DNA, 20 bp, Artificial Sequence
  Description of Artificial Sequence: Synthetic oligonucleotide
  Target: ATXN1; (+) strand; PAM type: NRG; PAM sequence: GAG
tgttttttaagtacatcaat

SEQ ID NO: 117002 - DNA, 20 bp, Artificial Sequence
  Description of Artificial Sequence: Synthetic oligonucleotide
  Target: ATXN1; (+) strand; PAM type: NRG; PAM sequence: AAG
cattaatgttataatttaaa

SEQ ID NO: 117003 - DNA, 20 bp, Artificial Sequence
  Description of Artificial Sequence: Synthetic oligonucleotide
  Target: ATXN1; (+) strand; PAM type: NRG; PAM sequence: TGG
aaagtgttttctccctctaa

SEQ ID NO: 117004 - DNA, 20 bp, Artificial Sequence
  Description of Artificial Sequence: Synthetic oligonucleotide
  Target: ATXN1; (+) strand; PAM type: NRG; PAM sequence: AAG
gtgttttctccctctaatgg

SEQ ID NO: 117005 - DNA, 20 bp, Artificial Sequence
  Description of Artificial Sequence: Synthetic oligonucleotide
  Target: ATXN1; (+) strand; PAM type: NRG; PAM sequence: TAG
tctccctctaatggaagatt

SEQ ID NO: 117006 - DNA, 20 bp, Artificial Sequence
  Description of Artificial Sequence: Synthetic oligonucleotide
  Target: ATXN1; (+) strand; PAM type: NRG; PAM sequence: AGG
ctccctctaatggaagattt

SEQ ID NO: 117007 - DNA, 20 bp, Artificial Sequence
  Description of Artificial Sequence: Synthetic oligonucleotide
  Target: ATXN1; (+) strand; PAM type: NRG; PAM sequence: TAG
ctctaatggaagatttaggc

SEQ ID NO: 117008 - DNA, 20 bp, Artificial Sequence
  Description of Artificial Sequence: Synthetic oligonucleotide
  Target: ATXN1; (+) strand; PAM type: NRG; PAM sequence: GAG
ctaatggaagatttaggcta

SEQ ID NO: 117009 - DNA, 20 bp, Artificial Sequence
  Description of Artificial Sequence: Synthetic oligonucleotide
  Target: ATXN1; (+) strand; PAM type: NRG; PAM sequence: AGG
taatggaagatttaggctag

SEQ ID NO: 117010 - DNA, 20 bp, Artificial Sequence
  Description of Artificial Sequence: Synthetic oligonucleotide
  Target: ATXN1; (+) strand; PAM type: NRG; PAM sequence: AAG
tggaagatttaggctagagg

SEQ ID NO: 117011 - DNA, 20 bp, Artificial Sequence
  Description of Artificial Sequence: Synthetic oligonucleotide
  Target: ATXN1; (+) strand; PAM type: NRG; PAM sequence: TGG
aggctagaggaagctatcat

SEQ ID NO: 117012 - DNA, 20 bp, Artificial Sequence
  Description of Artificial Sequence: Synthetic oligonucleotide
  Target: ATXN1; (+) strand; PAM type: NRG; PAM sequence: CAG
atcattggtcctccaaatcg

SEQ ID NO: 117013 - DNA, 20 bp, Artificial Sequence
  Description of Artificial Sequence: Synthetic oligonucleotide
  Target: ATXN1; (+) strand; PAM type: NRG; PAM sequence: AGG
tcattggtcctccaaatcgc

SEQ ID NO: 117014 - DNA, 20 bp, Artificial Sequence
  Description of Artificial Sequence: Synthetic oligonucleotide
  Target: ATXN1; (+) strand; PAM type: NRG; PAM sequence: TGG
taccaattaaaaaatgtaaa

SEQ ID NO: 117015 - DNA, 20 bp, Artificial Sequence
  Description of Artificial Sequence: Synthetic oligonucleotide
  Target: ATXN1; (+) strand; PAM type: NRG; PAM sequence: TAG
tgtaaatggtttcacattgt

SEQ ID NO: 117016 - DNA, 20 bp, Artificial Sequence
  Description of Artificial Sequence: Synthetic oligonucleotide
  Target: ATXN1; (+) strand; PAM type: NRG; PAM sequence: CAG
tttcacattgttagcgatat

SEQ ID NO: 117017 - DNA, 20 bp, Artificial Sequence
  Description of Artificial Sequence: Synthetic oligonucleotide
  Target: ATXN1; (+) strand; PAM type: NRG; PAM sequence: AAG
gttagcgatatcagctttga

SEQ ID NO: 117018 - DNA, 20 bp, Artificial Sequence
  Description of Artificial Sequence: Synthetic oligonucleotide
  Target: ATXN1; (+) strand; PAM type: NRG; PAM sequence: AAG
agcgatatcagctttgaaag

SEQ ID NO: 117019 - DNA, 20 bp, Artificial Sequence
  Description of Artificial Sequence: Synthetic oligonucleotide
  Target: ATXN1; (+) strand; PAM type: NRG; PAM sequence: AAG
tcttttcttccttttgtttt

SEQ ID NO: 117020 - DNA, 20 bp, Artificial Sequence
  Description of Artificial Sequence: Synthetic oligonucleotide
  Target: ATXN1; (+) strand; PAM type: NRG; PAM sequence: AAG
gttttaagtgaacacgtttt

SEQ ID NO: 117021 - DNA, 20 bp, Artificial Sequence
  Description of Artificial Sequence: Synthetic oligonucleotide
  Target: ATXN1; (+) strand; PAM type: NRG; PAM sequence: TGG
ttaagtgaacacgttttaag

SEQ ID NO: 117022 - DNA, 20 bp, Artificial Sequence
  Description of Artificial Sequence: Synthetic oligonucleotide
  Target: ATXN1; (+) strand; PAM type: NRG; PAM sequence: AAG
tgaacacgttttaagtggat

SEQ ID NO: 117023 - DNA, 20 bp, Artificial Sequence
  Description of Artificial Sequence: Synthetic oligonucleotide
  Target: ATXN1; (+) strand; PAM type: NRG; PAM sequence: AAG
gttttaagtggataagttta

SEQ ID NO: 117024 - DNA, 20 bp, Artificial Sequence
  Description of Artificial Sequence: Synthetic oligonucleotide
  Target: ATXN1; (+) strand; PAM type: NRG; PAM sequence: AGG
ttttaagtggataagtttaa

SEQ ID NO: 117025 - DNA, 20 bp, Artificial Sequence
  Description of Artificial Sequence: Synthetic oligonucleotide
  Target: ATXN1; (+) strand; PAM type: NRG; PAM sequence: GAG
tttaaaggaaaacatatcct

SEQ ID NO: 117026 - DNA, 20 bp, Artificial Sequence
  Description of Artificial Sequence: Synthetic oligonucleotide
  Target: ATXN1; (+) strand; PAM type: NRG; PAM sequence: AAG
aaaacatatcctgagcttgc

SEQ ID NO: 117027 - DNA, 20 bp, Artificial Sequence
  Description of Artificial Sequence: Synthetic oligonucleotide
  Target: ATXN1; (+) strand; PAM type: NRG; PAM sequence: AGG
aaacatatcctgagcttgca

SEQ ID NO: 117028 - DNA, 20 bp, Artificial Sequence
  Description of Artificial Sequence: Synthetic oligonucleotide
  Target: ATXN1; (+) strand; PAM type: NRG; PAM sequence: TAG
ttatttgcaactccttattt

SEQ ID NO: 117029 - DNA, 20 bp, Artificial Sequence
  Description of Artificial Sequence: Synthetic oligonucleotide
  Target: ATXN1; (+) strand; PAM type: NRG; PAM sequence: AGG
tatttgcaactccttatttt

SEQ ID NO: 117030 - DNA, 20 bp, Artificial Sequence
  Description of Artificial Sequence: Synthetic oligonucleotide
  Target: ATXN1; (+) strand; PAM type: NRG; PAM sequence: GGG
atttgcaactccttatttta

SEQ ID NO: 117031 - DNA, 20 bp, Artificial Sequence
  Description of Artificial Sequence: Synthetic oligonucleotide
  Target: ATXN1; (+) strand; PAM type: NRG; PAM sequence: CAG
aactccttattttagggaat

SEQ ID NO: 117032 - DNA, 20 bp, Artificial Sequence
  Description of Artificial Sequence: Synthetic oligonucleotide
  Target: ATXN1; (+) strand; PAM type: NRG; PAM sequence: AGG
actccttattttagggaatc

SEQ ID NO: 117033 - DNA, 20 bp, Artificial Sequence
  Description of Artificial Sequence: Synthetic oligonucleotide
  Target: ATXN1; (+) strand; PAM type: NRG; PAM sequence: GGG
ctccttattttagggaatca

SEQ ID NO: 117034 - DNA, 20 bp, Artificial Sequence
  Description of Artificial Sequence: Synthetic oligonucleotide
  Target: ATXN1; (+) strand; PAM type: NRG; PAM sequence: AAG
aaaaatatacctaacaacaa

SEQ ID NO: 117035 - DNA, 20 bp, Artificial Sequence
  Description of Artificial Sequence: Synthetic oligonucleotide
  Target: ATXN1; (+) strand; PAM type: NRG; PAM sequence: AGG
aaaatatacctaacaacaaa

SEQ ID NO: 117036 - DNA, 20 bp, Artificial Sequence
  Description of Artificial Sequence: Synthetic oligonucleotide
  Target: ATXN1; (+) strand; PAM type: NRG; PAM sequence: TGG
aacaacaaaaggcaataaat

SEQ ID NO: 117037 - DNA, 20 bp, Artificial Sequence
  Description of Artificial Sequence: Synthetic oligonucleotide
  Target: ATXN1; (+) strand; PAM type: NRG; PAM sequence: AAG
aggcaataaattggaaactg

SEQ ID NO: 117038 - DNA, 20 bp, Artificial Sequence
  Description of Artificial Sequence: Synthetic oligonucleotide
  Target: ATXN1; (+) strand; PAM type: NRG; PAM sequence: AAG
taaattggaaactgaagtta

SEQ ID NO: 117039 - DNA, 20 bp, Artificial Sequence
  Description of Artificial Sequence: Synthetic oligonucleotide
  Target: ATXN1; (+) strand; PAM type: NRG; PAM sequence: AAG
attggaaactgaagttaaag

SEQ ID NO: 117040 - DNA, 20 bp, Artificial Sequence
  Description of Artificial Sequence: Synthetic oligonucleotide
  Target: ATXN1; (+) strand; PAM type: NRG; PAM sequence: CAG
actgaagttaaagaagattg

SEQ ID NO: 117041 - DNA, 20 bp, Artificial Sequence
  Description of Artificial Sequence: Synthetic oligonucleotide
  Target: ATXN1; (+) strand; PAM type: NRG; PAM sequence: AAG
aaatttctgtgttcatcaca

SEQ ID NO: 117042 - DNA, 20 bp, Artificial Sequence
  Description of Artificial Sequence: Synthetic oligonucleotide
  Target: ATXN1; (+) strand; PAM type: NRG; PAM sequence: AAG
ttctttcttcttgattttat

SEQ ID NO: 117043 - DNA, 20 bp, Artificial Sequence
  Description of Artificial Sequence: Synthetic oligonucleotide
  Target: ATXN1; (+) strand; PAM type: NRG; PAM sequence: CAG
ttcttcttgattttataagt

SEQ ID NO: 117044 - DNA, 20 bp, Artificial Sequence
  Description of Artificial Sequence: Synthetic oligonucleotide
  Target: ATXN1; (+) strand; PAM type: NRG; PAM sequence: GAG
ctttattcgtttcatatgtt

SEQ ID NO: 117045 - DNA, 20 bp, Artificial Sequence
  Description of Artificial Sequence: Synthetic oligonucleotide
  Target: ATXN1; (+) strand; PAM type: NRG; PAM sequence: AGG
tttattcgtttcatatgttg

SEQ ID NO: 117046 - DNA, 20 bp, Artificial Sequence
  Description of Artificial Sequence: Synthetic oligonucleotide
  Target: ATXN1; (+) strand; PAM type: NRG; PAM sequence: AAG
gtttcatatgttgaggtttc

SEQ ID NO: 117047 - DNA, 20 bp, Artificial Sequence
  Description of Artificial Sequence: Synthetic oligonucleotide
  Target: ATXN1; (+) strand; PAM type: NRG; PAM sequence: AAG
tttcaagattgtgtttgaaa

SEQ ID NO: 117048 - DNA, 20 bp, Artificial Sequence
  Description of Artificial Sequence: Synthetic oligonucleotide
  Target: ATXN1; (+) strand; PAM type: NRG; PAM sequence: AAG
caagattgtgtttgaaaaag

SEQ ID NO: 117049 - DNA, 20 bp, Artificial Sequence
  Description of Artificial Sequence: Synthetic oligonucleotide
  Target: ATXN1; (+) strand; PAM type: NRG; PAM sequence: TAG
gattgtgtttgaaaaagaag

SEQ ID NO: 117050 - DNA, 20 bp, Artificial Sequence
  Description of Artificial Sequence: Synthetic oligonucleotide
  Target: ATXN1; (+) strand; PAM type: NRG; PAM sequence: GAG
ttgtgtttgaaaaagaagta

SEQ ID NO: 117051 - DNA, 20 bp, Artificial Sequence
  Description of Artificial Sequence: Synthetic oligonucleotide
  Target: ATXN1; (+) strand; PAM type: NRG; PAM sequence: AAG
aaaaatatttgtaaacctcc

SEQ ID NO: 117052 - DNA, 20 bp, Artificial Sequence
  Description of Artificial Sequence: Synthetic oligonucleotide
  Target: ATXN1; (+) strand; PAM type: NRG; PAM sequence: AAG
tatttgtaaacctccaagta

SEQ ID NO: 117053 - DNA, 20 bp, Artificial Sequence
  Description of Artificial Sequence: Synthetic oligonucleotide
  Target: ATXN1; (+) strand; PAM type: NRG; PAM sequence: AGG
atttgtaaacctccaagtaa

SEQ ID NO: 117054 - DNA, 20 bp, Artificial Sequence
  Description of Artificial Sequence: Synthetic oligonucleotide
  Target: ATXN1; (+) strand; PAM type: NRG; PAM sequence: CAG
agtaaaggcaatgaatgata

SEQ ID NO: 117055 - DNA, 20 bp, Artificial Sequence
  Description of Artificial Sequence: Synthetic oligonucleotide
  Target: ATXN1; (+) strand; PAM type: NRG; PAM sequence: TGG
tgatacagaatttgtacctg

SEQ ID NO: 117056 - DNA, 20 bp, Artificial Sequence
  Description of Artificial Sequence: Synthetic oligonucleotide
  Target: ATXN1; (+) strand; PAM type: NRG; PAM sequence: GGG
gatacagaatttgtacctgt

SEQ ID NO: 117057 - DNA, 20 bp, Artificial Sequence
  Description of Artificial Sequence: Synthetic oligonucleotide
  Target: ATXN1; (+) strand; PAM type: NRG; PAM sequence: TAG
cctgtgggtgatcactgcca

SEQ ID NO: 117058 - DNA, 20 bp, Artificial Sequence
  Description of Artificial Sequence: Synthetic oligonucleotide
  Target: ATXN1; (+) strand; PAM type: NRG; PAM sequence: CAG
agctatataatgcctaaata

SEQ ID NO: 117059 - DNA, 20 bp, Artificial Sequence
  Description of Artificial Sequence: Synthetic oligonucleotide
  Target: ATXN1; (+) strand; PAM type: NRG; PAM sequence: AGG
gctatataatgcctaaatac

SEQ ID NO: 117060 - DNA, 20 bp, Artificial Sequence
  Description of Artificial Sequence: Synthetic oligonucleotide
  Target: ATXN1; (+) strand; PAM type: NRG; PAM sequence: AAG
tataatgcctaaatacagga

SEQ ID NO: 117061 - DNA, 20 bp, Artificial Sequence
  Description of Artificial Sequence: Synthetic oligonucleotide
  Target: ATXN1; (+) strand; PAM type: NRG; PAM sequence: GAG
taatgcctaaatacaggaaa

SEQ ID NO: 117062 - DNA, 20 bp, Artificial Sequence
  Description of Artificial Sequence: Synthetic oligonucleotide
  Target: ATXN1; (+) strand; PAM type: NRG; PAM sequence: AAG
tgcctaaatacaggaaagag

SEQ ID NO: 117063 - DNA, 20 bp, Artificial Sequence
  Description of Artificial Sequence: Synthetic oligonucleotide
  Target: ATXN1; (+) strand; PAM type: NRG; PAM sequence: AAG
aatacaggaaagagaagcaa

SEQ ID NO: 117064 - DNA, 20 bp, Artificial Sequence
  Description of Artificial Sequence: Synthetic oligonucleotide
  Target: ATXN1; (+) strand; PAM type: NRG; PAM sequence: CGG
aagcaaaagtttacaaaaac

SEQ ID NO: 117065 - DNA, 20 bp, Artificial Sequence
  Description of Artificial Sequence: Synthetic oligonucleotide
  Target: ATXN1; (+) strand; PAM type: NRG; PAM sequence: TGG
tttacaaaaaccggtccttg

SEQ ID NO: 117066 - DNA, 20 bp, Artificial Sequence
  Description of Artificial Sequence: Synthetic oligonucleotide
  Target: ATXN1; (+) strand; PAM type: NRG; PAM sequence: GGG
ttacaaaaaccggtccttgt

SEQ ID NO: 117067 - DNA, 20 bp, Artificial Sequence
  Description of Artificial Sequence: Synthetic oligonucleotide
  Target: ATXN1; (+) strand; PAM type: NRG; PAM sequence: CAG
cctatatgattgcaaacact

SEQ ID NO: 117068 - DNA, 20 bp, Artificial Sequence
  Description of Artificial Sequence: Synthetic oligonucleotide
  Target: ATXN1; (+) strand; PAM type: NRG; PAM sequence: AAG
gattgcaaacactcagatat

SEQ ID NO: 117069 - DNA, 20 bp, Artificial Sequence
  Description of Artificial Sequence: Synthetic oligonucleotide
  Target: ATXN1; (+) strand; PAM type: NRG; PAM sequence: TGG
cctcttctttttcacatgtt

SEQ ID NO: 117070 - DNA, 20 bp, Artificial Sequence
  Description of Artificial Sequence: Synthetic oligonucleotide
  Target: ATXN1; (+) strand; PAM type: NRG; PAM sequence: GGG
ctcttctttttcacatgttt

SEQ ID NO: 117071 - DNA, 20 bp, Artificial Sequence
  Description of Artificial Sequence: Synthetic oligonucleotide
  Target: ATXN1; (+) strand; PAM type: NRG; PAM sequence: GAG
cttctttttcacatgtttgg

SEQ ID NO: 117072 - DNA, 20 bp, Artificial Sequence
  Description of Artificial Sequence: Synthetic oligonucleotide
  Target: ATXN1; (+) strand; PAM type: NRG; PAM sequence: AAG
tttttcacatgtttgggagc

SEQ ID NO: 117073 - DNA, 20 bp, Artificial Sequence
  Description of Artificial Sequence: Synthetic oligonucleotide
  Target: ATXN1; (+) strand; PAM type: NRG; PAM sequence: TAG
ttcacatgtttgggagcaag

SEQ ID NO: 117074 - DNA, 20 bp, Artificial Sequence
  Description of Artificial Sequence: Synthetic oligonucleotide
  Target: ATXN1; (+) strand; PAM type: NRG; PAM sequence: AGG
tcacatgtttgggagcaagt

SEQ ID NO: 117075 - DNA, 20 bp, Artificial Sequence
  Description of Artificial Sequence: Synthetic oligonucleotide
  Target: ATXN1; (+) strand; PAM type: NRG; PAM sequence: AAG
tgtttgggagcaagtaggca

SEQ ID NO: 117076 - DNA, 20 bp, Artificial Sequence
  Description of Artificial Sequence: Synthetic oligonucleotide
  Target: ATXN1; (+) strand; PAM type: NRG; PAM sequence: TGG
gggagcaagtaggcaaagcc

SEQ ID NO: 117077 - DNA, 20 bp, Artificial Sequence
  Description of Artificial Sequence: Synthetic oligonucleotide
  Target: ATXN1; (+) strand; PAM type: NRG; PAM sequence: TGG
catgtgtttacacacatgca

SEQ ID NO: 117078 - DNA, 20 bp, Artificial Sequence
  Description of Artificial Sequence: Synthetic oligonucleotide
  Target: ATXN1; (+) strand; PAM type: NRG; PAM sequence: TAG
ttacacacatgcatggttct

SEQ ID NO: 117079 - DNA, 20 bp, Artificial Sequence
  Description of Artificial Sequence: Synthetic oligonucleotide
  Target: ATXN1; (+) strand; PAM type: NRG; PAM sequence: GAG
acacacatgcatggttctta

SEQ ID NO: 117080 - DNA, 20 bp, Artificial Sequence
  Description of Artificial Sequence: Synthetic oligonucleotide
  Target: ATXN1; (+) strand; PAM type: NRG; PAM sequence: TGG
catgcatggttcttagagaa

SEQ ID NO: 117081 - DNA, 20 bp, Artificial Sequence
  Description of Artificial Sequence: Synthetic oligonucleotide
  Target: ATXN1; (+) strand; PAM type: NRG; PAM sequence: AAG
gcatggttcttagagaatgg

SEQ ID NO: 117082 - DNA, 20 bp, Artificial Sequence
  Description of Artificial Sequence: Synthetic oligonucleotide
  Target: ATXN1; (+) strand; PAM type: NRG; PAM sequence: AGG
catggttcttagagaatgga

SEQ ID NO: 117083 - DNA, 20 bp, Artificial Sequence
  Description of Artificial Sequence: Synthetic oligonucleotide
  Target: ATXN1; (+) strand; PAM type: NRG; PAM sequence: CAG
gttcttagagaatggaagga

SEQ ID NO: 117084 - DNA, 20 bp, Artificial Sequence
  Description of Artificial Sequence: Synthetic oligonucleotide
  Target: ATXN1; (+) strand; PAM type: NRG; PAM sequence: AGG
ttcttagagaatggaaggac

SEQ ID NO: 117085 - DNA, 20 bp, Artificial Sequence
  Description of Artificial Sequence: Synthetic oligonucleotide
  Target: ATXN1; (+) strand; PAM type: NRG; PAM sequence: GAG
cttagagaatggaaggacag

SEQ ID NO: 117086 - DNA, 20 bp, Artificial Sequence
  Description of Artificial Sequence: Synthetic oligonucleotide
  Target: ATXN1; (+) strand; PAM type: NRG; PAM sequence: TAG
atggaaggacaggagctgaa

SEQ ID NO: 117087 - DNA, 20 bp, Artificial Sequence
  Description of Artificial Sequence: Synthetic oligonucleotide
  Target: ATXN1; (+) strand; PAM type: NRG; PAM sequence: CAG
agctgaatagttccatctgc

SEQ ID NO: 117088 - DNA, 20 bp, Artificial Sequence
  Description of Artificial Sequence: Synthetic oligonucleotide
  Target: ATXN1; (+) strand; PAM type: NRG; PAM sequence: TAG
tccatctgccagtgataatg

SEQ ID NO: 117089 - DNA, 20 bp, Artificial Sequence
  Description of Artificial Sequence: Synthetic oligonucleotide
  Target: ATXN1; (+) strand; PAM type: NRG; PAM sequence: TAG
ctcccatcacccttcccatc

SEQ ID NO: 117090 - DNA, 20 bp, Artificial Sequence
  Description of Artificial Sequence: Synthetic oligonucleotide
  Target: ATXN1; (+) strand; PAM type: NRG; PAM sequence: AAG
catctagtgctctctgattc

SEQ ID NO: 117091 - DNA, 20 bp, Artificial Sequence
  Description of Artificial Sequence: Synthetic oligonucleotide
  Target: ATXN1; (+) strand; PAM type: NRG; PAM sequence: AGG
atctagtgctctctgattca

SEQ ID NO: 117092 - DNA, 20 bp, Artificial Sequence
  Description of Artificial Sequence: Synthetic oligonucleotide
  Target: ATXN1; (+) strand; PAM type: NRG; PAM sequence: GGG
tctagtgctctctgattcaa

SEQ ID NO: 117093 - DNA, 20 bp, Artificial Sequence
  Description of Artificial Sequence: Synthetic oligonucleotide
  Target: ATXN1; (+) strand; PAM type: NRG; PAM sequence: AAG
agtgctctctgattcaaggg

SEQ ID NO: 117094 - DNA, 20 bp, Artificial Sequence
  Description of Artificial Sequence: Synthetic oligonucleotide
  Target: ATXN1; (+) strand; PAM type: NRG; PAM sequence: AGG
gtgctctctgattcaaggga

SEQ ID NO: 117095 - DNA, 20 bp, Artificial Sequence
  Description of Artificial Sequence: Synthetic oligonucleotide
  Target: ATXN1; (+) strand; PAM type: NRG; PAM sequence: TGG
tcaagggaaggaatgtgctt

SEQ ID NO: 117096 - DNA, 20 bp, Artificial Sequence
  Description of Artificial Sequence: Synthetic oligonucleotide
  Target: ATXN1; (+) strand; PAM type: NRG; PAM sequence: AAG
agggaaggaatgtgctttgg

SEQ ID NO: 117097 - DNA, 20 bp, Artificial Sequence
  Description of Artificial Sequence: Synthetic oligonucleotide
  Target: ATXN1; (+) strand; PAM type: NRG; PAM sequence: GAG
ggaaggaatgtgctttggaa

SEQ ID NO: 117098 - DNA, 20 bp, Artificial Sequence
  Description of Artificial Sequence: Synthetic oligonucleotide
  Target: ATXN1; (+) strand; PAM type: NRG; PAM sequence: GAG
aaggaatgtgctttggaaga

SEQ ID NO: 117099 - DNA, 20 bp, Artificial Sequence
  Description of Artificial Sequence: Synthetic oligonucleotide
  Target: ATXN1; (+) strand; PAM type: NRG; PAM sequence: AGG
aggaatgtgctttggaagag

SEQ ID NO: 117100 - DNA, 20 bp, Artificial Sequence
  Description of Artificial Sequence: Synthetic oligonucleotide
  Target: ATXN1; (+) strand; PAM type: NRG; PAM sequence: GGG
ggaatgtgctttggaagaga

SEQ ID NO: 117101 - DNA, 20 bp, Artificial Sequence
  Description of Artificial Sequence: Synthetic oligonucleotide
  Target: ATXN1; (+) strand; PAM type: NRG; PAM sequence: CAG
atgtgctttggaagagaggg

SEQ ID NO: 117102 - DNA, 20 bp, Artificial Sequence
  Description of Artificial Sequence: Synthetic oligonucleotide
  Target: ATXN1; (+) strand; PAM type: NRG; PAM sequence: AGG
tgtgctttggaagagagggc

SEQ ID NO: 117103 - DNA, 20 bp, Artificial Sequence
  Description of Artificial Sequence: Synthetic oligonucleotide
  Target: ATXN1; (+) strand; PAM type: NRG; PAM sequence: GGG
gtgctttggaagagagggca

SEQ ID NO: 117104 - DNA, 20 bp, Artificial Sequence
  Description of Artificial Sequence: Synthetic oligonucleotide
  Target: ATXN1; (+) strand; PAM type: NRG; PAM sequence: GGG
tgctttggaagagagggcag

SEQ ID NO: 117105 - DNA, 20 bp, Artificial Sequence
  Description of Artificial Sequence: Synthetic oligonucleotide
  Target: ATXN1; (+) strand; PAM type: NRG; PAM sequence: CAG
gagggcaggggcttattact

SEQ ID NO: 117106 - DNA, 20 bp, Artificial Sequence
  Description of Artificial Sequence: Synthetic oligonucleotide
  Target: ATXN1; (+) strand; PAM type: NRG; PAM sequence: GAG
gggcaggggcttattactca

SEQ ID NO: 117107 - DNA, 20 bp, Artificial Sequence
  Description of Artificial Sequence: Synthetic oligonucleotide
  Target: ATXN1; (+) strand; PAM type: NRG; PAM sequence: GAG
gcaggggcttattactcaga

SEQ ID NO: 117108 - DNA, 20 bp, Artificial Sequence
  Description of Artificial Sequence: Synthetic oligonucleotide
  Target: ATXN1; (+) strand; PAM type: NRG; PAM sequence: TAG
gcttattactcagagagacg

SEQ ID NO: 117109 - DNA, 20 bp, Artificial Sequence
  Description of Artificial Sequence: Synthetic oligonucleotide
  Target: ATXN1; (+) strand; PAM type: NRG; PAM sequence: AGG
cttattactcagagagacgt

SEQ ID NO: 117110 - DNA, 20 bp, Artificial Sequence
  Description of Artificial Sequence: Synthetic oligonucleotide
  Target: ATXN1; (+) strand; PAM type: NRG; PAM sequence: AAG
ctcagagagacgtaggttca

SEQ ID NO: 117111 - DNA, 20 bp, Artificial Sequence
  Description of Artificial Sequence: Synthetic oligonucleotide
  Target: ATXN1; (+) strand; PAM type: NRG; PAM sequence: CAG
gagagacgtaggttcaaagc

SEQ ID NO: 117112 - DNA, 20 bp, Artificial Sequence
  Description of Artificial Sequence: Synthetic oligonucleotide
  Target: ATXN1; (+) strand; PAM type: NRG; PAM sequence: TAG
aaagccagcacgtttattat

SEQ ID NO: 117113 - DNA, 20 bp, Artificial Sequence
  Description of Artificial Sequence: Synthetic oligonucleotide
  Target: ATXN1; (+) strand; PAM type: NRG; PAM sequence: CAG
gccagcacgtttattattag

SEQ ID NO: 117114 - DNA, 20 bp, Artificial Sequence
  Description of Artificial Sequence: Synthetic oligonucleotide
  Target: ATXN1; (+) strand; PAM type: NRG; PAM sequence: GAG
cagcacgtttattattagca

SEQ ID NO: 117115 - DNA, 20 bp, Artificial Sequence
  Description of Artificial Sequence: Synthetic oligonucleotide
  Target: ATXN1; (+) strand; PAM type: NRG; PAM sequence: GAG
tgactcactcccattccatc

SEQ ID NO: 117116 - DNA, 20 bp, Artificial Sequence
  Description of Artificial Sequence: Synthetic oligonucleotide
  Target: ATXN1; (+) strand; PAM type: NRG; PAM sequence: TGG
agcctcttttatctgcaaca

SEQ ID NO: 117117 - DNA, 20 bp, Artificial Sequence
  Description of Artificial Sequence: Synthetic oligonucleotide
  Target: ATXN1; (+) strand; PAM type: NRG; PAM sequence: GAG
cctcttttatctgcaacatg

SEQ ID NO: 117118 - DNA, 20 bp, Artificial Sequence
  Description of Artificial Sequence: Synthetic oligonucleotide
  Target: ATXN1; (+) strand; PAM type: NRG; PAM sequence: GAG
ctgcaacatggagatgctat

SEQ ID NO: 117119 - DNA, 20 bp, Artificial Sequence
  Description of Artificial Sequence: Synthetic oligonucleotide
  Target: ATXN1; (+) strand; PAM type: NRG; PAM sequence: AAG
ggagatgctatgagtttctg

SEQ ID NO: 117120 - DNA, 20 bp, Artificial Sequence
  Description of Artificial Sequence: Synthetic oligonucleotide
  Target: ATXN1; (+) strand; PAM type: NRG; PAM sequence: AAG
cataaaaccacctccatatg

SEQ ID NO: 117121 - DNA, 20 bp, Artificial Sequence
  Description of Artificial Sequence: Synthetic oligonucleotide
  Target: ATXN1; (+) strand; PAM type: NRG; PAM sequence: TAG
catatgaagtattcaatgaa

SEQ ID NO: 117122 - DNA, 20 bp, Artificial Sequence
  Description of Artificial Sequence: Synthetic oligonucleotide
  Target: ATXN1; (+) strand; PAM type: NRG; PAM sequence: TGG
atgaatagcttcctcccttc

SEQ ID NO: 117123 - DNA, 20 bp, Artificial Sequence
  Description of Artificial Sequence: Synthetic oligonucleotide
  Target: ATXN1; (+) strand; PAM type: NRG; PAM sequence: GGG
tgaatagcttcctcccttct

SEQ ID NO: 117124 - DNA, 20 bp, Artificial Sequence
  Description of Artificial Sequence: Synthetic oligonucleotide
  Target: ATXN1; (+) strand; PAM type: NRG; PAM sequence: GGG
gaatagcttcctcccttctg

SEQ ID NO: 117125 - DNA, 20 bp, Artificial Sequence
  Description of Artificial Sequence: Synthetic oligonucleotide
  Target: ATXN1; (+) strand; PAM type: NRG; PAM sequence: TAG
cctcccttctggggaccttg

SEQ ID NO: 117126 - DNA, 20 bp, Artificial Sequence
  Description of Artificial Sequence: Synthetic oligonucleotide
  Target: ATXN1; (+) strand; PAM type: NRG; PAM sequence: GAG
gaccttgtagaaatgctgat

SEQ ID NO: 117127 - DNA, 20 bp, Artificial Sequence
  Description of Artificial Sequence: Synthetic oligonucleotide
  Target: ATXN1; (+) strand; PAM type: NRG; PAM sequence: AGG
accttgtagaaatgctgatg

SEQ ID NO: 117128 - DNA, 20 bp, Artificial Sequence
  Description of Artificial Sequence: Synthetic oligonucleotide
  Target: ATXN1; (+) strand; PAM type: NRG; PAM sequence: CAG
aaatgctgatgaggctgctc

SEQ ID NO: 117129 - DNA, 20 bp, Artificial Sequence
  Description of Artificial Sequence: Synthetic oligonucleotide
  Target: ATXN1; (+) strand; PAM type: NRG; PAM sequence: TGG
ccaaaatcaatgtccaatct

SEQ ID NO: 117130 - DNA, 20 bp, Artificial Sequence
  Description of Artificial Sequence: Synthetic oligonucleotide
  Target: ATXN1; (+) strand; PAM type: NRG; PAM sequence: GGG
caaaatcaatgtccaatctt

SEQ ID NO: 117131 - DNA, 20 bp, Artificial Sequence
  Description of Artificial Sequence: Synthetic oligonucleotide
  Target: ATXN1; (+) strand; PAM type: NRG; PAM sequence: AAG
atcaatgtccaatcttggga

SEQ ID NO: 117132 - DNA, 20 bp, Artificial Sequence
  Description of Artificial Sequence: Synthetic oligonucleotide
  Target: ATXN1; (+) strand; PAM type: NRG; PAM sequence: AGG
tcaatgtccaatcttgggaa

SEQ ID NO: 117133 - DNA, 20 bp, Artificial Sequence
  Description of Artificial Sequence: Synthetic oligonucleotide
  Target: ATXN1; (+) strand; PAM type: NRG; PAM sequence: TAG
aatcttgggaaaggaccttc

SEQ ID NO: 117134 - DNA, 20 bp, Artificial Sequence
  Description of Artificial Sequence: Synthetic oligonucleotide
  Target: ATXN1; (+) strand; PAM type: NRG; PAM sequence: AGG
atcttgggaaaggaccttct

SEQ ID NO: 117135 - DNA, 20 bp, Artificial Sequence
  Description of Artificial Sequence: Synthetic oligonucleotide
  Target: ATXN1; (+) strand; PAM type: NRG; PAM sequence: AAG
gggaaaggaccttctaggtg

SEQ ID NO: 117136 - DNA, 20 bp, Artificial Sequence
  Description of Artificial Sequence: Synthetic oligonucleotide
  Target: ATXN1; (+) strand; PAM type: NRG; PAM sequence: AGG
ggaaaggaccttctaggtga

SEQ ID NO: 117137 - DNA, 20 bp, Artificial Sequence
  Description of Artificial Sequence: Synthetic oligonucleotide
  Target: ATXN1; (+) strand; PAM type: NRG; PAM sequence: TGG
aaccccattcctaaacatca

SEQ ID NO: 117138 - DNA, 20 bp, Artificial Sequence
  Description of Artificial Sequence: Synthetic oligonucleotide
  Target: ATXN1; (+) strand; PAM type: NRG; PAM sequence: GAG
ccccattcctaaacatcatg

SEQ ID NO: 117139 - DNA, 20 bp, Artificial Sequence
  Description of Artificial Sequence: Synthetic oligonucleotide
  Target: ATXN1; (+) strand; PAM type: NRG; PAM sequence: GAG
ccattcctaaacatcatgga

SEQ ID NO: 117140 - DNA, 20 bp, Artificial Sequence
  Description of Artificial Sequence: Synthetic oligonucleotide
  Target: ATXN1; (+) strand; PAM type: NRG; PAM sequence: AGG
cattcctaaacatcatggag

SEQ ID NO: 117141 - DNA, 20 bp, Artificial Sequence
  Description of Artificial Sequence: Synthetic oligonucleotide
  Target: ATXN1; (+) strand; PAM type: NRG; PAM sequence: CAG
acatcatggagaggtcctct

SEQ ID NO: 117142 - DNA, 20 bp, Artificial Sequence
  Description of Artificial Sequence: Synthetic oligonucleotide
  Target: ATXN1; (+) strand; PAM type: NRG; PAM sequence: CAG
gagaggtcctctcagaaata

SEQ ID NO: 117143 - DNA, 20 bp, Artificial Sequence
  Description of Artificial Sequence: Synthetic oligonucleotide
  Target: ATXN1; (+) strand; PAM type: NRG; PAM sequence: AGG
agaggtcctctcagaaatac

SEQ ID NO: 117144 - DNA, 20 bp, Artificial Sequence
  Description of Artificial Sequence: Synthetic oligonucleotide
  Target: ATXN1; (+) strand; PAM type: NRG; PAM sequence: CAG
atccccatcctaacctcttt

SEQ ID NO: 117145 - DNA, 20 bp, Artificial Sequence
  Description of Artificial Sequence: Synthetic oligonucleotide
  Target: ATXN1; (+) strand; PAM type: NRG; PAM sequence: TAG
aacctctttcagcctcactt

SEQ ID NO: 117146 - DNA, 20 bp, Artificial Sequence
  Description of Artificial Sequence: Synthetic oligonucleotide
  Target: ATXN1; (+) strand; PAM type: NRG; PAM sequence: TGG
ctctttcagcctcactttag

SEQ ID NO: 117147 - DNA, 20 bp, Artificial Sequence
  Description of Artificial Sequence: Synthetic oligonucleotide
  Target: ATXN1; (+) strand; PAM type: NRG; PAM sequence: GAG
tgtgaacgcacctgatccat

SEQ ID NO: 117148 - DNA, 20 bp, Artificial Sequence
  Description of Artificial Sequence: Synthetic oligonucleotide
  Target: ATXN1; (+) strand; PAM type: NRG; PAM sequence: AGG
gtgaacgcacctgatccatg

SEQ ID NO: 117149 - DNA, 20 bp, Artificial Sequence
  Description of Artificial Sequence: Synthetic oligonucleotide
  Target: ATXN1; (+) strand; PAM type: NRG; PAM sequence: AAG
acctgatccatgaggattaa

SEQ ID NO: 117150 - DNA, 20 bp, Artificial Sequence
  Description of Artificial Sequence: Synthetic oligonucleotide
  Target: ATXN1; (+) strand; PAM type: NRG; PAM sequence: AGG
cctgatccatgaggattaaa

SEQ ID NO: 117151 - DNA, 20 bp, Artificial Sequence
  Description of Artificial Sequence: Synthetic oligonucleotide
  Target: ATXN1; (+) strand; PAM type: NRG; PAM sequence: CAG
catgaggattaaaaggacaa

SEQ ID NO: 117152 - DNA, 20 bp, Artificial Sequence
  Description of Artificial Sequence: Synthetic oligonucleotide
  Target: ATXN1; (+) strand; PAM type: NRG; PAM sequence: AGG
atgaggattaaaaggacaac

SEQ ID NO: 117153 - DNA, 20 bp, Artificial Sequence
  Description of Artificial Sequence: Synthetic oligonucleotide
  Target: ATXN1; (+) strand; PAM type: NRG; PAM sequence: GGG
tgaggattaaaaggacaaca

SEQ ID NO: 117154 - DNA, 20 bp, Artificial Sequence
  Description of Artificial Sequence: Synthetic oligonucleotide
  Target: ATXN1; (+) strand; PAM type: NRG; PAM sequence: GGG
gaggattaaaaggacaacag

SEQ ID NO: 117155 - DNA, 20 bp, Artificial Sequence
  Description of Artificial Sequence: Synthetic oligonucleotide
  Target: ATXN1; (+) strand; PAM type: NRG; PAM sequence: CGG
gattaaaaggacaacagggg

SEQ ID NO: 117156 - DNA, 20 bp, Artificial Sequence
  Description of Artificial Sequence: Synthetic oligonucleotide
  Target: ATXN1; (+) strand; PAM type: NRG; PAM sequence: CGG
taaaaggacaacaggggcgg

SEQ ID NO: 117157 - DNA, 20 bp, Artificial Sequence
  Description of Artificial Sequence: Synthetic oligonucleotide
  Target: ATXN1; (+) strand; PAM type: NRG; PAM sequence: GGG
aaaaggacaacaggggcggc

SEQ ID NO: 117158 - DNA, 20 bp, Artificial Sequence
  Description of Artificial Sequence: Synthetic oligonucleotide
  Target: ATXN1; (+) strand; PAM type: NRG; PAM sequence: GGG
aaaggacaacaggggcggcg

SEQ ID NO: 117159 - DNA, 20 bp, Artificial Sequence
  Description of Artificial Sequence: Synthetic oligonucleotide
  Target: ATXN1; (+) strand; PAM type: NRG; PAM sequence: GGG
aaggacaacaggggcggcgg

SEQ ID NO: 117160 - DNA, 20 bp, Artificial Sequence
  Description of Artificial Sequence: Synthetic oligonucleotide
  Target: ATXN1; (+) strand; PAM type: NRG; PAM sequence: TAG
acaacaggggcggcgggggt

SEQ ID NO: 117161 - DNA, 20 bp, Artificial Sequence
  Description of Artificial Sequence: Synthetic oligonucleotide
  Target: ATXN1; (+) strand; PAM type: NRG; PAM sequence: AAG
gggcggcgggggttagaaca

SEQ ID NO: 117162 - DNA, 20 bp, Artificial Sequence
  Description of Artificial Sequence: Synthetic oligonucleotide
  Target: ATXN1; (+) strand; PAM type: NRG; PAM sequence: AAG
gggggttagaacaaagatta

SEQ ID NO: 117163 - DNA, 20 bp, Artificial Sequence
  Description of Artificial Sequence: Synthetic oligonucleotide
  Target: ATXN1; (+) strand; PAM type: NRG; PAM sequence: TAG
ggttagaacaaagattaaag

SEQ ID NO: 117164 - DNA, 20 bp, Artificial Sequence
  Description of Artificial Sequence: Synthetic oligonucleotide
  Target: ATXN1; (+) strand; PAM type: NRG; PAM sequence: AAG
agattaaagtagaccccccc

SEQ ID NO: 117165 - DNA, 20 bp, Artificial Sequence
  Description of Artificial Sequence: Synthetic oligonucleotide
  Target: ATXN1; (+) strand; PAM type: NRG; PAM sequence: AGG
gattaaagtagaccccccca

SEQ ID NO: 117166 - DNA, 20 bp, Artificial Sequence
  Description of Artificial Sequence: Synthetic oligonucleotide
  Target: ATXN1; (+) strand; PAM type: NRG; PAM sequence: GGG
attaaagtagacccccccaa

SEQ ID NO: 117167 - DNA, 20 bp, Artificial Sequence
  Description of Artificial Sequence: Synthetic oligonucleotide
  Target: ATXN1; (+) strand; PAM type: NRG; PAM sequence: AAG
ccccaagggccaacgctatg

SEQ ID NO: 117168 - DNA, 20 bp, Artificial Sequence
  Description of Artificial Sequence: Synthetic oligonucleotide
  Target: ATXN1; (+) strand; PAM type: NRG; PAM sequence: GAG
ccaagggccaacgctatgaa

SEQ ID NO: 117169 - DNA, 20 bp, Artificial Sequence
  Description of Artificial Sequence: Synthetic oligonucleotide
  Target: ATXN1; (+) strand; PAM type: NRG; PAM sequence: TGG
caacgctatgaagagccaca

SEQ ID NO: 117170 - DNA, 20 bp, Artificial Sequence
  Description of Artificial Sequence: Synthetic oligonucleotide
  Target: ATXN1; (+) strand; PAM type: NRG; PAM sequence: GAG
gagccacatggccattcctt

SEQ ID NO: 117171 - DNA, 20 bp, Artificial Sequence
  Description of Artificial Sequence: Synthetic oligonucleotide
  Target: ATXN1; (+) strand; PAM type: NRG; PAM sequence: CGG
attactaatcatgaatcatt

SEQ ID NO: 117172 - DNA, 20 bp, Artificial Sequence
  Description of Artificial Sequence: Synthetic oligonucleotide
  Target: ATXN1; (+) strand; PAM type: NRG; PAM sequence: CAG
tcatgaatcattcggttctc

SEQ ID NO: 117173 - DNA, 20 bp, Artificial Sequence
  Description of Artificial Sequence: Synthetic oligonucleotide
  Target: ATXN1; (+) strand; PAM type: NRG; PAM sequence: AGG
catgaatcattcggttctcc

SEQ ID NO: 117174 - DNA, 20 bp, Artificial Sequence
  Description of Artificial Sequence: Synthetic oligonucleotide
  Target: ATXN1; (+) strand; PAM type: NRG; PAM sequence: TGG
ggttctccaggatgctcctt

SEQ ID NO: 117175 - DNA, 20 bp, Artificial Sequence
  Description of Artificial Sequence: Synthetic oligonucleotide
  Target: ATXN1; (+) strand; PAM type: NRG; PAM sequence: AAG
tgctcctttggcttaaaccg

SEQ ID NO: 117176 - DNA, 20 bp, Artificial Sequence
  Description of Artificial Sequence: Synthetic oligonucleotide
  Target: ATXN1; (+) strand; PAM type: NRG; PAM sequence: AAG
aaccgaagtcaatcttttct

SEQ ID NO: 117177 - DNA, 20 bp, Artificial Sequence
  Description of Artificial Sequence: Synthetic oligonucleotide
  Target: ATXN1; (+) strand; PAM type: NRG; PAM sequence: TGG
aatcttttctaagcattaaa

SEQ ID NO: 117178 - DNA, 20 bp, Artificial Sequence
  Description of Artificial Sequence: Synthetic oligonucleotide
  Target: ATXN1; (+) strand; PAM type: NRG; PAM sequence: GGG
atcttttctaagcattaaat

SEQ ID NO: 117179 - DNA, 20 bp, Artificial Sequence
  Description of Artificial Sequence: Synthetic oligonucleotide
  Target: ATXN1; (+) strand; PAM type: NRG; PAM sequence: GGG
tcttttctaagcattaaatg

SEQ ID NO: 117180 - DNA, 20 bp, Artificial Sequence
  Description of Artificial Sequence: Synthetic oligonucleotide
  Target: ATXN1; (+) strand; PAM type: NRG; PAM sequence: AAG
catcttctcttcccatttaa

SEQ ID NO: 117181 - DNA, 20 bp, Artificial Sequence
  Description of Artificial Sequence: Synthetic oligonucleotide
  Target: ATXN1; (+) strand; PAM type: NRG; PAM sequence: AAG
ttctcttcccatttaaaagc

SEQ ID NO: 117182 - DNA, 20 bp, Artificial Sequence
  Description of Artificial Sequence: Synthetic oligonucleotide
  Target: ATXN1; (+) strand; PAM type: NRG; PAM sequence: CAG
tcttcccatttaaaagcaag

SEQ ID NO: 117183 - DNA, 20 bp, Artificial Sequence
  Description of Artificial Sequence: Synthetic oligonucleotide
  Target: ATXN1; (+) strand; PAM type: NRG; PAM sequence: CAG
aaagcaagcagttgccactt

SEQ ID NO: 117184 - DNA, 20 bp, Artificial Sequence
  Description of Artificial Sequence: Synthetic oligonucleotide
  Target: ATXN1; (+) strand; PAM type: NRG; PAM sequence: TAG
cttcagctgtacaaattata

SEQ ID NO: 117185 - DNA, 20 bp, Artificial Sequence
  Description of Artificial Sequence: Synthetic oligonucleotide
  Target: ATXN1; (+) strand; PAM type: NRG; PAM sequence: AGG
ttcagctgtacaaattatat

SEQ ID NO: 117186 - DNA, 20 bp, Artificial Sequence
  Description of Artificial Sequence: Synthetic oligonucleotide
  Target: ATXN1; (+) strand; PAM type: NRG; PAM sequence: TAG
aaattatataggattgaaaa

SEQ ID NO: 117187 - DNA, 20 bp, Artificial Sequence
  Description of Artificial Sequence: Synthetic oligonucleotide
  Target: ATXN1; (+) strand; PAM type: NRG; PAM sequence: TGG
aggattgaaaatagtataac

SEQ ID NO: 117188 - DNA, 20 bp, Artificial Sequence
  Description of Artificial Sequence: Synthetic oligonucleotide
  Target: ATXN1; (+) strand; PAM type: NRG; PAM sequence: TGG
ttgaaaatagtataactggt

SEQ ID NO: 117189 - DNA, 20 bp, Artificial Sequence
  Description of Artificial Sequence: Synthetic oligonucleotide
  Target: ATXN1; (+) strand; PAM type: NRG; PAM sequence: GGG
tgaaaatagtataactggtt

SEQ ID NO: 117190 - DNA, 20 bp, Artificial Sequence
  Description of Artificial Sequence: Synthetic oligonucleotide
  Target: ATXN1; (+) strand; PAM type: NRG; PAM sequence: CAG
atagtataactggttgggca

SEQ ID NO: 117191 - DNA, 20 bp, Artificial Sequence
  Description of Artificial Sequence: Synthetic oligonucleotide
  Target: ATXN1; (+) strand; PAM type: NRG; PAM sequence: CAG
gttgctcacgcctgtaatcc

SEQ ID NO: 117192 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagaactt

SEQ ID NO: 117193 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagaacttt

SEQ ID NO: 117194 - DNA, 20 bp, Artificial Sequence
  Description of Artificial Sequence: Synthetic oligonucleotide
  Target: ATXN1; (+) strand; PAM type: NRG; PAM sequence: CAG
tcccagaactttgggatgcc

SEQ ID NO: 117195 - DNA, 20 bp, Artificial Sequence
  Description of Artificial Sequence: Synthetic oligonucleotide
  Target: ATXN1; (+) strand; PAM type: NRG; PAM sequence: AGG
cccagaactttgggatgccc

SEQ ID NO: 117196 - DNA, 20 bp, Artificial Sequence
  Description of Artificial Sequence: Synthetic oligonucleotide
  Target: ATXN1; (+) strand; PAM type: NRG; PAM sequence: TGG
agaactttgggatgcccagg

SEQ ID NO: 117197 - DNA, 20 bp, Artificial Sequence
  Description of Artificial Sequence: Synthetic oligonucleotide
  Target: ATXN1; (+) strand; PAM type: NRG; PAM sequence: GGG
gaactttgggatgcccaggt

SEQ ID NO: 117198 - DNA, 20 bp, Artificial Sequence
  Description of Artificial Sequence: Synthetic oligonucleotide
  Target: ATXN1; (+) strand; PAM type: NRG; PAM sequence: TGG
ctttgggatgcccaggtggg

SEQ ID NO: 117199 - DNA, 20 bp, Artificial Sequence
  Description of Artificial Sequence: Synthetic oligonucleotide
  Target: ATXN1; (+) strand; PAM type: NRG; PAM sequence: AAG
cccaggtgggtggatcacca

SEQ ID NO: 117200 - DNA, 20 bp, Artificial Sequence
  Description of Artificial Sequence: Synthetic oligonucleotide
  Target: ATXN1; (+) strand; PAM type: NRG; PAM sequence: AGG
ccaggtgggtggatcaccaa

SEQ ID NO: 117201 - DNA, 20 bp, Artificial Sequence
  Description of Artificial Sequence: Synthetic oligonucleotide
  Target: ATXN1; (+) strand; PAM type: NRG; PAM sequence: CAG
gtgggtggatcaccaaaggt

SEQ ID NO: 117202 - DNA, 20 bp, Artificial Sequence
  Description of Artificial Sequence: Synthetic oligonucleotide
  Target: ATXN1; (+) strand; PAM type: NRG; PAM sequence: AGG
tgggtggatcaccaaaggtc

SEQ ID NO: 117203 - DNA, 20 bp, Artificial Sequence
  Description of Artificial Sequence: Synthetic oligonucleotide
  Target: ATXN1; (+) strand; PAM type: NRG; PAM sequence: GAG
tcaccaaaggtcaggaattc

SEQ ID NO: 117204 - DNA, 20 bp, Artificial Sequence
  Description of Artificial Sequence: Synthetic oligonucleotide
  Target: ATXN1; (+) strand; PAM type: NRG; PAM sequence: AAG
aaaggtcaggaattcgagac

SEQ ID NO: 117205 - DNA, 20 bp, Artificial Sequence
  Description of Artificial Sequence: Synthetic oligonucleotide
  Target: ATXN1; (+) strand; PAM type: NRG; PAM sequence: TGG
tcaggaattcgagacaagcc

SEQ ID NO: 117206 - DNA, 20 bp, Artificial Sequence
  Description of Artificial Sequence: Synthetic oligonucleotide
  Target: ATXN1; (+) strand; PAM type: NRG; PAM sequence: CAG
cgagacaagcctggccaaca

SEQ ID NO: 117207 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 117208 - DNA, 20 bp, Artificial Sequence
  Description of Artificial Sequence: Synthetic oligonucleotide
  Target: ATXN1; (+) strand; PAM type: NRG; PAM sequence: TAG
tctactgaaaatacaaaaat

SEQ ID NO: 117209 - DNA, 20 bp, Artificial Sequence
  Description of Artificial Sequence: Synthetic oligonucleotide
  Target: ATXN1; (+) strand; PAM type: NRG; PAM sequence: TAG
ctgaaaatacaaaaattagt

SEQ ID NO: 117210 - DNA, 20 bp, Artificial Sequence
  Description of Artificial Sequence: Synthetic oligonucleotide
  Target: ATXN1; (+) strand; PAM type: NRG; PAM sequence: CAG
acaaaaattagttagctact

SEQ ID NO: 117211 - DNA, 20 bp, Artificial Sequence
  Description of Artificial Sequence: Synthetic oligonucleotide
  Target: ATXN1; (+) strand; PAM type: NRG; PAM sequence: AGG
caaaaattagttagctactc

SEQ ID NO: 117212 - DNA, 20 bp, Artificial Sequence
  Description of Artificial Sequence: Synthetic oligonucleotide
  Target: ATXN1; (+) strand; PAM type: NRG; PAM sequence: GAG
aaaattagttagctactcag

SEQ ID NO: 117213 - DNA, 20 bp, Artificial Sequence
  Description of Artificial Sequence: Synthetic oligonucleotide
  Target: ATXN1; (+) strand; PAM type: NRG; PAM sequence: AGG
aaattagttagctactcagg

SEQ ID NO: 117214 - DNA, 20 bp, Artificial Sequence
  Description of Artificial Sequence: Synthetic oligonucleotide
  Target: ATXN1; (+) strand; PAM type: NRG; PAM sequence: GAG
agttagctactcaggaggct

SEQ ID NO: 117215 - DNA, 20 bp, Artificial Sequence
  Description of Artificial Sequence: Synthetic oligonucleotide
  Target: ATXN1; (+) strand; PAM type: NRG; PAM sequence: AGG
gttagctactcaggaggctg

SEQ ID NO: 117216 - DNA, 20 bp, Artificial Sequence
  Description of Artificial Sequence: Synthetic oligonucleotide
  Target: ATXN1; (+) strand; PAM type: NRG; PAM sequence: CAG
agctactcaggaggctgagg

SEQ ID NO: 117217 - DNA, 20 bp, Artificial Sequence
  Description of Artificial Sequence: Synthetic oligonucleotide
  Target: ATXN1; (+) strand; PAM type: NRG; PAM sequence: AAG
tactcaggaggctgaggcag

SEQ ID NO: 117218 - DNA, 20 bp, Artificial Sequence
  Description of Artificial Sequence: Synthetic oligonucleotide
  Target: ATXN1; (+) strand; PAM type: NRG; PAM sequence: GAG
cagaagaatcacttgaaccc

SEQ ID NO: 117219 - DNA, 20 bp, Artificial Sequence
  Description of Artificial Sequence: Synthetic oligonucleotide
  Target: ATXN1; (+) strand; PAM type: NRG; PAM sequence: AGG
agaagaatcacttgaacccg

SEQ ID NO: 117220 - DNA, 20 bp, Artificial Sequence
  Description of Artificial Sequence: Synthetic oligonucleotide
  Target: ATXN1; (+) strand; PAM type: NRG; PAM sequence: GGG
gaagaatcacttgaacccga

SEQ ID NO: 117221 - DNA, 20 bp, Artificial Sequence
  Description of Artificial Sequence: Synthetic oligonucleotide
  Target: ATXN1; (+) strand; PAM type: NRG; PAM sequence: CAG
aatcacttgaacccgagggc

SEQ ID NO: 117222 - DNA, 20 bp, Artificial Sequence
  Description of Artificial Sequence: Synthetic oligonucleotide
  Target: ATXN1; (+) strand; PAM type: NRG; PAM sequence: GAG
tcacttgaacccgagggcca

SEQ ID NO: 117223 - DNA, 20 bp, Artificial Sequence
  Description of Artificial Sequence: Synthetic oligonucleotide
  Target: ATXN1; (+) strand; PAM type: NRG; PAM sequence: CAG
aacccgagggccagagtttg

SEQ ID NO: 117224 - DNA, 20 bp, Artificial Sequence
  Description of Artificial Sequence: Synthetic oligonucleotide
  Target: ATXN1; (+) strand; PAM type: NRG; PAM sequence: GAG
cgagggccagagtttgcagt

SEQ ID NO: 117225 - DNA, 20 bp, Artificial Sequence
  Description of Artificial Sequence: Synthetic oligonucleotide
  Target: ATXN1; (+) strand; PAM type: NRG; PAM sequence: AAG
gccagagtttgcagtgagcc

SEQ ID NO: 117226 - DNA, 20 bp, Artificial Sequence
  Description of Artificial Sequence: Synthetic oligonucleotide
  Target: ATXN1; (+) strand; PAM type: NRG; PAM sequence: CAG
aagatcacaccactgcactc

SEQ ID NO: 117227 - DNA, 20 bp, Artificial Sequence
  Description of Artificial Sequence: Synthetic oligonucleotide
  Target: ATXN1; (+) strand; PAM type: NRG; PAM sequence: TGG
cacaccactgcactccagcc

SEQ ID NO: 117228 - DNA, 20 bp, Artificial Sequence
  Description of Artificial Sequence: Synthetic oligonucleotide
  Target: ATXN1; (+) strand; PAM type: NRG; PAM sequence: GGG
acaccactgcactccagcct

SEQ ID NO: 117229 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggcga

SEQ ID NO: 117230 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggcgaca

SEQ ID NO: 117231 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggcgacagagc

SEQ ID NO: 117232 - DNA, 20 bp, Artificial Sequence
  Description of Artificial Sequence: Synthetic oligonucleotide
  Target: ATXN1; (+) strand; PAM type: NRG; PAM sequence: AAG
gagactccgtctcaaaaaaa

SEQ ID NO: 117233 - DNA, 20 bp, Artificial Sequence
  Description of Artificial Sequence: Synthetic oligonucleotide
  Target: ATXN1; (+) strand; PAM type: NRG; PAM sequence: AGG
agactccgtctcaaaaaaaa

SEQ ID NO: 117234 - DNA, 20 bp, Artificial Sequence
  Description of Artificial Sequence: Synthetic oligonucleotide
  Target: ATXN1; (+) strand; PAM type: NRG; PAM sequence: CAG
tccgtctcaaaaaaaaaggc

SEQ ID NO: 117235 - DNA, 20 bp, Artificial Sequence
  Description of Artificial Sequence: Synthetic oligonucleotide
  Target: ATXN1; (+) strand; PAM type: NRG; PAM sequence: AGG
ccgtctcaaaaaaaaaggcc

SEQ ID NO: 117236 - DNA, 20 bp, Artificial Sequence
  Description of Artificial Sequence: Synthetic oligonucleotide
  Target: ATXN1; (+) strand; PAM type: NRG; PAM sequence: CAG
tcaaaaaaaaaggccaggtg

SEQ ID NO: 117237 - DNA, 20 bp, Artificial Sequence
  Description of Artificial Sequence: Synthetic oligonucleotide
  Target: ATXN1; (+) strand; PAM type: NRG; PAM sequence: CAG
gtgcctcatgcctgtaatcc

SEQ ID NO: 117238 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagcactt

SEQ ID NO: 117239 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 117240 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 117241 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 117242 - DNA, 20 bp, Artificial Sequence
  Description of Artificial Sequence: Synthetic oligonucleotide
  Target: ATXN1; (+) strand; PAM type: NRG; PAM sequence: AAG
tcccagcactttgggaggcc

SEQ ID NO: 117243 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggcca

SEQ ID NO: 117244 - DNA, 20 bp, Artificial Sequence
  Description of Artificial Sequence: Synthetic oligonucleotide
  Target: ATXN1; (+) strand; PAM type: NRG; PAM sequence: CGG
gcactttgggaggccaaggc

SEQ ID NO: 117245 - DNA, 20 bp, Artificial Sequence
  Description of Artificial Sequence: Synthetic oligonucleotide
  Target: ATXN1; (+) strand; PAM type: NRG; PAM sequence: CAG
ctttgggaggccaaggccgg

SEQ ID NO: 117246 - DNA, 20 bp, Artificial Sequence
  Description of Artificial Sequence: Synthetic oligonucleotide
  Target: ATXN1; (+) strand; PAM type: NRG; PAM sequence: GAG
ccaaggccggcagatcacct

SEQ ID NO: 117247 - DNA, 20 bp, Artificial Sequence
  Description of Artificial Sequence: Synthetic oligonucleotide
  Target: ATXN1; (+) strand; PAM type: NRG; PAM sequence: AGG
caaggccggcagatcacctg

SEQ ID NO: 117248 - DNA, 20 bp, Artificial Sequence
  Description of Artificial Sequence: Synthetic oligonucleotide
  Target: ATXN1; (+) strand; PAM type: NRG; PAM sequence: CGG
gccggcagatcacctgaggt

SEQ ID NO: 117249 - DNA, 20 bp, Artificial Sequence
  Description of Artificial Sequence: Synthetic oligonucleotide
  Target: ATXN1; (+) strand; PAM type: NRG; PAM sequence: GGG
ccggcagatcacctgaggtc

SEQ ID NO: 117250 - DNA, 20 bp, Artificial Sequence
  Description of Artificial Sequence: Synthetic oligonucleotide
  Target: ATXN1; (+) strand; PAM type: NRG; PAM sequence: GAG
ggcagatcacctgaggtcgg

SEQ ID NO: 117251 - DNA, 20 bp, Artificial Sequence
  Description of Artificial Sequence: Synthetic oligonucleotide
  Target: ATXN1; (+) strand; PAM type: NRG; PAM sequence: TGG
gatcacctgaggtcgggagt

SEQ ID NO: 117252 - DNA, 20 bp, Artificial Sequence
  Description of Artificial Sequence: Synthetic oligonucleotide
  Target: ATXN1; (+) strand; PAM type: NRG; PAM sequence: GAG
tcacctgaggtcgggagttg

SEQ ID NO: 117253 - DNA, 20 bp, Artificial Sequence
  Description of Artificial Sequence: Synthetic oligonucleotide
  Target: ATXN1; (+) strand; PAM type: NRG; PAM sequence: CAG
tgaggtcgggagttggagac

SEQ ID NO: 117254 - DNA, 20 bp, Artificial Sequence
  Description of Artificial Sequence: Synthetic oligonucleotide
  Target: ATXN1; (+) strand; PAM type: NRG; PAM sequence: TGG
ggagaccagcccgaccaaca

SEQ ID NO: 117255 - DNA, 20 bp, Artificial Sequence
  Description of Artificial Sequence: Synthetic oligonucleotide
  Target: ATXN1; (+) strand; PAM type: NRG; PAM sequence: GAG
agaccagcccgaccaacatg

SEQ ID NO: 117256 - DNA, 20 bp, Artificial Sequence
  Description of Artificial Sequence: Synthetic oligonucleotide
  Target: ATXN1; (+) strand; PAM type: NRG; PAM sequence: AGG
gaccagcccgaccaacatgg

SEQ ID NO: 117257 - DNA, 20 bp, Artificial Sequence
  Description of Artificial Sequence: Synthetic oligonucleotide
  Target: ATXN1; (+) strand; PAM type: NRG; PAM sequence: TAG
ctctgctaaaaatgtaaaat

SEQ ID NO: 117258 - DNA, 20 bp, Artificial Sequence
  Description of Artificial Sequence: Synthetic oligonucleotide
  Target: ATXN1; (+) strand; PAM type: NRG; PAM sequence: CGG
gctaaaaatgtaaaattagc

SEQ ID NO: 117259 - DNA, 20 bp, Artificial Sequence
  Description of Artificial Sequence: Synthetic oligonucleotide
  Target: ATXN1; (+) strand; PAM type: NRG; PAM sequence: GGG
ctaaaaatgtaaaattagcc

SEQ ID NO: 117260 - DNA, 20 bp, Artificial Sequence
  Description of Artificial Sequence: Synthetic oligonucleotide
  Target: ATXN1; (+) strand; PAM type: NRG; PAM sequence: TGG
aatgtaaaattagccgggcg

SEQ ID NO: 117261 - DNA, 20 bp, Artificial Sequence
  Description of Artificial Sequence: Synthetic oligonucleotide
  Target: ATXN1; (+) strand; PAM type: NRG; PAM sequence: TGG
gtaaaattagccgggcgtgg

SEQ ID NO: 117262 - DNA, 20 bp, Artificial Sequence
  Description of Artificial Sequence: Synthetic oligonucleotide
  Target: ATXN1; (+) strand; PAM type: NRG; PAM sequence: CAG
gtggcacatgcctgtaatcc

SEQ ID NO: 117263 - DNA, 20 bp, Artificial Sequence
  Description of Artificial Sequence: Synthetic oligonucleotide
  Target: ATXN1; (+) strand; PAM type: NRG; PAM sequence: CAG
tgcctgtaatcccagctact

SEQ ID NO: 117264 - DNA, 20 bp, Artificial Sequence
  Description of Artificial Sequence: Synthetic oligonucleotide
  Target: ATXN1; (+) strand; PAM type: NRG; PAM sequence: AAG
ctgtaatcccagctactcag

SEQ ID NO: 117265 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctactcaga

SEQ ID NO: 117266 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcagaaggct

SEQ ID NO: 117267 - DNA, 20 bp, Artificial Sequence
  Description of Artificial Sequence: Synthetic oligonucleotide
  Target: ATXN1; (+) strand; PAM type: NRG; PAM sequence: AGG
cccagctactcagaaggctg

SEQ ID NO: 117268 - DNA, 20 bp, Artificial Sequence
  Description of Artificial Sequence: Synthetic oligonucleotide
  Target: ATXN1; (+) strand; PAM type: NRG; PAM sequence: CAG
agctactcagaaggctgagg

SEQ ID NO: 117269 - DNA, 20 bp, Artificial Sequence
  Description of Artificial Sequence: Synthetic oligonucleotide
  Target: ATXN1; (+) strand; PAM type: NRG; PAM sequence: AGG
gctactcagaaggctgaggc

SEQ ID NO: 117270 - DNA, 20 bp, Artificial Sequence
  Description of Artificial Sequence: Synthetic oligonucleotide
  Target: ATXN1; (+) strand; PAM type: NRG; PAM sequence: GAG
tactcagaaggctgaggcag

SEQ ID NO: 117271 - DNA, 20 bp, Artificial Sequence
  Description of Artificial Sequence: Synthetic oligonucleotide
  Target: ATXN1; (+) strand; PAM type: NRG; PAM sequence: CAG
gcaggagaaccacttgaacc

SEQ ID NO: 117272 - DNA, 20 bp, Artificial Sequence
  Description of Artificial Sequence: Synthetic oligonucleotide
  Target: ATXN1; (+) strand; PAM type: NRG; PAM sequence: AGG
caggagaaccacttgaaccc

SEQ ID NO: 117273 - DNA, 20 bp, Artificial Sequence
  Description of Artificial Sequence: Synthetic oligonucleotide
  Target: ATXN1; (+) strand; PAM type: NRG; PAM sequence: GAG
ggagaaccacttgaacccag

SEQ ID NO: 117274 - DNA, 20 bp, Artificial Sequence
  Description of Artificial Sequence: Synthetic oligonucleotide
  Target: ATXN1; (+) strand; PAM type: NRG; PAM sequence: AGG
gagaaccacttgaacccagg

SEQ ID NO: 117275 - DNA, 20 bp, Artificial Sequence
  Description of Artificial Sequence: Synthetic oligonucleotide
  Target: ATXN1; (+) strand; PAM type: NRG; PAM sequence: CGG
aaccacttgaacccaggagg

SEQ ID NO: 117276 - DNA, 20 bp, Artificial Sequence
  Description of Artificial Sequence: Synthetic oligonucleotide
  Target: ATXN1; (+) strand; PAM type: NRG; PAM sequence: GAG
ccacttgaacccaggaggcg

SEQ ID NO: 117277 - DNA, 20 bp, Artificial Sequence
  Description of Artificial Sequence: Synthetic oligonucleotide
  Target: ATXN1; (+) strand; PAM type: NRG; PAM sequence: AGG
cacttgaacccaggaggcgg

SEQ ID NO: 117278 - DNA, 20 bp, Artificial Sequence
  Description of Artificial Sequence: Synthetic oligonucleotide
  Target: ATXN1; (+) strand; PAM type: NRG; PAM sequence: CAG
aacccaggaggcggaggttg

SEQ ID NO: 117279 - DNA, 20 bp, Artificial Sequence
  Description of Artificial Sequence: Synthetic oligonucleotide
  Target: ATXN1; (+) strand; PAM type: NRG; PAM sequence: GAG
caggaggcggaggttgcagt

SEQ ID NO: 117280 - DNA, 20 bp, Artificial Sequence
  Description of Artificial Sequence: Synthetic oligonucleotide
  Target: ATXN1; (+) strand; PAM type: NRG; PAM sequence: AAG
ggcggaggttgcagtgagcc

SEQ ID NO: 117281 - DNA, 20 bp, Artificial Sequence
  Description of Artificial Sequence: Synthetic oligonucleotide
  Target: ATXN1; (+) strand; PAM type: NRG; PAM sequence: CAG
aagatcgtgccattgctctc

SEQ ID NO: 117282 - DNA, 20 bp, Artificial Sequence
  Description of Artificial Sequence: Synthetic oligonucleotide
  Target: ATXN1; (+) strand; PAM type: NRG; PAM sequence: TGG
cgtgccattgctctccagcg

SEQ ID NO: 117283 - DNA, 20 bp, Artificial Sequence
  Description of Artificial Sequence: Synthetic oligonucleotide
  Target: ATXN1; (+) strand; PAM type: NRG; PAM sequence: GGG
gtgccattgctctccagcgt

SEQ ID NO: 117284 - DNA, 20 bp, Artificial Sequence
  Description of Artificial Sequence: Synthetic oligonucleotide
  Target: ATXN1; (+) strand; PAM type: NRG; PAM sequence: AAG
tgctctccagcgtgggcaac

SEQ ID NO: 117285 - DNA, 20 bp, Artificial Sequence
  Description of Artificial Sequence: Synthetic oligonucleotide
  Target: ATXN1; (+) strand; PAM type: NRG; PAM sequence: GAG
ctctccagcgtgggcaacaa

SEQ ID NO: 117286 - DNA, 20 bp, Artificial Sequence
  Description of Artificial Sequence: Synthetic oligonucleotide
  Target: ATXN1; (+) strand; PAM type: NRG; PAM sequence: AAG
ctccgtctcaaaaaaaaaaa

SEQ ID NO: 117287 - DNA, 20 bp, Artificial Sequence
  Description of Artificial Sequence: Synthetic oligonucleotide
  Target: ATXN1; (+) strand; PAM type: NRG; PAM sequence: AAG
gtctcaaaaaaaaaaaaaga

SEQ ID NO: 117288 - DNA, 20 bp, Artificial Sequence
  Description of Artificial Sequence: Synthetic oligonucleotide
  Target: ATXN1; (+) strand; PAM type: NRG; PAM sequence: TAG
aaaaaaaaaaagaaagaaaa

SEQ ID NO: 117289 - DNA, 20 bp, Artificial Sequence
  Description of Artificial Sequence: Synthetic oligonucleotide
  Target: ATXN1; (+) strand; PAM type: NRG; PAM sequence: TAG
aaaaaagaaagaaaatagta

SEQ ID NO: 117290 - DNA, 20 bp, Artificial Sequence
  Description of Artificial Sequence: Synthetic oligonucleotide
  Target: ATXN1; (+) strand; PAM type: NRG; PAM sequence: AAG
aaagaaaatagtatagttga

SEQ ID NO: 117291 - DNA, 20 bp, Artificial Sequence
  Description of Artificial Sequence: Synthetic oligonucleotide
  Target: ATXN1; (+) strand; PAM type: NRG; PAM sequence: TGG
tagtatagttgaaagaaacg

SEQ ID NO: 117292 - DNA, 20 bp, Artificial Sequence
  Description of Artificial Sequence: Synthetic oligonucleotide
  Target: ATXN1; (+) strand; PAM type: NRG; PAM sequence: GAG
gtatagttgaaagaaacgtg

SEQ ID NO: 117293 - DNA, 20 bp, Artificial Sequence
  Description of Artificial Sequence: Synthetic oligonucleotide
  Target: ATXN1; (+) strand; PAM type: NRG; PAM sequence: TAG
agaaacgtggagtttgtaat

SEQ ID NO: 117294 - DNA, 20 bp, Artificial Sequence
  Description of Artificial Sequence: Synthetic oligonucleotide
  Target: ATXN1; (+) strand; PAM type: NRG; PAM sequence: GAG
aaacgtggagtttgtaatta

SEQ ID NO: 117295 - DNA, 20 bp, Artificial Sequence
  Description of Artificial Sequence: Synthetic oligonucleotide
  Target: ATXN1; (+) strand; PAM type: NRG; PAM sequence: AAG
tctcttttcccccattctca

SEQ ID NO: 117296 - DNA, 20 bp, Artificial Sequence
  Description of Artificial Sequence: Synthetic oligonucleotide
  Target: ATXN1; (+) strand; PAM type: NRG; PAM sequence: CAG
tcccccattctcaaagcaaa

SEQ ID NO: 117297 - DNA, 20 bp, Artificial Sequence
  Description of Artificial Sequence: Synthetic oligonucleotide
  Target: ATXN1; (+) strand; PAM type: NRG; PAM sequence: AAG
gaaacaaatttcacaaaaac

SEQ ID NO: 117298 - DNA, 20 bp, Artificial Sequence
  Description of Artificial Sequence: Synthetic oligonucleotide
  Target: ATXN1; (+) strand; PAM type: NRG; PAM sequence: AAG
cacaaaaacaagttgtttaa

SEQ ID NO: 117299 - DNA, 20 bp, Artificial Sequence
  Description of Artificial Sequence: Synthetic oligonucleotide
  Target: ATXN1; (+) strand; PAM type: NRG; PAM sequence: AGG
acaaaaacaagttgtttaaa

SEQ ID NO: 117300 - DNA, 20 bp, Artificial Sequence
  Description of Artificial Sequence: Synthetic oligonucleotide
  Target: ATXN1; (+) strand; PAM type: NRG; PAM sequence: CAG
tatcctcctgtttctatctt

SEQ ID NO: 117301 - DNA, 20 bp, Artificial Sequence
  Description of Artificial Sequence: Synthetic oligonucleotide
  Target: ATXN1; (+) strand; PAM type: NRG; PAM sequence: AAG
cttgctgtctttgtctttct

SEQ ID NO: 117302 - DNA, 20 bp, Artificial Sequence
  Description of Artificial Sequence: Synthetic oligonucleotide
  Target: ATXN1; (+) strand; PAM type: NRG; PAM sequence: CAG
tctttgtctttctaagatgc

SEQ ID NO: 117303 - DNA, 20 bp, Artificial Sequence
  Description of Artificial Sequence: Synthetic oligonucleotide
  Target: ATXN1; (+) strand; PAM type: NRG; PAM sequence: GAG
tttgtctttctaagatgcca

SEQ ID NO: 117304 - DNA, 20 bp, Artificial Sequence
  Description of Artificial Sequence: Synthetic oligonucleotide
  Target: ATXN1; (+) strand; PAM type: NRG; PAM sequence: AAG
gtctttctaagatgccagag

SEQ ID NO: 117305 - DNA, 20 bp, Artificial Sequence
  Description of Artificial Sequence: Synthetic oligonucleotide
  Target: ATXN1; (+) strand; PAM type: NRG; PAM sequence: TAG
agagaagtttcctctgcata

SEQ ID NO: 117306 - DNA, 20 bp, Artificial Sequence
  Description of Artificial Sequence: Synthetic oligonucleotide
  Target: ATXN1; (+) strand; PAM type: NRG; PAM sequence: TGG
tctgcatatagaaaatattc

SEQ ID NO: 117307 - DNA, 20 bp, Artificial Sequence
  Description of Artificial Sequence: Synthetic oligonucleotide
  Target: ATXN1; (+) strand; PAM type: NRG; PAM sequence: GGG
ctgcatatagaaaatattct

SEQ ID NO: 117308 - DNA, 20 bp, Artificial Sequence
  Description of Artificial Sequence: Synthetic oligonucleotide
  Target: ATXN1; (+) strand; PAM type: NRG; PAM sequence: TAG
tgtctgtcttgtgccctcac

SEQ ID NO: 117309 - DNA, 20 bp, Artificial Sequence
  Description of Artificial Sequence: Synthetic oligonucleotide
  Target: ATXN1; (+) strand; PAM type: NRG; PAM sequence: AGG
gtctgtcttgtgccctcact

SEQ ID NO: 117310 - DNA, 20 bp, Artificial Sequence
  Description of Artificial Sequence: Synthetic oligonucleotide
  Target: ATXN1; (+) strand; PAM type: NRG; PAM sequence: GGG
tctgtcttgtgccctcacta

SEQ ID NO: 117311 - DNA, 20 bp, Artificial Sequence
  Description of Artificial Sequence: Synthetic oligonucleotide
  Target: ATXN1; (+) strand; PAM type: NRG; PAM sequence: AAG
gtcttgtgccctcactaggg

SEQ ID NO: 117312 - DNA, 20 bp, Artificial Sequence
  Description of Artificial Sequence: Synthetic oligonucleotide
  Target: ATXN1; (+) strand; PAM type: NRG; PAM sequence: TAG
cctcactagggaagtcccct

SEQ ID NO: 117313 - DNA, 20 bp, Artificial Sequence
  Description of Artificial Sequence: Synthetic oligonucleotide
  Target: ATXN1; (+) strand; PAM type: NRG; PAM sequence: AGG
ctcactagggaagtcccctt

SEQ ID NO: 117314 - DNA, 20 bp, Artificial Sequence
  Description of Artificial Sequence: Synthetic oligonucleotide
  Target: ATXN1; (+) strand; PAM type: NRG; PAM sequence: CAG
ccccttaggcgtccgaatgt

SEQ ID NO: 117315 - DNA, 20 bp, Artificial Sequence
  Description of Artificial Sequence: Synthetic oligonucleotide
  Target: ATXN1; (+) strand; PAM type: NRG; PAM sequence: AGG
cccttaggcgtccgaatgtc

SEQ ID NO: 117316 - DNA, 20 bp, Artificial Sequence
  Description of Artificial Sequence: Synthetic oligonucleotide
  Target: ATXN1; (+) strand; PAM type: NRG; PAM sequence: TAG
tccgaatgtcaggccgttct

SEQ ID NO: 117317 - DNA, 20 bp, Artificial Sequence
  Description of Artificial Sequence: Synthetic oligonucleotide
  Target: ATXN1; (+) strand; PAM type: NRG; PAM sequence: GAG
cctttttgcctataacacac

SEQ ID NO: 117318 - DNA, 20 bp, Artificial Sequence
  Description of Artificial Sequence: Synthetic oligonucleotide
  Target: ATXN1; (+) strand; PAM type: NRG; PAM sequence: AGG
ctttttgcctataacacacg

SEQ ID NO: 117319 - DNA, 20 bp, Artificial Sequence
  Description of Artificial Sequence: Synthetic oligonucleotide
  Target: ATXN1; (+) strand; PAM type: NRG; PAM sequence: TGG
taacacacgaggttgtaatg

SEQ ID NO: 117320 - DNA, 20 bp, Artificial Sequence
  Description of Artificial Sequence: Synthetic oligonucleotide
  Target: ATXN1; (+) strand; PAM type: NRG; PAM sequence: AAG
ttgtaatgtggctcatgaac

SEQ ID NO: 117321 - DNA, 20 bp, Artificial Sequence
  Description of Artificial Sequence: Synthetic oligonucleotide
  Target: ATXN1; (+) strand; PAM type: NRG; PAM sequence: CAG
aatgtggctcatgaacaaga

SEQ ID NO: 117322 - DNA, 20 bp, Artificial Sequence
  Description of Artificial Sequence: Synthetic oligonucleotide
  Target: ATXN1; (+) strand; PAM type: NRG; PAM sequence: TAG
aacaagacagatgcctacta

SEQ ID NO: 117323 - DNA, 20 bp, Artificial Sequence
  Description of Artificial Sequence: Synthetic oligonucleotide
  Target: ATXN1; (+) strand; PAM type: NRG; PAM sequence: AAG
agacagatgcctactatagc

SEQ ID NO: 117324 - DNA, 20 bp, Artificial Sequence
  Description of Artificial Sequence: Synthetic oligonucleotide
  Target: ATXN1; (+) strand; PAM type: NRG; PAM sequence: TAG
cagatgcctactatagcaag

SEQ ID NO: 117325 - DNA, 20 bp, Artificial Sequence
  Description of Artificial Sequence: Synthetic oligonucleotide
  Target: ATXN1; (+) strand; PAM type: NRG; PAM sequence: CAG
acgacattcaatgacatcca

SEQ ID NO: 117326 - DNA, 20 bp, Artificial Sequence
  Description of Artificial Sequence: Synthetic oligonucleotide
  Target: ATXN1; (+) strand; PAM type: NRG; PAM sequence: GAG
gacattcaatgacatccaca

SEQ ID NO: 117327 - DNA, 20 bp, Artificial Sequence
  Description of Artificial Sequence: Synthetic oligonucleotide
  Target: ATXN1; (+) strand; PAM type: NRG; PAM sequence: GAG
cattcaatgacatccacaga

SEQ ID NO: 117328 - DNA, 20 bp, Artificial Sequence
  Description of Artificial Sequence: Synthetic oligonucleotide
  Target: ATXN1; (+) strand; PAM type: NRG; PAM sequence: AAG
tcaatgacatccacagagag

SEQ ID NO: 117329 - DNA, 20 bp, Artificial Sequence
  Description of Artificial Sequence: Synthetic oligonucleotide
  Target: ATXN1; (+) strand; PAM type: NRG; PAM sequence: CGG
cagagagaagacctgcaact

SEQ ID NO: 117330 - DNA, 20 bp, Artificial Sequence
  Description of Artificial Sequence: Synthetic oligonucleotide
  Target: ATXN1; (+) strand; PAM type: NRG; PAM sequence: TAG
agagaagacctgcaactcgg

SEQ ID NO: 117331 - DNA, 20 bp, Artificial Sequence
  Description of Artificial Sequence: Synthetic oligonucleotide
  Target: ATXN1; (+) strand; PAM type: NRG; PAM sequence: AAG
agacctgcaactcggtagaa

SEQ ID NO: 117332 - DNA, 20 bp, Artificial Sequence
  Description of Artificial Sequence: Synthetic oligonucleotide
  Target: ATXN1; (+) strand; PAM type: NRG; PAM sequence: TGG
tagaaaagaaacacgatgtt

SEQ ID NO: 117333 - DNA, 20 bp, Artificial Sequence
  Description of Artificial Sequence: Synthetic oligonucleotide
  Target: ATXN1; (+) strand; PAM type: NRG; PAM sequence: GAG
aacacgatgtttggtcaact

SEQ ID NO: 117334 - DNA, 20 bp, Artificial Sequence
  Description of Artificial Sequence: Synthetic oligonucleotide
  Target: ATXN1; (+) strand; PAM type: NRG; PAM sequence: CAG
atgtttggtcaactgagcac

SEQ ID NO: 117335 - DNA, 20 bp, Artificial Sequence
  Description of Artificial Sequence: Synthetic oligonucleotide
  Target: ATXN1; (+) strand; PAM type: NRG; PAM sequence: GAG
tcaactgagcaccagactgt

SEQ ID NO: 117336 - DNA, 20 bp, Artificial Sequence
  Description of Artificial Sequence: Synthetic oligonucleotide
  Target: ATXN1; (+) strand; PAM type: NRG; PAM sequence: GAG
caccagactgtgagcttttt

SEQ ID NO: 117337 - DNA, 20 bp, Artificial Sequence
  Description of Artificial Sequence: Synthetic oligonucleotide
  Target: ATXN1; (+) strand; PAM type: NRG; PAM sequence: AGG
accagactgtgagctttttg

SEQ ID NO: 117338 - DNA, 20 bp, Artificial Sequence
  Description of Artificial Sequence: Synthetic oligonucleotide
  Target: ATXN1; (+) strand; PAM type: NRG; PAM sequence: GGG
ccagactgtgagctttttga

SEQ ID NO: 117339 - DNA, 20 bp, Artificial Sequence
  Description of Artificial Sequence: Synthetic oligonucleotide
  Target: ATXN1; (+) strand; PAM type: NRG; PAM sequence: AAG
ctgtgagctttttgagggta

SEQ ID NO: 117340 - DNA, 20 bp, Artificial Sequence
  Description of Artificial Sequence: Synthetic oligonucleotide
  Target: ATXN1; (+) strand; PAM type: NRG; PAM sequence: GAG
gtaaagattatgttttctcc

SEQ ID NO: 117341 - DNA, 20 bp, Artificial Sequence
  Description of Artificial Sequence: Synthetic oligonucleotide
  Target: ATXN1; (+) strand; PAM type: NRG; PAM sequence: CAG
gattatgttttctccgagtt

SEQ ID NO: 117342 - DNA, 20 bp, Artificial Sequence
  Description of Artificial Sequence: Synthetic oligonucleotide
  Target: ATXN1; (+) strand; PAM type: NRG; PAM sequence: AGG
attatgttttctccgagttc

SEQ ID NO: 117343 - DNA, 20 bp, Artificial Sequence
  Description of Artificial Sequence: Synthetic oligonucleotide
  Target: ATXN1; (+) strand; PAM type: NRG; PAM sequence: GGG
ttatgttttctccgagttca

SEQ ID NO: 117344 - DNA, 20 bp, Artificial Sequence
  Description of Artificial Sequence: Synthetic oligonucleotide
  Target: ATXN1; (+) strand; PAM type: NRG; PAM sequence: TGG
ccgagttcagggtgtattgc

SEQ ID NO: 117345 - DNA, 20 bp, Artificial Sequence
  Description of Artificial Sequence: Synthetic oligonucleotide
  Target: ATXN1; (+) strand; PAM type: NRG; PAM sequence: TAG
gctggcattcaataaatatt

SEQ ID NO: 117346 - DNA, 20 bp, Artificial Sequence
  Description of Artificial Sequence: Synthetic oligonucleotide
  Target: ATXN1; (+) strand; PAM type: NRG; PAM sequence: AGG
ctggcattcaataaatattt

SEQ ID NO: 117347 - DNA, 20 bp, Artificial Sequence
  Description of Artificial Sequence: Synthetic oligonucleotide
  Target: ATXN1; (+) strand; PAM type: NRG; PAM sequence: GGG
tggcattcaataaatattta

SEQ ID NO: 117348 - DNA, 20 bp, Artificial Sequence
  Description of Artificial Sequence: Synthetic oligonucleotide
  Target: ATXN1; (+) strand; PAM type: NRG; PAM sequence: CAG
atttagggaatgaatacatg

SEQ ID NO: 117349 - DNA, 20 bp, Artificial Sequence
  Description of Artificial Sequence: Synthetic oligonucleotide
  Target: ATXN1; (+) strand; PAM type: NRG; PAM sequence: AGG
tttagggaatgaatacatgc

SEQ ID NO: 117350 - DNA, 20 bp, Artificial Sequence
  Description of Artificial Sequence: Synthetic oligonucleotide
  Target: ATXN1; (+) strand; PAM type: NRG; PAM sequence: GGG
ttagggaatgaatacatgca

SEQ ID NO: 117351 - DNA, 20 bp, Artificial Sequence
  Description of Artificial Sequence: Synthetic oligonucleotide
  Target: ATXN1; (+) strand; PAM type: NRG; PAM sequence: CAG
agggatgaatatgtgatgaa

SEQ ID NO: 117352 - DNA, 20 bp, Artificial Sequence
  Description of Artificial Sequence: Synthetic oligonucleotide
  Target: ATXN1; (+) strand; PAM type: NRG; PAM sequence: AGG
gggatgaatatgtgatgaac

SEQ ID NO: 117353 - DNA, 20 bp, Artificial Sequence
  Description of Artificial Sequence: Synthetic oligonucleotide
  Target: ATXN1; (+) strand; PAM type: NRG; PAM sequence: CGG
tgatgaacaggttacaaata

SEQ ID NO: 117354 - DNA, 20 bp, Artificial Sequence
  Description of Artificial Sequence: Synthetic oligonucleotide
  Target: ATXN1; (+) strand; PAM type: NRG; PAM sequence: CAG
aacaggttacaaatacggtt

SEQ ID NO: 117355 - DNA, 20 bp, Artificial Sequence
  Description of Artificial Sequence: Synthetic oligonucleotide
  Target: ATXN1; (+) strand; PAM type: NRG; PAM sequence: TAG
tacggttcagaattcataac

SEQ ID NO: 117356 - DNA, 20 bp, Artificial Sequence
  Description of Artificial Sequence: Synthetic oligonucleotide
  Target: ATXN1; (+) strand; PAM type: NRG; PAM sequence: GAG
taactagtaatgaatgatat

SEQ ID NO: 117357 - DNA, 20 bp, Artificial Sequence
  Description of Artificial Sequence: Synthetic oligonucleotide
  Target: ATXN1; (+) strand; PAM type: NRG; PAM sequence: AAG
tagtaatgaatgatatgaga

SEQ ID NO: 117358 - DNA, 20 bp, Artificial Sequence
  Description of Artificial Sequence: Synthetic oligonucleotide
  Target: ATXN1; (+) strand; PAM type: NRG; PAM sequence: CAG
tatgagaaagtaaacctttc

SEQ ID NO: 117359 - DNA, 20 bp, Artificial Sequence
  Description of Artificial Sequence: Synthetic oligonucleotide
  Target: ATXN1; (+) strand; PAM type: NRG; PAM sequence: TAG
acctttccagattttgttga

SEQ ID NO: 117360 - DNA, 20 bp, Artificial Sequence
  Description of Artificial Sequence: Synthetic oligonucleotide
  Target: ATXN1; (+) strand; PAM type: NRG; PAM sequence: AAG
ccagattttgttgatagcat

SEQ ID NO: 117361 - DNA, 20 bp, Artificial Sequence
  Description of Artificial Sequence: Synthetic oligonucleotide
  Target: ATXN1; (+) strand; PAM type: NRG; PAM sequence: CAG
tgatagcataagattaaatt

SEQ ID NO: 117362 - DNA, 20 bp, Artificial Sequence
  Description of Artificial Sequence: Synthetic oligonucleotide
  Target: ATXN1; (+) strand; PAM type: NRG; PAM sequence: TGG
agcataagattaaattcagc

SEQ ID NO: 117363 - DNA, 20 bp, Artificial Sequence
  Description of Artificial Sequence: Synthetic oligonucleotide
  Target: ATXN1; (+) strand; PAM type: NRG; PAM sequence: AAG
aagattaaattcagctggaa

SEQ ID NO: 117364 - DNA, 20 bp, Artificial Sequence
  Description of Artificial Sequence: Synthetic oligonucleotide
  Target: ATXN1; (+) strand; PAM type: NRG; PAM sequence: AGG
agattaaattcagctggaaa

SEQ ID NO: 117365 - DNA, 20 bp, Artificial Sequence
  Description of Artificial Sequence: Synthetic oligonucleotide
  Target: ATXN1; (+) strand; PAM type: NRG; PAM sequence: TAG
agctggaaaaggaaaacatt

SEQ ID NO: 117366 - DNA, 20 bp, Artificial Sequence
  Description of Artificial Sequence: Synthetic oligonucleotide
  Target: ATXN1; (+) strand; PAM type: NRG; PAM sequence: AGG
gctggaaaaggaaaacattt

SEQ ID NO: 117367 - DNA, 20 bp, Artificial Sequence
  Description of Artificial Sequence: Synthetic oligonucleotide
  Target: ATXN1; (+) strand; PAM type: NRG; PAM sequence: GAG
atttaggattatccatctct

SEQ ID NO: 117368 - DNA, 20 bp, Artificial Sequence
  Description of Artificial Sequence: Synthetic oligonucleotide
  Target: ATXN1; (+) strand; PAM type: NRG; PAM sequence: CAG
atctctgagtgattgtgtgt

SEQ ID NO: 117369 - DNA, 20 bp, Artificial Sequence
  Description of Artificial Sequence: Synthetic oligonucleotide
  Target: ATXN1; (+) strand; PAM type: NRG; PAM sequence: CAG
agtgattgtgtgtcagtctt

SEQ ID NO: 117370 - DNA, 20 bp, Artificial Sequence
  Description of Artificial Sequence: Synthetic oligonucleotide
  Target: ATXN1; (+) strand; PAM type: NRG; PAM sequence: GAG
tgattgtgtgtcagtcttca

SEQ ID NO: 117371 - DNA, 20 bp, Artificial Sequence
  Description of Artificial Sequence: Synthetic oligonucleotide
  Target: ATXN1; (+) strand; PAM type: NRG; PAM sequence: AGG
gattgtgtgtcagtcttcag

SEQ ID NO: 117372 - DNA, 20 bp, Artificial Sequence
  Description of Artificial Sequence: Synthetic oligonucleotide
  Target: ATXN1; (+) strand; PAM type: NRG; PAM sequence: AAG
aactgaatttttcttttaaa

SEQ ID NO: 117373 - DNA, 20 bp, Artificial Sequence
  Description of Artificial Sequence: Synthetic oligonucleotide
  Target: ATXN1; (+) strand; PAM type: NRG; PAM sequence: CAG
gaatttttcttttaaaaagc

SEQ ID NO: 117374 - DNA, 20 bp, Artificial Sequence
  Description of Artificial Sequence: Synthetic oligonucleotide
  Target: ATXN1; (+) strand; PAM type: NRG; PAM sequence: TGG
tttttcttttaaaaagccag

SEQ ID NO: 117375 - DNA, 20 bp, Artificial Sequence
  Description of Artificial Sequence: Synthetic oligonucleotide
  Target: ATXN1; (+) strand; PAM type: NRG; PAM sequence: GGG
ttttcttttaaaaagccagt

SEQ ID NO: 117376 - DNA, 20 bp, Artificial Sequence
  Description of Artificial Sequence: Synthetic oligonucleotide
  Target: ATXN1; (+) strand; PAM type: NRG; PAM sequence: CAG
cttttaaaaagccagtggga

SEQ ID NO: 117377 - DNA, 20 bp, Artificial Sequence
  Description of Artificial Sequence: Synthetic oligonucleotide
  Target: ATXN1; (+) strand; PAM type: NRG; PAM sequence: CAG
actcatttgtgaatcaaaac

SEQ ID NO: 117378 - DNA, 20 bp, Artificial Sequence
  Description of Artificial Sequence: Synthetic oligonucleotide
  Target: ATXN1; (+) strand; PAM type: NRG; PAM sequence: GAG
tcatttgtgaatcaaaacca

SEQ ID NO: 117379 - DNA, 20 bp, Artificial Sequence
  Description of Artificial Sequence: Synthetic oligonucleotide
  Target: ATXN1; (+) strand; PAM type: NRG; PAM sequence: TAG
tttgtgaatcaaaaccagag

SEQ ID NO: 117380 - DNA, 20 bp, Artificial Sequence
  Description of Artificial Sequence: Synthetic oligonucleotide
  Target: ATXN1; (+) strand; PAM type: NRG; PAM sequence: AAG
aatcaaaaccagagtagacc

SEQ ID NO: 117381 - DNA, 20 bp, Artificial Sequence
  Description of Artificial Sequence: Synthetic oligonucleotide
  Target: ATXN1; (+) strand; PAM type: NRG; PAM sequence: GAG
ccagagtagaccaagtgact

SEQ ID NO: 117382 - DNA, 20 bp, Artificial Sequence
  Description of Artificial Sequence: Synthetic oligonucleotide
  Target: ATXN1; (+) strand; PAM type: NRG; PAM sequence: AAG
gtgactgagcattccaatga

SEQ ID NO: 117383 - DNA, 20 bp, Artificial Sequence
  Description of Artificial Sequence: Synthetic oligonucleotide
  Target: ATXN1; (+) strand; PAM type: NRG; PAM sequence: AGG
tgactgagcattccaatgaa

SEQ ID NO: 117384 - DNA, 20 bp, Artificial Sequence
  Description of Artificial Sequence: Synthetic oligonucleotide
  Target: ATXN1; (+) strand; PAM type: NRG; PAM sequence: GGG
gactgagcattccaatgaaa

SEQ ID NO: 117385 - DNA, 20 bp, Artificial Sequence
  Description of Artificial Sequence: Synthetic oligonucleotide
  Target: ATXN1; (+) strand; PAM type: NRG; PAM sequence: AAG
ttccaatgaaagggtaaaaa

SEQ ID NO: 117386 - DNA, 20 bp, Artificial Sequence
  Description of Artificial Sequence: Synthetic oligonucleotide
  Target: ATXN1; (+) strand; PAM type: NRG; PAM sequence: CAG
caatgaaagggtaaaaaaag

SEQ ID NO: 117387 - DNA, 20 bp, Artificial Sequence
  Description of Artificial Sequence: Synthetic oligonucleotide
  Target: ATXN1; (+) strand; PAM type: NRG; PAM sequence: TGG
gggtaaaaaaagcagaaata

SEQ ID NO: 117388 - DNA, 20 bp, Artificial Sequence
  Description of Artificial Sequence: Synthetic oligonucleotide
  Target: ATXN1; (+) strand; PAM type: NRG; PAM sequence: TGG
gatttttttcccactctcac

SEQ ID NO: 117389 - DNA, 20 bp, Artificial Sequence
  Description of Artificial Sequence: Synthetic oligonucleotide
  Target: ATXN1; (+) strand; PAM type: NRG; PAM sequence: GAG
tttcccactctcactggtgt

SEQ ID NO: 117390 - DNA, 20 bp, Artificial Sequence
  Description of Artificial Sequence: Synthetic oligonucleotide
  Target: ATXN1; (+) strand; PAM type: NRG; PAM sequence: AAG
ctcactggtgtgagatttta

SEQ ID NO: 117391 - DNA, 20 bp, Artificial Sequence
  Description of Artificial Sequence: Synthetic oligonucleotide
  Target: ATXN1; (+) strand; PAM type: NRG; PAM sequence: AAG
aagacattccttcctgtcaa

SEQ ID NO: 117392 - DNA, 20 bp, Artificial Sequence
  Description of Artificial Sequence: Synthetic oligonucleotide
  Target: ATXN1; (+) strand; PAM type: NRG; PAM sequence: AGG
agacattccttcctgtcaaa

SEQ ID NO: 117393 - DNA, 20 bp, Artificial Sequence
  Description of Artificial Sequence: Synthetic oligonucleotide
  Target: ATXN1; (+) strand; PAM type: NRG; PAM sequence: TGG
attccttcctgtcaaaagga

SEQ ID NO: 117394 - DNA, 20 bp, Artificial Sequence
  Description of Artificial Sequence: Synthetic oligonucleotide
  Target: ATXN1; (+) strand; PAM type: NRG; PAM sequence: AAG
gatggcgtcaaatgtatttt

SEQ ID NO: 117395 - DNA, 20 bp, Artificial Sequence
  Description of Artificial Sequence: Synthetic oligonucleotide
  Target: ATXN1; (+) strand; PAM type: NRG; PAM sequence: TAG
tcatatccctcttgttctta

SEQ ID NO: 117396 - DNA, 20 bp, Artificial Sequence
  Description of Artificial Sequence: Synthetic oligonucleotide
  Target: ATXN1; (+) strand; PAM type: NRG; PAM sequence: AAG
ttgtctcattccaccacaac

SEQ ID NO: 117397 - DNA, 20 bp, Artificial Sequence
  Description of Artificial Sequence: Synthetic oligonucleotide
  Target: ATXN1; (+) strand; PAM type: NRG; PAM sequence: TAG
caccacaacaagttttataa

SEQ ID NO: 117398 - DNA, 20 bp, Artificial Sequence
  Description of Artificial Sequence: Synthetic oligonucleotide
  Target: ATXN1; (+) strand; PAM type: NRG; PAM sequence: CAG
cacaacaagttttataatag

SEQ ID NO: 117399 - DNA, 20 bp, Artificial Sequence
  Description of Artificial Sequence: Synthetic oligonucleotide
  Target: ATXN1; (+) strand; PAM type: NRG; PAM sequence: AGG
acaacaagttttataatagc

SEQ ID NO: 117400 - DNA, 20 bp, Artificial Sequence
  Description of Artificial Sequence: Synthetic oligonucleotide
  Target: ATXN1; (+) strand; PAM type: NRG; PAM sequence: TAG
acaagttttataatagcagg

SEQ ID NO: 117401 - DNA, 20 bp, Artificial Sequence
  Description of Artificial Sequence: Synthetic oligonucleotide
  Target: ATXN1; (+) strand; PAM type: NRG; PAM sequence: AGG
caagttttataatagcaggt

SEQ ID NO: 117402 - DNA, 20 bp, Artificial Sequence
  Description of Artificial Sequence: Synthetic oligonucleotide
  Target: ATXN1; (+) strand; PAM type: NRG; PAM sequence: CAG
tttatcttttgaaaatgtta

SEQ ID NO: 117403 - DNA, 20 bp, Artificial Sequence
  Description of Artificial Sequence: Synthetic oligonucleotide
  Target: ATXN1; (+) strand; PAM type: NRG; PAM sequence: AAG
aaactctattactgatttaa

SEQ ID NO: 117404 - DNA, 20 bp, Artificial Sequence
  Description of Artificial Sequence: Synthetic oligonucleotide
  Target: ATXN1; (+) strand; PAM type: NRG; PAM sequence: AAG
tattactgatttaaaagttc

SEQ ID NO: 117405 - DNA, 20 bp, Artificial Sequence
  Description of Artificial Sequence: Synthetic oligonucleotide
  Target: ATXN1; (+) strand; PAM type: NRG; PAM sequence: TAG
tgatttaaaagttcaagatt

SEQ ID NO: 117406 - DNA, 20 bp, Artificial Sequence
  Description of Artificial Sequence: Synthetic oligonucleotide
  Target: ATXN1; (+) strand; PAM type: NRG; PAM sequence: AAG
aagttcaagatttagaattt

SEQ ID NO: 117407 - DNA, 20 bp, Artificial Sequence
  Description of Artificial Sequence: Synthetic oligonucleotide
  Target: ATXN1; (+) strand; PAM type: NRG; PAM sequence: AGG
agttcaagatttagaattta

SEQ ID NO: 117408 - DNA, 20 bp, Artificial Sequence
  Description of Artificial Sequence: Synthetic oligonucleotide
  Target: ATXN1; (+) strand; PAM type: NRG; PAM sequence: AAG
gaatttaaggattctgatga

SEQ ID NO: 117409 - DNA, 20 bp, Artificial Sequence
  Description of Artificial Sequence: Synthetic oligonucleotide
  Target: ATXN1; (+) strand; PAM type: NRG; PAM sequence: TAG
taaggattctgatgaaagtt

SEQ ID NO: 117410 - DNA, 20 bp, Artificial Sequence
  Description of Artificial Sequence: Synthetic oligonucleotide
  Target: ATXN1; (+) strand; PAM type: NRG; PAM sequence: TAG
agtttagcgtaaacctactt

SEQ ID NO: 117411 - DNA, 20 bp, Artificial Sequence
  Description of Artificial Sequence: Synthetic oligonucleotide
  Target: ATXN1; (+) strand; PAM type: NRG; PAM sequence: TAG
gtaaacctactttagctgac

SEQ ID NO: 117412 - DNA, 20 bp, Artificial Sequence
  Description of Artificial Sequence: Synthetic oligonucleotide
  Target: ATXN1; (+) strand; PAM type: NRG; PAM sequence: AAG
tagctgactagattttttaa

SEQ ID NO: 117413 - DNA, 20 bp, Artificial Sequence
  Description of Artificial Sequence: Synthetic oligonucleotide
  Target: ATXN1; (+) strand; PAM type: NRG; PAM sequence: AGG
agctgactagattttttaaa

SEQ ID NO: 117414 - DNA, 20 bp, Artificial Sequence
  Description of Artificial Sequence: Synthetic oligonucleotide
  Target: ATXN1; (+) strand; PAM type: NRG; PAM sequence: TAG
actagattttttaaaaggtt

SEQ ID NO: 117415 - DNA, 20 bp, Artificial Sequence
  Description of Artificial Sequence: Synthetic oligonucleotide
  Target: ATXN1; (+) strand; PAM type: NRG; PAM sequence: AGG
ctagattttttaaaaggttt

SEQ ID NO: 117416 - DNA, 20 bp, Artificial Sequence
  Description of Artificial Sequence: Synthetic oligonucleotide
  Target: ATXN1; (+) strand; PAM type: NRG; PAM sequence: AAG
aggaattgtttacctccttt

SEQ ID NO: 117417 - DNA, 20 bp, Artificial Sequence
  Description of Artificial Sequence: Synthetic oligonucleotide
  Target: ATXN1; (+) strand; PAM type: NRG; PAM sequence: CAG
ttatcaccatcatttgcatc

SEQ ID NO: 117418 - DNA, 20 bp, Artificial Sequence
  Description of Artificial Sequence: Synthetic oligonucleotide
  Target: ATXN1; (+) strand; PAM type: NRG; PAM sequence: TAG
tttgcatccagacaacatgc

SEQ ID NO: 117419 - DNA, 20 bp, Artificial Sequence
  Description of Artificial Sequence: Synthetic oligonucleotide
  Target: ATXN1; (+) strand; PAM type: NRG; PAM sequence: AAG
ccagacaacatgctagtcga

SEQ ID NO: 117420 - DNA, 20 bp, Artificial Sequence
  Description of Artificial Sequence: Synthetic oligonucleotide
  Target: ATXN1; (+) strand; PAM type: NRG; PAM sequence: TAG
catgctagtcgaaagtgatt

SEQ ID NO: 117421 - DNA, 20 bp, Artificial Sequence
  Description of Artificial Sequence: Synthetic oligonucleotide
  Target: ATXN1; (+) strand; PAM type: NRG; PAM sequence: AAG
cgaaagtgatttagtcttta

SEQ ID NO: 117422 - DNA, 20 bp, Artificial Sequence
  Description of Artificial Sequence: Synthetic oligonucleotide
  Target: ATXN1; (+) strand; PAM type: NRG; PAM sequence: TAG
aattctttataaaattttat

SEQ ID NO: 117423 - DNA, 20 bp, Artificial Sequence
  Description of Artificial Sequence: Synthetic oligonucleotide
  Target: ATXN1; (+) strand; PAM type: NRG; PAM sequence: TGG
ttataaaattttattagatt

SEQ ID NO: 117424 - DNA, 20 bp, Artificial Sequence
  Description of Artificial Sequence: Synthetic oligonucleotide
  Target: ATXN1; (+) strand; PAM type: NRG; PAM sequence: TGG
aaattttattagatttggtg

SEQ ID NO: 117425 - DNA, 20 bp, Artificial Sequence
  Description of Artificial Sequence: Synthetic oligonucleotide
  Target: ATXN1; (+) strand; PAM type: NRG; PAM sequence: GAG
attttattagatttggtgtg

SEQ ID NO: 117426 - DNA, 20 bp, Artificial Sequence
  Description of Artificial Sequence: Synthetic oligonucleotide
  Target: ATXN1; (+) strand; PAM type: NRG; PAM sequence: AGG
ttttattagatttggtgtgg

SEQ ID NO: 117427 - DNA, 20 bp, Artificial Sequence
  Description of Artificial Sequence: Synthetic oligonucleotide
  Target: ATXN1; (+) strand; PAM type: NRG; PAM sequence: AAG
ttagatttggtgtggaggaa

SEQ ID NO: 117428 - DNA, 20 bp, Artificial Sequence
  Description of Artificial Sequence: Synthetic oligonucleotide
  Target: ATXN1; (+) strand; PAM type: NRG; PAM sequence: GAG
tgtggaggaaaagttgacgt

SEQ ID NO: 117429 - DNA, 20 bp, Artificial Sequence
  Description of Artificial Sequence: Synthetic oligonucleotide
  Target: ATXN1; (+) strand; PAM type: NRG; PAM sequence: TGG
acgtgagaaaataaaaaaac

SEQ ID NO: 117430 - DNA, 20 bp, Artificial Sequence
  Description of Artificial Sequence: Synthetic oligonucleotide
  Target: ATXN1; (+) strand; PAM type: NRG; PAM sequence: GGG
cgtgagaaaataaaaaaact

SEQ ID NO: 117431 - DNA, 20 bp, Artificial Sequence
  Description of Artificial Sequence: Synthetic oligonucleotide
  Target: ATXN1; (+) strand; PAM type: NRG; PAM sequence: AAG
aaaataaaaaaactgggttc

SEQ ID NO: 117432 - DNA, 20 bp, Artificial Sequence
  Description of Artificial Sequence: Synthetic oligonucleotide
  Target: ATXN1; (+) strand; PAM type: NRG; PAM sequence: AGG
aaataaaaaaactgggttca

SEQ ID NO: 117433 - DNA, 20 bp, Artificial Sequence
  Description of Artificial Sequence: Synthetic oligonucleotide
  Target: ATXN1; (+) strand; PAM type: NRG; PAM sequence: TGG
ctgggttcaaggtctgtttt

SEQ ID NO: 117434 - DNA, 20 bp, Artificial Sequence
  Description of Artificial Sequence: Synthetic oligonucleotide
  Target: ATXN1; (+) strand; PAM type: NRG; PAM sequence: CAG
cataatcatgttacttttct

SEQ ID NO: 117435 - DNA, 20 bp, Artificial Sequence
  Description of Artificial Sequence: Synthetic oligonucleotide
  Target: ATXN1; (+) strand; PAM type: NRG; PAM sequence: CAG
catgttacttttctcagcat

SEQ ID NO: 117436 - DNA, 20 bp, Artificial Sequence
  Description of Artificial Sequence: Synthetic oligonucleotide
  Target: ATXN1; (+) strand; PAM type: NRG; PAM sequence: TAG
agcatcagtctcatcattga

SEQ ID NO: 117437 - DNA, 20 bp, Artificial Sequence
  Description of Artificial Sequence: Synthetic oligonucleotide
  Target: ATXN1; (+) strand; PAM type: NRG; PAM sequence: GAG
catcagtctcatcattgata

SEQ ID NO: 117438 - DNA, 20 bp, Artificial Sequence
  Description of Artificial Sequence: Synthetic oligonucleotide
  Target: ATXN1; (+) strand; PAM type: NRG; PAM sequence: AGG
atcagtctcatcattgatag

SEQ ID NO: 117439 - DNA, 20 bp, Artificial Sequence
  Description of Artificial Sequence: Synthetic oligonucleotide
  Target: ATXN1; (+) strand; PAM type: NRG; PAM sequence: GGG
tcagtctcatcattgataga

SEQ ID NO: 117440 - DNA, 20 bp, Artificial Sequence
  Description of Artificial Sequence: Synthetic oligonucleotide
  Target: ATXN1; (+) strand; PAM type: NRG; PAM sequence: GGG
cagtctcatcattgatagag

SEQ ID NO: 117441 - DNA, 20 bp, Artificial Sequence
  Description of Artificial Sequence: Synthetic oligonucleotide
  Target: ATXN1; (+) strand; PAM type: NRG; PAM sequence: GGG
agtctcatcattgatagagg

SEQ ID NO: 117442 - DNA, 20 bp, Artificial Sequence
  Description of Artificial Sequence: Synthetic oligonucleotide
  Target: ATXN1; (+) strand; PAM type: NRG; PAM sequence: CAG
tgatagagggggtacactct

SEQ ID NO: 117443 - DNA, 20 bp, Artificial Sequence
  Description of Artificial Sequence: Synthetic oligonucleotide
  Target: ATXN1; (+) strand; PAM type: NRG; PAM sequence: TGG
ggggtacactctcagcactt

SEQ ID NO: 117444 - DNA, 20 bp, Artificial Sequence
  Description of Artificial Sequence: Synthetic oligonucleotide
  Target: ATXN1; (+) strand; PAM type: NRG; PAM sequence: GGG
gggtacactctcagcacttt

SEQ ID NO: 117445 - DNA, 20 bp, Artificial Sequence
  Description of Artificial Sequence: Synthetic oligonucleotide
  Target: ATXN1; (+) strand; PAM type: NRG; PAM sequence: GAG
tctcagcactttgggatgcc

SEQ ID NO: 117446 - DNA, 20 bp, Artificial Sequence
  Description of Artificial Sequence: Synthetic oligonucleotide
  Target: ATXN1; (+) strand; PAM type: NRG; PAM sequence: AGG
ctcagcactttgggatgccg

SEQ ID NO: 117447 - DNA, 20 bp, Artificial Sequence
  Description of Artificial Sequence: Synthetic oligonucleotide
  Target: ATXN1; (+) strand; PAM type: NRG; PAM sequence: CGG
agcactttgggatgccgagg

SEQ ID NO: 117448 - DNA, 20 bp, Artificial Sequence
  Description of Artificial Sequence: Synthetic oligonucleotide
  Target: ATXN1; (+) strand; PAM type: NRG; PAM sequence: GGG
gcactttgggatgccgaggc

SEQ ID NO: 117449 - DNA, 20 bp, Artificial Sequence
  Description of Artificial Sequence: Synthetic oligonucleotide
  Target: ATXN1; (+) strand; PAM type: NRG; PAM sequence: TGG
ctttgggatgccgaggcggg

SEQ ID NO: 117450 - DNA, 20 bp, Artificial Sequence
  Description of Artificial Sequence: Synthetic oligonucleotide
  Target: ATXN1; (+) strand; PAM type: NRG; PAM sequence: AAG
tgccgaggcgggtggatcac

SEQ ID NO: 117451 - DNA, 20 bp, Artificial Sequence
  Description of Artificial Sequence: Synthetic oligonucleotide
  Target: ATXN1; (+) strand; PAM type: NRG; PAM sequence: AGG
gccgaggcgggtggatcaca

SEQ ID NO: 117452 - DNA, 20 bp, Artificial Sequence
  Description of Artificial Sequence: Synthetic oligonucleotide
  Target: ATXN1; (+) strand; PAM type: NRG; PAM sequence: CAG
aggcgggtggatcacaaggt

SEQ ID NO: 117453 - DNA, 20 bp, Artificial Sequence
  Description of Artificial Sequence: Synthetic oligonucleotide
  Target: ATXN1; (+) strand; PAM type: NRG; PAM sequence: AGG
ggcgggtggatcacaaggtc

SEQ ID NO: 117454 - DNA, 20 bp, Artificial Sequence
  Description of Artificial Sequence: Synthetic oligonucleotide
  Target: ATXN1; (+) strand; PAM type: NRG; PAM sequence: GAG
cgggtggatcacaaggtcag

SEQ ID NO: 117455 - DNA, 20 bp, Artificial Sequence
  Description of Artificial Sequence: Synthetic oligonucleotide
  Target: ATXN1; (+) strand; PAM type: NRG; PAM sequence: GAG
gatcacaaggtcaggagatc

SEQ ID NO: 117456 - DNA, 20 bp, Artificial Sequence
  Description of Artificial Sequence: Synthetic oligonucleotide
  Target: ATXN1; (+) strand; PAM type: NRG; PAM sequence: TGG
tcaggagatcgagaccatcc

SEQ ID NO: 117457 - DNA, 20 bp, Artificial Sequence
  Description of Artificial Sequence: Synthetic oligonucleotide
  Target: ATXN1; (+) strand; PAM type: NRG; PAM sequence: CGG
cgagaccatcctggctaaca

SEQ ID NO: 117458 - DNA, 20 bp, Artificial Sequence
  Description of Artificial Sequence: Synthetic oligonucleotide
  Target: ATXN1; (+) strand; PAM type: NRG; PAM sequence: TAG
tactaaaaatacaaaaaaat

SEQ ID NO: 117459 - DNA, 20 bp, Artificial Sequence
  Description of Artificial Sequence: Synthetic oligonucleotide
  Target: ATXN1; (+) strand; PAM type: NRG; PAM sequence: TGG
aaaaatacaaaaaaattagc

SEQ ID NO: 117460 - DNA, 20 bp, Artificial Sequence
  Description of Artificial Sequence: Synthetic oligonucleotide
  Target: ATXN1; (+) strand; PAM type: NRG; PAM sequence: GGG
aaaatacaaaaaaattagct

SEQ ID NO: 117461 - DNA, 20 bp, Artificial Sequence
  Description of Artificial Sequence: Synthetic oligonucleotide
  Target: ATXN1; (+) strand; PAM type: NRG; PAM sequence: TAG
acaaaaaaattagctgggcg

SEQ ID NO: 117462 - DNA, 20 bp, Artificial Sequence
  Description of Artificial Sequence: Synthetic oligonucleotide
  Target: ATXN1; (+) strand; PAM type: NRG; PAM sequence: TGG
aaaaaattagctgggcgtag

SEQ ID NO: 117463 - DNA, 20 bp, Artificial Sequence
  Description of Artificial Sequence: Synthetic oligonucleotide
  Target: ATXN1; (+) strand; PAM type: NRG; PAM sequence: CAG
aaattagctgggcgtagtgg

SEQ ID NO: 117464 - DNA, 20 bp, Artificial Sequence
  Description of Artificial Sequence: Synthetic oligonucleotide
  Target: ATXN1; (+) strand; PAM type: NRG; PAM sequence: AGG
aattagctgggcgtagtggc

SEQ ID NO: 117465 - DNA, 20 bp, Artificial Sequence
  Description of Artificial Sequence: Synthetic oligonucleotide
  Target: ATXN1; (+) strand; PAM type: NRG; PAM sequence: TAG
ggcgtagtggcaggtgcctg

SEQ ID NO: 117466 - DNA, 20 bp, Artificial Sequence
  Description of Artificial Sequence: Synthetic oligonucleotide
  Target: ATXN1; (+) strand; PAM type: NRG; PAM sequence: CAG
gtggcaggtgcctgtagtcc

SEQ ID NO: 117467 - DNA, 20 bp, Artificial Sequence
  Description of Artificial Sequence: Synthetic oligonucleotide
  Target: ATXN1; (+) strand; PAM type: NRG; PAM sequence: CAG
tgcctgtagtcccagctact

SEQ ID NO: 117468 - DNA, 20 bp, Artificial Sequence
  Description of Artificial Sequence: Synthetic oligonucleotide
  Target: ATXN1; (+) strand; PAM type: NRG; PAM sequence: AGG
gcctgtagtcccagctactc

SEQ ID NO: 117469 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagctactcag

SEQ ID NO: 117470 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagctactcagg

SEQ ID NO: 117471 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcaggaggct

SEQ ID NO: 117472 - DNA, 20 bp, Artificial Sequence
  Description of Artificial Sequence: Synthetic oligonucleotide
  Target: ATXN1; (+) strand; PAM type: NRG; PAM sequence: AGG
cccagctactcaggaggctg

SEQ ID NO: 117473 - DNA, 20 bp, Artificial Sequence
  Description of Artificial Sequence: Synthetic oligonucleotide
  Target: ATXN1; (+) strand; PAM type: NRG; PAM sequence: CAG
agctactcaggaggctgagg

SEQ ID NO: 117474 - DNA, 20 bp, Artificial Sequence
  Description of Artificial Sequence: Synthetic oligonucleotide
  Target: ATXN1; (+) strand; PAM type: NRG; PAM sequence: AGG
gctactcaggaggctgaggc

SEQ ID NO: 117475 - DNA, 20 bp, Artificial Sequence
  Description of Artificial Sequence: Synthetic oligonucleotide
  Target: ATXN1; (+) strand; PAM type: NRG; PAM sequence: GAG
tactcaggaggctgaggcag

SEQ ID NO: 117476 - DNA, 20 bp, Artificial Sequence
  Description of Artificial Sequence: Synthetic oligonucleotide
  Target: ATXN1; (+) strand; PAM type: NRG; PAM sequence: CGG
gcaggagaatcgcttgaacc

SEQ ID NO: 117477 - DNA, 20 bp, Artificial Sequence
  Description of Artificial Sequence: Synthetic oligonucleotide
  Target: ATXN1; (+) strand; PAM type: NRG; PAM sequence: GGG
caggagaatcgcttgaaccc

SEQ ID NO: 117478 - DNA, 20 bp, Artificial Sequence
  Description of Artificial Sequence: Synthetic oligonucleotide
  Target: ATXN1; (+) strand; PAM type: NRG; PAM sequence: GAG
ggagaatcgcttgaacccgg

SEQ ID NO: 117479 - DNA, 20 bp, Artificial Sequence
  Description of Artificial Sequence: Synthetic oligonucleotide
  Target: ATXN1; (+) strand; PAM type: NRG; PAM sequence: AGG
gagaatcgcttgaacccggg

SEQ ID NO: 117480 - DNA, 20 bp, Artificial Sequence
  Description of Artificial Sequence: Synthetic oligonucleotide
  Target: ATXN1; (+) strand; PAM type: NRG; PAM sequence: CAG
aatcgcttgaacccgggagg

SEQ ID NO: 117481 - DNA, 20 bp, Artificial Sequence
  Description of Artificial Sequence: Synthetic oligonucleotide
  Target: ATXN1; (+) strand; PAM type: NRG; PAM sequence: GAG
tcgcttgaacccgggaggca

SEQ ID NO: 117482 - DNA, 20 bp, Artificial Sequence
  Description of Artificial Sequence: Synthetic oligonucleotide
  Target: ATXN1; (+) strand; PAM type: NRG; PAM sequence: AGG
cgcttgaacccgggaggcag

SEQ ID NO: 117483 - DNA, 20 bp, Artificial Sequence
  Description of Artificial Sequence: Synthetic oligonucleotide
  Target: ATXN1; (+) strand; PAM type: NRG; PAM sequence: AAG
aacccgggaggcagaggttg

SEQ ID NO: 117484 - DNA, 20 bp, Artificial Sequence
  Description of Artificial Sequence: Synthetic oligonucleotide
  Target: ATXN1; (+) strand; PAM type: NRG; PAM sequence: GAG
cgggaggcagaggttgaagt

SEQ ID NO: 117485 - DNA, 20 bp, Artificial Sequence
  Description of Artificial Sequence: Synthetic oligonucleotide
  Target: ATXN1; (+) strand; PAM type: NRG; PAM sequence: AAG
ggcagaggttgaagtgagcc

SEQ ID NO: 117486 - DNA, 20 bp, Artificial Sequence
  Description of Artificial Sequence: Synthetic oligonucleotide
  Target: ATXN1; (+) strand; PAM type: NRG; PAM sequence: CAG
aagattgcgccactgcactc

SEQ ID NO: 117487 - DNA, 20 bp, Artificial Sequence
  Description of Artificial Sequence: Synthetic oligonucleotide
  Target: ATXN1; (+) strand; PAM type: NRG; PAM sequence: TGG
tgcgccactgcactccagcc

SEQ ID NO: 117488 - DNA, 20 bp, Artificial Sequence
  Description of Artificial Sequence: Synthetic oligonucleotide
  Target: ATXN1; (+) strand; PAM type: NRG; PAM sequence: GGG
gcgccactgcactccagcct

SEQ ID NO: 117489 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggcga

SEQ ID NO: 117490 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggcgaca

SEQ ID NO: 117491 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggcgacagagt

SEQ ID NO: 117492 - DNA, 20 bp, Artificial Sequence
  Description of Artificial Sequence: Synthetic oligonucleotide
  Target: ATXN1; (+) strand; PAM type: NRG; PAM sequence: AAG
ctcaaaaataaaataaaata

SEQ ID NO: 117493 - DNA, 20 bp, Artificial Sequence
  Description of Artificial Sequence: Synthetic oligonucleotide
  Target: ATXN1; (+) strand; PAM type: NRG; PAM sequence: GAG
caaaaataaaataaaataaa

SEQ ID NO: 117494 - DNA, 20 bp, Artificial Sequence
  Description of Artificial Sequence: Synthetic oligonucleotide
  Target: ATXN1; (+) strand; PAM type: NRG; PAM sequence: AGG
aaaaataaaataaaataaag

SEQ ID NO: 117495 - DNA, 20 bp, Artificial Sequence
  Description of Artificial Sequence: Synthetic oligonucleotide
  Target: ATXN1; (+) strand; PAM type: NRG; PAM sequence: GGG
aaaataaaataaaataaaga

SEQ ID NO: 117496 - DNA, 20 bp, Artificial Sequence
  Description of Artificial Sequence: Synthetic oligonucleotide
  Target: ATXN1; (+) strand; PAM type: NRG; PAM sequence: GGG
aaataaaataaaataaagag

SEQ ID NO: 117497 - DNA, 20 bp, Artificial Sequence
  Description of Artificial Sequence: Synthetic oligonucleotide
  Target: ATXN1; (+) strand; PAM type: NRG; PAM sequence: GGG
aataaaataaaataaagagg

SEQ ID NO: 117498 - DNA, 20 bp, Artificial Sequence
  Description of Artificial Sequence: Synthetic oligonucleotide
  Target: ATXN1; (+) strand; PAM type: NRG; PAM sequence: AAG
gtaaaaaaccataattgtct

SEQ ID NO: 117499 - DNA, 20 bp, Artificial Sequence
  Description of Artificial Sequence: Synthetic oligonucleotide
  Target: ATXN1; (+) strand; PAM type: NRG; PAM sequence: GAG
aattgtctaagaattgctct

SEQ ID NO: 117500 - DNA, 20 bp, Artificial Sequence
  Description of Artificial Sequence: Synthetic oligonucleotide
  Target: ATXN1; (+) strand; PAM type: NRG; PAM sequence: AGG
attgtctaagaattgctctg

SEQ ID NO: 117501 - DNA, 20 bp, Artificial Sequence
  Description of Artificial Sequence: Synthetic oligonucleotide
  Target: ATXN1; (+) strand; PAM type: NRG; PAM sequence: CAG
aattgctctgaggattacat

SEQ ID NO: 117502 - DNA, 20 bp, Artificial Sequence
  Description of Artificial Sequence: Synthetic oligonucleotide
  Target: ATXN1; (+) strand; PAM type: NRG; PAM sequence: AAG
tctgaggattacatcagtgt

SEQ ID NO: 117503 - DNA, 20 bp, Artificial Sequence
  Description of Artificial Sequence: Synthetic oligonucleotide
  Target: ATXN1; (+) strand; PAM type: NRG; PAM sequence: AGG
ctgaggattacatcagtgta

SEQ ID NO: 117504 - DNA, 20 bp, Artificial Sequence
  Description of Artificial Sequence: Synthetic oligonucleotide
  Target: ATXN1; (+) strand; PAM type: NRG; PAM sequence: AAG
actttaaaaacttcaaatga

SEQ ID NO: 117505 - DNA, 20 bp, Artificial Sequence
  Description of Artificial Sequence: Synthetic oligonucleotide
  Target: ATXN1; (+) strand; PAM type: NRG; PAM sequence: GAG
tttaaaaacttcaaatgaaa

SEQ ID NO: 117506 - DNA, 20 bp, Artificial Sequence
  Description of Artificial Sequence: Synthetic oligonucleotide
  Target: ATXN1; (+) strand; PAM type: NRG; PAM sequence: AGG
ttaaaaacttcaaatgaaag

SEQ ID NO: 117507 - DNA, 20 bp, Artificial Sequence
  Description of Artificial Sequence: Synthetic oligonucleotide
  Target: ATXN1; (+) strand; PAM type: NRG; PAM sequence: GGG
taaaaacttcaaatgaaaga

SEQ ID NO: 117508 - DNA, 20 bp, Artificial Sequence
  Description of Artificial Sequence: Synthetic oligonucleotide
  Target: ATXN1; (+) strand; PAM type: NRG; PAM sequence: AAG
aacttcaaatgaaagagggt

SEQ ID NO: 117509 - DNA, 20 bp, Artificial Sequence
  Description of Artificial Sequence: Synthetic oligonucleotide
  Target: ATXN1; (+) strand; PAM type: NRG; PAM sequence: AAG
tcaaatgaaagagggtaaga

SEQ ID NO: 117510 - DNA, 20 bp, Artificial Sequence
  Description of Artificial Sequence: Synthetic oligonucleotide
  Target: ATXN1; (+) strand; PAM type: NRG; PAM sequence: TGG
gagggtaagaaagaacccac

SEQ ID NO: 117511 - DNA, 20 bp, Artificial Sequence
  Description of Artificial Sequence: Synthetic oligonucleotide
  Target: ATXN1; (+) strand; PAM type: NRG; PAM sequence: TGG
tggatcccctactctgtacc

SEQ ID NO: 117512 - DNA, 20 bp, Artificial Sequence
  Description of Artificial Sequence: Synthetic oligonucleotide
  Target: ATXN1; (+) strand; PAM type: NRG; PAM sequence: CAG
ctgtacctggcattgtgcta

SEQ ID NO: 117513 - DNA, 20 bp, Artificial Sequence
  Description of Artificial Sequence: Synthetic oligonucleotide
  Target: ATXN1; (+) strand; PAM type: NRG; PAM sequence: AGG
tgtacctggcattgtgctac

SEQ ID NO: 117514 - DNA, 20 bp, Artificial Sequence
  Description of Artificial Sequence: Synthetic oligonucleotide
  Target: ATXN1; (+) strand; PAM type: NRG; PAM sequence: TAG
ggttgtgcatatgtcacttt

SEQ ID NO: 117515 - DNA, 20 bp, Artificial Sequence
  Description of Artificial Sequence: Synthetic oligonucleotide
  Target: ATXN1; (+) strand; PAM type: NRG; PAM sequence: AGG
gttgtgcatatgtcactttt

SEQ ID NO: 117516 - DNA, 20 bp, Artificial Sequence
  Description of Artificial Sequence: Synthetic oligonucleotide
  Target: ATXN1; (+) strand; PAM type: NRG; PAM sequence: CAG
tcacttttaggttacaacaa

SEQ ID NO: 117517 - DNA, 20 bp, Artificial Sequence
  Description of Artificial Sequence: Synthetic oligonucleotide
  Target: ATXN1; (+) strand; PAM type: NRG; PAM sequence: TAG
ataaatttatatctgctgta

SEQ ID NO: 117518 - DNA, 20 bp, Artificial Sequence
  Description of Artificial Sequence: Synthetic oligonucleotide
  Target: ATXN1; (+) strand; PAM type: NRG; PAM sequence: AGG
taaatttatatctgctgtat

SEQ ID NO: 117519 - DNA, 20 bp, Artificial Sequence
  Description of Artificial Sequence: Synthetic oligonucleotide
  Target: ATXN1; (+) strand; PAM type: NRG; PAM sequence: TGG
ataaactatatttctaattc

SEQ ID NO: 117520 - DNA, 20 bp, Artificial Sequence
  Description of Artificial Sequence: Synthetic oligonucleotide
  Target: ATXN1; (+) strand; PAM type: NRG; PAM sequence: GAG
tatttctaattctggaaaat

SEQ ID NO: 117521 - DNA, 20 bp, Artificial Sequence
  Description of Artificial Sequence: Synthetic oligonucleotide
  Target: ATXN1; (+) strand; PAM type: NRG; PAM sequence: AGG
atttctaattctggaaaatg

SEQ ID NO: 117522 - DNA, 20 bp, Artificial Sequence
  Description of Artificial Sequence: Synthetic oligonucleotide
  Target: ATXN1; (+) strand; PAM type: NRG; PAM sequence: CAG
taattctggaaaatgaggtg

SEQ ID NO: 117523 - DNA, 20 bp, Artificial Sequence
  Description of Artificial Sequence: Synthetic oligonucleotide
  Target: ATXN1; (+) strand; PAM type: NRG; PAM sequence: GAG
attctggaaaatgaggtgca

SEQ ID NO: 117524 - DNA, 20 bp, Artificial Sequence
  Description of Artificial Sequence: Synthetic oligonucleotide
  Target: ATXN1; (+) strand; PAM type: NRG; PAM sequence: GAG
tctggaaaatgaggtgcaga

SEQ ID NO: 117525 - DNA, 20 bp, Artificial Sequence
  Description of Artificial Sequence: Synthetic oligonucleotide
  Target: ATXN1; (+) strand; PAM type: NRG; PAM sequence: AGG
ctggaaaatgaggtgcagag

SEQ ID NO: 117526 - DNA, 20 bp, Artificial Sequence
  Description of Artificial Sequence: Synthetic oligonucleotide
  Target: ATXN1; (+) strand; PAM type: NRG; PAM sequence: AAG
aatgaggtgcagagaggatt

SEQ ID NO: 117527 - DNA, 20 bp, Artificial Sequence
  Description of Artificial Sequence: Synthetic oligonucleotide
  Target: ATXN1; (+) strand; PAM type: NRG; PAM sequence: AAG
taagtaacatgcttgaattc

SEQ ID NO: 117528 - DNA, 20 bp, Artificial Sequence
  Description of Artificial Sequence: Synthetic oligonucleotide
  Target: ATXN1; (+) strand; PAM type: NRG; PAM sequence: AAG
atgcttcaataattaaatcg

SEQ ID NO: 117529 - DNA, 20 bp, Artificial Sequence
  Description of Artificial Sequence: Synthetic oligonucleotide
  Target: ATXN1; (+) strand; PAM type: NRG; PAM sequence: TGG
ttcaataattaaatcgaagc

SEQ ID NO: 117530 - DNA, 20 bp, Artificial Sequence
  Description of Artificial Sequence: Synthetic oligonucleotide
  Target: ATXN1; (+) strand; PAM type: NRG; PAM sequence: GGG
tcaataattaaatcgaagct

SEQ ID NO: 117531 - DNA, 20 bp, Artificial Sequence
  Description of Artificial Sequence: Synthetic oligonucleotide
  Target: ATXN1; (+) strand; PAM type: NRG; PAM sequence: GAG
taattaaatcgaagctgggc

SEQ ID NO: 117532 - DNA, 20 bp, Artificial Sequence
  Description of Artificial Sequence: Synthetic oligonucleotide
  Target: ATXN1; (+) strand; PAM type: NRG; PAM sequence: TGG
taaatcgaagctgggcgaga

SEQ ID NO: 117533 - DNA, 20 bp, Artificial Sequence
  Description of Artificial Sequence: Synthetic oligonucleotide
  Target: ATXN1; (+) strand; PAM type: NRG; PAM sequence: CAG
atggctcacacttgtaatcc

SEQ ID NO: 117534 - DNA, 20 bp, Artificial Sequence
  Description of Artificial Sequence: Synthetic oligonucleotide
  Target: ATXN1; (+) strand; PAM type: NRG; PAM sequence: TGG
cacttgtaatcccagcactt

SEQ ID NO: 117535 - DNA, 20 bp, Artificial Sequence
  Description of Artificial Sequence: Synthetic oligonucleotide
  Target: ATXN1; (+) strand; PAM type: NRG; PAM sequence: GGG
acttgtaatcccagcacttt

SEQ ID NO: 117536 - DNA, 20 bp, Artificial Sequence
  Description of Artificial Sequence: Synthetic oligonucleotide
  Target: ATXN1; (+) strand; PAM type: NRG; PAM sequence: GAG
ttgtaatcccagcactttgg

SEQ ID NO: 117537 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 117538 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggct

SEQ ID NO: 117539 - DNA, 20 bp, Artificial Sequence
  Description of Artificial Sequence: Synthetic oligonucleotide
  Target: ATXN1; (+) strand; PAM type: NRG; PAM sequence: CAG
agcactttgggaggctgagt

SEQ ID NO: 117540 - DNA, 20 bp, Artificial Sequence
  Description of Artificial Sequence: Synthetic oligonucleotide
  Target: ATXN1; (+) strand; PAM type: NRG; PAM sequence: AGG
gcactttgggaggctgagtc

SEQ ID NO: 117541 - DNA, 20 bp, Artificial Sequence
  Description of Artificial Sequence: Synthetic oligonucleotide
  Target: ATXN1; (+) strand; PAM type: NRG; PAM sequence: CGG
ctttgggaggctgagtcagg

SEQ ID NO: 117542 - DNA, 20 bp, Artificial Sequence
  Description of Artificial Sequence: Synthetic oligonucleotide
  Target: ATXN1; (+) strand; PAM type: NRG; PAM sequence: GAG
ctgagtcaggcggatcactt

SEQ ID NO: 117543 - DNA, 20 bp, Artificial Sequence
  Description of Artificial Sequence: Synthetic oligonucleotide
  Target: ATXN1; (+) strand; PAM type: NRG; PAM sequence: AGG
tgagtcaggcggatcacttg

SEQ ID NO: 117544 - DNA, 20 bp, Artificial Sequence
  Description of Artificial Sequence: Synthetic oligonucleotide
  Target: ATXN1; (+) strand; PAM type: NRG; PAM sequence: CAG
tcaggcggatcacttgaggt

SEQ ID NO: 117545 - DNA, 20 bp, Artificial Sequence
  Description of Artificial Sequence: Synthetic oligonucleotide
  Target: ATXN1; (+) strand; PAM type: NRG; PAM sequence: AGG
caggcggatcacttgaggtc

SEQ ID NO: 117546 - DNA, 20 bp, Artificial Sequence
  Description of Artificial Sequence: Synthetic oligonucleotide
  Target: ATXN1; (+) strand; PAM type: NRG; PAM sequence: GAG
ggcggatcacttgaggtcag

SEQ ID NO: 117547 - DNA, 20 bp, Artificial Sequence
  Description of Artificial Sequence: Synthetic oligonucleotide
  Target: ATXN1; (+) strand; PAM type: NRG; PAM sequence: AAG
tcacttgaggtcaggagttc

SEQ ID NO: 117548 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagttcaagac

SEQ ID NO: 117549 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcaagaccagcc

SEQ ID NO: 117550 - DNA, 20 bp, Artificial Sequence
  Description of Artificial Sequence: Synthetic oligonucleotide
  Target: ATXN1; (+) strand; PAM type: NRG; PAM sequence: TGG
caagaccagcctggccaaca

SEQ ID NO: 117551 - DNA, 20 bp, Artificial Sequence
  Description of Artificial Sequence: Synthetic oligonucleotide
  Target: ATXN1; (+) strand; PAM type: NRG; PAM sequence: AAG
tctctactaaaactacaaaa

SEQ ID NO: 117552 - DNA, 20 bp, Artificial Sequence
  Description of Artificial Sequence: Synthetic oligonucleotide
  Target: ATXN1; (+) strand; PAM type: NRG; PAM sequence: AGG
ctctactaaaactacaaaaa

SEQ ID NO: 117553 - DNA, 20 bp, Artificial Sequence
  Description of Artificial Sequence: Synthetic oligonucleotide
  Target: ATXN1; (+) strand; PAM type: NRG; PAM sequence: TAG
actaaaactacaaaaaaggt

SEQ ID NO: 117554 - DNA, 20 bp, Artificial Sequence
  Description of Artificial Sequence: Synthetic oligonucleotide
  Target: ATXN1; (+) strand; PAM type: NRG; PAM sequence: CAG
aaactacaaaaaaggttagc

SEQ ID NO: 117555 - DNA, 20 bp, Artificial Sequence
  Description of Artificial Sequence: Synthetic oligonucleotide
  Target: ATXN1; (+) strand; PAM type: NRG; PAM sequence: AGG
aactacaaaaaaggttagcc

SEQ ID NO: 117556 - DNA, 20 bp, Artificial Sequence
  Description of Artificial Sequence: Synthetic oligonucleotide
  Target: ATXN1; (+) strand; PAM type: NRG; PAM sequence: TGG
caaaaaaggttagccaggca

SEQ ID NO: 117557 - DNA, 20 bp, Artificial Sequence
  Description of Artificial Sequence: Synthetic oligonucleotide
  Target: ATXN1; (+) strand; PAM type: NRG; PAM sequence: TGG
aaaaggttagccaggcatgg

SEQ ID NO: 117558 - DNA, 20 bp, Artificial Sequence
  Description of Artificial Sequence: Synthetic oligonucleotide
  Target: ATXN1; (+) strand; PAM type: NRG; PAM sequence: CAG
gtggcacgtgcctgtaattc

SEQ ID NO: 117559 - DNA, 20 bp, Artificial Sequence
  Description of Artificial Sequence: Synthetic oligonucleotide
  Target: ATXN1; (+) strand; PAM type: NRG; PAM sequence: CAG
tgcctgtaattccagctact

SEQ ID NO: 117560 - DNA, 20 bp, Artificial Sequence
  Description of Artificial Sequence: Synthetic oligonucleotide
  Target: ATXN1; (+) strand; PAM type: NRG; PAM sequence: CAG
ctcagacaatcgcttgaacc

SEQ ID NO: 117561 - DNA, 20 bp, Artificial Sequence
  Description of Artificial Sequence: Synthetic oligonucleotide
  Target: ATXN1; (+) strand; PAM type: NRG; PAM sequence: AGG
tcagacaatcgcttgaaccc

SEQ ID NO: 117562 - DNA, 20 bp, Artificial Sequence
  Description of Artificial Sequence: Synthetic oligonucleotide
  Target: ATXN1; (+) strand; PAM type: NRG; PAM sequence: AAG
gacaatcgcttgaacccagg

SEQ ID NO: 117563 - DNA, 20 bp, Artificial Sequence
  Description of Artificial Sequence: Synthetic oligonucleotide
  Target: ATXN1; (+) strand; PAM type: NRG; PAM sequence: TGG
aatcgcttgaacccaggaag

SEQ ID NO: 117564 - DNA, 20 bp, Artificial Sequence
  Description of Artificial Sequence: Synthetic oligonucleotide
  Target: ATXN1; (+) strand; PAM type: NRG; PAM sequence: GAG
tcgcttgaacccaggaagtg

SEQ ID NO: 117565 - DNA, 20 bp, Artificial Sequence
  Description of Artificial Sequence: Synthetic oligonucleotide
  Target: ATXN1; (+) strand; PAM type: NRG; PAM sequence: AGG
cgcttgaacccaggaagtgg

SEQ ID NO: 117566 - DNA, 20 bp, Artificial Sequence
  Description of Artificial Sequence: Synthetic oligonucleotide
  Target: ATXN1; (+) strand; PAM type: NRG; PAM sequence: CAG
aacccaggaagtggaggttg

SEQ ID NO: 117567 - DNA, 20 bp, Artificial Sequence
  Description of Artificial Sequence: Synthetic oligonucleotide
  Target: ATXN1; (+) strand; PAM type: NRG; PAM sequence: GAG
caggaagtggaggttgcagt

SEQ ID NO: 117568 - DNA, 20 bp, Artificial Sequence
  Description of Artificial Sequence: Synthetic oligonucleotide
  Target: ATXN1; (+) strand; PAM type: NRG; PAM sequence: GAG
agtggaggttgcagtgagct

SEQ ID NO: 117569 - DNA, 20 bp, Artificial Sequence
  Description of Artificial Sequence: Synthetic oligonucleotide
  Target: ATXN1; (+) strand; PAM type: NRG; PAM sequence: TGG
gaggttgcagtgagctgaga

SEQ ID NO: 117570 - DNA, 20 bp, Artificial Sequence
  Description of Artificial Sequence: Synthetic oligonucleotide
  Target: ATXN1; (+) strand; PAM type: NRG; PAM sequence: TGG
ttgcagtgagctgagatggc

SEQ ID NO: 117571 - DNA, 20 bp, Artificial Sequence
  Description of Artificial Sequence: Synthetic oligonucleotide
  Target: ATXN1; (+) strand; PAM type: NRG; PAM sequence: CAG
gagctgagatggctggactc

SEQ ID NO: 117572 - DNA, 20 bp, Artificial Sequence
  Description of Artificial Sequence: Synthetic oligonucleotide
  Target: ATXN1; (+) strand; PAM type: NRG; PAM sequence: TGG
gagatggctggactccagcc

SEQ ID NO: 117573 - DNA, 20 bp, Artificial Sequence
  Description of Artificial Sequence: Synthetic oligonucleotide
  Target: ATXN1; (+) strand; PAM type: NRG; PAM sequence: GGG
agatggctggactccagcct

SEQ ID NO: 117574 - DNA, 20 bp, Artificial Sequence
  Description of Artificial Sequence: Synthetic oligonucleotide
  Target: ATXN1; (+) strand; PAM type: NRG; PAM sequence: AAG
tggactccagcctgggcaat

SEQ ID NO: 117575 - DNA, 20 bp, Artificial Sequence
  Description of Artificial Sequence: Synthetic oligonucleotide
  Target: ATXN1; (+) strand; PAM type: NRG; PAM sequence: GAG
gactccagcctgggcaataa

SEQ ID NO: 117576 - DNA, 20 bp, Artificial Sequence
  Description of Artificial Sequence: Synthetic oligonucleotide
  Target: ATXN1; (+) strand; PAM type: NRG; PAM sequence: GAG
ccagcctgggcaataagagc

SEQ ID NO: 117577 - DNA, 20 bp, Artificial Sequence
  Description of Artificial Sequence: Synthetic oligonucleotide
  Target: ATXN1; (+) strand; PAM type: NRG; PAM sequence: CAG
aaaaaaaaaaaaaaaaaaaa

SEQ ID NO: 117578 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaaaaaaacag

SEQ ID NO: 117579 - DNA, 20 bp, Artificial Sequence
  Description of Artificial Sequence: Synthetic oligonucleotide
  Target: ATXN1; (+) strand; PAM type: NRG; PAM sequence: TAG
aaaaaaaaaaacagaagaat

SEQ ID NO: 117580 - DNA, 20 bp, Artificial Sequence
  Description of Artificial Sequence: Synthetic oligonucleotide
  Target: ATXN1; (+) strand; PAM type: NRG; PAM sequence: GAG
tagatcgataaatatttact

SEQ ID NO: 117581 - DNA, 20 bp, Artificial Sequence
  Description of Artificial Sequence: Synthetic oligonucleotide
  Target: ATXN1; (+) strand; PAM type: NRG; PAM sequence: CAG
aaatatttactgagtgctta

SEQ ID NO: 117582 - DNA, 20 bp, Artificial Sequence
  Description of Artificial Sequence: Synthetic oligonucleotide
  Target: ATXN1; (+) strand; PAM type: NRG; PAM sequence: AAG
ctgagtgcttacagtgtgcc

SEQ ID NO: 117583 - DNA, 20 bp, Artificial Sequence
  Description of Artificial Sequence: Synthetic oligonucleotide
  Target: ATXN1; (+) strand; PAM type: NRG; PAM sequence: TAG
cagtgtgccaagtactgatt

SEQ ID NO: 117584 - DNA, 20 bp, Artificial Sequence
  Description of Artificial Sequence: Synthetic oligonucleotide
  Target: ATXN1; (+) strand; PAM type: NRG; PAM sequence: AGG
agtgtgccaagtactgattt

SEQ ID NO: 117585 - DNA, 20 bp, Artificial Sequence
  Description of Artificial Sequence: Synthetic oligonucleotide
  Target: ATXN1; (+) strand; PAM type: NRG; PAM sequence: CAG
gccaagtactgatttaggta

SEQ ID NO: 117586 - DNA, 20 bp, Artificial Sequence
  Description of Artificial Sequence: Synthetic oligonucleotide
  Target: ATXN1; (+) strand; PAM type: NRG; PAM sequence: AGG
ccaagtactgatttaggtac

SEQ ID NO: 117587 - DNA, 20 bp, Artificial Sequence
  Description of Artificial Sequence: Synthetic oligonucleotide
  Target: ATXN1; (+) strand; PAM type: NRG; PAM sequence: GGG
caagtactgatttaggtaca

SEQ ID NO: 117588 - DNA, 20 bp, Artificial Sequence
  Description of Artificial Sequence: Synthetic oligonucleotide
  Target: ATXN1; (+) strand; PAM type: NRG; PAM sequence: TAG
tactgatttaggtacaggga

SEQ ID NO: 117589 - DNA, 20 bp, Artificial Sequence
  Description of Artificial Sequence: Synthetic oligonucleotide
  Target: ATXN1; (+) strand; PAM type: NRG; PAM sequence: GAG
ctgatttaggtacagggata

SEQ ID NO: 117590 - DNA, 20 bp, Artificial Sequence
  Description of Artificial Sequence: Synthetic oligonucleotide
  Target: ATXN1; (+) strand; PAM type: NRG; PAM sequence: CAG
atttaggtacagggatagag

SEQ ID NO: 117591 - DNA, 20 bp, Artificial Sequence
  Description of Artificial Sequence: Synthetic oligonucleotide
  Target: ATXN1; (+) strand; PAM type: NRG; PAM sequence: GAG
aggtacagggatagagcagt

SEQ ID NO: 117592 - DNA, 20 bp, Artificial Sequence
  Description of Artificial Sequence: Synthetic oligonucleotide
  Target: ATXN1; (+) strand; PAM type: NRG; PAM sequence: GAG
cagggatagagcagtgagct

SEQ ID NO: 117593 - DNA, 20 bp, Artificial Sequence
  Description of Artificial Sequence: Synthetic oligonucleotide
  Target: ATXN1; (+) strand; PAM type: NRG; PAM sequence: CAG
ggatagagcagtgagctgag

SEQ ID NO: 117594 - DNA, 20 bp, Artificial Sequence
  Description of Artificial Sequence: Synthetic oligonucleotide
  Target: ATXN1; (+) strand; PAM type: NRG; PAM sequence: CAG
gcagacaaaatccctgccat

SEQ ID NO: 117595 - DNA, 20 bp, Artificial Sequence
  Description of Artificial Sequence: Synthetic oligonucleotide
  Target: ATXN1; (+) strand; PAM type: NRG; PAM sequence: GAG
agacaaaatccctgccatca

SEQ ID NO: 117596 - DNA, 20 bp, Artificial Sequence
  Description of Artificial Sequence: Synthetic oligonucleotide
  Target: ATXN1; (+) strand; PAM type: NRG; PAM sequence: GAG
acaaaatccctgccatcaga

SEQ ID NO: 117597 - DNA, 20 bp, Artificial Sequence
  Description of Artificial Sequence: Synthetic oligonucleotide
  Target: ATXN1; (+) strand; PAM type: NRG; PAM sequence: CAG
cctgccatcagagagctgac

SEQ ID NO: 117598 - DNA, 20 bp, Artificial Sequence
  Description of Artificial Sequence: Synthetic oligonucleotide
  Target: ATXN1; (+) strand; PAM type: NRG; PAM sequence: AGG
ctgccatcagagagctgacc

SEQ ID NO: 117599 - DNA, 20 bp, Artificial Sequence
  Description of Artificial Sequence: Synthetic oligonucleotide
  Target: ATXN1; (+) strand; PAM type: NRG; PAM sequence: CAG
ttccccactccatattgtgc

SEQ ID NO: 117600 - DNA, 20 bp, Artificial Sequence
  Description of Artificial Sequence: Synthetic oligonucleotide
  Target: ATXN1; (+) strand; PAM type: NRG; PAM sequence: TGG
ctccatattgtgccagtgct

SEQ ID NO: 117601 - DNA, 20 bp, Artificial Sequence
  Description of Artificial Sequence: Synthetic oligonucleotide
  Target: ATXN1; (+) strand; PAM type: NRG; PAM sequence: GGG
tccatattgtgccagtgctt

SEQ ID NO: 117602 - DNA, 20 bp, Artificial Sequence
  Description of Artificial Sequence: Synthetic oligonucleotide
  Target: ATXN1; (+) strand; PAM type: NRG; PAM sequence: GGG
ccatattgtgccagtgcttg

SEQ ID NO: 117603 - DNA, 20 bp, Artificial Sequence
  Description of Artificial Sequence: Synthetic oligonucleotide
  Target: ATXN1; (+) strand; PAM type: NRG; PAM sequence: AAG
gcttgcacttgctctctcta

SEQ ID NO: 117604 - DNA, 20 bp, Artificial Sequence
  Description of Artificial Sequence: Synthetic oligonucleotide
  Target: ATXN1; (+) strand; PAM type: NRG; PAM sequence: AGG
cttgcacttgctctctctaa

SEQ ID NO: 117605 - DNA, 20 bp, Artificial Sequence
  Description of Artificial Sequence: Synthetic oligonucleotide
  Target: ATXN1; (+) strand; PAM type: NRG; PAM sequence: TAG
ctctaaaggaactacttgta

SEQ ID NO: 117606 - DNA, 20 bp, Artificial Sequence
  Description of Artificial Sequence: Synthetic oligonucleotide
  Target: ATXN1; (+) strand; PAM type: NRG; PAM sequence: TGG
cttgtatagaaaataacatc

SEQ ID NO: 117607 - DNA, 20 bp, Artificial Sequence
  Description of Artificial Sequence: Synthetic oligonucleotide
  Target: ATXN1; (+) strand; PAM type: NRG; PAM sequence: GGG
ttgtatagaaaataacatct

SEQ ID NO: 117608 - DNA, 20 bp, Artificial Sequence
  Description of Artificial Sequence: Synthetic oligonucleotide
  Target: ATXN1; (+) strand; PAM type: NRG; PAM sequence: CAG
tatagaaaataacatctggg

SEQ ID NO: 117609 - DNA, 20 bp, Artificial Sequence
  Description of Artificial Sequence: Synthetic oligonucleotide
  Target: ATXN1; (+) strand; PAM type: NRG; PAM sequence: CAG
agaaaataacatctgggcag

SEQ ID NO: 117610 - DNA, 20 bp, Artificial Sequence
  Description of Artificial Sequence: Synthetic oligonucleotide
  Target: ATXN1; (+) strand; PAM type: NRG; PAM sequence: TGG
cagcagcataattgcataaa

SEQ ID NO: 117611 - DNA, 20 bp, Artificial Sequence
  Description of Artificial Sequence: Synthetic oligonucleotide
  Target: ATXN1; (+) strand; PAM type: NRG; PAM sequence: TAG
aaatggttaaccccccctgc

SEQ ID NO: 117612 - DNA, 20 bp, Artificial Sequence
  Description of Artificial Sequence: Synthetic oligonucleotide
  Target: ATXN1; (+) strand; PAM type: NRG; PAM sequence: AGG
aatggttaaccccccctgct

SEQ ID NO: 117613 - DNA, 20 bp, Artificial Sequence
  Description of Artificial Sequence: Synthetic oligonucleotide
  Target: ATXN1; (+) strand; PAM type: NRG; PAM sequence: GGG
atggttaaccccccctgcta

SEQ ID NO: 117614 - DNA, 20 bp, Artificial Sequence
  Description of Artificial Sequence: Synthetic oligonucleotide
  Target: ATXN1; (+) strand; PAM type: NRG; PAM sequence: GGG
tggttaaccccccctgctag

SEQ ID NO: 117615 - DNA, 20 bp, Artificial Sequence
  Description of Artificial Sequence: Synthetic oligonucleotide
  Target: ATXN1; (+) strand; PAM type: NRG; PAM sequence: TAG
cccccctgctaggggctctg

SEQ ID NO: 117616 - DNA, 20 bp, Artificial Sequence
  Description of Artificial Sequence: Synthetic oligonucleotide
  Target: ATXN1; (+) strand; PAM type: NRG; PAM sequence: CAG
tgctaggggctctgtagcct

SEQ ID NO: 117617 - DNA, 20 bp, Artificial Sequence
  Description of Artificial Sequence: Synthetic oligonucleotide
  Target: ATXN1; (+) strand; PAM type: NRG; PAM sequence: AGG
gctaggggctctgtagcctc

SEQ ID NO: 117618 - DNA, 20 bp, Artificial Sequence
  Description of Artificial Sequence: Synthetic oligonucleotide
  Target: ATXN1; (+) strand; PAM type: NRG; PAM sequence: GGG
ctaggggctctgtagcctca

SEQ ID NO: 117619 - DNA, 20 bp, Artificial Sequence
  Description of Artificial Sequence: Synthetic oligonucleotide
  Target: ATXN1; (+) strand; PAM type: NRG; PAM sequence: GGG
taggggctctgtagcctcag

SEQ ID NO: 117620 - DNA, 20 bp, Artificial Sequence
  Description of Artificial Sequence: Synthetic oligonucleotide
  Target: ATXN1; (+) strand; PAM type: NRG; PAM sequence: AAG
gctctgtagcctcaggggtc

SEQ ID NO: 117621 - DNA, 20 bp, Artificial Sequence
  Description of Artificial Sequence: Synthetic oligonucleotide
  Target: ATXN1; (+) strand; PAM type: NRG; PAM sequence: AGG
ctctgtagcctcaggggtca

SEQ ID NO: 117622 - DNA, 20 bp, Artificial Sequence
  Description of Artificial Sequence: Synthetic oligonucleotide
  Target: ATXN1; (+) strand; PAM type: NRG; PAM sequence: GAG
ctcaggggtcaaggctgcct

SEQ ID NO: 117623 - DNA, 20 bp, Artificial Sequence
  Description of Artificial Sequence: Synthetic oligonucleotide
  Target: ATXN1; (+) strand; PAM type: NRG; PAM sequence: AGG
tcaggggtcaaggctgcctg

SEQ ID NO: 117624 - DNA, 20 bp, Artificial Sequence
  Description of Artificial Sequence: Synthetic oligonucleotide
  Target: ATXN1; (+) strand; PAM type: NRG; PAM sequence: GGG
caggggtcaaggctgcctga

SEQ ID NO: 117625 - DNA, 20 bp, Artificial Sequence
  Description of Artificial Sequence: Synthetic oligonucleotide
  Target: ATXN1; (+) strand; PAM type: NRG; PAM sequence: GAG
gtcaaggctgcctgagggct

SEQ ID NO: 117626 - DNA, 20 bp, Artificial Sequence
  Description of Artificial Sequence: Synthetic oligonucleotide
  Target: ATXN1; (+) strand; PAM type: NRG; PAM sequence: AGG
tcaaggctgcctgagggctg

SEQ ID NO: 117627 - DNA, 20 bp, Artificial Sequence
  Description of Artificial Sequence: Synthetic oligonucleotide
  Target: ATXN1; (+) strand; PAM type: NRG; PAM sequence: TGG
gggctgaggcaatccatact

SEQ ID NO: 117628 - DNA, 20 bp, Artificial Sequence
  Description of Artificial Sequence: Synthetic oligonucleotide
  Target: ATXN1; (+) strand; PAM type: NRG; PAM sequence: TAG
tccatacttggatatacctg

SEQ ID NO: 117629 - DNA, 20 bp, Artificial Sequence
  Description of Artificial Sequence: Synthetic oligonucleotide
  Target: ATXN1; (+) strand; PAM type: NRG; PAM sequence: TGG
gtagcccatttgtaacaaac

SEQ ID NO: 117630 - DNA, 20 bp, Artificial Sequence
  Description of Artificial Sequence: Synthetic oligonucleotide
  Target: ATXN1; (+) strand; PAM type: NRG; PAM sequence: GAG
catttgtaacaaactggctt

SEQ ID NO: 117631 - DNA, 20 bp, Artificial Sequence
  Description of Artificial Sequence: Synthetic oligonucleotide
  Target: ATXN1; (+) strand; PAM type: NRG; PAM sequence: AAG
ttgtaacaaactggcttgag

SEQ ID NO: 117632 - DNA, 20 bp, Artificial Sequence
  Description of Artificial Sequence: Synthetic oligonucleotide
  Target: ATXN1; (+) strand; PAM type: NRG; PAM sequence: CAG
ttgagaagctgcattatcta

SEQ ID NO: 117633 - DNA, 20 bp, Artificial Sequence
  Description of Artificial Sequence: Synthetic oligonucleotide
  Target: ATXN1; (+) strand; PAM type: NRG; PAM sequence: TAG
aagctgcattatctacagtg

SEQ ID NO: 117634 - DNA, 20 bp, Artificial Sequence
  Description of Artificial Sequence: Synthetic oligonucleotide
  Target: ATXN1; (+) strand; PAM type: NRG; PAM sequence: CAG
ctacagtgtagccaatgatt

SEQ ID NO: 117635 - DNA, 20 bp, Artificial Sequence
  Description of Artificial Sequence: Synthetic oligonucleotide
  Target: ATXN1; (+) strand; PAM type: NRG; PAM sequence: AGG
tacagtgtagccaatgattc

SEQ ID NO: 117636 - DNA, 20 bp, Artificial Sequence
  Description of Artificial Sequence: Synthetic oligonucleotide
  Target: ATXN1; (+) strand; PAM type: NRG; PAM sequence: CAG
tgttaattattattgctaca

SEQ ID NO: 117637 - DNA, 20 bp, Artificial Sequence
  Description of Artificial Sequence: Synthetic oligonucleotide
  Target: ATXN1; (+) strand; PAM type: NRG; PAM sequence: CAG
gtacatgtaattgtattata

SEQ ID NO: 117638 - DNA, 20 bp, Artificial Sequence
  Description of Artificial Sequence: Synthetic oligonucleotide
  Target: ATXN1; (+) strand; PAM type: NRG; PAM sequence: GAG
acatgtaattgtattataca

SEQ ID NO: 117639 - DNA, 20 bp, Artificial Sequence
  Description of Artificial Sequence: Synthetic oligonucleotide
  Target: ATXN1; (+) strand; PAM type: NRG; PAM sequence: TGG
taattgtattatacagagac

SEQ ID NO: 117640 - DNA, 20 bp, Artificial Sequence
  Description of Artificial Sequence: Synthetic oligonucleotide
  Target: ATXN1; (+) strand; PAM type: NRG; PAM sequence: CAG
gtattatacagagactggaa

SEQ ID NO: 117641 - DNA, 20 bp, Artificial Sequence
  Description of Artificial Sequence: Synthetic oligonucleotide
  Target: ATXN1; (+) strand; PAM type: NRG; PAM sequence: TAG
tttccactctcttactgcca

SEQ ID NO: 117642 - DNA, 20 bp, Artificial Sequence
  Description of Artificial Sequence: Synthetic oligonucleotide
  Target: ATXN1; (+) strand; PAM type: NRG; PAM sequence: TAG
ctctcttactgccatagact

SEQ ID NO: 117643 - DNA, 20 bp, Artificial Sequence
  Description of Artificial Sequence: Synthetic oligonucleotide
  Target: ATXN1; (+) strand; PAM type: NRG; PAM sequence: TGG
tgccatagacttagtgcttt

SEQ ID NO: 117644 - DNA, 20 bp, Artificial Sequence
  Description of Artificial Sequence: Synthetic oligonucleotide
  Target: ATXN1; (+) strand; PAM type: NRG; PAM sequence: CAG
catagacttagtgcttttgg

SEQ ID NO: 117645 - DNA, 20 bp, Artificial Sequence
  Description of Artificial Sequence: Synthetic oligonucleotide
  Target: ATXN1; (+) strand; PAM type: NRG; PAM sequence: AGG
atagacttagtgcttttggc

SEQ ID NO: 117646 - DNA, 20 bp, Artificial Sequence
  Description of Artificial Sequence: Synthetic oligonucleotide
  Target: ATXN1; (+) strand; PAM type: NRG; PAM sequence: CAG
acttagtgcttttggcaggt

SEQ ID NO: 117647 - DNA, 20 bp, Artificial Sequence
  Description of Artificial Sequence: Synthetic oligonucleotide
  Target: ATXN1; (+) strand; PAM type: NRG; PAM sequence: AAG
agtgcttttggcaggtcagc

SEQ ID NO: 117648 - DNA, 20 bp, Artificial Sequence
  Description of Artificial Sequence: Synthetic oligonucleotide
  Target: ATXN1; (+) strand; PAM type: NRG; PAM sequence: GAG
ttttggcaggtcagcaagat

SEQ ID NO: 117649 - DNA, 20 bp, Artificial Sequence
  Description of Artificial Sequence: Synthetic oligonucleotide
  Target: ATXN1; (+) strand; PAM type: NRG; PAM sequence: AGG
tttggcaggtcagcaagatg

SEQ ID NO: 117650 - DNA, 20 bp, Artificial Sequence
  Description of Artificial Sequence: Synthetic oligonucleotide
  Target: ATXN1; (+) strand; PAM type: NRG; PAM sequence: TAG
tgaggtcaaaacaacctttg

SEQ ID NO: 117651 - DNA, 20 bp, Artificial Sequence
  Description of Artificial Sequence: Synthetic oligonucleotide
  Target: ATXN1; (+) strand; PAM type: NRG; PAM sequence: CAG
gtcaaaacaacctttgtagt

SEQ ID NO: 117652 - DNA, 20 bp, Artificial Sequence
  Description of Artificial Sequence: Synthetic oligonucleotide
  Target: ATXN1; (+) strand; PAM type: NRG; PAM sequence: CAG
aaaacaacctttgtagtcag

SEQ ID NO: 117653 - DNA, 20 bp, Artificial Sequence
  Description of Artificial Sequence: Synthetic oligonucleotide
  Target: ATXN1; (+) strand; PAM type: NRG; PAM sequence: CAG
agtcagcagacaaaactaaa

SEQ ID NO: 117654 - DNA, 20 bp, Artificial Sequence
  Description of Artificial Sequence: Synthetic oligonucleotide
  Target: ATXN1; (+) strand; PAM type: NRG; PAM sequence: CAG
agacaaaactaaacagccat

SEQ ID NO: 117655 - DNA, 20 bp, Artificial Sequence
  Description of Artificial Sequence: Synthetic oligonucleotide
  Target: ATXN1; (+) strand; PAM type: NRG; PAM sequence: TAG
aatatgctattaaattatta

SEQ ID NO: 117656 - DNA, 20 bp, Artificial Sequence
  Description of Artificial Sequence: Synthetic oligonucleotide
  Target: ATXN1; (+) strand; PAM type: NRG; PAM sequence: TAG
atgctattaaattattatag

SEQ ID NO: 117657 - DNA, 20 bp, Artificial Sequence
  Description of Artificial Sequence: Synthetic oligonucleotide
  Target: ATXN1; (+) strand; PAM type: NRG; PAM sequence: CAG
tattaaattattatagtaga

SEQ ID NO: 117658 - DNA, 20 bp, Artificial Sequence
  Description of Artificial Sequence: Synthetic oligonucleotide
  Target: ATXN1; (+) strand; PAM type: NRG; PAM sequence: AAG
ttatagtagacagcaaaacc

SEQ ID NO: 117659 - DNA, 20 bp, Artificial Sequence
  Description of Artificial Sequence: Synthetic oligonucleotide
  Target: ATXN1; (+) strand; PAM type: NRG; PAM sequence: AAG
aaaccaagaaattaatgcaa

SEQ ID NO: 117660 - DNA, 20 bp, Artificial Sequence
  Description of Artificial Sequence: Synthetic oligonucleotide
  Target: ATXN1; (+) strand; PAM type: NRG; PAM sequence: AAG
gaaattaatgcaaaagaacc

SEQ ID NO: 117661 - DNA, 20 bp, Artificial Sequence
  Description of Artificial Sequence: Synthetic oligonucleotide
  Target: ATXN1; (+) strand; PAM type: NRG; PAM sequence: GAG
aattaatgcaaaagaaccaa

SEQ ID NO: 117662 - DNA, 20 bp, Artificial Sequence
  Description of Artificial Sequence: Synthetic oligonucleotide
  Target: ATXN1; (+) strand; PAM type: NRG; PAM sequence: CAG
agatttcttaatcttatcac

SEQ ID NO: 117663 - DNA, 20 bp, Artificial Sequence
  Description of Artificial Sequence: Synthetic oligonucleotide
  Target: ATXN1; (+) strand; PAM type: NRG; PAM sequence: CAG
tcttaatcttatcaccagtt

SEQ ID NO: 117664 - DNA, 20 bp, Artificial Sequence
  Description of Artificial Sequence: Synthetic oligonucleotide
  Target: ATXN1; (+) strand; PAM type: NRG; PAM sequence: CAG
tcttatcaccagttcagatt

SEQ ID NO: 117665 - DNA, 20 bp, Artificial Sequence
  Description of Artificial Sequence: Synthetic oligonucleotide
  Target: ATXN1; (+) strand; PAM type: NRG; PAM sequence: AAG
caccagttcagattcagaaa

SEQ ID NO: 117666 - DNA, 20 bp, Artificial Sequence
  Description of Artificial Sequence: Synthetic oligonucleotide
  Target: ATXN1; (+) strand; PAM type: NRG; PAM sequence: AAG
agattcagaaaaagaactaa

SEQ ID NO: 117667 - DNA, 20 bp, Artificial Sequence
  Description of Artificial Sequence: Synthetic oligonucleotide
  Target: ATXN1; (+) strand; PAM type: NRG; PAM sequence: TGG
aagaactaaaagctgtgatc

SEQ ID NO: 117668 - DNA, 20 bp, Artificial Sequence
  Description of Artificial Sequence: Synthetic oligonucleotide
  Target: ATXN1; (+) strand; PAM type: NRG; PAM sequence: GGG
agaactaaaagctgtgatct

SEQ ID NO: 117669 - DNA, 20 bp, Artificial Sequence
  Description of Artificial Sequence: Synthetic oligonucleotide
  Target: ATXN1; (+) strand; PAM type: NRG; PAM sequence: GAG
aactaaaagctgtgatctgg

SEQ ID NO: 117670 - DNA, 20 bp, Artificial Sequence
  Description of Artificial Sequence: Synthetic oligonucleotide
  Target: ATXN1; (+) strand; PAM type: NRG; PAM sequence: TGG
aaagctgtgatctgggagct

SEQ ID NO: 117671 - DNA, 20 bp, Artificial Sequence
  Description of Artificial Sequence: Synthetic oligonucleotide
  Target: ATXN1; (+) strand; PAM type: NRG; PAM sequence: TAG
atctgggagcttggatatta

SEQ ID NO: 117672 - DNA, 20 bp, Artificial Sequence
  Description of Artificial Sequence: Synthetic oligonucleotide
  Target: ATXN1; (+) strand; PAM type: NRG; PAM sequence: AAG
gcttggatattatagcaatt

SEQ ID NO: 117673 - DNA, 20 bp, Artificial Sequence
  Description of Artificial Sequence: Synthetic oligonucleotide
  Target: ATXN1; (+) strand; PAM type: NRG; PAM sequence: CAG
tggatattatagcaattaag

SEQ ID NO: 117674 - DNA, 20 bp, Artificial Sequence
  Description of Artificial Sequence: Synthetic oligonucleotide
  Target: ATXN1; (+) strand; PAM type: NRG; PAM sequence: TGG
attatagcaattaagcagct

SEQ ID NO: 117675 - DNA, 20 bp, Artificial Sequence
  Description of Artificial Sequence: Synthetic oligonucleotide
  Target: ATXN1; (+) strand; PAM type: NRG; PAM sequence: AAG
ttaagcagcttggatataaa

SEQ ID NO: 117676 - DNA, 20 bp, Artificial Sequence
  Description of Artificial Sequence: Synthetic oligonucleotide
  Target: ATXN1; (+) strand; PAM type: NRG; PAM sequence: GAG
aagcagcttggatataaaaa

SEQ ID NO: 117677 - DNA, 20 bp, Artificial Sequence
  Description of Artificial Sequence: Synthetic oligonucleotide
  Target: ATXN1; (+) strand; PAM type: NRG; PAM sequence: AGG
agcagcttggatataaaaag

SEQ ID NO: 117678 - DNA, 20 bp, Artificial Sequence
  Description of Artificial Sequence: Synthetic oligonucleotide
  Target: ATXN1; (+) strand; PAM type: NRG; PAM sequence: TAG
agcttggatataaaaagagg

SEQ ID NO: 117679 - DNA, 20 bp, Artificial Sequence
  Description of Artificial Sequence: Synthetic oligonucleotide
  Target: ATXN1; (+) strand; PAM type: NRG; PAM sequence: AAG
ggatataaaaagaggtagat

SEQ ID NO: 117680 - DNA, 20 bp, Artificial Sequence
  Description of Artificial Sequence: Synthetic oligonucleotide
  Target: ATXN1; (+) strand; PAM type: NRG; PAM sequence: CAG
gaggtagataagctcacctt

SEQ ID NO: 117681 - DNA, 20 bp, Artificial Sequence
  Description of Artificial Sequence: Synthetic oligonucleotide
  Target: ATXN1; (+) strand; PAM type: NRG; PAM sequence: AGG
aggtagataagctcaccttc

SEQ ID NO: 117682 - DNA, 20 bp, Artificial Sequence
  Description of Artificial Sequence: Synthetic oligonucleotide
  Target: ATXN1; (+) strand; PAM type: NRG; PAM sequence: GGG
ggtagataagctcaccttca

SEQ ID NO: 117683 - DNA, 20 bp, Artificial Sequence
  Description of Artificial Sequence: Synthetic oligonucleotide
  Target: ATXN1; (+) strand; PAM type: NRG; PAM sequence: GGG
gtagataagctcaccttcag

SEQ ID NO: 117684 - DNA, 20 bp, Artificial Sequence
  Description of Artificial Sequence: Synthetic oligonucleotide
  Target: ATXN1; (+) strand; PAM type: NRG; PAM sequence: GGG
tagataagctcaccttcagg

SEQ ID NO: 117685 - DNA, 20 bp, Artificial Sequence
  Description of Artificial Sequence: Synthetic oligonucleotide
  Target: ATXN1; (+) strand; PAM type: NRG; PAM sequence: CAG
agctcaccttcagggggact

SEQ ID NO: 117686 - DNA, 20 bp, Artificial Sequence
  Description of Artificial Sequence: Synthetic oligonucleotide
  Target: ATXN1; (+) strand; PAM type: NRG; PAM sequence: CAG
tcaccttcagggggactcag

SEQ ID NO: 117687 - DNA, 20 bp, Artificial Sequence
  Description of Artificial Sequence: Synthetic oligonucleotide
  Target: ATXN1; (+) strand; PAM type: NRG; PAM sequence: TGG
gtgaccaccactgttatgta

SEQ ID NO: 117688 - DNA, 20 bp, Artificial Sequence
  Description of Artificial Sequence: Synthetic oligonucleotide
  Target: ATXN1; (+) strand; PAM type: NRG; PAM sequence: AAG
ccaccactgttatgtatgga

SEQ ID NO: 117689 - DNA, 20 bp, Artificial Sequence
  Description of Artificial Sequence: Synthetic oligonucleotide
  Target: ATXN1; (+) strand; PAM type: NRG; PAM sequence: AGG
caccactgttatgtatggaa

SEQ ID NO: 117690 - DNA, 20 bp, Artificial Sequence
  Description of Artificial Sequence: Synthetic oligonucleotide
  Target: ATXN1; (+) strand; PAM type: NRG; PAM sequence: GAG
ccactgttatgtatggaaag

SEQ ID NO: 117691 - DNA, 20 bp, Artificial Sequence
  Description of Artificial Sequence: Synthetic oligonucleotide
  Target: ATXN1; (+) strand; PAM type: NRG; PAM sequence: AAG
gttatgtatggaaaggagta

SEQ ID NO: 117692 - DNA, 20 bp, Artificial Sequence
  Description of Artificial Sequence: Synthetic oligonucleotide
  Target: ATXN1; (+) strand; PAM type: NRG; PAM sequence: AGG
ttatgtatggaaaggagtaa

SEQ ID NO: 117693 - DNA, 20 bp, Artificial Sequence
  Description of Artificial Sequence: Synthetic oligonucleotide
  Target: ATXN1; (+) strand; PAM type: NRG; PAM sequence: GGG
tatgtatggaaaggagtaaa

SEQ ID NO: 117694 - DNA, 20 bp, Artificial Sequence
  Description of Artificial Sequence: Synthetic oligonucleotide
  Target: ATXN1; (+) strand; PAM type: NRG; PAM sequence: GAG
gaaaggagtaaagggaatgc

SEQ ID NO: 117695 - DNA, 20 bp, Artificial Sequence
  Description of Artificial Sequence: Synthetic oligonucleotide
  Target: ATXN1; (+) strand; PAM type: NRG; PAM sequence: GAG
aaggagtaaagggaatgcga

SEQ ID NO: 117696 - DNA, 20 bp, Artificial Sequence
  Description of Artificial Sequence: Synthetic oligonucleotide
  Target: ATXN1; (+) strand; PAM type: NRG; PAM sequence: AGG
aggagtaaagggaatgcgag

SEQ ID NO: 117697 - DNA, 20 bp, Artificial Sequence
  Description of Artificial Sequence: Synthetic oligonucleotide
  Target: ATXN1; (+) strand; PAM type: NRG; PAM sequence: GAG
gcgagaggatatatgaactt

SEQ ID NO: 117698 - DNA, 20 bp, Artificial Sequence
  Description of Artificial Sequence: Synthetic oligonucleotide
  Target: ATXN1; (+) strand; PAM type: NRG; PAM sequence: AGG
cgagaggatatatgaacttg

SEQ ID NO: 117699 - DNA, 20 bp, Artificial Sequence
  Description of Artificial Sequence: Synthetic oligonucleotide
  Target: ATXN1; (+) strand; PAM type: NRG; PAM sequence: CAG
aggatatatgaacttgaggt

SEQ ID NO: 117700 - DNA, 20 bp, Artificial Sequence
  Description of Artificial Sequence: Synthetic oligonucleotide
  Target: ATXN1; (+) strand; PAM type: NRG; PAM sequence: AGG
ggatatatgaacttgaggtc

SEQ ID NO: 117701 - DNA, 20 bp, Artificial Sequence
  Description of Artificial Sequence: Synthetic oligonucleotide
  Target: ATXN1; (+) strand; PAM type: NRG; PAM sequence: TGG
acttgaggtcaggaaacatg

SEQ ID NO: 117702 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggaaacatgtgg

SEQ ID NO: 117703 - DNA, 20 bp, Artificial Sequence
  Description of Artificial Sequence: Synthetic oligonucleotide
  Target: ATXN1; (+) strand; PAM type: NRG; PAM sequence: AGG
gaggtcaggaaacatgtggc

SEQ ID NO: 117704 - DNA, 20 bp, Artificial Sequence
  Description of Artificial Sequence: Synthetic oligonucleotide
  Target: ATXN1; (+) strand; PAM type: NRG; PAM sequence: TGG
aggaaacatgtggcaggcat

SEQ ID NO: 117705 - DNA, 20 bp, Artificial Sequence
  Description of Artificial Sequence: Synthetic oligonucleotide
  Target: ATXN1; (+) strand; PAM type: NRG; PAM sequence: GGG
ggaaacatgtggcaggcatt

SEQ ID NO: 117706 - DNA, 20 bp, Artificial Sequence
  Description of Artificial Sequence: Synthetic oligonucleotide
  Target: ATXN1; (+) strand; PAM type: NRG; PAM sequence: TGG
acatgtggcaggcattgggt

SEQ ID NO: 117707 - DNA, 20 bp, Artificial Sequence
  Description of Artificial Sequence: Synthetic oligonucleotide
  Target: ATXN1; (+) strand; PAM type: NRG; PAM sequence: GGG
catgtggcaggcattgggtt

SEQ ID NO: 117708 - DNA, 20 bp, Artificial Sequence
  Description of Artificial Sequence: Synthetic oligonucleotide
  Target: ATXN1; (+) strand; PAM type: NRG; PAM sequence: AAG
gtggcaggcattgggttggg

SEQ ID NO: 117709 - DNA, 20 bp, Artificial Sequence
  Description of Artificial Sequence: Synthetic oligonucleotide
  Target: ATXN1; (+) strand; PAM type: NRG; PAM sequence: GAG
ttgggaagactgtatttact

SEQ ID NO: 117710 - DNA, 20 bp, Artificial Sequence
  Description of Artificial Sequence: Synthetic oligonucleotide
  Target: ATXN1; (+) strand; PAM type: NRG; PAM sequence: AGG
tgggaagactgtatttactg

SEQ ID NO: 117711 - DNA, 20 bp, Artificial Sequence
  Description of Artificial Sequence: Synthetic oligonucleotide
  Target: ATXN1; (+) strand; PAM type: NRG; PAM sequence: AAG
ctgtatttactgaggatctg

SEQ ID NO: 117712 - DNA, 20 bp, Artificial Sequence
  Description of Artificial Sequence: Synthetic oligonucleotide
  Target: ATXN1; (+) strand; PAM type: NRG; PAM sequence: TGG
tttactgaggatctgaagtg

SEQ ID NO: 117713 - DNA, 20 bp, Artificial Sequence
  Description of Artificial Sequence: Synthetic oligonucleotide
  Target: ATXN1; (+) strand; PAM type: NRG; PAM sequence: TAG
ctgaagtgtggcaaatgctc

SEQ ID NO: 117714 - DNA, 20 bp, Artificial Sequence
  Description of Artificial Sequence: Synthetic oligonucleotide
  Target: ATXN1; (+) strand; PAM type: NRG; PAM sequence: AGG
tgaagtgtggcaaatgctct

SEQ ID NO: 117715 - DNA, 20 bp, Artificial Sequence
  Description of Artificial Sequence: Synthetic oligonucleotide
  Target: ATXN1; (+) strand; PAM type: NRG; PAM sequence: GAG
aagtgtggcaaatgctctag

SEQ ID NO: 117716 - DNA, 20 bp, Artificial Sequence
  Description of Artificial Sequence: Synthetic oligonucleotide
  Target: ATXN1; (+) strand; PAM type: NRG; PAM sequence: CAG
gtggcaaatgctctaggaga

SEQ ID NO: 117717 - DNA, 20 bp, Artificial Sequence
  Description of Artificial Sequence: Synthetic oligonucleotide
  Target: ATXN1; (+) strand; PAM type: NRG; PAM sequence: AAG
gcaaatgctctaggagacag

SEQ ID NO: 117718 - DNA, 20 bp, Artificial Sequence
  Description of Artificial Sequence: Synthetic oligonucleotide
  Target: ATXN1; (+) strand; PAM type: NRG; PAM sequence: AGG
caaatgctctaggagacaga

SEQ ID NO: 117719 - DNA, 20 bp, Artificial Sequence
  Description of Artificial Sequence: Synthetic oligonucleotide
  Target: ATXN1; (+) strand; PAM type: NRG; PAM sequence: AAG
atgctctaggagacagaagg

SEQ ID NO: 117720 - DNA, 20 bp, Artificial Sequence
  Description of Artificial Sequence: Synthetic oligonucleotide
  Target: ATXN1; (+) strand; PAM type: NRG; PAM sequence: AGG
tgctctaggagacagaagga

SEQ ID NO: 117721 - DNA, 20 bp, Artificial Sequence
  Description of Artificial Sequence: Synthetic oligonucleotide
  Target: ATXN1; (+) strand; PAM type: NRG; PAM sequence: AAG
tctaggagacagaaggaagg

SEQ ID NO: 117722 - DNA, 20 bp, Artificial Sequence
  Description of Artificial Sequence: Synthetic oligonucleotide
  Target: ATXN1; (+) strand; PAM type: NRG; PAM sequence: AGG
ctaggagacagaaggaagga

SEQ ID NO: 117723 - DNA, 20 bp, Artificial Sequence
  Description of Artificial Sequence: Synthetic oligonucleotide
  Target: ATXN1; (+) strand; PAM type: NRG; PAM sequence: GAG
aggagacagaaggaaggaag

SEQ ID NO: 117724 - DNA, 20 bp, Artificial Sequence
  Description of Artificial Sequence: Synthetic oligonucleotide
  Target: ATXN1; (+) strand; PAM type: NRG; PAM sequence: GAG
gagacagaaggaaggaagga

SEQ ID NO: 117725 - DNA, 20 bp, Artificial Sequence
  Description of Artificial Sequence: Synthetic oligonucleotide
  Target: ATXN1; (+) strand; PAM type: NRG; PAM sequence: AAG
aggaaggagagcatctctac

SEQ ID NO: 117726 - DNA, 20 bp, Artificial Sequence
  Description of Artificial Sequence: Synthetic oligonucleotide
  Target: ATXN1; (+) strand; PAM type: NRG; PAM sequence: CAG
caagtaacacccaatctaac

SEQ ID NO: 117727 - DNA, 20 bp, Artificial Sequence
  Description of Artificial Sequence: Synthetic oligonucleotide
  Target: ATXN1; (+) strand; PAM type: NRG; PAM sequence: AGG
aagtaacacccaatctaacc

SEQ ID NO: 117728 - DNA, 20 bp, Artificial Sequence
  Description of Artificial Sequence: Synthetic oligonucleotide
  Target: ATXN1; (+) strand; PAM type: NRG; PAM sequence: TAG
taacacccaatctaaccagg

SEQ ID NO: 117729 - DNA, 20 bp, Artificial Sequence
  Description of Artificial Sequence: Synthetic oligonucleotide
  Target: ATXN1; (+) strand; PAM type: NRG; PAM sequence: AAG
acccaatctaaccaggtagt

SEQ ID NO: 117730 - DNA, 20 bp, Artificial Sequence
  Description of Artificial Sequence: Synthetic oligonucleotide
  Target: ATXN1; (+) strand; PAM type: NRG; PAM sequence: AAG
agactcatcttgatgtaaaa

SEQ ID NO: 117731 - DNA, 20 bp, Artificial Sequence
  Description of Artificial Sequence: Synthetic oligonucleotide
  Target: ATXN1; (+) strand; PAM type: NRG; PAM sequence: AAG
ctcatcttgatgtaaaaaag

SEQ ID NO: 117732 - DNA, 20 bp, Artificial Sequence
  Description of Artificial Sequence: Synthetic oligonucleotide
  Target: ATXN1; (+) strand; PAM type: NRG; PAM sequence: CAG
aaaaagaagtaaccacacaa

SEQ ID NO: 117733 - DNA, 20 bp, Artificial Sequence
  Description of Artificial Sequence: Synthetic oligonucleotide
  Target: ATXN1; (+) strand; PAM type: NRG; PAM sequence: GAG
aaagaagtaaccacacaaca

SEQ ID NO: 117734 - DNA, 20 bp, Artificial Sequence
  Description of Artificial Sequence: Synthetic oligonucleotide
  Target: ATXN1; (+) strand; PAM type: NRG; PAM sequence: TAG
gtaaccacacaacagagctg

SEQ ID NO: 117735 - DNA, 20 bp, Artificial Sequence
  Description of Artificial Sequence: Synthetic oligonucleotide
  Target: ATXN1; (+) strand; PAM type: NRG; PAM sequence: TAG
gctgtagaaaacttcactat

SEQ ID NO: 117736 - DNA, 20 bp, Artificial Sequence
  Description of Artificial Sequence: Synthetic oligonucleotide
  Target: ATXN1; (+) strand; PAM type: NRG; PAM sequence: CAG
ctattagaaaacaaacaacc

SEQ ID NO: 117737 - DNA, 20 bp, Artificial Sequence
  Description of Artificial Sequence: Synthetic oligonucleotide
  Target: ATXN1; (+) strand; PAM type: NRG; PAM sequence: TGG
aaacaacccagtttttaaaa

SEQ ID NO: 117738 - DNA, 20 bp, Artificial Sequence
  Description of Artificial Sequence: Synthetic oligonucleotide
  Target: ATXN1; (+) strand; PAM type: NRG; PAM sequence: AAG
ccagtttttaaaatggacaa

SEQ ID NO: 117739 - DNA, 20 bp, Artificial Sequence
  Description of Artificial Sequence: Synthetic oligonucleotide
  Target: ATXN1; (+) strand; PAM type: NRG; PAM sequence: CAG
aaatggacaaaagacctgac

SEQ ID NO: 117740 - DNA, 20 bp, Artificial Sequence
  Description of Artificial Sequence: Synthetic oligonucleotide
  Target: ATXN1; (+) strand; PAM type: NRG; PAM sequence: TAG
gaccagacaccttaccaaat

SEQ ID NO: 117741 - DNA, 20 bp, Artificial Sequence
  Description of Artificial Sequence: Synthetic oligonucleotide
  Target: ATXN1; (+) strand; PAM type: NRG; PAM sequence: TAG
acaccttaccaaattagaca

SEQ ID NO: 117742 - DNA, 20 bp, Artificial Sequence
  Description of Artificial Sequence: Synthetic oligonucleotide
  Target: ATXN1; (+) strand; PAM type: NRG; PAM sequence: GAG
accttaccaaattagacata

SEQ ID NO: 117743 - DNA, 20 bp, Artificial Sequence
  Description of Artificial Sequence: Synthetic oligonucleotide
  Target: ATXN1; (+) strand; PAM type: NRG; PAM sequence: TGG
taccaaattagacatagaga

SEQ ID NO: 117744 - DNA, 20 bp, Artificial Sequence
  Description of Artificial Sequence: Synthetic oligonucleotide
  Target: ATXN1; (+) strand; PAM type: NRG; PAM sequence: AAG
aaattagacatagagatggc

SEQ ID NO: 117745 - DNA, 20 bp, Artificial Sequence
  Description of Artificial Sequence: Synthetic oligonucleotide
  Target: ATXN1; (+) strand; PAM type: NRG; PAM sequence: AAG
tagacatagagatggcaagt

SEQ ID NO: 117746 - DNA, 20 bp, Artificial Sequence
  Description of Artificial Sequence: Synthetic oligonucleotide
  Target: ATXN1; (+) strand; PAM type: NRG; PAM sequence: AAG
atggcaagtaagcacataaa

SEQ ID NO: 117747 - DNA, 20 bp, Artificial Sequence
  Description of Artificial Sequence: Synthetic oligonucleotide
  Target: ATXN1; (+) strand; PAM type: NRG; PAM sequence: TAG
tgctccacattatgaatcac

SEQ ID NO: 117748 - DNA, 20 bp, Artificial Sequence
  Description of Artificial Sequence: Synthetic oligonucleotide
  Target: ATXN1; (+) strand; PAM type: NRG; PAM sequence: AGG
gctccacattatgaatcact

SEQ ID NO: 117749 - DNA, 20 bp, Artificial Sequence
  Description of Artificial Sequence: Synthetic oligonucleotide
  Target: ATXN1; (+) strand; PAM type: NRG; PAM sequence: GGG
ctccacattatgaatcacta

SEQ ID NO: 117750 - DNA, 20 bp, Artificial Sequence
  Description of Artificial Sequence: Synthetic oligonucleotide
  Target: ATXN1; (+) strand; PAM type: NRG; PAM sequence: AAG
ctgtgaattaaaacaaacac

SEQ ID NO: 117751 - DNA, 20 bp, Artificial Sequence
  Description of Artificial Sequence: Synthetic oligonucleotide
  Target: ATXN1; (+) strand; PAM type: NRG; PAM sequence: TGG
caagataccacctatgaaaa

SEQ ID NO: 117752 - DNA, 20 bp, Artificial Sequence
  Description of Artificial Sequence: Synthetic oligonucleotide
  Target: ATXN1; (+) strand; PAM type: NRG; PAM sequence: CAG
aaaatccaacacactgccaa

SEQ ID NO: 117753 - DNA, 20 bp, Artificial Sequence
  Description of Artificial Sequence: Synthetic oligonucleotide
  Target: ATXN1; (+) strand; PAM type: NRG; PAM sequence: CAG
atccaacacactgccaacag

SEQ ID NO: 117754 - DNA, 20 bp, Artificial Sequence
  Description of Artificial Sequence: Synthetic oligonucleotide
  Target: ATXN1; (+) strand; PAM type: NRG; PAM sequence: TGG
acactgccaacagcagatgc

SEQ ID NO: 117755 - DNA, 20 bp, Artificial Sequence
  Description of Artificial Sequence: Synthetic oligonucleotide
  Target: ATXN1; (+) strand; PAM type: NRG; PAM sequence: AAG
tgccaacagcagatgctggc

SEQ ID NO: 117756 - DNA, 20 bp, Artificial Sequence
  Description of Artificial Sequence: Synthetic oligonucleotide
  Target: ATXN1; (+) strand; PAM type: NRG; PAM sequence: AGG
gccaacagcagatgctggca

SEQ ID NO: 117757 - DNA, 20 bp, Artificial Sequence
  Description of Artificial Sequence: Synthetic oligonucleotide
  Target: ATXN1; (+) strand; PAM type: NRG; PAM sequence: CAG
agcagatgctggcaaggatg

SEQ ID NO: 117758 - DNA, 20 bp, Artificial Sequence
  Description of Artificial Sequence: Synthetic oligonucleotide
  Target: ATXN1; (+) strand; PAM type: NRG; PAM sequence: GAG
cagatgctggcaaggatgca

SEQ ID NO: 117759 - DNA, 20 bp, Artificial Sequence
  Description of Artificial Sequence: Synthetic oligonucleotide
  Target: ATXN1; (+) strand; PAM type: NRG; PAM sequence: TAG
ctggcaaggatgcagagcca

SEQ ID NO: 117760 - DNA, 20 bp, Artificial Sequence
  Description of Artificial Sequence: Synthetic oligonucleotide
  Target: ATXN1; (+) strand; PAM type: NRG; PAM sequence: AGG
tggcaaggatgcagagccat

SEQ ID NO: 117761 - DNA, 20 bp, Artificial Sequence
  Description of Artificial Sequence: Synthetic oligonucleotide
  Target: ATXN1; (+) strand; PAM type: NRG; PAM sequence: AAG
gcagagccataggaactctc

SEQ ID NO: 117762 - DNA, 20 bp, Artificial Sequence
  Description of Artificial Sequence: Synthetic oligonucleotide
  Target: ATXN1; (+) strand; PAM type: NRG; PAM sequence: CGG
taggaactctcaagtcattg

SEQ ID NO: 117763 - DNA, 20 bp, Artificial Sequence
  Description of Artificial Sequence: Synthetic oligonucleotide
  Target: ATXN1; (+) strand; PAM type: NRG; PAM sequence: GGG
aggaactctcaagtcattgc

SEQ ID NO: 117764 - DNA, 20 bp, Artificial Sequence
  Description of Artificial Sequence: Synthetic oligonucleotide
  Target: ATXN1; (+) strand; PAM type: NRG; PAM sequence: TGG
aactctcaagtcattgcggg

SEQ ID NO: 117765 - DNA, 20 bp, Artificial Sequence
  Description of Artificial Sequence: Synthetic oligonucleotide
  Target: ATXN1; (+) strand; PAM type: NRG; PAM sequence: GGG
actctcaagtcattgcgggt

SEQ ID NO: 117766 - DNA, 20 bp, Artificial Sequence
  Description of Artificial Sequence: Synthetic oligonucleotide
  Target: ATXN1; (+) strand; PAM type: NRG; PAM sequence: TAG
attgcgggtgggaatgcaaa

SEQ ID NO: 117767 - DNA, 20 bp, Artificial Sequence
  Description of Artificial Sequence: Synthetic oligonucleotide
  Target: ATXN1; (+) strand; PAM type: NRG; PAM sequence: AAG
cgggtgggaatgcaaatagt

SEQ ID NO: 117768 - DNA, 20 bp, Artificial Sequence
  Description of Artificial Sequence: Synthetic oligonucleotide
  Target: ATXN1; (+) strand; PAM type: NRG; PAM sequence: TGG
aatgcaaatagtaagctact

SEQ ID NO: 117769 - DNA, 20 bp, Artificial Sequence
  Description of Artificial Sequence: Synthetic oligonucleotide
  Target: ATXN1; (+) strand; PAM type: NRG; PAM sequence: GGG
atgcaaatagtaagctactt

SEQ ID NO: 117770 - DNA, 20 bp, Artificial Sequence
  Description of Artificial Sequence: Synthetic oligonucleotide
  Target: ATXN1; (+) strand; PAM type: NRG; PAM sequence: CAG
tagtaagctacttgggaaaa

SEQ ID NO: 117771 - DNA, 20 bp, Artificial Sequence
  Description of Artificial Sequence: Synthetic oligonucleotide
  Target: ATXN1; (+) strand; PAM type: NRG; PAM sequence: TGG
agctacttgggaaaacagtt

SEQ ID NO: 117772 - DNA, 20 bp, Artificial Sequence
  Description of Artificial Sequence: Synthetic oligonucleotide
  Target: ATXN1; (+) strand; PAM type: NRG; PAM sequence: CAG
tacttgggaaaacagtttgg

SEQ ID NO: 117773 - DNA, 20 bp, Artificial Sequence
  Description of Artificial Sequence: Synthetic oligonucleotide
  Target: ATXN1; (+) strand; PAM type: NRG; PAM sequence: AAG
cagtttggcagtttcctaca

SEQ ID NO: 117774 - DNA, 20 bp, Artificial Sequence
  Description of Artificial Sequence: Synthetic oligonucleotide
  Target: ATXN1; (+) strand; PAM type: NRG; PAM sequence: TGG
catactcttaacatgcaatg

SEQ ID NO: 117775 - DNA, 20 bp, Artificial Sequence
  Description of Artificial Sequence: Synthetic oligonucleotide
  Target: ATXN1; (+) strand; PAM type: NRG; PAM sequence: AAG
ctcttaacatgcaatgtggc

SEQ ID NO: 117776 - DNA, 20 bp, Artificial Sequence
  Description of Artificial Sequence: Synthetic oligonucleotide
  Target: ATXN1; (+) strand; PAM type: NRG; PAM sequence: TGG
aatgtggcaagcatgctcct

SEQ ID NO: 117777 - DNA, 20 bp, Artificial Sequence
  Description of Artificial Sequence: Synthetic oligonucleotide
  Target: ATXN1; (+) strand; PAM type: NRG; PAM sequence: AAG
cacaaataaactaaaaactt

SEQ ID NO: 117778 - DNA, 20 bp, Artificial Sequence
  Description of Artificial Sequence: Synthetic oligonucleotide
  Target: ATXN1; (+) strand; PAM type: NRG; PAM sequence: TAG
aacctgcactcaaatgttta

SEQ ID NO: 117779 - DNA, 20 bp, Artificial Sequence
  Description of Artificial Sequence: Synthetic oligonucleotide
  Target: ATXN1; (+) strand; PAM type: NRG; PAM sequence: CAG
ctgcactcaaatgtttatag

SEQ ID NO: 117780 - DNA, 20 bp, Artificial Sequence
  Description of Artificial Sequence: Synthetic oligonucleotide
  Target: ATXN1; (+) strand; PAM type: NRG; PAM sequence: TGG
gcttcattcataatcgtgaa

SEQ ID NO: 117781 - DNA, 20 bp, Artificial Sequence
  Description of Artificial Sequence: Synthetic oligonucleotide
  Target: ATXN1; (+) strand; PAM type: NRG; PAM sequence: GGG
cttcattcataatcgtgaat

SEQ ID NO: 117782 - DNA, 20 bp, Artificial Sequence
  Description of Artificial Sequence: Synthetic oligonucleotide
  Target: ATXN1; (+) strand; PAM type: NRG; PAM sequence: TGG
gtgaatgggtacatgaactg

SEQ ID NO: 117783 - DNA, 20 bp, Artificial Sequence
  Description of Artificial Sequence: Synthetic oligonucleotide
  Target: ATXN1; (+) strand; PAM type: NRG; PAM sequence: TAG
actgtggtacatccatacaa

SEQ ID NO: 117784 - DNA, 20 bp, Artificial Sequence
  Description of Artificial Sequence: Synthetic oligonucleotide
  Target: ATXN1; (+) strand; PAM type: NRG; PAM sequence: CAG
ccatacaatagaatattatt

SEQ ID NO: 117785 - DNA, 20 bp, Artificial Sequence
  Description of Artificial Sequence: Synthetic oligonucleotide
  Target: ATXN1; (+) strand; PAM type: NRG; PAM sequence: AAG
attcagcactaaaaacaaat

SEQ ID NO: 117786 - DNA, 20 bp, Artificial Sequence
  Description of Artificial Sequence: Synthetic oligonucleotide
  Target: ATXN1; (+) strand; PAM type: NRG; PAM sequence: CAG
actaaaaacaaataagcttt

SEQ ID NO: 117787 - DNA, 20 bp, Artificial Sequence
  Description of Artificial Sequence: Synthetic oligonucleotide
  Target: ATXN1; (+) strand; PAM type: NRG; PAM sequence: AGG
ctaaaaacaaataagctttc

SEQ ID NO: 117788 - DNA, 20 bp, Artificial Sequence
  Description of Artificial Sequence: Synthetic oligonucleotide
  Target: ATXN1; (+) strand; PAM type: NRG; PAM sequence: GAG
agctttcaggccataaaaat

SEQ ID NO: 117789 - DNA, 20 bp, Artificial Sequence
  Description of Artificial Sequence: Synthetic oligonucleotide
  Target: ATXN1; (+) strand; PAM type: NRG; PAM sequence: GAG
ctttcaggccataaaaatga

SEQ ID NO: 117790 - DNA, 20 bp, Artificial Sequence
  Description of Artificial Sequence: Synthetic oligonucleotide
  Target: ATXN1; (+) strand; PAM type: NRG; PAM sequence: AGG
tttcaggccataaaaatgag

SEQ ID NO: 117791 - DNA, 20 bp, Artificial Sequence
  Description of Artificial Sequence: Synthetic oligonucleotide
  Target: ATXN1; (+) strand; PAM type: NRG; PAM sequence: AAG
ggccataaaaatgagaggtg

SEQ ID NO: 117792 - DNA, 20 bp, Artificial Sequence
  Description of Artificial Sequence: Synthetic oligonucleotide
  Target: ATXN1; (+) strand; PAM type: NRG; PAM sequence: CAG
ataaaaatgagaggtgaagc

SEQ ID NO: 117793 - DNA, 20 bp, Artificial Sequence
  Description of Artificial Sequence: Synthetic oligonucleotide
  Target: ATXN1; (+) strand; PAM type: NRG; PAM sequence: TGG
aaatgagaggtgaagccagc

SEQ ID NO: 117794 - DNA, 20 bp, Artificial Sequence
  Description of Artificial Sequence: Synthetic oligonucleotide
  Target: ATXN1; (+) strand; PAM type: NRG; PAM sequence: TGG
gtgaagccagctggacttcc

SEQ ID NO: 117795 - DNA, 20 bp, Artificial Sequence
  Description of Artificial Sequence: Synthetic oligonucleotide
  Target: ATXN1; (+) strand; PAM type: NRG; PAM sequence: GGG
tgaagccagctggacttcct

SEQ ID NO: 117796 - DNA, 20 bp, Artificial Sequence
  Description of Artificial Sequence: Synthetic oligonucleotide
  Target: ATXN1; (+) strand; PAM type: NRG; PAM sequence: GAG
ccagctggacttcctgggtt

SEQ ID NO: 117797 - DNA, 20 bp, Artificial Sequence
  Description of Artificial Sequence: Synthetic oligonucleotide
  Target: ATXN1; (+) strand; PAM type: NRG; PAM sequence: TGG
gctggacttcctgggttgag

SEQ ID NO: 117798 - DNA, 20 bp, Artificial Sequence
  Description of Artificial Sequence: Synthetic oligonucleotide
  Target: ATXN1; (+) strand; PAM type: NRG; PAM sequence: GGG
ctggacttcctgggttgagt

SEQ ID NO: 117799 - DNA, 20 bp, Artificial Sequence
  Description of Artificial Sequence: Synthetic oligonucleotide
  Target: ATXN1; (+) strand; PAM type: NRG; PAM sequence: GGG
tggacttcctgggttgagtg

SEQ ID NO: 117800 - DNA, 20 bp, Artificial Sequence
  Description of Artificial Sequence: Synthetic oligonucleotide
  Target: ATXN1; (+) strand; PAM type: NRG; PAM sequence: TGG
tcctgggttgagtggggact

SEQ ID NO: 117801 - DNA, 20 bp, Artificial Sequence
  Description of Artificial Sequence: Synthetic oligonucleotide
  Target: ATXN1; (+) strand; PAM type: NRG; PAM sequence: GGG
cctgggttgagtggggactt

SEQ ID NO: 117802 - DNA, 20 bp, Artificial Sequence
  Description of Artificial Sequence: Synthetic oligonucleotide
  Target: ATXN1; (+) strand; PAM type: NRG; PAM sequence: GGG
ctgggttgagtggggacttg

SEQ ID NO: 117803 - DNA, 20 bp, Artificial Sequence
  Description of Artificial Sequence: Synthetic oligonucleotide
  Target: ATXN1; (+) strand; PAM type: NRG; PAM sequence: AAG
ggaaatttcccgtcctacaa

SEQ ID NO: 117804 - DNA, 20 bp, Artificial Sequence
  Description of Artificial Sequence: Synthetic oligonucleotide
  Target: ATXN1; (+) strand; PAM type: NRG; PAM sequence: AGG
gaaatttcccgtcctacaaa

SEQ ID NO: 117805 - DNA, 20 bp, Artificial Sequence
  Description of Artificial Sequence: Synthetic oligonucleotide
  Target: ATXN1; (+) strand; PAM type: NRG; PAM sequence: CAG
ggattgtaaaacacaccaat

SEQ ID NO: 117806 - DNA, 20 bp, Artificial Sequence
  Description of Artificial Sequence: Synthetic oligonucleotide
  Target: ATXN1; (+) strand; PAM type: NRG; PAM sequence: AGG
gattgtaaaacacaccaatc

SEQ ID NO: 117807 - DNA, 20 bp, Artificial Sequence
  Description of Artificial Sequence: Synthetic oligonucleotide
  Target: ATXN1; (+) strand; PAM type: NRG; PAM sequence: AAG
caggaactttcctgtcttat

SEQ ID NO: 117808 - DNA, 20 bp, Artificial Sequence
  Description of Artificial Sequence: Synthetic oligonucleotide
  Target: ATXN1; (+) strand; PAM type: NRG; PAM sequence: GAG
ggaactttcctgtcttataa

SEQ ID NO: 117809 - DNA, 20 bp, Artificial Sequence
  Description of Artificial Sequence: Synthetic oligonucleotide
  Target: ATXN1; (+) strand; PAM type: NRG; PAM sequence: AGG
gaactttcctgtcttataag

SEQ ID NO: 117810 - DNA, 20 bp, Artificial Sequence
  Description of Artificial Sequence: Synthetic oligonucleotide
  Target: ATXN1; (+) strand; PAM type: NRG; PAM sequence: AAG
tgtcttataagaggtttgta

SEQ ID NO: 117811 - DNA, 20 bp, Artificial Sequence
  Description of Artificial Sequence: Synthetic oligonucleotide
  Target: ATXN1; (+) strand; PAM type: NRG; PAM sequence: CAG
ggtttgtaaagcgcaccaat

SEQ ID NO: 117812 - DNA, 20 bp, Artificial Sequence
  Description of Artificial Sequence: Synthetic oligonucleotide
  Target: ATXN1; (+) strand; PAM type: NRG; PAM sequence: TGG
aaagcgcaccaatcagcact

SEQ ID NO: 117813 - DNA, 20 bp, Artificial Sequence
  Description of Artificial Sequence: Synthetic oligonucleotide
  Target: ATXN1; (+) strand; PAM type: NRG; PAM sequence: CAG
gctctgtaaaatgcaccaat

SEQ ID NO: 117814 - DNA, 20 bp, Artificial Sequence
  Description of Artificial Sequence: Synthetic oligonucleotide
  Target: ATXN1; (+) strand; PAM type: NRG; PAM sequence: CAG
ctgtaaaatgcaccaatcag

SEQ ID NO: 117815 - DNA, 20 bp, Artificial Sequence
  Description of Artificial Sequence: Synthetic oligonucleotide
  Target: ATXN1; (+) strand; PAM type: NRG; PAM sequence: AGG
tgtaaaatgcaccaatcagc

SEQ ID NO: 117816 - DNA, 20 bp, Artificial Sequence
  Description of Artificial Sequence: Synthetic oligonucleotide
  Target: ATXN1; (+) strand; PAM type: NRG; PAM sequence: GAG
taaaatgcaccaatcagcag

SEQ ID NO: 117817 - DNA, 20 bp, Artificial Sequence
  Description of Artificial Sequence: Synthetic oligonucleotide
  Target: ATXN1; (+) strand; PAM type: NRG; PAM sequence: AAG
accaatcagcaggagtataa

SEQ ID NO: 117818 - DNA, 20 bp, Artificial Sequence
  Description of Artificial Sequence: Synthetic oligonucleotide
  Target: ATXN1; (+) strand; PAM type: NRG; PAM sequence: TAG
aatcagcaggagtataaaag

SEQ ID NO: 117819 - DNA, 20 bp, Artificial Sequence
  Description of Artificial Sequence: Synthetic oligonucleotide
  Target: ATXN1; (+) strand; PAM type: NRG; PAM sequence: CAG
agtataaaagtagccaatcg

SEQ ID NO: 117820 - DNA, 20 bp, Artificial Sequence
  Description of Artificial Sequence: Synthetic oligonucleotide
  Target: ATXN1; (+) strand; PAM type: NRG; PAM sequence: AGG
gtataaaagtagccaatcgc

SEQ ID NO: 117821 - DNA, 20 bp, Artificial Sequence
  Description of Artificial Sequence: Synthetic oligonucleotide
  Target: ATXN1; (+) strand; PAM type: NRG; PAM sequence: GGG
tataaaagtagccaatcgca

SEQ ID NO: 117822 - DNA, 20 bp, Artificial Sequence
  Description of Artificial Sequence: Synthetic oligonucleotide
  Target: ATXN1; (+) strand; PAM type: NRG; PAM sequence: GAG
taaaagtagccaatcgcagg

SEQ ID NO: 117823 - DNA, 20 bp, Artificial Sequence
  Description of Artificial Sequence: Synthetic oligonucleotide
  Target: ATXN1; (+) strand; PAM type: NRG; PAM sequence: AGG
aaaagtagccaatcgcaggg

SEQ ID NO: 117824 - DNA, 20 bp, Artificial Sequence
  Description of Artificial Sequence: Synthetic oligonucleotide
  Target: ATXN1; (+) strand; PAM type: NRG; PAM sequence: TGG
gcagggaggattgaaaaaaa

SEQ ID NO: 117825 - DNA, 20 bp, Artificial Sequence
  Description of Artificial Sequence: Synthetic oligonucleotide
  Target: ATXN1; (+) strand; PAM type: NRG; PAM sequence: TAG
tgaaaaaaatggcactctga

SEQ ID NO: 117826 - DNA, 20 bp, Artificial Sequence
  Description of Artificial Sequence: Synthetic oligonucleotide
  Target: ATXN1; (+) strand; PAM type: NRG; PAM sequence: AGG
gaaaaaaatggcactctgat

SEQ ID NO: 117827 - DNA, 20 bp, Artificial Sequence
  Description of Artificial Sequence: Synthetic oligonucleotide
  Target: ATXN1; (+) strand; PAM type: NRG; PAM sequence: CAG
aaaatggcactctgatagga

SEQ ID NO: 117828 - DNA, 20 bp, Artificial Sequence
  Description of Artificial Sequence: Synthetic oligonucleotide
  Target: ATXN1; (+) strand; PAM type: NRG; PAM sequence: CAG
gcactctgataggacagaaa

SEQ ID NO: 117829 - DNA, 20 bp, Artificial Sequence
  Description of Artificial Sequence: Synthetic oligonucleotide
  Target: ATXN1; (+) strand; PAM type: NRG; PAM sequence: TGG
gataggacagaaacagaata

SEQ ID NO: 117830 - DNA, 20 bp, Artificial Sequence
  Description of Artificial Sequence: Synthetic oligonucleotide
  Target: ATXN1; (+) strand; PAM type: NRG; PAM sequence: GGG
ataggacagaaacagaatat

SEQ ID NO: 117831 - DNA, 20 bp, Artificial Sequence
  Description of Artificial Sequence: Synthetic oligonucleotide
  Target: ATXN1; (+) strand; PAM type: NRG; PAM sequence: GAG
aggacagaaacagaatatgg

SEQ ID NO: 117832 - DNA, 20 bp, Artificial Sequence
  Description of Artificial Sequence: Synthetic oligonucleotide
  Target: ATXN1; (+) strand; PAM type: NRG; PAM sequence: AGG
ggacagaaacagaatatggg

SEQ ID NO: 117833 - DNA, 20 bp, Artificial Sequence
  Description of Artificial Sequence: Synthetic oligonucleotide
  Target: ATXN1; (+) strand; PAM type: NRG; PAM sequence: GGG
gacagaaacagaatatggga

SEQ ID NO: 117834 - DNA, 20 bp, Artificial Sequence
  Description of Artificial Sequence: Synthetic oligonucleotide
  Target: ATXN1; (+) strand; PAM type: NRG; PAM sequence: GGG
acagaaacagaatatgggag

SEQ ID NO: 117835 - DNA, 20 bp, Artificial Sequence
  Description of Artificial Sequence: Synthetic oligonucleotide
  Target: ATXN1; (+) strand; PAM type: NRG; PAM sequence: AAG
gaatatgggaggggacaaat

SEQ ID NO: 117836 - DNA, 20 bp, Artificial Sequence
  Description of Artificial Sequence: Synthetic oligonucleotide
  Target: ATXN1; (+) strand; PAM type: NRG; PAM sequence: AGG
aatatgggaggggacaaata

SEQ ID NO: 117837 - DNA, 20 bp, Artificial Sequence
  Description of Artificial Sequence: Synthetic oligonucleotide
  Target: ATXN1; (+) strand; PAM type: NRG; PAM sequence: GGG
atatgggaggggacaaataa

SEQ ID NO: 117838 - DNA, 20 bp, Artificial Sequence
  Description of Artificial Sequence: Synthetic oligonucleotide
  Target: ATXN1; (+) strand; PAM type: NRG; PAM sequence: AAG
ggggacaaataagggaataa

SEQ ID NO: 117839 - DNA, 20 bp, Artificial Sequence
  Description of Artificial Sequence: Synthetic oligonucleotide
  Target: ATXN1; (+) strand; PAM type: NRG; PAM sequence: CGG
gacaaataagggaataaaag

SEQ ID NO: 117840 - DNA, 20 bp, Artificial Sequence
  Description of Artificial Sequence: Synthetic oligonucleotide
  Target: ATXN1; (+) strand; PAM type: NRG; PAM sequence: GGG
acaaataagggaataaaagc

SEQ ID NO: 117841 - DNA, 20 bp, Artificial Sequence
  Description of Artificial Sequence: Synthetic oligonucleotide
  Target: ATXN1; (+) strand; PAM type: NRG; PAM sequence: CAG
ggaataaaagcgggccaccc

SEQ ID NO: 117842 - DNA, 20 bp, Artificial Sequence
  Description of Artificial Sequence: Synthetic oligonucleotide
  Target: ATXN1; (+) strand; PAM type: NRG; PAM sequence: CAG
taaaagcgggccaccccagc

SEQ ID NO: 117843 - DNA, 20 bp, Artificial Sequence
  Description of Artificial Sequence: Synthetic oligonucleotide
  Target: ATXN1; (+) strand; PAM type: NRG; PAM sequence: CAG
aagcgggccaccccagccag

SEQ ID NO: 117844 - DNA, 20 bp, Artificial Sequence
  Description of Artificial Sequence: Synthetic oligonucleotide
  Target: ATXN1; (+) strand; PAM type: NRG; PAM sequence: TGG
cgggccaccccagccagcag

SEQ ID NO: 117845 - DNA, 20 bp, Artificial Sequence
  Description of Artificial Sequence: Synthetic oligonucleotide
  Target: ATXN1; (+) strand; PAM type: NRG; PAM sequence: TGG
gccagcagtggcaacccatt

SEQ ID NO: 117846 - DNA, 20 bp, Artificial Sequence
  Description of Artificial Sequence: Synthetic oligonucleotide
  Target: ATXN1; (+) strand; PAM type: NRG; PAM sequence: GGG
ccagcagtggcaacccattt

SEQ ID NO: 117847 - DNA, 20 bp, Artificial Sequence
  Description of Artificial Sequence: Synthetic oligonucleotide
  Target: ATXN1; (+) strand; PAM type: NRG; PAM sequence: TGG
atttgggtccccttccacgc

SEQ ID NO: 117848 - DNA, 20 bp, Artificial Sequence
  Description of Artificial Sequence: Synthetic oligonucleotide
  Target: ATXN1; (+) strand; PAM type: NRG; PAM sequence: GGG
tttgggtccccttccacgct

SEQ ID NO: 117849 - DNA, 20 bp, Artificial Sequence
  Description of Artificial Sequence: Synthetic oligonucleotide
  Target: ATXN1; (+) strand; PAM type: NRG; PAM sequence: GGG
ttgggtccccttccacgctg

SEQ ID NO: 117850 - DNA, 20 bp, Artificial Sequence
  Description of Artificial Sequence: Synthetic oligonucleotide
  Target: ATXN1; (+) strand; PAM type: NRG; PAM sequence: AAG
ggtccccttccacgctgggg

SEQ ID NO: 117851 - DNA, 20 bp, Artificial Sequence
  Description of Artificial Sequence: Synthetic oligonucleotide
  Target: ATXN1; (+) strand; PAM type: NRG; PAM sequence: CAG
ctttgtcctgtcgctcttca

SEQ ID NO: 117852 - DNA, 20 bp, Artificial Sequence
  Description of Artificial Sequence: Synthetic oligonucleotide
  Target: ATXN1; (+) strand; PAM type: NRG; PAM sequence: TGG
ccttgctactgctcactctt

SEQ ID NO: 117853 - DNA, 20 bp, Artificial Sequence
  Description of Artificial Sequence: Synthetic oligonucleotide
  Target: ATXN1; (+) strand; PAM type: NRG; PAM sequence: GGG
cttgctactgctcactcttt

SEQ ID NO: 117854 - DNA, 20 bp, Artificial Sequence
  Description of Artificial Sequence: Synthetic oligonucleotide
  Target: ATXN1; (+) strand; PAM type: NRG; PAM sequence: AAG
tttgggtctgtgccatcttt

SEQ ID NO: 117855 - DNA, 20 bp, Artificial Sequence
  Description of Artificial Sequence: Synthetic oligonucleotide
  Target: ATXN1; (+) strand; PAM type: NRG; PAM sequence: GAG
tgggtctgtgccatctttaa

SEQ ID NO: 117856 - DNA, 20 bp, Artificial Sequence
  Description of Artificial Sequence: Synthetic oligonucleotide
  Target: ATXN1; (+) strand; PAM type: NRG; PAM sequence: AAG
gagctgtaacactcaccgtg

SEQ ID NO: 117857 - DNA, 20 bp, Artificial Sequence
  Description of Artificial Sequence: Synthetic oligonucleotide
  Target: ATXN1; (+) strand; PAM type: NRG; PAM sequence: AGG
agctgtaacactcaccgtga

SEQ ID NO: 117858 - DNA, 20 bp, Artificial Sequence
  Description of Artificial Sequence: Synthetic oligonucleotide
  Target: ATXN1; (+) strand; PAM type: NRG; PAM sequence: AAG
ggtccgtgcctccattcttg

SEQ ID NO: 117859 - DNA, 20 bp, Artificial Sequence
  Description of Artificial Sequence: Synthetic oligonucleotide
  Target: ATXN1; (+) strand; PAM type: NRG; PAM sequence: CAG
cgtgcctccattcttgaagt

SEQ ID NO: 117860 - DNA, 20 bp, Artificial Sequence
  Description of Artificial Sequence: Synthetic oligonucleotide
  Target: ATXN1; (+) strand; PAM type: NRG; PAM sequence: GAG
cctccattcttgaagtcagc

SEQ ID NO: 117861 - DNA, 20 bp, Artificial Sequence
  Description of Artificial Sequence: Synthetic oligonucleotide
  Target: ATXN1; (+) strand; PAM type: NRG; PAM sequence: CGG
cagcgagaccatgaatccac

SEQ ID NO: 117862 - DNA, 20 bp, Artificial Sequence
  Description of Artificial Sequence: Synthetic oligonucleotide
  Target: ATXN1; (+) strand; PAM type: NRG; PAM sequence: TGG
gagaccatgaatccaccggc

SEQ ID NO: 117863 - DNA, 20 bp, Artificial Sequence
  Description of Artificial Sequence: Synthetic oligonucleotide
  Target: ATXN1; (+) strand; PAM type: NRG; PAM sequence: TGG
ccaccggctggaaccaactc

SEQ ID NO: 117864 - DNA, 20 bp, Artificial Sequence
  Description of Artificial Sequence: Synthetic oligonucleotide
  Target: ATXN1; (+) strand; PAM type: NRG; PAM sequence: TGG
aaccaactctggacacatct

SEQ ID NO: 117865 - DNA, 20 bp, Artificial Sequence
  Description of Artificial Sequence: Synthetic oligonucleotide
  Target: ATXN1; (+) strand; PAM type: NRG; PAM sequence: GGG
accaactctggacacatctt

SEQ ID NO: 117866 - DNA, 20 bp, Artificial Sequence
  Description of Artificial Sequence: Synthetic oligonucleotide
  Target: ATXN1; (+) strand; PAM type: NRG; PAM sequence: GGG
ccaactctggacacatcttg

SEQ ID NO: 117867 - DNA, 20 bp, Artificial Sequence
  Description of Artificial Sequence: Synthetic oligonucleotide
  Target: ATXN1; (+) strand; PAM type: NRG; PAM sequence: GGG
caactctggacacatcttgg

SEQ ID NO: 117868 - DNA, 20 bp, Artificial Sequence
  Description of Artificial Sequence: Synthetic oligonucleotide
  Target: ATXN1; (+) strand; PAM type: NRG; PAM sequence: CAG
cacatcttgggggatcctcc

SEQ ID NO: 117869 - DNA, 20 bp, Artificial Sequence
  Description of Artificial Sequence: Synthetic oligonucleotide
  Target: ATXN1; (+) strand; PAM type: NRG; PAM sequence: TGG
tcctcccagatattgcaacg

SEQ ID NO: 117870 - DNA, 20 bp, Artificial Sequence
  Description of Artificial Sequence: Synthetic oligonucleotide
  Target: ATXN1; (+) strand; PAM type: NRG; PAM sequence: GAG
cccagatattgcaacgtggt

SEQ ID NO: 117871 - DNA, 20 bp, Artificial Sequence
  Description of Artificial Sequence: Synthetic oligonucleotide
  Target: ATXN1; (+) strand; PAM type: NRG; PAM sequence: CAG
tgcaacgtggtgagtaccat

SEQ ID NO: 117872 - DNA, 20 bp, Artificial Sequence
  Description of Artificial Sequence: Synthetic oligonucleotide
  Target: ATXN1; (+) strand; PAM type: NRG; PAM sequence: TAG
tattctgtcctatttttcct

SEQ ID NO: 117873 - DNA, 20 bp, Artificial Sequence
  Description of Artificial Sequence: Synthetic oligonucleotide
  Target: ATXN1; (+) strand; PAM type: NRG; PAM sequence: CAG
tcctatttttccttagaatt

SEQ ID NO: 117874 - DNA, 20 bp, Artificial Sequence
  Description of Artificial Sequence: Synthetic oligonucleotide
  Target: ATXN1; (+) strand; PAM type: NRG; PAM sequence: AGG
cctatttttccttagaattc

SEQ ID NO: 117875 - DNA, 20 bp, Artificial Sequence
  Description of Artificial Sequence: Synthetic oligonucleotide
  Target: ATXN1; (+) strand; PAM type: NRG; PAM sequence: GGG
ctatttttccttagaattca

SEQ ID NO: 117876 - DNA, 20 bp, Artificial Sequence
  Description of Artificial Sequence: Synthetic oligonucleotide
  Target: ATXN1; (+) strand; PAM type: NRG; PAM sequence: GGG
tatttttccttagaattcag

SEQ ID NO: 117877 - DNA, 20 bp, Artificial Sequence
  Description of Artificial Sequence: Synthetic oligonucleotide
  Target: ATXN1; (+) strand; PAM type: NRG; PAM sequence: TAG
tagaattcaggggctaaaac

SEQ ID NO: 117878 - DNA, 20 bp, Artificial Sequence
  Description of Artificial Sequence: Synthetic oligonucleotide
  Target: ATXN1; (+) strand; PAM type: NRG; PAM sequence: AGG
agaattcaggggctaaaact

SEQ ID NO: 117879 - DNA, 20 bp, Artificial Sequence
  Description of Artificial Sequence: Synthetic oligonucleotide
  Target: ATXN1; (+) strand; PAM type: NRG; PAM sequence: CAG
ggctaaaactaggcacctgt

SEQ ID NO: 117880 - DNA, 20 bp, Artificial Sequence
  Description of Artificial Sequence: Synthetic oligonucleotide
  Target: ATXN1; (+) strand; PAM type: NRG; PAM sequence: CAG
aaaactaggcacctgtcagc

SEQ ID NO: 117881 - DNA, 20 bp, Artificial Sequence
  Description of Artificial Sequence: Synthetic oligonucleotide
  Target: ATXN1; (+) strand; PAM type: NRG; PAM sequence: AAG
ggcacctgtcagccagttaa

SEQ ID NO: 117882 - DNA, 20 bp, Artificial Sequence
  Description of Artificial Sequence: Synthetic oligonucleotide
  Target: ATXN1; (+) strand; PAM type: NRG; PAM sequence: TAG
gtcagccagttaaaagcaac

SEQ ID NO: 117883 - DNA, 20 bp, Artificial Sequence
  Description of Artificial Sequence: Synthetic oligonucleotide
  Target: ATXN1; (+) strand; PAM type: NRG; PAM sequence: TGG
ccagttaaaagcaactagca

SEQ ID NO: 117884 - DNA, 20 bp, Artificial Sequence
  Description of Artificial Sequence: Synthetic oligonucleotide
  Target: ATXN1; (+) strand; PAM type: NRG; PAM sequence: CAG
aaaagcaactagcatggcca

SEQ ID NO: 117885 - DNA, 20 bp, Artificial Sequence
  Description of Artificial Sequence: Synthetic oligonucleotide
  Target: ATXN1; (+) strand; PAM type: NRG; PAM sequence: AGG
aaagcaactagcatggccac

SEQ ID NO: 117886 - DNA, 20 bp, Artificial Sequence
  Description of Artificial Sequence: Synthetic oligonucleotide
  Target: ATXN1; (+) strand; PAM type: NRG; PAM sequence: AAG
actagcatggccacaggact

SEQ ID NO: 117887 - DNA, 20 bp, Artificial Sequence
  Description of Artificial Sequence: Synthetic oligonucleotide
  Target: ATXN1; (+) strand; PAM type: NRG; PAM sequence: AGG
ctagcatggccacaggacta

SEQ ID NO: 117888 - DNA, 20 bp, Artificial Sequence
  Description of Artificial Sequence: Synthetic oligonucleotide
  Target: ATXN1; (+) strand; PAM type: NRG; PAM sequence: TGG
tggccacaggactaaggaca

SEQ ID NO: 117889 - DNA, 20 bp, Artificial Sequence
  Description of Artificial Sequence: Synthetic oligonucleotide
  Target: ATXN1; (+) strand; PAM type: NRG; PAM sequence: CAG
aggactaaggacatggatgt

SEQ ID NO: 117890 - DNA, 20 bp, Artificial Sequence
  Description of Artificial Sequence: Synthetic oligonucleotide
  Target: ATXN1; (+) strand; PAM type: NRG; PAM sequence: AGG
ggactaaggacatggatgtc

SEQ ID NO: 117891 - DNA, 20 bp, Artificial Sequence
  Description of Artificial Sequence: Synthetic oligonucleotide
  Target: ATXN1; (+) strand; PAM type: NRG; PAM sequence: TGG
gacatggatgtcaggctctc

SEQ ID NO: 117892 - DNA, 20 bp, Artificial Sequence
  Description of Artificial Sequence: Synthetic oligonucleotide
  Target: ATXN1; (+) strand; PAM type: NRG; PAM sequence: GGG
acatggatgtcaggctctct

SEQ ID NO: 117893 - DNA, 20 bp, Artificial Sequence
  Description of Artificial Sequence: Synthetic oligonucleotide
  Target: ATXN1; (+) strand; PAM type: NRG; PAM sequence: AAG
ggatgtcaggctctctggga

SEQ ID NO: 117894 - DNA, 20 bp, Artificial Sequence
  Description of Artificial Sequence: Synthetic oligonucleotide
  Target: ATXN1; (+) strand; PAM type: NRG; PAM sequence: AGG
gatgtcaggctctctgggaa

SEQ ID NO: 117895 - DNA, 20 bp, Artificial Sequence
  Description of Artificial Sequence: Synthetic oligonucleotide
  Target: ATXN1; (+) strand; PAM type: NRG; PAM sequence: GGG
atgtcaggctctctgggaaa

SEQ ID NO: 117896 - DNA, 20 bp, Artificial Sequence
  Description of Artificial Sequence: Synthetic oligonucleotide
  Target: ATXN1; (+) strand; PAM type: NRG; PAM sequence: TGG
actaacaacccccgactgtt

SEQ ID NO: 117897 - DNA, 20 bp, Artificial Sequence
  Description of Artificial Sequence: Synthetic oligonucleotide
  Target: ATXN1; (+) strand; PAM type: NRG; PAM sequence: GAG
taacaacccccgactgtttg

SEQ ID NO: 117898 - DNA, 20 bp, Artificial Sequence
  Description of Artificial Sequence: Synthetic oligonucleotide
  Target: ATXN1; (+) strand; PAM type: NRG; PAM sequence: CAG
aacccccgactgtttggagt

SEQ ID NO: 117899 - DNA, 20 bp, Artificial Sequence
  Description of Artificial Sequence: Synthetic oligonucleotide
  Target: ATXN1; (+) strand; PAM type: NRG; PAM sequence: AGG
acccccgactgtttggagtc

SEQ ID NO: 117900 - DNA, 20 bp, Artificial Sequence
  Description of Artificial Sequence: Synthetic oligonucleotide
  Target: ATXN1; (+) strand; PAM type: NRG; PAM sequence: GAG
ccccgactgtttggagtcag

SEQ ID NO: 117901 - DNA, 20 bp, Artificial Sequence
  Description of Artificial Sequence: Synthetic oligonucleotide
  Target: ATXN1; (+) strand; PAM type: NRG; PAM sequence: TGG
ctgtttggagtcaggagcat

SEQ ID NO: 117902 - DNA, 20 bp, Artificial Sequence
  Description of Artificial Sequence: Synthetic oligonucleotide
  Target: ATXN1; (+) strand; PAM type: NRG; PAM sequence: TGG
gtcaggagcattggtttgcc

SEQ ID NO: 117903 - DNA, 20 bp, Artificial Sequence
  Description of Artificial Sequence: Synthetic oligonucleotide
  Target: ATXN1; (+) strand; PAM type: NRG; PAM sequence: CAG
agcattggtttgcctggaac

SEQ ID NO: 117904 - DNA, 20 bp, Artificial Sequence
  Description of Artificial Sequence: Synthetic oligonucleotide
  Target: ATXN1; (+) strand; PAM type: NRG; PAM sequence: CGG
ttctgcttttcctgcacttc

SEQ ID NO: 117905 - DNA, 20 bp, Artificial Sequence
  Description of Artificial Sequence: Synthetic oligonucleotide
  Target: ATXN1; (+) strand; PAM type: NRG; PAM sequence: GGG
tctgcttttcctgcacttcc

SEQ ID NO: 117906 - DNA, 20 bp, Artificial Sequence
  Description of Artificial Sequence: Synthetic oligonucleotide
  Target: ATXN1; (+) strand; PAM type: NRG; PAM sequence: AAG
ttttcctgcacttccgggct

SEQ ID NO: 117907 - DNA, 20 bp, Artificial Sequence
  Description of Artificial Sequence: Synthetic oligonucleotide
  Target: ATXN1; (+) strand; PAM type: NRG; PAM sequence: TAG
ctgcacttccgggctaagcc

SEQ ID NO: 117908 - DNA, 20 bp, Artificial Sequence
  Description of Artificial Sequence: Synthetic oligonucleotide
  Target: ATXN1; (+) strand; PAM type: NRG; PAM sequence: AGG
tgcacttccgggctaagcct

SEQ ID NO: 117909 - DNA, 20 bp, Artificial Sequence
  Description of Artificial Sequence: Synthetic oligonucleotide
  Target: ATXN1; (+) strand; PAM type: NRG; PAM sequence: GGG
gcacttccgggctaagccta

SEQ ID NO: 117910 - DNA, 20 bp, Artificial Sequence
  Description of Artificial Sequence: Synthetic oligonucleotide
  Target: ATXN1; (+) strand; PAM type: NRG; PAM sequence: CAG
cgggctaagcctagggtcga

SEQ ID NO: 117911 - DNA, 20 bp, Artificial Sequence
  Description of Artificial Sequence: Synthetic oligonucleotide
  Target: ATXN1; (+) strand; PAM type: NRG; PAM sequence: GAG
ggctaagcctagggtcgaca

SEQ ID NO: 117912 - DNA, 20 bp, Artificial Sequence
  Description of Artificial Sequence: Synthetic oligonucleotide
  Target: ATXN1; (+) strand; PAM type: NRG; PAM sequence: GAG
ctaagcctagggtcgacaga

SEQ ID NO: 117913 - DNA, 20 bp, Artificial Sequence
  Description of Artificial Sequence: Synthetic oligonucleotide
  Target: ATXN1; (+) strand; PAM type: NRG; PAM sequence: AGG
taagcctagggtcgacagag

SEQ ID NO: 117914 - DNA, 20 bp, Artificial Sequence
  Description of Artificial Sequence: Synthetic oligonucleotide
  Target: ATXN1; (+) strand; PAM type: NRG; PAM sequence: AAG
cctagggtcgacagagagga

SEQ ID NO: 117915 - DNA, 20 bp, Artificial Sequence
  Description of Artificial Sequence: Synthetic oligonucleotide
  Target: ATXN1; (+) strand; PAM type: NRG; PAM sequence: CAG
cgacagagaggaaagccatt

SEQ ID NO: 117916 - DNA, 20 bp, Artificial Sequence
  Description of Artificial Sequence: Synthetic oligonucleotide
  Target: ATXN1; (+) strand; PAM type: NRG; PAM sequence: CGG
agaggaaagccattcagctc

SEQ ID NO: 117917 - DNA, 20 bp, Artificial Sequence
  Description of Artificial Sequence: Synthetic oligonucleotide
  Target: ATXN1; (+) strand; PAM type: NRG; PAM sequence: GGG
gaggaaagccattcagctcc

SEQ ID NO: 117918 - DNA, 20 bp, Artificial Sequence
  Description of Artificial Sequence: Synthetic oligonucleotide
  Target: ATXN1; (+) strand; PAM type: NRG; PAM sequence: GGG
aggaaagccattcagctccg

SEQ ID NO: 117919 - DNA, 20 bp, Artificial Sequence
  Description of Artificial Sequence: Synthetic oligonucleotide
  Target: ATXN1; (+) strand; PAM type: NRG; PAM sequence: AAG
agctccggggtctcaacaaa

SEQ ID NO: 117920 - DNA, 20 bp, Artificial Sequence
  Description of Artificial Sequence: Synthetic oligonucleotide
  Target: ATXN1; (+) strand; PAM type: NRG; PAM sequence: TGG
ccggggtctcaacaaaaagt

SEQ ID NO: 117921 - DNA, 20 bp, Artificial Sequence
  Description of Artificial Sequence: Synthetic oligonucleotide
  Target: ATXN1; (+) strand; PAM type: NRG; PAM sequence: TGG
ggtctcaacaaaaagttggt

SEQ ID NO: 117922 - DNA, 20 bp, Artificial Sequence
  Description of Artificial Sequence: Synthetic oligonucleotide
  Target: ATXN1; (+) strand; PAM type: NRG; PAM sequence: CAG
caaaaagttggttggccctg

SEQ ID NO: 117923 - DNA, 20 bp, Artificial Sequence
  Description of Artificial Sequence: Synthetic oligonucleotide
  Target: ATXN1; (+) strand; PAM type: NRG; PAM sequence: GAG
ttggttggccctgcagccat

SEQ ID NO: 117924 - DNA, 20 bp, Artificial Sequence
  Description of Artificial Sequence: Synthetic oligonucleotide
  Target: ATXN1; (+) strand; PAM type: NRG; PAM sequence: CAG
gttggccctgcagccatgag

SEQ ID NO: 117925 - DNA, 20 bp, Artificial Sequence
  Description of Artificial Sequence: Synthetic oligonucleotide
  Target: ATXN1; (+) strand; PAM type: NRG; PAM sequence: AAG
agccatgagcagaactctca

SEQ ID NO: 117926 - DNA, 20 bp, Artificial Sequence
  Description of Artificial Sequence: Synthetic oligonucleotide
  Target: ATXN1; (+) strand; PAM type: NRG; PAM sequence: TAG
gcagaactctcaaagttaca

SEQ ID NO: 117927 - DNA, 20 bp, Artificial Sequence
  Description of Artificial Sequence: Synthetic oligonucleotide
  Target: ATXN1; (+) strand; PAM type: NRG; PAM sequence: AAG
caaagttacatagcccaaac

SEQ ID NO: 117928 - DNA, 20 bp, Artificial Sequence
  Description of Artificial Sequence: Synthetic oligonucleotide
  Target: ATXN1; (+) strand; PAM type: NRG; PAM sequence: TGG
ctatcctgacccttgcctcc

SEQ ID NO: 117929 - DNA, 20 bp, Artificial Sequence
  Description of Artificial Sequence: Synthetic oligonucleotide
  Target: ATXN1; (+) strand; PAM type: NRG; PAM sequence: GGG
tatcctgacccttgcctcct

SEQ ID NO: 117930 - DNA, 20 bp, Artificial Sequence
  Description of Artificial Sequence: Synthetic oligonucleotide
  Target: ATXN1; (+) strand; PAM type: NRG; PAM sequence: CAG
tcctgggtcctaacacctgt

SEQ ID NO: 117931 - DNA, 20 bp, Artificial Sequence
  Description of Artificial Sequence: Synthetic oligonucleotide
  Target: ATXN1; (+) strand; PAM type: NRG; PAM sequence: AAG
ttctcccgcctctcttctcc

SEQ ID NO: 117932 - DNA, 20 bp, Artificial Sequence
  Description of Artificial Sequence: Synthetic oligonucleotide
  Target: ATXN1; (+) strand; PAM type: NRG; PAM sequence: AGG
tctcccgcctctcttctcca

SEQ ID NO: 117933 - DNA, 20 bp, Artificial Sequence
  Description of Artificial Sequence: Synthetic oligonucleotide
  Target: ATXN1; (+) strand; PAM type: NRG; PAM sequence: TAG
ccgcctctcttctccaaggt

SEQ ID NO: 117934 - DNA, 20 bp, Artificial Sequence
  Description of Artificial Sequence: Synthetic oligonucleotide
  Target: ATXN1; (+) strand; PAM type: NRG; PAM sequence: TGG
taaaaaccactccctgtccc

SEQ ID NO: 117935 - DNA, 20 bp, Artificial Sequence
  Description of Artificial Sequence: Synthetic oligonucleotide
  Target: ATXN1; (+) strand; PAM type: NRG; PAM sequence: CAG
ccctgtccctggtgctcttc

SEQ ID NO: 117936 - DNA, 20 bp, Artificial Sequence
  Description of Artificial Sequence: Synthetic oligonucleotide
  Target: ATXN1; (+) strand; PAM type: NRG; PAM sequence: AAG
gctcttccagtttctcctat

SEQ ID NO: 117937 - DNA, 20 bp, Artificial Sequence
  Description of Artificial Sequence: Synthetic oligonucleotide
  Target: ATXN1; (+) strand; PAM type: NRG; PAM sequence: AGG
ctcttccagtttctcctata

SEQ ID NO: 117938 - DNA, 20 bp, Artificial Sequence
  Description of Artificial Sequence: Synthetic oligonucleotide
  Target: ATXN1; (+) strand; PAM type: NRG; PAM sequence: CAG
atgatttctaatataaattt

SEQ ID NO: 117939 - DNA, 20 bp, Artificial Sequence
  Description of Artificial Sequence: Synthetic oligonucleotide
  Target: ATXN1; (+) strand; PAM type: NRG; PAM sequence: AGG
tgatttctaatataaatttc

SEQ ID NO: 117940 - DNA, 20 bp, Artificial Sequence
  Description of Artificial Sequence: Synthetic oligonucleotide
  Target: ATXN1; (+) strand; PAM type: NRG; PAM sequence: TAG
caggactctgctcccttctt

SEQ ID NO: 117941 - DNA, 20 bp, Artificial Sequence
  Description of Artificial Sequence: Synthetic oligonucleotide
  Target: ATXN1; (+) strand; PAM type: NRG; PAM sequence: AGG
aggactctgctcccttcttt

SEQ ID NO: 117942 - DNA, 20 bp, Artificial Sequence
  Description of Artificial Sequence: Synthetic oligonucleotide
  Target: ATXN1; (+) strand; PAM type: NRG; PAM sequence: CAG
tgctcccttctttaggcacc

SEQ ID NO: 117943 - DNA, 20 bp, Artificial Sequence
  Description of Artificial Sequence: Synthetic oligonucleotide
  Target: ATXN1; (+) strand; PAM type: NRG; PAM sequence: AGG
gctcccttctttaggcaccc

SEQ ID NO: 117944 - DNA, 20 bp, Artificial Sequence
  Description of Artificial Sequence: Synthetic oligonucleotide
  Target: ATXN1; (+) strand; PAM type: NRG; PAM sequence: CAG
aggcacccaggctcaccaat

SEQ ID NO: 117945 - DNA, 20 bp, Artificial Sequence
  Description of Artificial Sequence: Synthetic oligonucleotide
  Target: ATXN1; (+) strand; PAM type: NRG; PAM sequence: AAG
acccaggctcaccaatcaga

SEQ ID NO: 117946 - DNA, 20 bp, Artificial Sequence
  Description of Artificial Sequence: Synthetic oligonucleotide
  Target: ATXN1; (+) strand; PAM type: NRG; PAM sequence: AAG
aaagacataatttttgtcca

SEQ ID NO: 117947 - DNA, 20 bp, Artificial Sequence
  Description of Artificial Sequence: Synthetic oligonucleotide
  Target: ATXN1; (+) strand; PAM type: NRG; PAM sequence: TGG
ttttgtccaaagccctgttg

SEQ ID NO: 117948 - DNA, 20 bp, Artificial Sequence
  Description of Artificial Sequence: Synthetic oligonucleotide
  Target: ATXN1; (+) strand; PAM type: NRG; PAM sequence: GGG
tttgtccaaagccctgttgt

SEQ ID NO: 117949 - DNA, 20 bp, Artificial Sequence
  Description of Artificial Sequence: Synthetic oligonucleotide
  Target: ATXN1; (+) strand; PAM type: NRG; PAM sequence: GGG
ttgtccaaagccctgttgtg

SEQ ID NO: 117950 - DNA, 20 bp, Artificial Sequence
  Description of Artificial Sequence: Synthetic oligonucleotide
  Target: ATXN1; (+) strand; PAM type: NRG; PAM sequence: GGG
tgtccaaagccctgttgtgg

SEQ ID NO: 117951 - DNA, 20 bp, Artificial Sequence
  Description of Artificial Sequence: Synthetic oligonucleotide
  Target: ATXN1; (+) strand; PAM type: NRG; PAM sequence: TGG
ccctgttgtgggggactatc

SEQ ID NO: 117952 - DNA, 20 bp, Artificial Sequence
  Description of Artificial Sequence: Synthetic oligonucleotide
  Target: ATXN1; (+) strand; PAM type: NRG; PAM sequence: TAG
tgggggactatctggaattt

SEQ ID NO: 117953 - DNA, 20 bp, Artificial Sequence
  Description of Artificial Sequence: Synthetic oligonucleotide
  Target: ATXN1; (+) strand; PAM type: NRG; PAM sequence: AGG
gggggactatctggaatttt

SEQ ID NO: 117954 - DNA, 20 bp, Artificial Sequence
  Description of Artificial Sequence: Synthetic oligonucleotide
  Target: ATXN1; (+) strand; PAM type: NRG; PAM sequence: CAG
ggaattttaggatccctcct

SEQ ID NO: 117955 - DNA, 20 bp, Artificial Sequence
  Description of Artificial Sequence: Synthetic oligonucleotide
  Target: ATXN1; (+) strand; PAM type: NRG; PAM sequence: TAG
tttaggatccctcctcagac

SEQ ID NO: 117956 - DNA, 20 bp, Artificial Sequence
  Description of Artificial Sequence: Synthetic oligonucleotide
  Target: ATXN1; (+) strand; PAM type: NRG; PAM sequence: CAG
aggatccctcctcagactag

SEQ ID NO: 117957 - DNA, 20 bp, Artificial Sequence
  Description of Artificial Sequence: Synthetic oligonucleotide
  Target: ATXN1; (+) strand; PAM type: NRG; PAM sequence: AAG
tcagactagcagacctaaca

SEQ ID NO: 117958 - DNA, 20 bp, Artificial Sequence
  Description of Artificial Sequence: Synthetic oligonucleotide
  Target: ATXN1; (+) strand; PAM type: NRG; PAM sequence: AGG
cagactagcagacctaacaa

SEQ ID NO: 117959 - DNA, 20 bp, Artificial Sequence
  Description of Artificial Sequence: Synthetic oligonucleotide
  Target: ATXN1; (+) strand; PAM type: NRG; PAM sequence: AAG
cctaacaaaggctattccca

SEQ ID NO: 117960 - DNA, 20 bp, Artificial Sequence
  Description of Artificial Sequence: Synthetic oligonucleotide
  Target: ATXN1; (+) strand; PAM type: NRG; PAM sequence: TAG
acaaaggctattcccaaagc

SEQ ID NO: 117961 - DNA, 20 bp, Artificial Sequence
  Description of Artificial Sequence: Synthetic oligonucleotide
  Target: ATXN1; (+) strand; PAM type: NRG; PAM sequence: AGG
caaaggctattcccaaagct

SEQ ID NO: 117962 - DNA, 20 bp, Artificial Sequence
  Description of Artificial Sequence: Synthetic oligonucleotide
  Target: ATXN1; (+) strand; PAM type: NRG; PAM sequence: TAG
ggctattcccaaagctagga

SEQ ID NO: 117963 - DNA, 20 bp, Artificial Sequence
  Description of Artificial Sequence: Synthetic oligonucleotide
  Target: ATXN1; (+) strand; PAM type: NRG; PAM sequence: AGG
gctattcccaaagctaggat

SEQ ID NO: 117964 - DNA, 20 bp, Artificial Sequence
  Description of Artificial Sequence: Synthetic oligonucleotide
  Target: ATXN1; (+) strand; PAM type: NRG; PAM sequence: GAG
tattcccaaagctaggatag

SEQ ID NO: 117965 - DNA, 20 bp, Artificial Sequence
  Description of Artificial Sequence: Synthetic oligonucleotide
  Target: ATXN1; (+) strand; PAM type: NRG; PAM sequence: AGG
attcccaaagctaggatagg

SEQ ID NO: 117966 - DNA, 20 bp, Artificial Sequence
  Description of Artificial Sequence: Synthetic oligonucleotide
  Target: ATXN1; (+) strand; PAM type: NRG; PAM sequence: GAG
tcccaaagctaggataggag

SEQ ID NO: 117967 - DNA, 20 bp, Artificial Sequence
  Description of Artificial Sequence: Synthetic oligonucleotide
  Target: ATXN1; (+) strand; PAM type: NRG; PAM sequence: CAG
agctaggataggaggagact

SEQ ID NO: 117968 - DNA, 20 bp, Artificial Sequence
  Description of Artificial Sequence: Synthetic oligonucleotide
  Target: ATXN1; (+) strand; PAM type: NRG; PAM sequence: AAG
atccttcctattcatatgat

SEQ ID NO: 117969 - DNA, 20 bp, Artificial Sequence
  Description of Artificial Sequence: Synthetic oligonucleotide
  Target: ATXN1; (+) strand; PAM type: NRG; PAM sequence: GAG
ttcctattcatatgataagt

SEQ ID NO: 117970 - DNA, 20 bp, Artificial Sequence
  Description of Artificial Sequence: Synthetic oligonucleotide
  Target: ATXN1; (+) strand; PAM type: NRG; PAM sequence: AGG
tcctattcatatgataagtg

SEQ ID NO: 117971 - DNA, 20 bp, Artificial Sequence
  Description of Artificial Sequence: Synthetic oligonucleotide
  Target: ATXN1; (+) strand; PAM type: NRG; PAM sequence: TGG
acgcatcactcttccaaccc

SEQ ID NO: 117972 - DNA, 20 bp, Artificial Sequence
  Description of Artificial Sequence: Synthetic oligonucleotide
  Target: ATXN1; (+) strand; PAM type: NRG; PAM sequence: GAG
gcatcactcttccaaccctg

SEQ ID NO: 117973 - DNA, 20 bp, Artificial Sequence
  Description of Artificial Sequence: Synthetic oligonucleotide
  Target: ATXN1; (+) strand; PAM type: NRG; PAM sequence: CAG
tggagatcccttccttccct

SEQ ID NO: 117974 - DNA, 20 bp, Artificial Sequence
  Description of Artificial Sequence: Synthetic oligonucleotide
  Target: ATXN1; (+) strand; PAM type: NRG; PAM sequence: AGG
ggagatcccttccttccctc

SEQ ID NO: 117975 - DNA, 20 bp, Artificial Sequence
  Description of Artificial Sequence: Synthetic oligonucleotide
  Target: ATXN1; (+) strand; PAM type: NRG; PAM sequence: GGG
gagatcccttccttccctca

SEQ ID NO: 117976 - DNA, 20 bp, Artificial Sequence
  Description of Artificial Sequence: Synthetic oligonucleotide
  Target: ATXN1; (+) strand; PAM type: NRG; PAM sequence: TGG
cccttccttccctcagggta

SEQ ID NO: 117977 - DNA, 20 bp, Artificial Sequence
  Description of Artificial Sequence: Synthetic oligonucleotide
  Target: ATXN1; (+) strand; PAM type: NRG; PAM sequence: GAG
atggccctccactccatttt

SEQ ID NO: 117978 - DNA, 20 bp, Artificial Sequence
  Description of Artificial Sequence: Synthetic oligonucleotide
  Target: ATXN1; (+) strand; PAM type: NRG; PAM sequence: AGG
tggccctccactccattttg

SEQ ID NO: 117979 - DNA, 20 bp, Artificial Sequence
  Description of Artificial Sequence: Synthetic oligonucleotide
  Target: ATXN1; (+) strand; PAM type: NRG; PAM sequence: TAG
tttgaggcatattatcttta

SEQ ID NO: 117980 - DNA, 20 bp, Artificial Sequence
  Description of Artificial Sequence: Synthetic oligonucleotide
  Target: ATXN1; (+) strand; PAM type: NRG; PAM sequence: AAG
gcatattatctttatagtac

SEQ ID NO: 117981 - DNA, 20 bp, Artificial Sequence
  Description of Artificial Sequence: Synthetic oligonucleotide
  Target: ATXN1; (+) strand; PAM type: NRG; PAM sequence: AGG
catattatctttatagtaca

SEQ ID NO: 117982 - DNA, 20 bp, Artificial Sequence
  Description of Artificial Sequence: Synthetic oligonucleotide
  Target: ATXN1; (+) strand; PAM type: NRG; PAM sequence: GGG
atattatctttatagtacaa

SEQ ID NO: 117983 - DNA, 20 bp, Artificial Sequence
  Description of Artificial Sequence: Synthetic oligonucleotide
  Target: ATXN1; (+) strand; PAM type: NRG; PAM sequence: AAG
tatctttatagtacaagggt

SEQ ID NO: 117984 - DNA, 20 bp, Artificial Sequence
  Description of Artificial Sequence: Synthetic oligonucleotide
  Target: ATXN1; (+) strand; PAM type: NRG; PAM sequence: AGG
atctttatagtacaagggta

SEQ ID NO: 117985 - DNA, 20 bp, Artificial Sequence
  Description of Artificial Sequence: Synthetic oligonucleotide
  Target: ATXN1; (+) strand; PAM type: NRG; PAM sequence: CAG
gggtaaggtcctaataacaa

SEQ ID NO: 117986 - DNA, 20 bp, Artificial Sequence
  Description of Artificial Sequence: Synthetic oligonucleotide
  Target: ATXN1; (+) strand; PAM type: NRG; PAM sequence: AGG
ggtaaggtcctaataacaac

SEQ ID NO: 117987 - DNA, 20 bp, Artificial Sequence
  Description of Artificial Sequence: Synthetic oligonucleotide
  Target: ATXN1; (+) strand; PAM type: NRG; PAM sequence: GAG
taaggtcctaataacaacag

SEQ ID NO: 117988 - DNA, 20 bp, Artificial Sequence
  Description of Artificial Sequence: Synthetic oligonucleotide
  Target: ATXN1; (+) strand; PAM type: NRG; PAM sequence: TAG
taacaacaggagaaaacact

SEQ ID NO: 117989 - DNA, 20 bp, Artificial Sequence
  Description of Artificial Sequence: Synthetic oligonucleotide
  Target: ATXN1; (+) strand; PAM type: NRG; PAM sequence: AGG
aacaacaggagaaaacactt

SEQ ID NO: 117990 - DNA, 20 bp, Artificial Sequence
  Description of Artificial Sequence: Synthetic oligonucleotide
  Target: ATXN1; (+) strand; PAM type: NRG; PAM sequence: CAG
gaaaacacttaggactctaa

SEQ ID NO: 117991 - DNA, 20 bp, Artificial Sequence
  Description of Artificial Sequence: Synthetic oligonucleotide
  Target: ATXN1; (+) strand; PAM type: NRG; PAM sequence: AGG
aaaacacttaggactctaac

SEQ ID NO: 117992 - DNA, 20 bp, Artificial Sequence
  Description of Artificial Sequence: Synthetic oligonucleotide
  Target: ATXN1; (+) strand; PAM type: NRG; PAM sequence: AAG
taggactctaacaggttttc

SEQ ID NO: 117993 - DNA, 20 bp, Artificial Sequence
  Description of Artificial Sequence: Synthetic oligonucleotide
  Target: ATXN1; (+) strand; PAM type: NRG; PAM sequence: TGG
acaggttttcaagaatgcat

SEQ ID NO: 117994 - DNA, 20 bp, Artificial Sequence
  Description of Artificial Sequence: Synthetic oligonucleotide
  Target: ATXN1; (+) strand; PAM type: NRG; PAM sequence: AAG
gttttcaagaatgcattggt

SEQ ID NO: 117995 - DNA, 20 bp, Artificial Sequence
  Description of Artificial Sequence: Synthetic oligonucleotide
  Target: ATXN1; (+) strand; PAM type: NRG; PAM sequence: AGG
ttttcaagaatgcattggta

SEQ ID NO: 117996 - DNA, 20 bp, Artificial Sequence
  Description of Artificial Sequence: Synthetic oligonucleotide
  Target: ATXN1; (+) strand; PAM type: NRG; PAM sequence: GGG
tttcaagaatgcattggtaa

SEQ ID NO: 117997 - DNA, 20 bp, Artificial Sequence
  Description of Artificial Sequence: Synthetic oligonucleotide
  Target: ATXN1; (+) strand; PAM type: NRG; PAM sequence: CAG
ccactaaatctgacttttct

SEQ ID NO: 117998 - DNA, 20 bp, Artificial Sequence
  Description of Artificial Sequence: Synthetic oligonucleotide
  Target: ATXN1; (+) strand; PAM type: NRG; PAM sequence: TGG
acttttctcagtcctctttg

SEQ ID NO: 117999 - DNA, 20 bp, Artificial Sequence
  Description of Artificial Sequence: Synthetic oligonucleotide
  Target: ATXN1; (+) strand; PAM type: NRG; PAM sequence: AAG
tcagtcctctttgtggtcta

SEQ ID NO: 118000 - DNA, 20 bp, Artificial Sequence
  Description of Artificial Sequence: Synthetic oligonucleotide
  Target: ATXN1; (+) strand; PAM type: NRG; PAM sequence: AAG
tctttgtggtctaaagacga

SEQ ID NO: 118001 - DNA, 20 bp, Artificial Sequence
  Description of Artificial Sequence: Synthetic oligonucleotide
  Target: ATXN1; (+) strand; PAM type: NRG; PAM sequence: AGG
ctttgtggtctaaagacgaa

SEQ ID NO: 118002 - DNA, 20 bp, Artificial Sequence
  Description of Artificial Sequence: Synthetic oligonucleotide
  Target: ATXN1; (+) strand; PAM type: NRG; PAM sequence: AAG
gtggtctaaagacgaaaggc

SEQ ID NO: 118003 - DNA, 20 bp, Artificial Sequence
  Description of Artificial Sequence: Synthetic oligonucleotide
  Target: ATXN1; (+) strand; PAM type: NRG; PAM sequence: AGG
tggtctaaagacgaaaggca

SEQ ID NO: 118004 - DNA, 20 bp, Artificial Sequence
  Description of Artificial Sequence: Synthetic oligonucleotide
  Target: ATXN1; (+) strand; PAM type: NRG; PAM sequence: GGG
ggtctaaagacgaaaggcaa

SEQ ID NO: 118005 - DNA, 20 bp, Artificial Sequence
  Description of Artificial Sequence: Synthetic oligonucleotide
  Target: ATXN1; (+) strand; PAM type: NRG; PAM sequence: CAG
aaagacgaaaggcaagggtg

SEQ ID NO: 118006 - DNA, 20 bp, Artificial Sequence
  Description of Artificial Sequence: Synthetic oligonucleotide
  Target: ATXN1; (+) strand; PAM type: NRG; PAM sequence: AGG
aagacgaaaggcaagggtgc

SEQ ID NO: 118007 - DNA, 20 bp, Artificial Sequence
  Description of Artificial Sequence: Synthetic oligonucleotide
  Target: ATXN1; (+) strand; PAM type: NRG; PAM sequence: GAG
aggcaagggtgcaggttttt

SEQ ID NO: 118008 - DNA, 20 bp, Artificial Sequence
  Description of Artificial Sequence: Synthetic oligonucleotide
  Target: ATXN1; (+) strand; PAM type: NRG; PAM sequence: TGG
gcaggtttttgagaatccat

SEQ ID NO: 118009 - DNA, 20 bp, Artificial Sequence
  Description of Artificial Sequence: Synthetic oligonucleotide
  Target: ATXN1; (+) strand; PAM type: NRG; PAM sequence: AAG
gtttttgagaatccattggt

SEQ ID NO: 118010 - DNA, 20 bp, Artificial Sequence
  Description of Artificial Sequence: Synthetic oligonucleotide
  Target: ATXN1; (+) strand; PAM type: NRG; PAM sequence: AGG
tttttgagaatccattggta

SEQ ID NO: 118011 - DNA, 20 bp, Artificial Sequence
  Description of Artificial Sequence: Synthetic oligonucleotide
  Target: ATXN1; (+) strand; PAM type: NRG; PAM sequence: GGG
ttttgagaatccattggtaa

SEQ ID NO: 118012 - DNA, 20 bp, Artificial Sequence
  Description of Artificial Sequence: Synthetic oligonucleotide
  Target: ATXN1; (+) strand; PAM type: NRG; PAM sequence: CAG
ccactaaatctgaccttcct

SEQ ID NO: 118013 - DNA, 20 bp, Artificial Sequence
  Description of Artificial Sequence: Synthetic oligonucleotide
  Target: ATXN1; (+) strand; PAM type: NRG; PAM sequence: TGG
accttcctcagtcctttttg

SEQ ID NO: 118014 - DNA, 20 bp, Artificial Sequence
  Description of Artificial Sequence: Synthetic oligonucleotide
  Target: ATXN1; (+) strand; PAM type: NRG; PAM sequence: TAG
cctcagtcctttttgtggtc

SEQ ID NO: 118015 - DNA, 20 bp, Artificial Sequence
  Description of Artificial Sequence: Synthetic oligonucleotide
  Target: ATXN1; (+) strand; PAM type: NRG; PAM sequence: AGG
ctcagtcctttttgtggtct

SEQ ID NO: 118016 - DNA, 20 bp, Artificial Sequence
  Description of Artificial Sequence: Synthetic oligonucleotide
  Target: ATXN1; (+) strand; PAM type: NRG; PAM sequence: GAG
cagtcctttttgtggtctag

SEQ ID NO: 118017 - DNA, 20 bp, Artificial Sequence
  Description of Artificial Sequence: Synthetic oligonucleotide
  Target: ATXN1; (+) strand; PAM type: NRG; PAM sequence: AGG
agtcctttttgtggtctagg

SEQ ID NO: 118018 - DNA, 20 bp, Artificial Sequence
  Description of Artificial Sequence: Synthetic oligonucleotide
  Target: ATXN1; (+) strand; PAM type: NRG; PAM sequence: TAG
ttgtggtctaggaggaaaac

SEQ ID NO: 118019 - DNA, 20 bp, Artificial Sequence
  Description of Artificial Sequence: Synthetic oligonucleotide
  Target: ATXN1; (+) strand; PAM type: NRG; PAM sequence: TGG
tagtgtttccgctgctgctt

SEQ ID NO: 118020 - DNA, 20 bp, Artificial Sequence
  Description of Artificial Sequence: Synthetic oligonucleotide
  Target: ATXN1; (+) strand; PAM type: NRG; PAM sequence: GAG
gtttccgctgctgctttggt

SEQ ID NO: 118021 - DNA, 20 bp, Artificial Sequence
  Description of Artificial Sequence: Synthetic oligonucleotide
  Target: ATXN1; (+) strand; PAM type: NRG; PAM sequence: CAG
cgctgctgctttggtgagca

SEQ ID NO: 118022 - DNA, 20 bp, Artificial Sequence
  Description of Artificial Sequence: Synthetic oligonucleotide
  Target: ATXN1; (+) strand; PAM type: NRG; PAM sequence: CAG
gtgagcacagctattccgaa

SEQ ID NO: 118023 - DNA, 20 bp, Artificial Sequence
  Description of Artificial Sequence: Synthetic oligonucleotide
  Target: ATXN1; (+) strand; PAM type: NRG; PAM sequence: CAG
agcacagctattccgaacag

SEQ ID NO: 118024 - DNA, 20 bp, Artificial Sequence
  Description of Artificial Sequence: Synthetic oligonucleotide
  Target: ATXN1; (+) strand; PAM type: NRG; PAM sequence: AGG
gcacagctattccgaacagc

SEQ ID NO: 118025 - DNA, 20 bp, Artificial Sequence
  Description of Artificial Sequence: Synthetic oligonucleotide
  Target: ATXN1; (+) strand; PAM type: NRG; PAM sequence: CAG
ctattccgaacagcaggatc

SEQ ID NO: 118026 - DNA, 20 bp, Artificial Sequence
  Description of Artificial Sequence: Synthetic oligonucleotide
  Target: ATXN1; (+) strand; PAM type: NRG; PAM sequence: AGG
tattccgaacagcaggatcc

SEQ ID NO: 118027 - DNA, 20 bp, Artificial Sequence
  Description of Artificial Sequence: Synthetic oligonucleotide
  Target: ATXN1; (+) strand; PAM type: NRG; PAM sequence: GGG
attccgaacagcaggatcca

SEQ ID NO: 118028 - DNA, 20 bp, Artificial Sequence
  Description of Artificial Sequence: Synthetic oligonucleotide
  Target: ATXN1; (+) strand; PAM type: NRG; PAM sequence: TGG
gcaggatccagggactgttg

SEQ ID NO: 118029 - DNA, 20 bp, Artificial Sequence
  Description of Artificial Sequence: Synthetic oligonucleotide
  Target: ATXN1; (+) strand; PAM type: NRG; PAM sequence: GGG
caggatccagggactgttgt

SEQ ID NO: 118030 - DNA, 20 bp, Artificial Sequence
  Description of Artificial Sequence: Synthetic oligonucleotide
  Target: ATXN1; (+) strand; PAM type: NRG; PAM sequence: TGG
cagggactgttgtgggttct

SEQ ID NO: 118031 - DNA, 20 bp, Artificial Sequence
  Description of Artificial Sequence: Synthetic oligonucleotide
  Target: ATXN1; (+) strand; PAM type: NRG; PAM sequence: GGG
agggactgttgtgggttctt

SEQ ID NO: 118032 - DNA, 20 bp, Artificial Sequence
  Description of Artificial Sequence: Synthetic oligonucleotide
  Target: ATXN1; (+) strand; PAM type: NRG; PAM sequence: CAG
gactgttgtgggttcttggg

SEQ ID NO: 118033 - DNA, 20 bp, Artificial Sequence
  Description of Artificial Sequence: Synthetic oligonucleotide
  Target: ATXN1; (+) strand; PAM type: NRG; PAM sequence: AGG
actgttgtgggttcttgggc

SEQ ID NO: 118034 - DNA, 20 bp, Artificial Sequence
  Description of Artificial Sequence: Synthetic oligonucleotide
  Target: ATXN1; (+) strand; PAM type: NRG; PAM sequence: GGG
ctgttgtgggttcttgggca

SEQ ID NO: 118035 - DNA, 20 bp, Artificial Sequence
  Description of Artificial Sequence: Synthetic oligonucleotide
  Target: ATXN1; (+) strand; PAM type: NRG; PAM sequence: GAG
gttgtgggttcttgggcagg

SEQ ID NO: 118036 - DNA, 20 bp, Artificial Sequence
  Description of Artificial Sequence: Synthetic oligonucleotide
  Target: ATXN1; (+) strand; PAM type: NRG; PAM sequence: AAG
gtgggttcttgggcagggag

SEQ ID NO: 118037 - DNA, 20 bp, Artificial Sequence
  Description of Artificial Sequence: Synthetic oligonucleotide
  Target: ATXN1; (+) strand; PAM type: NRG; PAM sequence: GAG
gggttcttgggcagggagaa

SEQ ID NO: 118038 - DNA, 20 bp, Artificial Sequence
  Description of Artificial Sequence: Synthetic oligonucleotide
  Target: ATXN1; (+) strand; PAM type: NRG; PAM sequence: CAG
gagaaaaaaaaaaaaaactg

SEQ ID NO: 118039 - DNA, 20 bp, Artificial Sequence
  Description of Artificial Sequence: Synthetic oligonucleotide
  Target: ATXN1; (+) strand; PAM type: NRG; PAM sequence: AGG
agaaaaaaaaaaaaaactgc

SEQ ID NO: 118040 - DNA, 20 bp, Artificial Sequence
  Description of Artificial Sequence: Synthetic oligonucleotide
  Target: ATXN1; (+) strand; PAM type: NRG; PAM sequence: CGG
aaaaaaaaaaaaactgcagg

SEQ ID NO: 118041 - DNA, 20 bp, Artificial Sequence
  Description of Artificial Sequence: Synthetic oligonucleotide
  Target: ATXN1; (+) strand; PAM type: NRG; PAM sequence: CAG
ctgcaggcggttttttcttt

SEQ ID NO: 118042 - DNA, 20 bp, Artificial Sequence
  Description of Artificial Sequence: Synthetic oligonucleotide
  Target: ATXN1; (+) strand; PAM type: NRG; PAM sequence: TGG
aggcggttttttctttcaga

SEQ ID NO: 118043 - DNA, 20 bp, Artificial Sequence
  Description of Artificial Sequence: Synthetic oligonucleotide
  Target: ATXN1; (+) strand; PAM type: NRG; PAM sequence: GGG
ggcggttttttctttcagat

SEQ ID NO: 118044 - DNA, 20 bp, Artificial Sequence
  Description of Artificial Sequence: Synthetic oligonucleotide
  Target: ATXN1; (+) strand; PAM type: NRG; PAM sequence: CAG
tctttcagatgggaaacacc

SEQ ID NO: 118045 - DNA, 20 bp, Artificial Sequence
  Description of Artificial Sequence: Synthetic oligonucleotide
  Target: ATXN1; (+) strand; PAM type: NRG; PAM sequence: AGG
ctttcagatgggaaacaccc

SEQ ID NO: 118046 - DNA, 20 bp, Artificial Sequence
  Description of Artificial Sequence: Synthetic oligonucleotide
  Target: ATXN1; (+) strand; PAM type: NRG; PAM sequence: AAG
ggaaacacccaggcatcaac

SEQ ID NO: 118047 - DNA, 20 bp, Artificial Sequence
  Description of Artificial Sequence: Synthetic oligonucleotide
  Target: ATXN1; (+) strand; PAM type: NRG; PAM sequence: AAG
tcacccttgaaacgcatcct

SEQ ID NO: 118048 - DNA, 20 bp, Artificial Sequence
  Description of Artificial Sequence: Synthetic oligonucleotide
  Target: ATXN1; (+) strand; PAM type: NRG; PAM sequence: TGG
tgaaacgcatcctaagccat

SEQ ID NO: 118049 - DNA, 20 bp, Artificial Sequence
  Description of Artificial Sequence: Synthetic oligonucleotide
  Target: ATXN1; (+) strand; PAM type: NRG; PAM sequence: GGG
gaaacgcatcctaagccatt

SEQ ID NO: 118050 - DNA, 20 bp, Artificial Sequence
  Description of Artificial Sequence: Synthetic oligonucleotide
  Target: ATXN1; (+) strand; PAM type: NRG; PAM sequence: AAG
ttgtcccgcaaaccctgaaa

SEQ ID NO: 118051 - DNA, 20 bp, Artificial Sequence
  Description of Artificial Sequence: Synthetic oligonucleotide
  Target: ATXN1; (+) strand; PAM type: NRG; PAM sequence: AAG
tcccgcaaaccctgaaaaag

SEQ ID NO: 118052 - DNA, 20 bp, Artificial Sequence
  Description of Artificial Sequence: Synthetic oligonucleotide
  Target: ATXN1; (+) strand; PAM type: NRG; PAM sequence: CGG
cgcaaaccctgaaaaagaag

SEQ ID NO: 118053 - DNA, 20 bp, Artificial Sequence
  Description of Artificial Sequence: Synthetic oligonucleotide
  Target: ATXN1; (+) strand; PAM type: NRG; PAM sequence: CGG
ggcttattttttctgcacta

SEQ ID NO: 118054 - DNA, 20 bp, Artificial Sequence
  Description of Artificial Sequence: Synthetic oligonucleotide
  Target: ATXN1; (+) strand; PAM type: NRG; PAM sequence: TGG
attttttctgcactacggtc

SEQ ID NO: 118055 - DNA, 20 bp, Artificial Sequence
  Description of Artificial Sequence: Synthetic oligonucleotide
  Target: ATXN1; (+) strand; PAM type: NRG; PAM sequence: TAG
ccttaatattatctctctaa

SEQ ID NO: 118056 - DNA, 20 bp, Artificial Sequence
  Description of Artificial Sequence: Synthetic oligonucleotide
  Target: ATXN1; (+) strand; PAM type: NRG; PAM sequence: AGG
cttaatattatctctctaat

SEQ ID NO: 118057 - DNA, 20 bp, Artificial Sequence
  Description of Artificial Sequence: Synthetic oligonucleotide
  Target: ATXN1; (+) strand; PAM type: NRG; PAM sequence: GGG
ttaatattatctctctaata

SEQ ID NO: 118058 - DNA, 20 bp, Artificial Sequence
  Description of Artificial Sequence: Synthetic oligonucleotide
  Target: ATXN1; (+) strand; PAM type: NRG; PAM sequence: TGG
atctctctaatagggaaaaa

SEQ ID NO: 118059 - DNA, 20 bp, Artificial Sequence
  Description of Artificial Sequence: Synthetic oligonucleotide
  Target: ATXN1; (+) strand; PAM type: NRG; PAM sequence: GAG
atagggaaaaatggtcacct

SEQ ID NO: 118060 - DNA, 20 bp, Artificial Sequence
  Description of Artificial Sequence: Synthetic oligonucleotide
  Target: ATXN1; (+) strand; PAM type: NRG; PAM sequence: AGG
tagggaaaaatggtcacctg

SEQ ID NO: 118061 - DNA, 20 bp, Artificial Sequence
  Description of Artificial Sequence: Synthetic oligonucleotide
  Target: ATXN1; (+) strand; PAM type: NRG; PAM sequence: GGG
agggaaaaatggtcacctga

SEQ ID NO: 118062 - DNA, 20 bp, Artificial Sequence
  Description of Artificial Sequence: Synthetic oligonucleotide
  Target: ATXN1; (+) strand; PAM type: NRG; PAM sequence: AAG
gaaaaatggtcacctgaggg

SEQ ID NO: 118063 - DNA, 20 bp, Artificial Sequence
  Description of Artificial Sequence: Synthetic oligonucleotide
  Target: ATXN1; (+) strand; PAM type: NRG; PAM sequence: CAG
taaattacaacactattctg

SEQ ID NO: 118064 - DNA, 20 bp, Artificial Sequence
  Description of Artificial Sequence: Synthetic oligonucleotide
  Target: ATXN1; (+) strand; PAM type: NRG; PAM sequence: AGG
aaattacaacactattctgc

SEQ ID NO: 118065 - DNA, 20 bp, Artificial Sequence
  Description of Artificial Sequence: Synthetic oligonucleotide
  Target: ATXN1; (+) strand; PAM type: NRG; PAM sequence: AAG
tgcaggttgaccttttctgt

SEQ ID NO: 118066 - DNA, 20 bp, Artificial Sequence
  Description of Artificial Sequence: Synthetic oligonucleotide
  Target: ATXN1; (+) strand; PAM type: NRG; PAM sequence: GAG
caggttgaccttttctgtaa

SEQ ID NO: 118067 - DNA, 20 bp, Artificial Sequence
  Description of Artificial Sequence: Synthetic oligonucleotide
  Target: ATXN1; (+) strand; PAM type: NRG; PAM sequence: AGG
aggttgaccttttctgtaag

SEQ ID NO: 118068 - DNA, 20 bp, Artificial Sequence
  Description of Artificial Sequence: Synthetic oligonucleotide
  Target: ATXN1; (+) strand; PAM type: NRG; PAM sequence: GGG
ggttgaccttttctgtaaga

SEQ ID NO: 118069 - DNA, 20 bp, Artificial Sequence
  Description of Artificial Sequence: Synthetic oligonucleotide
  Target: ATXN1; (+) strand; PAM type: NRG; PAM sequence: AAG
tgaccttttctgtaagaggg

SEQ ID NO: 118070 - DNA, 20 bp, Artificial Sequence
  Description of Artificial Sequence: Synthetic oligonucleotide
  Target: ATXN1; (+) strand; PAM type: NRG; PAM sequence: AGG
gaccttttctgtaagaggga

SEQ ID NO: 118071 - DNA, 20 bp, Artificial Sequence
  Description of Artificial Sequence: Synthetic oligonucleotide
  Target: ATXN1; (+) strand; PAM type: NRG; PAM sequence: GGG
accttttctgtaagagggaa

SEQ ID NO: 118072 - DNA, 20 bp, Artificial Sequence
  Description of Artificial Sequence: Synthetic oligonucleotide
  Target: ATXN1; (+) strand; PAM type: NRG; PAM sequence: TGG
tctgtaagagggaagggaaa

SEQ ID NO: 118073 - DNA, 20 bp, Artificial Sequence
  Description of Artificial Sequence: Synthetic oligonucleotide
  Target: ATXN1; (+) strand; PAM type: NRG; PAM sequence: GAG
tgtaagagggaagggaaatg

SEQ ID NO: 118074 - DNA, 20 bp, Artificial Sequence
  Description of Artificial Sequence: Synthetic oligonucleotide
  Target: ATXN1; (+) strand; PAM type: NRG; PAM sequence: AAG
gagtgaaataccttatgtcc

SEQ ID NO: 118075 - DNA, 20 bp, Artificial Sequence
  Description of Artificial Sequence: Synthetic oligonucleotide
  Target: ATXN1; (+) strand; PAM type: NRG; PAM sequence: AAG
tccaagctttctttttactg

SEQ ID NO: 118076 - DNA, 20 bp, Artificial Sequence
  Description of Artificial Sequence: Synthetic oligonucleotide
  Target: ATXN1; (+) strand; PAM type: NRG; PAM sequence: AGG
ccaagctttctttttactga

SEQ ID NO: 118077 - DNA, 20 bp, Artificial Sequence
  Description of Artificial Sequence: Synthetic oligonucleotide
  Target: ATXN1; (+) strand; PAM type: NRG; PAM sequence: AAG
ggataatccacaactatgca

SEQ ID NO: 118078 - DNA, 20 bp, Artificial Sequence
  Description of Artificial Sequence: Synthetic oligonucleotide
  Target: ATXN1; (+) strand; PAM type: NRG; PAM sequence: TGG
aatccacaactatgcaaagc

SEQ ID NO: 118079 - DNA, 20 bp, Artificial Sequence
  Description of Artificial Sequence: Synthetic oligonucleotide
  Target: ATXN1; (+) strand; PAM type: NRG; PAM sequence: CAG
agctggcgatttacattcca

SEQ ID NO: 118080 - DNA, 20 bp, Artificial Sequence
  Description of Artificial Sequence: Synthetic oligonucleotide
  Target: ATXN1; (+) strand; PAM type: NRG; PAM sequence: AGG
gctggcgatttacattccac

SEQ ID NO: 118081 - DNA, 20 bp, Artificial Sequence
  Description of Artificial Sequence: Synthetic oligonucleotide
  Target: ATXN1; (+) strand; PAM type: NRG; PAM sequence: GAG
tggcgatttacattccacag

SEQ ID NO: 118082 - DNA, 20 bp, Artificial Sequence
  Description of Artificial Sequence: Synthetic oligonucleotide
  Target: ATXN1; (+) strand; PAM type: NRG; PAM sequence: AGG
ggcgatttacattccacagg

SEQ ID NO: 118083 - DNA, 20 bp, Artificial Sequence
  Description of Artificial Sequence: Synthetic oligonucleotide
  Target: ATXN1; (+) strand; PAM type: NRG; PAM sequence: CAG
cattccacaggaggacctct

SEQ ID NO: 118084 - DNA, 20 bp, Artificial Sequence
  Description of Artificial Sequence: Synthetic oligonucleotide
  Target: ATXN1; (+) strand; PAM type: NRG; PAM sequence: TAG
ctcagattacctccatatcc

SEQ ID NO: 118085 - DNA, 20 bp, Artificial Sequence
  Description of Artificial Sequence: Synthetic oligonucleotide
  Target: ATXN1; (+) strand; PAM type: NRG; PAM sequence: CAG
tccatatcctagcctcccta

SEQ ID NO: 118086 - DNA, 20 bp, Artificial Sequence
  Description of Artificial Sequence: Synthetic oligonucleotide
  Target: ATXN1; (+) strand; PAM type: NRG; PAM sequence: GAG
ctccccttcctattaatgat

SEQ ID NO: 118087 - DNA, 20 bp, Artificial Sequence
  Description of Artificial Sequence: Synthetic oligonucleotide
  Target: ATXN1; (+) strand; PAM type: NRG; PAM sequence: CAG
ctcctctaatctcctccatc

SEQ ID NO: 118088 - DNA, 20 bp, Artificial Sequence
  Description of Artificial Sequence: Synthetic oligonucleotide
  Target: ATXN1; (+) strand; PAM type: NRG; PAM sequence: AAG
ctctaatctcctccatccag

SEQ ID NO: 118089 - DNA, 20 bp, Artificial Sequence
  Description of Artificial Sequence: Synthetic oligonucleotide
  Target: ATXN1; (+) strand; PAM type: NRG; PAM sequence: AGG
tctaatctcctccatccaga

SEQ ID NO: 118090 - DNA, 20 bp, Artificial Sequence
  Description of Artificial Sequence: Synthetic oligonucleotide
  Target: ATXN1; (+) strand; PAM type: NRG; PAM sequence: AAG
tcctccatccagaaggaaac

SEQ ID NO: 118091 - DNA, 20 bp, Artificial Sequence
  Description of Artificial Sequence: Synthetic oligonucleotide
  Target: ATXN1; (+) strand; PAM type: NRG; PAM sequence: AAG
catccagaaggaaacaagca

SEQ ID NO: 118092 - DNA, 20 bp, Artificial Sequence
  Description of Artificial Sequence: Synthetic oligonucleotide
  Target: ATXN1; (+) strand; PAM type: NRG; PAM sequence: AAG
aacaagcaaagaaatttcca

SEQ ID NO: 118093 - DNA, 20 bp, Artificial Sequence
  Description of Artificial Sequence: Synthetic oligonucleotide
  Target: ATXN1; (+) strand; PAM type: NRG; PAM sequence: AGG
acaagcaaagaaatttccaa

SEQ ID NO: 118094 - DNA, 20 bp, Artificial Sequence
  Description of Artificial Sequence: Synthetic oligonucleotide
  Target: ATXN1; (+) strand; PAM type: NRG; PAM sequence: CAG
caaaggaccaccaaacccct

SEQ ID NO: 118095 - DNA, 20 bp, Artificial Sequence
  Description of Artificial Sequence: Synthetic oligonucleotide
  Target: ATXN1; (+) strand; PAM type: NRG; PAM sequence: AGG
aaaggaccaccaaacccctc

SEQ ID NO: 118096 - DNA, 20 bp, Artificial Sequence
  Description of Artificial Sequence: Synthetic oligonucleotide
  Target: ATXN1; (+) strand; PAM type: NRG; PAM sequence: CAG
caccaaacccctcaggctat

SEQ ID NO: 118097 - DNA, 20 bp, Artificial Sequence
  Description of Artificial Sequence: Synthetic oligonucleotide
  Target: ATXN1; (+) strand; PAM type: NRG; PAM sequence: AAG
ctatcagttatgtctccttt

SEQ ID NO: 118098 - DNA, 20 bp, Artificial Sequence
  Description of Artificial Sequence: Synthetic oligonucleotide
  Target: ATXN1; (+) strand; PAM type: NRG; PAM sequence: TAG
gttatgtctcctttaagctg

SEQ ID NO: 118099 - DNA, 20 bp, Artificial Sequence
  Description of Artificial Sequence: Synthetic oligonucleotide
  Target: ATXN1; (+) strand; PAM type: NRG; PAM sequence: AGG
ttatgtctcctttaagctgt

SEQ ID NO: 118100 - DNA, 20 bp, Artificial Sequence
  Description of Artificial Sequence: Synthetic oligonucleotide
  Target: ATXN1; (+) strand; PAM type: NRG; PAM sequence: GGG
tatgtctcctttaagctgta

SEQ ID NO: 118101 - DNA, 20 bp, Artificial Sequence
  Description of Artificial Sequence: Synthetic oligonucleotide
  Target: ATXN1; (+) strand; PAM type: NRG; PAM sequence: GGG
atgtctcctttaagctgtag

SEQ ID NO: 118102 - DNA, 20 bp, Artificial Sequence
  Description of Artificial Sequence: Synthetic oligonucleotide
  Target: ATXN1; (+) strand; PAM type: NRG; PAM sequence: GGG
tgtctcctttaagctgtagg

SEQ ID NO: 118103 - DNA, 20 bp, Artificial Sequence
  Description of Artificial Sequence: Synthetic oligonucleotide
  Target: ATXN1; (+) strand; PAM type: NRG; PAM sequence: GAG
tctcctttaagctgtagggg

SEQ ID NO: 118104 - DNA, 20 bp, Artificial Sequence
  Description of Artificial Sequence: Synthetic oligonucleotide
  Target: ATXN1; (+) strand; PAM type: NRG; PAM sequence: AGG
ctcctttaagctgtaggggg

SEQ ID NO: 118105 - DNA, 20 bp, Artificial Sequence
  Description of Artificial Sequence: Synthetic oligonucleotide
  Target: ATXN1; (+) strand; PAM type: NRG; PAM sequence: GGG
tcctttaagctgtaggggga

SEQ ID NO: 118106 - DNA, 20 bp, Artificial Sequence
  Description of Artificial Sequence: Synthetic oligonucleotide
  Target: ATXN1; (+) strand; PAM type: NRG; PAM sequence: GGG
cctttaagctgtagggggag

SEQ ID NO: 118107 - DNA, 20 bp, Artificial Sequence
  Description of Artificial Sequence: Synthetic oligonucleotide
  Target: ATXN1; (+) strand; PAM type: NRG; PAM sequence: TGG
gctgtagggggaggggaatt

SEQ ID NO: 118108 - DNA, 20 bp, Artificial Sequence
  Description of Artificial Sequence: Synthetic oligonucleotide
  Target: ATXN1; (+) strand; PAM type: NRG; PAM sequence: TGG
gaggggaatttggcccaaca

SEQ ID NO: 118109 - DNA, 20 bp, Artificial Sequence
  Description of Artificial Sequence: Synthetic oligonucleotide
  Target: ATXN1; (+) strand; PAM type: NRG; PAM sequence: GGG
aggggaatttggcccaacat

SEQ ID NO: 118110 - DNA, 20 bp, Artificial Sequence
  Description of Artificial Sequence: Synthetic oligonucleotide
  Target: ATXN1; (+) strand; PAM type: NRG; PAM sequence: AAG
ccttctctctctctgaatta

SEQ ID NO: 118111 - DNA, 20 bp, Artificial Sequence
  Description of Artificial Sequence: Synthetic oligonucleotide
  Target: ATXN1; (+) strand; PAM type: NRG; PAM sequence: CAG
tctctctctctgaattaaag

SEQ ID NO: 118112 - DNA, 20 bp, Artificial Sequence
  Description of Artificial Sequence: Synthetic oligonucleotide
  Target: ATXN1; (+) strand; PAM type: NRG; PAM sequence: AAG
tctctgaattaaagcagatc

SEQ ID NO: 118113 - DNA, 20 bp, Artificial Sequence
  Description of Artificial Sequence: Synthetic oligonucleotide
  Target: ATXN1; (+) strand; PAM type: NRG; PAM sequence: AGG
ctctgaattaaagcagatca

SEQ ID NO: 118114 - DNA, 20 bp, Artificial Sequence
  Description of Artificial Sequence: Synthetic oligonucleotide
  Target: ATXN1; (+) strand; PAM type: NRG; PAM sequence: TAG
tgaattaaagcagatcaagg

SEQ ID NO: 118115 - DNA, 20 bp, Artificial Sequence
  Description of Artificial Sequence: Synthetic oligonucleotide
  Target: ATXN1; (+) strand; PAM type: NRG; PAM sequence: TGG
aaagcagatcaaggtagacc

SEQ ID NO: 118116 - DNA, 20 bp, Artificial Sequence
  Description of Artificial Sequence: Synthetic oligonucleotide
  Target: ATXN1; (+) strand; PAM type: NRG; PAM sequence: GGG
aagcagatcaaggtagacct

SEQ ID NO: 118117 - DNA, 20 bp, Artificial Sequence
  Description of Artificial Sequence: Synthetic oligonucleotide
  Target: ATXN1; (+) strand; PAM type: NRG; PAM sequence: AAG
agatcaaggtagacctggga

SEQ ID NO: 118118 - DNA, 20 bp, Artificial Sequence
  Description of Artificial Sequence: Synthetic oligonucleotide
  Target: ATXN1; (+) strand; PAM type: NRG; PAM sequence: CAG
ggtagacctgggaaagtttt

SEQ ID NO: 118119 - DNA, 20 bp, Artificial Sequence
  Description of Artificial Sequence: Synthetic oligonucleotide
  Target: ATXN1; (+) strand; PAM type: NRG; PAM sequence: TGG
ggaaagttttcagatgatcc

SEQ ID NO: 118120 - DNA, 20 bp, Artificial Sequence
  Description of Artificial Sequence: Synthetic oligonucleotide
  Target: ATXN1; (+) strand; PAM type: NRG; PAM sequence: TAG
aagttttcagatgatcctgg

SEQ ID NO: 118121 - DNA, 20 bp, Artificial Sequence
  Description of Artificial Sequence: Synthetic oligonucleotide
  Target: ATXN1; (+) strand; PAM type: NRG; PAM sequence: AGG
agttttcagatgatcctggt

SEQ ID NO: 118122 - DNA, 20 bp, Artificial Sequence
  Description of Artificial Sequence: Synthetic oligonucleotide
  Target: ATXN1; (+) strand; PAM type: NRG; PAM sequence: TAG
agatgatcctggtaggtata

SEQ ID NO: 118123 - DNA, 20 bp, Artificial Sequence
  Description of Artificial Sequence: Synthetic oligonucleotide
  Target: ATXN1; (+) strand; PAM type: NRG; PAM sequence: CAG
gtaggtatatagatgtccta

SEQ ID NO: 118124 - DNA, 20 bp, Artificial Sequence
  Description of Artificial Sequence: Synthetic oligonucleotide
  Target: ATXN1; (+) strand; PAM type: NRG; PAM sequence: AGG
taggtatatagatgtcctac

SEQ ID NO: 118125 - DNA, 20 bp, Artificial Sequence
  Description of Artificial Sequence: Synthetic oligonucleotide
  Target: ATXN1; (+) strand; PAM type: NRG; PAM sequence: GGG
aggtatatagatgtcctaca

SEQ ID NO: 118126 - DNA, 20 bp, Artificial Sequence
  Description of Artificial Sequence: Synthetic oligonucleotide
  Target: ATXN1; (+) strand; PAM type: NRG; PAM sequence: CAG
tatagatgtcctacagggtc

SEQ ID NO: 118127 - DNA, 20 bp, Artificial Sequence
  Description of Artificial Sequence: Synthetic oligonucleotide
  Target: ATXN1; (+) strand; PAM type: NRG; PAM sequence: AGG
atagatgtcctacagggtcc

SEQ ID NO: 118128 - DNA, 20 bp, Artificial Sequence
  Description of Artificial Sequence: Synthetic oligonucleotide
  Target: ATXN1; (+) strand; PAM type: NRG; PAM sequence: GGG
tagatgtcctacagggtcca

SEQ ID NO: 118129 - DNA, 20 bp, Artificial Sequence
  Description of Artificial Sequence: Synthetic oligonucleotide
  Target: ATXN1; (+) strand; PAM type: NRG; PAM sequence: TGG
ggcaaaccttcgacctcact

SEQ ID NO: 118130 - DNA, 20 bp, Artificial Sequence
  Description of Artificial Sequence: Synthetic oligonucleotide
  Target: ATXN1; (+) strand; PAM type: NRG; PAM sequence: GAG
caaaccttcgacctcacttg

SEQ ID NO: 118131 - DNA, 20 bp, Artificial Sequence
  Description of Artificial Sequence: Synthetic oligonucleotide
  Target: ATXN1; (+) strand; PAM type: NRG; PAM sequence: GAG
aaccttcgacctcacttgga

SEQ ID NO: 118132 - DNA, 20 bp, Artificial Sequence
  Description of Artificial Sequence: Synthetic oligonucleotide
  Target: ATXN1; (+) strand; PAM type: NRG; PAM sequence: TAG
gagagatgtcatgctattgt

SEQ ID NO: 118133 - DNA, 20 bp, Artificial Sequence
  Description of Artificial Sequence: Synthetic oligonucleotide
  Target: ATXN1; (+) strand; PAM type: NRG; PAM sequence: TGG
gctattgttagatcaaaccc

SEQ ID NO: 118134 - DNA, 20 bp, Artificial Sequence
  Description of Artificial Sequence: Synthetic oligonucleotide
  Target: ATXN1; (+) strand; PAM type: NRG; PAM sequence: AAG
aaaccctggcctttaatgaa

SEQ ID NO: 118135 - DNA, 20 bp, Artificial Sequence
  Description of Artificial Sequence: Synthetic oligonucleotide
  Target: ATXN1; (+) strand; PAM type: NRG; PAM sequence: CAG
ggcctttaatgaaaagaatg

SEQ ID NO: 118136 - DNA, 20 bp, Artificial Sequence
  Description of Artificial Sequence: Synthetic oligonucleotide
  Target: ATXN1; (+) strand; PAM type: NRG; PAM sequence: TAG
taatgaaaagaatgcagctt

SEQ ID NO: 118137 - DNA, 20 bp, Artificial Sequence
  Description of Artificial Sequence: Synthetic oligonucleotide
  Target: ATXN1; (+) strand; PAM type: NRG; PAM sequence: CAG
aaagaatgcagctttagctg

SEQ ID NO: 118138 - DNA, 20 bp, Artificial Sequence
  Description of Artificial Sequence: Synthetic oligonucleotide
  Target: ATXN1; (+) strand; PAM type: NRG; PAM sequence: GAG
tgcagctttagctgcagccc

SEQ ID NO: 118139 - DNA, 20 bp, Artificial Sequence
  Description of Artificial Sequence: Synthetic oligonucleotide
  Target: ATXN1; (+) strand; PAM type: NRG; PAM sequence: TGG
ttagctgcagcccgagaatt

SEQ ID NO: 118140 - DNA, 20 bp, Artificial Sequence
  Description of Artificial Sequence: Synthetic oligonucleotide
  Target: ATXN1; (+) strand; PAM type: NRG; PAM sequence: GAG
agctgcagcccgagaatttg

SEQ ID NO: 118141 - DNA, 20 bp, Artificial Sequence
  Description of Artificial Sequence: Synthetic oligonucleotide
  Target: ATXN1; (+) strand; PAM type: NRG; PAM sequence: TGG
cccgagaatttggagatacc

SEQ ID NO: 118142 - DNA, 20 bp, Artificial Sequence
  Description of Artificial Sequence: Synthetic oligonucleotide
  Target: ATXN1; (+) strand; PAM type: NRG; PAM sequence: TAG
tttggagatacctggtatct

SEQ ID NO: 118143 - DNA, 20 bp, Artificial Sequence
  Description of Artificial Sequence: Synthetic oligonucleotide
  Target: ATXN1; (+) strand; PAM type: NRG; PAM sequence: AAG
agatacctggtatcttagtc

SEQ ID NO: 118144 - DNA, 20 bp, Artificial Sequence
  Description of Artificial Sequence: Synthetic oligonucleotide
  Target: ATXN1; (+) strand; PAM type: NRG; PAM sequence: CAG
tcaagtaaatgacaaaatga

SEQ ID NO: 118145 - DNA, 20 bp, Artificial Sequence
  Description of Artificial Sequence: Synthetic oligonucleotide
  Target: ATXN1; (+) strand; PAM type: NRG; PAM sequence: AAG
aaatgacaaaatgacagccg

SEQ ID NO: 118146 - DNA, 20 bp, Artificial Sequence
  Description of Artificial Sequence: Synthetic oligonucleotide
  Target: ATXN1; (+) strand; PAM type: NRG; PAM sequence: AAG
gacaaaatgacagccgaaga

SEQ ID NO: 118147 - DNA, 20 bp, Artificial Sequence
  Description of Artificial Sequence: Synthetic oligonucleotide
  Target: ATXN1; (+) strand; PAM type: NRG; PAM sequence: AGG
acaaaatgacagccgaagaa

SEQ ID NO: 118148 - DNA, 20 bp, Artificial Sequence
  Description of Artificial Sequence: Synthetic oligonucleotide
  Target: ATXN1; (+) strand; PAM type: NRG; PAM sequence: GGG
caaaatgacagccgaagaaa

SEQ ID NO: 118149 - DNA, 20 bp, Artificial Sequence
  Description of Artificial Sequence: Synthetic oligonucleotide
  Target: ATXN1; (+) strand; PAM type: NRG; PAM sequence: TGG
gaaagggacaaattccctaa

SEQ ID NO: 118150 - DNA, 20 bp, Artificial Sequence
  Description of Artificial Sequence: Synthetic oligonucleotide
  Target: ATXN1; (+) strand; PAM type: NRG; PAM sequence: GGG
aaagggacaaattccctaat

SEQ ID NO: 118151 - DNA, 20 bp, Artificial Sequence
  Description of Artificial Sequence: Synthetic oligonucleotide
  Target: ATXN1; (+) strand; PAM type: NRG; PAM sequence: CAG
gggacaaattccctaatggg

SEQ ID NO: 118152 - DNA, 20 bp, Artificial Sequence
  Description of Artificial Sequence: Synthetic oligonucleotide
  Target: ATXN1; (+) strand; PAM type: NRG; PAM sequence: AAG
caaattccctaatgggcagc

SEQ ID NO: 118153 - DNA, 20 bp, Artificial Sequence
  Description of Artificial Sequence: Synthetic oligonucleotide
  Target: ATXN1; (+) strand; PAM type: NRG; PAM sequence: TGG
gcagcaagccatccccatta

SEQ ID NO: 118154 - DNA, 20 bp, Artificial Sequence
  Description of Artificial Sequence: Synthetic oligonucleotide
  Target: ATXN1; (+) strand; PAM type: NRG; PAM sequence: TGG
tccccattatggatccccac

SEQ ID NO: 118155 - DNA, 20 bp, Artificial Sequence
  Description of Artificial Sequence: Synthetic oligonucleotide
  Target: ATXN1; (+) strand; PAM type: NRG; PAM sequence: GGG
ccccattatggatccccact

SEQ ID NO: 118156 - DNA, 20 bp, Artificial Sequence
  Description of Artificial Sequence: Synthetic oligonucleotide
  Target: ATXN1; (+) strand; PAM type: NRG; PAM sequence: TAG
tatggatccccactgggacc

SEQ ID NO: 118157 - DNA, 20 bp, Artificial Sequence
  Description of Artificial Sequence: Synthetic oligonucleotide
  Target: ATXN1; (+) strand; PAM type: NRG; PAM sequence: CAG
tccccactgggacctagact

SEQ ID NO: 118158 - DNA, 20 bp, Artificial Sequence
  Description of Artificial Sequence: Synthetic oligonucleotide
  Target: ATXN1; (+) strand; PAM type: NRG; PAM sequence: TGG
tgggacctagactcagatca

SEQ ID NO: 118159 - DNA, 20 bp, Artificial Sequence
  Description of Artificial Sequence: Synthetic oligonucleotide
  Target: ATXN1; (+) strand; PAM type: NRG; PAM sequence: GGG
gggacctagactcagatcat

SEQ ID NO: 118160 - DNA, 20 bp, Artificial Sequence
  Description of Artificial Sequence: Synthetic oligonucleotide
  Target: ATXN1; (+) strand; PAM type: NRG; PAM sequence: TGG
tagactcagatcatgggaac

SEQ ID NO: 118161 - DNA, 20 bp, Artificial Sequence
  Description of Artificial Sequence: Synthetic oligonucleotide
  Target: ATXN1; (+) strand; PAM type: NRG; PAM sequence: GAG
gactcagatcatgggaactg

SEQ ID NO: 118162 - DNA, 20 bp, Artificial Sequence
  Description of Artificial Sequence: Synthetic oligonucleotide
  Target: ATXN1; (+) strand; PAM type: NRG; PAM sequence: CAG
acatctgttgacctgtattc

SEQ ID NO: 118163 - DNA, 20 bp, Artificial Sequence
  Description of Artificial Sequence: Synthetic oligonucleotide
  Target: ATXN1; (+) strand; PAM type: NRG; PAM sequence: AAG
tctgttgacctgtattccag

SEQ ID NO: 118164 - DNA, 20 bp, Artificial Sequence
  Description of Artificial Sequence: Synthetic oligonucleotide
  Target: ATXN1; (+) strand; PAM type: NRG; PAM sequence: AGG
ctgttgacctgtattccaga

SEQ ID NO: 118165 - DNA, 20 bp, Artificial Sequence
  Description of Artificial Sequence: Synthetic oligonucleotide
  Target: ATXN1; (+) strand; PAM type: NRG; PAM sequence: AAG
acctgtattccagaaggact

SEQ ID NO: 118166 - DNA, 20 bp, Artificial Sequence
  Description of Artificial Sequence: Synthetic oligonucleotide
  Target: ATXN1; (+) strand; PAM type: NRG; PAM sequence: AGG
cctgtattccagaaggacta

SEQ ID NO: 118167 - DNA, 20 bp, Artificial Sequence
  Description of Artificial Sequence: Synthetic oligonucleotide
  Target: ATXN1; (+) strand; PAM type: NRG; PAM sequence: GAG
tgtattccagaaggactaag

SEQ ID NO: 118168 - DNA, 20 bp, Artificial Sequence
  Description of Artificial Sequence: Synthetic oligonucleotide
  Target: ATXN1; (+) strand; PAM type: NRG; PAM sequence: TAG
ccagaaggactaaggagaat

SEQ ID NO: 118169 - DNA, 20 bp, Artificial Sequence
  Description of Artificial Sequence: Synthetic oligonucleotide
  Target: ATXN1; (+) strand; PAM type: NRG; PAM sequence: AGG
cagaaggactaaggagaatt

SEQ ID NO: 118170 - DNA, 20 bp, Artificial Sequence
  Description of Artificial Sequence: Synthetic oligonucleotide
  Target: ATXN1; (+) strand; PAM type: NRG; PAM sequence: AAG
gactaaggagaattaggaaa

SEQ ID NO: 118171 - DNA, 20 bp, Artificial Sequence
  Description of Artificial Sequence: Synthetic oligonucleotide
  Target: ATXN1; (+) strand; PAM type: NRG; PAM sequence: CAG
caatgatgtccaccataact

SEQ ID NO: 118172 - DNA, 20 bp, Artificial Sequence
  Description of Artificial Sequence: Synthetic oligonucleotide
  Target: ATXN1; (+) strand; PAM type: NRG; PAM sequence: AGG
aatgatgtccaccataactc

SEQ ID NO: 118173 - DNA, 20 bp, Artificial Sequence
  Description of Artificial Sequence: Synthetic oligonucleotide
  Target: ATXN1; (+) strand; PAM type: NRG; PAM sequence: GGG
atgatgtccaccataactca

SEQ ID NO: 118174 - DNA, 20 bp, Artificial Sequence
  Description of Artificial Sequence: Synthetic oligonucleotide
  Target: ATXN1; (+) strand; PAM type: NRG; PAM sequence: AAG
tgtccaccataactcaggga

SEQ ID NO: 118175 - DNA, 20 bp, Artificial Sequence
  Description of Artificial Sequence: Synthetic oligonucleotide
  Target: ATXN1; (+) strand; PAM type: NRG; PAM sequence: AGG
gtccaccataactcagggaa

SEQ ID NO: 118176 - DNA, 20 bp, Artificial Sequence
  Description of Artificial Sequence: Synthetic oligonucleotide
  Target: ATXN1; (+) strand; PAM type: NRG; PAM sequence: AAG
caccataactcagggaaagg

SEQ ID NO: 118177 - DNA, 20 bp, Artificial Sequence
  Description of Artificial Sequence: Synthetic oligonucleotide
  Target: ATXN1; (+) strand; PAM type: NRG; PAM sequence: AAG
aaaatcctactgccttcctc

SEQ ID NO: 118178 - DNA, 20 bp, Artificial Sequence
  Description of Artificial Sequence: Synthetic oligonucleotide
  Target: ATXN1; (+) strand; PAM type: NRG; PAM sequence: CAG
atcctactgccttcctcaag

SEQ ID NO: 118179 - DNA, 20 bp, Artificial Sequence
  Description of Artificial Sequence: Synthetic oligonucleotide
  Target: ATXN1; (+) strand; PAM type: NRG; PAM sequence: TGG
ctgccttcctcaagcagcta

SEQ ID NO: 118180 - DNA, 20 bp, Artificial Sequence
  Description of Artificial Sequence: Synthetic oligonucleotide
  Target: ATXN1; (+) strand; PAM type: NRG; PAM sequence: GGG
tgccttcctcaagcagctat

SEQ ID NO: 118181 - DNA, 20 bp, Artificial Sequence
  Description of Artificial Sequence: Synthetic oligonucleotide
  Target: ATXN1; (+) strand; PAM type: NRG; PAM sequence: GAG
ccttcctcaagcagctatgg

SEQ ID NO: 118182 - DNA, 20 bp, Artificial Sequence
  Description of Artificial Sequence: Synthetic oligonucleotide
  Target: ATXN1; (+) strand; PAM type: NRG; PAM sequence: AGG
cttcctcaagcagctatggg

SEQ ID NO: 118183 - DNA, 20 bp, Artificial Sequence
  Description of Artificial Sequence: Synthetic oligonucleotide
  Target: ATXN1; (+) strand; PAM type: NRG; PAM sequence: AAG
aagcagctatgggaggcctt

SEQ ID NO: 118184 - DNA, 20 bp, Artificial Sequence
  Description of Artificial Sequence: Synthetic oligonucleotide
  Target: ATXN1; (+) strand; PAM type: NRG; PAM sequence: GAG
ccctgtcacccaactccctc

SEQ ID NO: 118185 - DNA, 20 bp, Artificial Sequence
  Description of Artificial Sequence: Synthetic oligonucleotide
  Target: ATXN1; (+) strand; PAM type: NRG; PAM sequence: AGG
cctgtcacccaactccctcg

SEQ ID NO: 118186 - DNA, 20 bp, Artificial Sequence
  Description of Artificial Sequence: Synthetic oligonucleotide
  Target: ATXN1; (+) strand; PAM type: NRG; PAM sequence: GGG
ctgtcacccaactccctcga

SEQ ID NO: 118187 - DNA, 20 bp, Artificial Sequence
  Description of Artificial Sequence: Synthetic oligonucleotide
  Target: ATXN1; (+) strand; PAM type: NRG; PAM sequence: AAG
cgagggtcaattgatcctaa

SEQ ID NO: 118188 - DNA, 20 bp, Artificial Sequence
  Description of Artificial Sequence: Synthetic oligonucleotide
  Target: ATXN1; (+) strand; PAM type: NRG; PAM sequence: CAG
aaagatgtttattacccaat

SEQ ID NO: 118189 - DNA, 20 bp, Artificial Sequence
  Description of Artificial Sequence: Synthetic oligonucleotide
  Target: ATXN1; (+) strand; PAM type: NRG; PAM sequence: GAG
tgtttattacccaatcagct

SEQ ID NO: 118190 - DNA, 20 bp, Artificial Sequence
  Description of Artificial Sequence: Synthetic oligonucleotide
  Target: ATXN1; (+) strand; PAM type: NRG; PAM sequence: CAG
tacccaatcagctgagatat

SEQ ID NO: 118191 - DNA, 20 bp, Artificial Sequence
  Description of Artificial Sequence: Synthetic oligonucleotide
  Target: ATXN1; (+) strand; PAM type: NRG; PAM sequence: AGG
acccaatcagctgagatatc

SEQ ID NO: 118192 - DNA, 20 bp, Artificial Sequence
  Description of Artificial Sequence: Synthetic oligonucleotide
  Target: ATXN1; (+) strand; PAM type: NRG; PAM sequence: GAG
ccaatcagctgagatatcag

SEQ ID NO: 118193 - DNA, 20 bp, Artificial Sequence
  Description of Artificial Sequence: Synthetic oligonucleotide
  Target: ATXN1; (+) strand; PAM type: NRG; PAM sequence: AAG
tcagctgagatatcaggaga

SEQ ID NO: 118194 - DNA, 20 bp, Artificial Sequence
  Description of Artificial Sequence: Synthetic oligonucleotide
  Target: ATXN1; (+) strand; PAM type: NRG; PAM sequence: AAG
atatcaggagaaagctccaa

SEQ ID NO: 118195 - DNA, 20 bp, Artificial Sequence
  Description of Artificial Sequence: Synthetic oligonucleotide
  Target: ATXN1; (+) strand; PAM type: NRG; PAM sequence: GAG
caggagaaagctccaaaagc

SEQ ID NO: 118196 - DNA, 20 bp, Artificial Sequence
  Description of Artificial Sequence: Synthetic oligonucleotide
  Target: ATXN1; (+) strand; PAM type: NRG; PAM sequence: TGG
aagctccaaaagcgagccct

SEQ ID NO: 118197 - DNA, 20 bp, Artificial Sequence
  Description of Artificial Sequence: Synthetic oligonucleotide
  Target: ATXN1; (+) strand; PAM type: NRG; PAM sequence: TGG
ccttggccctgaacaaaatc

SEQ ID NO: 118198 - DNA, 20 bp, Artificial Sequence
  Description of Artificial Sequence: Synthetic oligonucleotide
  Target: ATXN1; (+) strand; PAM type: NRG; PAM sequence: GAG
ttggccctgaacaaaatctg

SEQ ID NO: 118199 - DNA, 20 bp, Artificial Sequence
  Description of Artificial Sequence: Synthetic oligonucleotide
  Target: ATXN1; (+) strand; PAM type: NRG; PAM sequence: AGG
tggccctgaacaaaatctgg

SEQ ID NO: 118200 - DNA, 20 bp, Artificial Sequence
  Description of Artificial Sequence: Synthetic oligonucleotide
  Target: ATXN1; (+) strand; PAM type: NRG; PAM sequence: TGG
tctggaggcattattaaacc

SEQ ID NO: 118201 - DNA, 20 bp, Artificial Sequence
  Description of Artificial Sequence: Synthetic oligonucleotide
  Target: ATXN1; (+) strand; PAM type: NRG; PAM sequence: CGG
attattaaacctggcaaccg

SEQ ID NO: 118202 - DNA, 20 bp, Artificial Sequence
  Description of Artificial Sequence: Synthetic oligonucleotide
  Target: ATXN1; (+) strand; PAM type: NRG; PAM sequence: TAG
gcaaccgcggtgttctctaa

SEQ ID NO: 118203 - DNA, 20 bp, Artificial Sequence
  Description of Artificial Sequence: Synthetic oligonucleotide
  Target: ATXN1; (+) strand; PAM type: NRG; PAM sequence: AGG
caaccgcggtgttctctaat

SEQ ID NO: 118204 - DNA, 20 bp, Artificial Sequence
  Description of Artificial Sequence: Synthetic oligonucleotide
  Target: ATXN1; (+) strand; PAM type: NRG; PAM sequence: AAG
ggtgttctctaataggaacc

SEQ ID NO: 118205 - DNA, 20 bp, Artificial Sequence
  Description of Artificial Sequence: Synthetic oligonucleotide
  Target: ATXN1; (+) strand; PAM type: NRG; PAM sequence: GAG
tgttctctaataggaaccaa

SEQ ID NO: 118206 - DNA, 20 bp, Artificial Sequence
  Description of Artificial Sequence: Synthetic oligonucleotide
  Target: ATXN1; (+) strand; PAM type: NRG; PAM sequence: AGG
gttctctaataggaaccaag

SEQ ID NO: 118207 - DNA, 20 bp, Artificial Sequence
  Description of Artificial Sequence: Synthetic oligonucleotide
  Target: ATXN1; (+) strand; PAM type: NRG; PAM sequence: CAG
ctaataggaaccaagaggaa

SEQ ID NO: 118208 - DNA, 20 bp, Artificial Sequence
  Description of Artificial Sequence: Synthetic oligonucleotide
  Target: ATXN1; (+) strand; PAM type: NRG; PAM sequence: AGG
taataggaaccaagaggaac

SEQ ID NO: 118209 - DNA, 20 bp, Artificial Sequence
  Description of Artificial Sequence: Synthetic oligonucleotide
  Target: ATXN1; (+) strand; PAM type: NRG; PAM sequence: CAG
taggaaccaagaggaacagg

SEQ ID NO: 118210 - DNA, 20 bp, Artificial Sequence
  Description of Artificial Sequence: Synthetic oligonucleotide
  Target: ATXN1; (+) strand; PAM type: NRG; PAM sequence: AAG
accaagaggaacaggcagaa

SEQ ID NO: 118211 - DNA, 20 bp, Artificial Sequence
  Description of Artificial Sequence: Synthetic oligonucleotide
  Target: ATXN1; (+) strand; PAM type: NRG; PAM sequence: AGG
ccaagaggaacaggcagaaa

SEQ ID NO: 118212 - DNA, 20 bp, Artificial Sequence
  Description of Artificial Sequence: Synthetic oligonucleotide
  Target: ATXN1; (+) strand; PAM type: NRG; PAM sequence: AAG
aggaacaggcagaaaaggaa

SEQ ID NO: 118213 - DNA, 20 bp, Artificial Sequence
  Description of Artificial Sequence: Synthetic oligonucleotide
  Target: ATXN1; (+) strand; PAM type: NRG; PAM sequence: GAG
acaggcagaaaaggaaaagc

SEQ ID NO: 118214 - DNA, 20 bp, Artificial Sequence
  Description of Artificial Sequence: Synthetic oligonucleotide
  Target: ATXN1; (+) strand; PAM type: NRG; PAM sequence: AAG
cagaaaaggaaaagcgagat

SEQ ID NO: 118215 - DNA, 20 bp, Artificial Sequence
  Description of Artificial Sequence: Synthetic oligonucleotide
  Target: ATXN1; (+) strand; PAM type: NRG; PAM sequence: GAG
gaaaaggaaaagcgagataa

SEQ ID NO: 118216 - DNA, 20 bp, Artificial Sequence
  Description of Artificial Sequence: Synthetic oligonucleotide
  Target: ATXN1; (+) strand; PAM type: NRG; PAM sequence: AAG
aggaaaagcgagataagaga

SEQ ID NO: 118217 - DNA, 20 bp, Artificial Sequence
  Description of Artificial Sequence: Synthetic oligonucleotide
  Target: ATXN1; (+) strand; PAM type: NRG; PAM sequence: AGG
ggaaaagcgagataagagaa

SEQ ID NO: 118218 - DNA, 20 bp, Artificial Sequence
  Description of Artificial Sequence: Synthetic oligonucleotide
  Target: ATXN1; (+) strand; PAM type: NRG; PAM sequence: CAG
gcgagataagagaaaggccg

SEQ ID NO: 118219 - DNA, 20 bp, Artificial Sequence
  Description of Artificial Sequence: Synthetic oligonucleotide
  Target: ATXN1; (+) strand; PAM type: NRG; PAM sequence: CAG
taagagaaaggccgcagcct

SEQ ID NO: 118220 - DNA, 20 bp, Artificial Sequence
  Description of Artificial Sequence: Synthetic oligonucleotide
  Target: ATXN1; (+) strand; PAM type: NRG; PAM sequence: TGG
aaaggccgcagcctcagtca

SEQ ID NO: 118221 - DNA, 20 bp, Artificial Sequence
  Description of Artificial Sequence: Synthetic oligonucleotide
  Target: ATXN1; (+) strand; PAM type: NRG; PAM sequence: CAG
gcagcctcagtcatggccct

SEQ ID NO: 118222 - DNA, 20 bp, Artificial Sequence
  Description of Artificial Sequence: Synthetic oligonucleotide
  Target: ATXN1; (+) strand; PAM type: NRG; PAM sequence: TGG
gccctcagacaaacaaacct

SEQ ID NO: 118223 - DNA, 20 bp, Artificial Sequence
  Description of Artificial Sequence: Synthetic oligonucleotide
  Target: ATXN1; (+) strand; PAM type: NRG; PAM sequence: TGG
ctcagacaaacaaaccttgg

SEQ ID NO: 118224 - DNA, 20 bp, Artificial Sequence
  Description of Artificial Sequence: Synthetic oligonucleotide
  Target: ATXN1; (+) strand; PAM type: NRG; PAM sequence: CAG
acaaacaaaccttggtggtt

SEQ ID NO: 118225 - DNA, 20 bp, Artificial Sequence
  Description of Artificial Sequence: Synthetic oligonucleotide
  Target: ATXN1; (+) strand; PAM type: NRG; PAM sequence: GAG
aaacaaaccttggtggttca

SEQ ID NO: 118226 - DNA, 20 bp, Artificial Sequence
  Description of Artificial Sequence: Synthetic oligonucleotide
  Target: ATXN1; (+) strand; PAM type: NRG; PAM sequence: GAG
acaaaccttggtggttcaga

SEQ ID NO: 118227 - DNA, 20 bp, Artificial Sequence
  Description of Artificial Sequence: Synthetic oligonucleotide
  Target: ATXN1; (+) strand; PAM type: NRG; PAM sequence: AGG
caaaccttggtggttcagag

SEQ ID NO: 118228 - DNA, 20 bp, Artificial Sequence
  Description of Artificial Sequence: Synthetic oligonucleotide
  Target: ATXN1; (+) strand; PAM type: NRG; PAM sequence: CAG
ccttggtggttcagagagga

SEQ ID NO: 118229 - DNA, 20 bp, Artificial Sequence
  Description of Artificial Sequence: Synthetic oligonucleotide
  Target: ATXN1; (+) strand; PAM type: NRG; PAM sequence: TGG
ggttcagagaggacagaaaa

SEQ ID NO: 118230 - DNA, 20 bp, Artificial Sequence
  Description of Artificial Sequence: Synthetic oligonucleotide
  Target: ATXN1; (+) strand; PAM type: NRG; PAM sequence: GAG
ttcagagaggacagaaaatg

SEQ ID NO: 118231 - DNA, 20 bp, Artificial Sequence
  Description of Artificial Sequence: Synthetic oligonucleotide
  Target: ATXN1; (+) strand; PAM type: NRG; PAM sequence: CAG
agagaggacagaaaatggag

SEQ ID NO: 118232 - DNA, 20 bp, Artificial Sequence
  Description of Artificial Sequence: Synthetic oligonucleotide
  Target: ATXN1; (+) strand; PAM type: NRG; PAM sequence: AGG
gagaggacagaaaatggagc

SEQ ID NO: 118233 - DNA, 20 bp, Artificial Sequence
  Description of Artificial Sequence: Synthetic oligonucleotide
  Target: ATXN1; (+) strand; PAM type: NRG; PAM sequence: CAG
aatggagcaggccaatcacc

SEQ ID NO: 118234 - DNA, 20 bp, Artificial Sequence
  Description of Artificial Sequence: Synthetic oligonucleotide
  Target: ATXN1; (+) strand; PAM type: NRG; PAM sequence: TAG
ggagcaggccaatcacccag

SEQ ID NO: 118235 - DNA, 20 bp, Artificial Sequence
  Description of Artificial Sequence: Synthetic oligonucleotide
  Target: ATXN1; (+) strand; PAM type: NRG; PAM sequence: AGG
gagcaggccaatcacccagt

SEQ ID NO: 118236 - DNA, 20 bp, Artificial Sequence
  Description of Artificial Sequence: Synthetic oligonucleotide
  Target: ATXN1; (+) strand; PAM type: NRG; PAM sequence: GGG
agcaggccaatcacccagta

SEQ ID NO: 118237 - DNA, 20 bp, Artificial Sequence
  Description of Artificial Sequence: Synthetic oligonucleotide
  Target: ATXN1; (+) strand; PAM type: NRG; PAM sequence: CAG
cacccagtagggcttgttat

SEQ ID NO: 118238 - DNA, 20 bp, Artificial Sequence
  Description of Artificial Sequence: Synthetic oligonucleotide
  Target: ATXN1; (+) strand; PAM type: NRG; PAM sequence: TGG
agtagggcttgttatcagtg

SEQ ID NO: 118239 - DNA, 20 bp, Artificial Sequence
  Description of Artificial Sequence: Synthetic oligonucleotide
  Target: ATXN1; (+) strand; PAM type: NRG; PAM sequence: AAG
ttgttatcagtgtggtttgc

SEQ ID NO: 118240 - DNA, 20 bp, Artificial Sequence
  Description of Artificial Sequence: Synthetic oligonucleotide
  Target: ATXN1; (+) strand; PAM type: NRG; PAM sequence: AGG
tgttatcagtgtggtttgca

SEQ ID NO: 118241 - DNA, 20 bp, Artificial Sequence
  Description of Artificial Sequence: Synthetic oligonucleotide
  Target: ATXN1; (+) strand; PAM type: NRG; PAM sequence: AAG
tttgcaaggacaccttaaaa

SEQ ID NO: 118242 - DNA, 20 bp, Artificial Sequence
  Description of Artificial Sequence: Synthetic oligonucleotide
  Target: ATXN1; (+) strand; PAM type: NRG; PAM sequence: AAG
cttaaaaaagactgtccaac

SEQ ID NO: 118243 - DNA, 20 bp, Artificial Sequence
  Description of Artificial Sequence: Synthetic oligonucleotide
  Target: ATXN1; (+) strand; PAM type: NRG; PAM sequence: AAG
aagactgtccaacaagaaac

SEQ ID NO: 118244 - DNA, 20 bp, Artificial Sequence
  Description of Artificial Sequence: Synthetic oligonucleotide
  Target: ATXN1; (+) strand; PAM type: NRG; PAM sequence: AAG
tcacccatgtccactatgcc

SEQ ID NO: 118245 - DNA, 20 bp, Artificial Sequence
  Description of Artificial Sequence: Synthetic oligonucleotide
  Target: ATXN1; (+) strand; PAM type: NRG; PAM sequence: AGG
cacccatgtccactatgcca

SEQ ID NO: 118246 - DNA, 20 bp, Artificial Sequence
  Description of Artificial Sequence: Synthetic oligonucleotide
  Target: ATXN1; (+) strand; PAM type: NRG; PAM sequence: TAG
cactatgccaaggcaatcac

SEQ ID NO: 118247 - DNA, 20 bp, Artificial Sequence
  Description of Artificial Sequence: Synthetic oligonucleotide
  Target: ATXN1; (+) strand; PAM type: NRG; PAM sequence: CGG
atgccaaggcaatcactaga

SEQ ID NO: 118248 - DNA, 20 bp, Artificial Sequence
  Description of Artificial Sequence: Synthetic oligonucleotide
  Target: ATXN1; (+) strand; PAM type: NRG; PAM sequence: GGG
tgccaaggcaatcactagac

SEQ ID NO: 118249 - DNA, 20 bp, Artificial Sequence
  Description of Artificial Sequence: Synthetic oligonucleotide
  Target: ATXN1; (+) strand; PAM type: NRG; PAM sequence: GGG
gccaaggcaatcactagacg

SEQ ID NO: 118250 - DNA, 20 bp, Artificial Sequence
  Description of Artificial Sequence: Synthetic oligonucleotide
  Target: ATXN1; (+) strand; PAM type: NRG; PAM sequence: CAG
cactagacggggtactgccc

SEQ ID NO: 118251 - DNA, 20 bp, Artificial Sequence
  Description of Artificial Sequence: Synthetic oligonucleotide
  Target: ATXN1; (+) strand; PAM type: NRG; PAM sequence: GAG
ctagacggggtactgcccca

SEQ ID NO: 118252 - DNA, 20 bp, Artificial Sequence
  Description of Artificial Sequence: Synthetic oligonucleotide
  Target: ATXN1; (+) strand; PAM type: NRG; PAM sequence: AGG
tagacggggtactgccccag

SEQ ID NO: 118253 - DNA, 20 bp, Artificial Sequence
  Description of Artificial Sequence: Synthetic oligonucleotide
  Target: ATXN1; (+) strand; PAM type: NRG; PAM sequence: AAG
gggtactgccccagaggaca

SEQ ID NO: 118254 - DNA, 20 bp, Artificial Sequence
  Description of Artificial Sequence: Synthetic oligonucleotide
  Target: ATXN1; (+) strand; PAM type: NRG; PAM sequence: AGG
ggtactgccccagaggacaa

SEQ ID NO: 118255 - DNA, 20 bp, Artificial Sequence
  Description of Artificial Sequence: Synthetic oligonucleotide
  Target: ATXN1; (+) strand; PAM type: NRG; PAM sequence: CGG
cccagaggacaaaggttctc

SEQ ID NO: 118256 - DNA, 20 bp, Artificial Sequence
  Description of Artificial Sequence: Synthetic oligonucleotide
  Target: ATXN1; (+) strand; PAM type: NRG; PAM sequence: GGG
ccagaggacaaaggttctcc

SEQ ID NO: 118257 - DNA, 20 bp, Artificial Sequence
  Description of Artificial Sequence: Synthetic oligonucleotide
  Target: ATXN1; (+) strand; PAM type: NRG; PAM sequence: CAG
aggacaaaggttctccgggc

SEQ ID NO: 118258 - DNA, 20 bp, Artificial Sequence
  Description of Artificial Sequence: Synthetic oligonucleotide
  Target: ATXN1; (+) strand; PAM type: NRG; PAM sequence: AAG
acaaaggttctccgggccag

SEQ ID NO: 118259 - DNA, 20 bp, Artificial Sequence
  Description of Artificial Sequence: Synthetic oligonucleotide
  Target: ATXN1; (+) strand; PAM type: NRG; PAM sequence: CAG
ccgggccagaagcccccaac

SEQ ID NO: 118260 - DNA, 20 bp, Artificial Sequence
  Description of Artificial Sequence: Synthetic oligonucleotide
  Target: ATXN1; (+) strand; PAM type: NRG; PAM sequence: CAG
ccaaccagatgatccaacaa

SEQ ID NO: 118261 - DNA, 20 bp, Artificial Sequence
  Description of Artificial Sequence: Synthetic oligonucleotide
  Target: ATXN1; (+) strand; PAM type: NRG; PAM sequence: AGG
caaccagatgatccaacaac

SEQ ID NO: 118262 - DNA, 20 bp, Artificial Sequence
  Description of Artificial Sequence: Synthetic oligonucleotide
  Target: ATXN1; (+) strand; PAM type: NRG; PAM sequence: GAG
gatgatccaacaacaggact

SEQ ID NO: 118263 - DNA, 20 bp, Artificial Sequence
  Description of Artificial Sequence: Synthetic oligonucleotide
  Target: ATXN1; (+) strand; PAM type: NRG; PAM sequence: AGG
atgatccaacaacaggactg

SEQ ID NO: 118264 - DNA, 20 bp, Artificial Sequence
  Description of Artificial Sequence: Synthetic oligonucleotide
  Target: ATXN1; (+) strand; PAM type: NRG; PAM sequence: GGG
tgatccaacaacaggactga

SEQ ID NO: 118265 - DNA, 20 bp, Artificial Sequence
  Description of Artificial Sequence: Synthetic oligonucleotide
  Target: ATXN1; (+) strand; PAM type: NRG; PAM sequence: TGG
acaacaggactgagggtgcc

SEQ ID NO: 118266 - DNA, 20 bp, Artificial Sequence
  Description of Artificial Sequence: Synthetic oligonucleotide
  Target: ATXN1; (+) strand; PAM type: NRG; PAM sequence: AAG
ggactgagggtgcctggtgc

SEQ ID NO: 118267 - DNA, 20 bp, Artificial Sequence
  Description of Artificial Sequence: Synthetic oligonucleotide
  Target: ATXN1; (+) strand; PAM type: NRG; PAM sequence: CAG
agggtgcctggtgcaagcac

SEQ ID NO: 118268 - DNA, 20 bp, Artificial Sequence
  Description of Artificial Sequence: Synthetic oligonucleotide
  Target: ATXN1; (+) strand; PAM type: NRG; PAM sequence: GAG
ctcatgtcatcaccctcact

SEQ ID NO: 118269 - DNA, 20 bp, Artificial Sequence
  Description of Artificial Sequence: Synthetic oligonucleotide
  Target: ATXN1; (+) strand; PAM type: NRG; PAM sequence: TGG
tcatcaccctcactgagccc

SEQ ID NO: 118270 - DNA, 20 bp, Artificial Sequence
  Description of Artificial Sequence: Synthetic oligonucleotide
  Target: ATXN1; (+) strand; PAM type: NRG; PAM sequence: GGG
catcaccctcactgagccct

SEQ ID NO: 118271 - DNA, 20 bp, Artificial Sequence
  Description of Artificial Sequence: Synthetic oligonucleotide
  Target: ATXN1; (+) strand; PAM type: NRG; PAM sequence: AAG
accctcactgagccctgggc

SEQ ID NO: 118272 - DNA, 20 bp, Artificial Sequence
  Description of Artificial Sequence: Synthetic oligonucleotide
  Target: ATXN1; (+) strand; PAM type: NRG; PAM sequence: TAG
cactgagccctgggcaagtt

SEQ ID NO: 118273 - DNA, 20 bp, Artificial Sequence
  Description of Artificial Sequence: Synthetic oligonucleotide
  Target: ATXN1; (+) strand; PAM type: NRG; PAM sequence: GAG
cctgggcaagtttagccatt

SEQ ID NO: 118274 - DNA, 20 bp, Artificial Sequence
  Description of Artificial Sequence: Synthetic oligonucleotide
  Target: ATXN1; (+) strand; PAM type: NRG; PAM sequence: AGG
ctgggcaagtttagccattg

SEQ ID NO: 118275 - DNA, 20 bp, Artificial Sequence
  Description of Artificial Sequence: Synthetic oligonucleotide
  Target: ATXN1; (+) strand; PAM type: NRG; PAM sequence: GGG
tgggcaagtttagccattga

SEQ ID NO: 118276 - DNA, 20 bp, Artificial Sequence
  Description of Artificial Sequence: Synthetic oligonucleotide
  Target: ATXN1; (+) strand; PAM type: NRG; PAM sequence: CAG
caagtttagccattgagggc

SEQ ID NO: 118277 - DNA, 20 bp, Artificial Sequence
  Description of Artificial Sequence: Synthetic oligonucleotide
  Target: ATXN1; (+) strand; PAM type: NRG; PAM sequence: AGG
aagtttagccattgagggcc

SEQ ID NO: 118278 - DNA, 20 bp, Artificial Sequence
  Description of Artificial Sequence: Synthetic oligonucleotide
  Target: ATXN1; (+) strand; PAM type: NRG; PAM sequence: TGG
ccaggaaattgacttcctcc

SEQ ID NO: 118279 - DNA, 20 bp, Artificial Sequence
  Description of Artificial Sequence: Synthetic oligonucleotide
  Target: ATXN1; (+) strand; PAM type: NRG; PAM sequence: TGG
attgacttcctcctggacac

SEQ ID NO: 118280 - DNA, 20 bp, Artificial Sequence
  Description of Artificial Sequence: Synthetic oligonucleotide
  Target: ATXN1; (+) strand; PAM type: NRG; PAM sequence: TGG
cttcctcctggacactggca

SEQ ID NO: 118281 - DNA, 20 bp, Artificial Sequence
  Description of Artificial Sequence: Synthetic oligonucleotide
  Target: ATXN1; (+) strand; PAM type: NRG; PAM sequence: CAG
ggacactggcatggccttct

SEQ ID NO: 118282 - DNA, 20 bp, Artificial Sequence
  Description of Artificial Sequence: Synthetic oligonucleotide
  Target: ATXN1; (+) strand; PAM type: NRG; PAM sequence: CAG
tcagtgttaatctcctgccc

SEQ ID NO: 118283 - DNA, 20 bp, Artificial Sequence
  Description of Artificial Sequence: Synthetic oligonucleotide
  Target: ATXN1; (+) strand; PAM type: NRG; PAM sequence: CAG
tgttaatctcctgccccaga

SEQ ID NO: 118284 - DNA, 20 bp, Artificial Sequence
  Description of Artificial Sequence: Synthetic oligonucleotide
  Target: ATXN1; (+) strand; PAM type: NRG; PAM sequence: AAG
tgccccagacagctgtcctc

SEQ ID NO: 118285 - DNA, 20 bp, Artificial Sequence
  Description of Artificial Sequence: Synthetic oligonucleotide
  Target: ATXN1; (+) strand; PAM type: NRG; PAM sequence: AAG
ctcaagatccattaccatcc

SEQ ID NO: 118286 - DNA, 20 bp, Artificial Sequence
  Description of Artificial Sequence: Synthetic oligonucleotide
  Target: ATXN1; (+) strand; PAM type: NRG; PAM sequence: AGG
tcaagatccattaccatcca

SEQ ID NO: 118287 - DNA, 20 bp, Artificial Sequence
  Description of Artificial Sequence: Synthetic oligonucleotide
  Target: ATXN1; (+) strand; PAM type: NRG; PAM sequence: TGG
cattaccatccaaggaatcc

SEQ ID NO: 118288 - DNA, 20 bp, Artificial Sequence
  Description of Artificial Sequence: Synthetic oligonucleotide
  Target: ATXN1; (+) strand; PAM type: NRG; PAM sequence: GGG
attaccatccaaggaatcct

SEQ ID NO: 118289 - DNA, 20 bp, Artificial Sequence
  Description of Artificial Sequence: Synthetic oligonucleotide
  Target: ATXN1; (+) strand; PAM type: NRG; PAM sequence: CAG
ccatccaaggaatcctggga

SEQ ID NO: 118290 - DNA, 20 bp, Artificial Sequence
  Description of Artificial Sequence: Synthetic oligonucleotide
  Target: ATXN1; (+) strand; PAM type: NRG; PAM sequence: CAG
atcctgggacagcctgtaac

SEQ ID NO: 118291 - DNA, 20 bp, Artificial Sequence
  Description of Artificial Sequence: Synthetic oligonucleotide
  Target: ATXN1; (+) strand; PAM type: NRG; PAM sequence: AGG
tcctgggacagcctgtaacc

SEQ ID NO: 118292 - DNA, 20 bp, Artificial Sequence
  Description of Artificial Sequence: Synthetic oligonucleotide
  Target: ATXN1; (+) strand; PAM type: NRG; PAM sequence: CAG
aggtatttctcccacctcct

SEQ ID NO: 118293 - DNA, 20 bp, Artificial Sequence
  Description of Artificial Sequence: Synthetic oligonucleotide
  Target: ATXN1; (+) strand; PAM type: NRG; PAM sequence: TGG
cccacctcctcagttgtaat

SEQ ID NO: 118294 - DNA, 20 bp, Artificial Sequence
  Description of Artificial Sequence: Synthetic oligonucleotide
  Target: ATXN1; (+) strand; PAM type: NRG; PAM sequence: GGG
ccacctcctcagttgtaatt

SEQ ID NO: 118295 - DNA, 20 bp, Artificial Sequence
  Description of Artificial Sequence: Synthetic oligonucleotide
  Target: ATXN1; (+) strand; PAM type: NRG; PAM sequence: GAG
acctcctcagttgtaattgg

SEQ ID NO: 118296 - DNA, 20 bp, Artificial Sequence
  Description of Artificial Sequence: Synthetic oligonucleotide
  Target: ATXN1; (+) strand; PAM type: NRG; PAM sequence: AAG
catgcttttcttatgcctga

SEQ ID NO: 118297 - DNA, 20 bp, Artificial Sequence
  Description of Artificial Sequence: Synthetic oligonucleotide
  Target: ATXN1; (+) strand; PAM type: NRG; PAM sequence: TAG
tgaaagccccacacccttat

SEQ ID NO: 118298 - DNA, 20 bp, Artificial Sequence
  Description of Artificial Sequence: Synthetic oligonucleotide
  Target: ATXN1; (+) strand; PAM type: NRG; PAM sequence: AGG
gaaagccccacacccttatt

SEQ ID NO: 118299 - DNA, 20 bp, Artificial Sequence
  Description of Artificial Sequence: Synthetic oligonucleotide
  Target: ATXN1; (+) strand; PAM type: NRG; PAM sequence: GGG
aaagccccacacccttatta

SEQ ID NO: 118300 - DNA, 20 bp, Artificial Sequence
  Description of Artificial Sequence: Synthetic oligonucleotide
  Target: ATXN1; (+) strand; PAM type: NRG; PAM sequence: GAG
agccccacacccttattagg

SEQ ID NO: 118301 - DNA, 20 bp, Artificial Sequence
  Description of Artificial Sequence: Synthetic oligonucleotide
  Target: ATXN1; (+) strand; PAM type: NRG; PAM sequence: AGG
gccccacacccttattaggg

SEQ ID NO: 118302 - DNA, 20 bp, Artificial Sequence
  Description of Artificial Sequence: Synthetic oligonucleotide
  Target: ATXN1; (+) strand; PAM type: NRG; PAM sequence: GGG
ccccacacccttattaggga

SEQ ID NO: 118303 - DNA, 20 bp, Artificial Sequence
  Description of Artificial Sequence: Synthetic oligonucleotide
  Target: ATXN1; (+) strand; PAM type: NRG; PAM sequence: TAG
cttattagggagggacatat

SEQ ID NO: 118304 - DNA, 20 bp, Artificial Sequence
  Description of Artificial Sequence: Synthetic oligonucleotide
  Target: ATXN1; (+) strand; PAM type: NRG; PAM sequence: AAG
agggagggacatattagcca

SEQ ID NO: 118305 - DNA, 20 bp, Artificial Sequence
  Description of Artificial Sequence: Synthetic oligonucleotide
  Target: ATXN1; (+) strand; PAM type: NRG; PAM sequence: TGG
agggacatattagccaaagc

SEQ ID NO: 118306 - DNA, 20 bp, Artificial Sequence
  Description of Artificial Sequence: Synthetic oligonucleotide
  Target: ATXN1; (+) strand; PAM type: NRG; PAM sequence: GAG
ggacatattagccaaagctg

SEQ ID NO: 118307 - DNA, 20 bp, Artificial Sequence
  Description of Artificial Sequence: Synthetic oligonucleotide
  Target: ATXN1; (+) strand; PAM type: NRG; PAM sequence: TGG
agccattaactatatgaata

SEQ ID NO: 118308 - DNA, 20 bp, Artificial Sequence
  Description of Artificial Sequence: Synthetic oligonucleotide
  Target: ATXN1; (+) strand; PAM type: NRG; PAM sequence: GGG
gccattaactatatgaatat

SEQ ID NO: 118309 - DNA, 20 bp, Artificial Sequence
  Description of Artificial Sequence: Synthetic oligonucleotide
  Target: ATXN1; (+) strand; PAM type: NRG; PAM sequence: GGG
ccattaactatatgaatatg

SEQ ID NO: 118310 - DNA, 20 bp, Artificial Sequence
  Description of Artificial Sequence: Synthetic oligonucleotide
  Target: ATXN1; (+) strand; PAM type: NRG; PAM sequence: AAG
actatatgaatatggggaac

SEQ ID NO: 118311 - DNA, 20 bp, Artificial Sequence
  Description of Artificial Sequence: Synthetic oligonucleotide
  Target: ATXN1; (+) strand; PAM type: NRG; PAM sequence: GAG
ccatttgttgtcccctactt

SEQ ID NO: 118312 - DNA, 20 bp, Artificial Sequence
  Description of Artificial Sequence: Synthetic oligonucleotide
  Target: ATXN1; (+) strand; PAM type: NRG; PAM sequence: AGG
catttgttgtcccctacttg

SEQ ID NO: 118313 - DNA, 20 bp, Artificial Sequence
  Description of Artificial Sequence: Synthetic oligonucleotide
  Target: ATXN1; (+) strand; PAM type: NRG; PAM sequence: GAG
tttgttgtcccctacttgag

SEQ ID NO: 118314 - DNA, 20 bp, Artificial Sequence
  Description of Artificial Sequence: Synthetic oligonucleotide
  Target: ATXN1; (+) strand; PAM type: NRG; PAM sequence: AGG
ttgttgtcccctacttgagg

SEQ ID NO: 118315 - DNA, 20 bp, Artificial Sequence
  Description of Artificial Sequence: Synthetic oligonucleotide
  Target: ATXN1; (+) strand; PAM type: NRG; PAM sequence: GGG
tgttgtcccctacttgagga

SEQ ID NO: 118316 - DNA, 20 bp, Artificial Sequence
  Description of Artificial Sequence: Synthetic oligonucleotide
  Target: ATXN1; (+) strand; PAM type: NRG; PAM sequence: AAG
tgaggagggaatcaaccctg

SEQ ID NO: 118317 - DNA, 20 bp, Artificial Sequence
  Description of Artificial Sequence: Synthetic oligonucleotide
  Target: ATXN1; (+) strand; PAM type: NRG; PAM sequence: TGG
agggaatcaaccctgaagtc

SEQ ID NO: 118318 - DNA, 20 bp, Artificial Sequence
  Description of Artificial Sequence: Synthetic oligonucleotide
  Target: ATXN1; (+) strand; PAM type: NRG; PAM sequence: GGG
gggaatcaaccctgaagtct

SEQ ID NO: 118319 - DNA, 20 bp, Artificial Sequence
  Description of Artificial Sequence: Synthetic oligonucleotide
  Target: ATXN1; (+) strand; PAM type: NRG; PAM sequence: TGG
caaccctgaagtctgggcat

SEQ ID NO: 118320 - DNA, 20 bp, Artificial Sequence
  Description of Artificial Sequence: Synthetic oligonucleotide
  Target: ATXN1; (+) strand; PAM type: NRG; PAM sequence: AAG
ccctgaagtctgggcattgg

SEQ ID NO: 118321 - DNA, 20 bp, Artificial Sequence
  Description of Artificial Sequence: Synthetic oligonucleotide
  Target: ATXN1; (+) strand; PAM type: NRG; PAM sequence: AGG
cctgaagtctgggcattgga

SEQ ID NO: 118322 - DNA, 20 bp, Artificial Sequence
  Description of Artificial Sequence: Synthetic oligonucleotide
  Target: ATXN1; (+) strand; PAM type: NRG; PAM sequence: CGG
tgggcattggaaggacaatt

SEQ ID NO: 118323 - DNA, 20 bp, Artificial Sequence
  Description of Artificial Sequence: Synthetic oligonucleotide
  Target: ATXN1; (+) strand; PAM type: NRG; PAM sequence: AAG
cattggaaggacaattcgga

SEQ ID NO: 118324 - DNA, 20 bp, Artificial Sequence
  Description of Artificial Sequence: Synthetic oligonucleotide
  Target: ATXN1; (+) strand; PAM type: NRG; PAM sequence: AGG
attggaaggacaattcggaa

SEQ ID NO: 118325 - DNA, 20 bp, Artificial Sequence
  Description of Artificial Sequence: Synthetic oligonucleotide
  Target: ATXN1; (+) strand; PAM type: NRG; PAM sequence: CAG
aaaggcaaaaaatgcccacc

SEQ ID NO: 118326 - DNA, 20 bp, Artificial Sequence
  Description of Artificial Sequence: Synthetic oligonucleotide
  Target: ATXN1; (+) strand; PAM type: NRG; PAM sequence: CAG
aatgcccacccagtccaaat

SEQ ID NO: 118327 - DNA, 20 bp, Artificial Sequence
  Description of Artificial Sequence: Synthetic oligonucleotide
  Target: ATXN1; (+) strand; PAM type: NRG; PAM sequence: AGG
atgcccacccagtccaaatc

SEQ ID NO: 118328 - DNA, 20 bp, Artificial Sequence
  Description of Artificial Sequence: Synthetic oligonucleotide
  Target: ATXN1; (+) strand; PAM type: NRG; PAM sequence: AAG
cccagtccaaatcaggctat

SEQ ID NO: 118329 - DNA, 20 bp, Artificial Sequence
  Description of Artificial Sequence: Synthetic oligonucleotide
  Target: ATXN1; (+) strand; PAM type: NRG; PAM sequence: AAG
cccaccacttttccttatca

SEQ ID NO: 118330 - DNA, 20 bp, Artificial Sequence
  Description of Artificial Sequence: Synthetic oligonucleotide
  Target: ATXN1; (+) strand; PAM type: NRG; PAM sequence: AGG
ccaccacttttccttatcaa

SEQ ID NO: 118331 - DNA, 20 bp, Artificial Sequence
  Description of Artificial Sequence: Synthetic oligonucleotide
  Target: ATXN1; (+) strand; PAM type: NRG; PAM sequence: AAG
tatcaaaggcaatatctctt

SEQ ID NO: 118332 - DNA, 20 bp, Artificial Sequence
  Description of Artificial Sequence: Synthetic oligonucleotide
  Target: ATXN1; (+) strand; PAM type: NRG; PAM sequence: AGG
atcaaaggcaatatctctta

SEQ ID NO: 118333 - DNA, 20 bp, Artificial Sequence
  Description of Artificial Sequence: Synthetic oligonucleotide
  Target: ATXN1; (+) strand; PAM type: NRG; PAM sequence: AAG
gcaatatctcttaaggcctg

SEQ ID NO: 118334 - DNA, 20 bp, Artificial Sequence
  Description of Artificial Sequence: Synthetic oligonucleotide
  Target: ATXN1; (+) strand; PAM type: NRG; PAM sequence: AAG
cttaaggcctgaagctcata

SEQ ID NO: 118335 - DNA, 20 bp, Artificial Sequence
  Description of Artificial Sequence: Synthetic oligonucleotide
  Target: ATXN1; (+) strand; PAM type: NRG; PAM sequence: AGG
ttaaggcctgaagctcataa

SEQ ID NO: 118336 - DNA, 20 bp, Artificial Sequence
  Description of Artificial Sequence: Synthetic oligonucleotide
  Target: ATXN1; (+) strand; PAM type: NRG; PAM sequence: CAG
ctgaagctcataaaggatta

SEQ ID NO: 118337 - DNA, 20 bp, Artificial Sequence
  Description of Artificial Sequence: Synthetic oligonucleotide
  Target: ATXN1; (+) strand; PAM type: NRG; PAM sequence: AGG
tgaagctcataaaggattac

SEQ ID NO: 118338 - DNA, 20 bp, Artificial Sequence
  Description of Artificial Sequence: Synthetic oligonucleotide
  Target: ATXN1; (+) strand; PAM type: NRG; PAM sequence: AAG
ggatattgttatacatttaa

SEQ ID NO: 118339 - DNA, 20 bp, Artificial Sequence
  Description of Artificial Sequence: Synthetic oligonucleotide
  Target: ATXN1; (+) strand; PAM type: NRG; PAM sequence: GAG
tgttatacatttaaaagttc

SEQ ID NO: 118340 - DNA, 20 bp, Artificial Sequence
  Description of Artificial Sequence: Synthetic oligonucleotide
  Target: ATXN1; (+) strand; PAM type: NRG; PAM sequence: AGG
gttatacatttaaaagttcg

SEQ ID NO: 118341 - DNA, 20 bp, Artificial Sequence
  Description of Artificial Sequence: Synthetic oligonucleotide
  Target: ATXN1; (+) strand; PAM type: NRG; PAM sequence: TAG
acatttaaaagttcgaggct

SEQ ID NO: 118342 - DNA, 20 bp, Artificial Sequence
  Description of Artificial Sequence: Synthetic oligonucleotide
  Target: ATXN1; (+) strand; PAM type: NRG; PAM sequence: AAG
ttaaaagttcgaggcttagt

SEQ ID NO: 118343 - DNA, 20 bp, Artificial Sequence
  Description of Artificial Sequence: Synthetic oligonucleotide
  Target: ATXN1; (+) strand; PAM type: NRG; PAM sequence: CAG
cgaggcttagtaagaaaatg

SEQ ID NO: 118344 - DNA, 20 bp, Artificial Sequence
  Description of Artificial Sequence: Synthetic oligonucleotide
  Target: ATXN1; (+) strand; PAM type: NRG; PAM sequence: TAG
ggcttagtaagaaaatgcag

SEQ ID NO: 118345 - DNA, 20 bp, Artificial Sequence
  Description of Artificial Sequence: Synthetic oligonucleotide
  Target: ATXN1; (+) strand; PAM type: NRG; PAM sequence: TAG
cccctgcaacaccccaattc

SEQ ID NO: 118346 - DNA, 20 bp, Artificial Sequence
  Description of Artificial Sequence: Synthetic oligonucleotide
  Target: ATXN1; (+) strand; PAM type: NRG; PAM sequence: AGG
ccctgcaacaccccaattct

SEQ ID NO: 118347 - DNA, 20 bp, Artificial Sequence
  Description of Artificial Sequence: Synthetic oligonucleotide
  Target: ATXN1; (+) strand; PAM type: NRG; PAM sequence: GAG
ctgcaacaccccaattctag

SEQ ID NO: 118348 - DNA, 20 bp, Artificial Sequence
  Description of Artificial Sequence: Synthetic oligonucleotide
  Target: ATXN1; (+) strand; PAM type: NRG; PAM sequence: CAG
gagtacaaaaactgaatcgt

SEQ ID NO: 118349 - DNA, 20 bp, Artificial Sequence
  Description of Artificial Sequence: Synthetic oligonucleotide
  Target: ATXN1; (+) strand; PAM type: NRG; PAM sequence: TGG
tacaaaaactgaatcgtcag

SEQ ID NO: 118350 - DNA, 20 bp, Artificial Sequence
  Description of Artificial Sequence: Synthetic oligonucleotide
  Target: ATXN1; (+) strand; PAM type: NRG; PAM sequence: GAG
caaaaactgaatcgtcagtg

SEQ ID NO: 118351 - DNA, 20 bp, Artificial Sequence
  Description of Artificial Sequence: Synthetic oligonucleotide
  Target: ATXN1; (+) strand; PAM type: NRG; PAM sequence: TAG
actgaatcgtcagtggagac

SEQ ID NO: 118352 - DNA, 20 bp, Artificial Sequence
  Description of Artificial Sequence: Synthetic oligonucleotide
  Target: ATXN1; (+) strand; PAM type: NRG; PAM sequence: AAG
tcgtcagtggagactagtgc

SEQ ID NO: 118353 - DNA, 20 bp, Artificial Sequence
  Description of Artificial Sequence: Synthetic oligonucleotide
  Target: ATXN1; (+) strand; PAM type: NRG; PAM sequence: TAG
tggagactagtgcaagatcc

SEQ ID NO: 118354 - DNA, 20 bp, Artificial Sequence
  Description of Artificial Sequence: Synthetic oligonucleotide
  Target: ATXN1; (+) strand; PAM type: NRG; PAM sequence: CAG
gtgcaagatcctagactcat

SEQ ID NO: 118355 - DNA, 20 bp, Artificial Sequence
  Description of Artificial Sequence: Synthetic oligonucleotide
  Target: ATXN1; (+) strand; PAM type: NRG; PAM sequence: GAG
aagatcctagactcatcagt

SEQ ID NO: 118356 - DNA, 20 bp, Artificial Sequence
  Description of Artificial Sequence: Synthetic oligonucleotide
  Target: ATXN1; (+) strand; PAM type: NRG; PAM sequence: AGG
agatcctagactcatcagtg

SEQ ID NO: 118357 - DNA, 20 bp, Artificial Sequence
  Description of Artificial Sequence: Synthetic oligonucleotide
  Target: ATXN1; (+) strand; PAM type: NRG; PAM sequence: AAG
tcctagactcatcagtgagg

SEQ ID NO: 118358 - DNA, 20 bp, Artificial Sequence
  Description of Artificial Sequence: Synthetic oligonucleotide
  Target: ATXN1; (+) strand; PAM type: NRG; PAM sequence: CGG
ggaagtaattcctctatatc

SEQ ID NO: 118359 - DNA, 20 bp, Artificial Sequence
  Description of Artificial Sequence: Synthetic oligonucleotide
  Target: ATXN1; (+) strand; PAM type: NRG; PAM sequence: AAG
ccctgctctctcaaatacca

SEQ ID NO: 118360 - DNA, 20 bp, Artificial Sequence
  Description of Artificial Sequence: Synthetic oligonucleotide
  Target: ATXN1; (+) strand; PAM type: NRG; PAM sequence: AGG
cctgctctctcaaataccaa

SEQ ID NO: 118361 - DNA, 20 bp, Artificial Sequence
  Description of Artificial Sequence: Synthetic oligonucleotide
  Target: ATXN1; (+) strand; PAM type: NRG; PAM sequence: AAG
gctctctcaaataccaaagg

SEQ ID NO: 118362 - DNA, 20 bp, Artificial Sequence
  Description of Artificial Sequence: Synthetic oligonucleotide
  Target: ATXN1; (+) strand; PAM type: NRG; PAM sequence: CAG
ctctcaaataccaaaggaag

SEQ ID NO: 118363 - DNA, 20 bp, Artificial Sequence
  Description of Artificial Sequence: Synthetic oligonucleotide
  Target: ATXN1; (+) strand; PAM type: NRG; PAM sequence: TGG
aaataccaaaggaagcagaa

SEQ ID NO: 118364 - DNA, 20 bp, Artificial Sequence
  Description of Artificial Sequence: Synthetic oligonucleotide
  Target: ATXN1; (+) strand; PAM type: NRG; PAM sequence: TGG
gcagaatggtttcactgttc

SEQ ID NO: 118365 - DNA, 20 bp, Artificial Sequence
  Description of Artificial Sequence: Synthetic oligonucleotide
  Target: ATXN1; (+) strand; PAM type: NRG; PAM sequence: AAG
gtttcactgttctggacctc

SEQ ID NO: 118366 - DNA, 20 bp, Artificial Sequence
  Description of Artificial Sequence: Synthetic oligonucleotide
  Target: ATXN1; (+) strand; PAM type: NRG; PAM sequence: AGG
tttcactgttctggacctca

SEQ ID NO: 118367 - DNA, 20 bp, Artificial Sequence
  Description of Artificial Sequence: Synthetic oligonucleotide
  Target: ATXN1; (+) strand; PAM type: NRG; PAM sequence: TGG
cttctgcgttcctctgcact

SEQ ID NO: 118368 - DNA, 20 bp, Artificial Sequence
  Description of Artificial Sequence: Synthetic oligonucleotide
  Target: ATXN1; (+) strand; PAM type: NRG; PAM sequence: CAG
ttcctctgcacttggactcc

SEQ ID NO: 118369 - DNA, 20 bp, Artificial Sequence
  Description of Artificial Sequence: Synthetic oligonucleotide
  Target: ATXN1; (+) strand; PAM type: NRG; PAM sequence: GAG
cccagtttctctttgccttt

SEQ ID NO: 118370 - DNA, 20 bp, Artificial Sequence
  Description of Artificial Sequence: Synthetic oligonucleotide
  Target: ATXN1; (+) strand; PAM type: NRG; PAM sequence: AGG
ccagtttctctttgcctttg

SEQ ID NO: 118371 - DNA, 20 bp, Artificial Sequence
  Description of Artificial Sequence: Synthetic oligonucleotide
  Target: ATXN1; (+) strand; PAM type: NRG; PAM sequence: CAG
ctttgcctttgaggatccca

SEQ ID NO: 118372 - DNA, 20 bp, Artificial Sequence
  Description of Artificial Sequence: Synthetic oligonucleotide
  Target: ATXN1; (+) strand; PAM type: NRG; PAM sequence: TGG
accacaaaacccaacttaca

SEQ ID NO: 118373 - DNA, 20 bp, Artificial Sequence
  Description of Artificial Sequence: Synthetic oligonucleotide
  Target: ATXN1; (+) strand; PAM type: NRG; PAM sequence: CGG
caaaacccaacttacatgga

SEQ ID NO: 118374 - DNA, 20 bp, Artificial Sequence
  Description of Artificial Sequence: Synthetic oligonucleotide
  Target: ATXN1; (+) strand; PAM type: NRG; PAM sequence: AAG
tacatggacggtcttgcctc

SEQ ID NO: 118375 - DNA, 20 bp, Artificial Sequence
  Description of Artificial Sequence: Synthetic oligonucleotide
  Target: ATXN1; (+) strand; PAM type: NRG; PAM sequence: AGG
acatggacggtcttgcctca

SEQ ID NO: 118376 - DNA, 20 bp, Artificial Sequence
  Description of Artificial Sequence: Synthetic oligonucleotide
  Target: ATXN1; (+) strand; PAM type: NRG; PAM sequence: GGG
catggacggtcttgcctcaa

SEQ ID NO: 118377 - DNA, 20 bp, Artificial Sequence
  Description of Artificial Sequence: Synthetic oligonucleotide
  Target: ATXN1; (+) strand; PAM type: NRG; PAM sequence: TAG
acggtcttgcctcaagggtt

SEQ ID NO: 118378 - DNA, 20 bp, Artificial Sequence
  Description of Artificial Sequence: Synthetic oligonucleotide
  Target: ATXN1; (+) strand; PAM type: NRG; PAM sequence: AGG
cggtcttgcctcaagggttt

SEQ ID NO: 118379 - DNA, 20 bp, Artificial Sequence
  Description of Artificial Sequence: Synthetic oligonucleotide
  Target: ATXN1; (+) strand; PAM type: NRG; PAM sequence: GGG
ggtcttgcctcaagggttta

SEQ ID NO: 118380 - DNA, 20 bp, Artificial Sequence
  Description of Artificial Sequence: Synthetic oligonucleotide
  Target: ATXN1; (+) strand; PAM type: NRG; PAM sequence: TAG
ttgcctcaagggtttaggga

SEQ ID NO: 118381 - DNA, 20 bp, Artificial Sequence
  Description of Artificial Sequence: Synthetic oligonucleotide
  Target: ATXN1; (+) strand; PAM type: NRG; PAM sequence: TGG
agggatagccctcatctgtt

SEQ ID NO: 118382 - DNA, 20 bp, Artificial Sequence
  Description of Artificial Sequence: Synthetic oligonucleotide
  Target: ATXN1; (+) strand; PAM type: NRG; PAM sequence: CAG
atagccctcatctgtttggt

SEQ ID NO: 118383 - DNA, 20 bp, Artificial Sequence
  Description of Artificial Sequence: Synthetic oligonucleotide
  Target: ATXN1; (+) strand; PAM type: NRG; PAM sequence: AGG
tagccctcatctgtttggtc

SEQ ID NO: 118384 - DNA, 20 bp, Artificial Sequence
  Description of Artificial Sequence: Synthetic oligonucleotide
  Target: ATXN1; (+) strand; PAM type: NRG; PAM sequence: AAG
gtttggtcaggcactgtccc

SEQ ID NO: 118385 - DNA, 20 bp, Artificial Sequence
  Description of Artificial Sequence: Synthetic oligonucleotide
  Target: ATXN1; (+) strand; PAM type: NRG; PAM sequence: TAG
tcaggcactgtcccaagatc

SEQ ID NO: 118386 - DNA, 20 bp, Artificial Sequence
  Description of Artificial Sequence: Synthetic oligonucleotide
  Target: ATXN1; (+) strand; PAM type: NRG; PAM sequence: AGG
caggcactgtcccaagatct

SEQ ID NO: 118387 - DNA, 20 bp, Artificial Sequence
  Description of Artificial Sequence: Synthetic oligonucleotide
  Target: ATXN1; (+) strand; PAM type: NRG; PAM sequence: AAG
caagatctaggccacttctc

SEQ ID NO: 118388 - DNA, 20 bp, Artificial Sequence
  Description of Artificial Sequence: Synthetic oligonucleotide
  Target: ATXN1; (+) strand; PAM type: NRG; PAM sequence: CAG
tctaggccacttctcaagtc

SEQ ID NO: 118389 - DNA, 20 bp, Artificial Sequence
  Description of Artificial Sequence: Synthetic oligonucleotide
  Target: ATXN1; (+) strand; PAM type: NRG; PAM sequence: AGG
ctaggccacttctcaagtcc

SEQ ID NO: 118390 - DNA, 20 bp, Artificial Sequence
  Description of Artificial Sequence: Synthetic oligonucleotide
  Target: ATXN1; (+) strand; PAM type: NRG; PAM sequence: TGG
cttctcaagtccaggcatgc

SEQ ID NO: 118391 - DNA, 20 bp, Artificial Sequence
  Description of Artificial Sequence: Synthetic oligonucleotide
  Target: ATXN1; (+) strand; PAM type: NRG; PAM sequence: CAG
gtccaggcatgctggtcctt

SEQ ID NO: 118392 - DNA, 20 bp, Artificial Sequence
  Description of Artificial Sequence: Synthetic oligonucleotide
  Target: ATXN1; (+) strand; PAM type: NRG; PAM sequence: TGG
catgctggtccttcagtatg

SEQ ID NO: 118393 - DNA, 20 bp, Artificial Sequence
  Description of Artificial Sequence: Synthetic oligonucleotide
  Target: ATXN1; (+) strand; PAM type: NRG; PAM sequence: TGG
gtatgtggatgatttacttt

SEQ ID NO: 118394 - DNA, 20 bp, Artificial Sequence
  Description of Artificial Sequence: Synthetic oligonucleotide
  Target: ATXN1; (+) strand; PAM type: NRG; PAM sequence: CAG
gatgatttacttttggctac

SEQ ID NO: 118395 - DNA, 20 bp, Artificial Sequence
  Description of Artificial Sequence: Synthetic oligonucleotide
  Target: ATXN1; (+) strand; PAM type: NRG; PAM sequence: CGG
tttacttttggctaccagtt

SEQ ID NO: 118396 - DNA, 20 bp, Artificial Sequence
  Description of Artificial Sequence: Synthetic oligonucleotide
  Target: ATXN1; (+) strand; PAM type: NRG; PAM sequence: AAG
acttttggctaccagttcgg

SEQ ID NO: 118397 - DNA, 20 bp, Artificial Sequence
  Description of Artificial Sequence: Synthetic oligonucleotide
  Target: ATXN1; (+) strand; PAM type: NRG; PAM sequence: CAG
ccagttcggaagcttcatgc

SEQ ID NO: 118398 - DNA, 20 bp, Artificial Sequence
  Description of Artificial Sequence: Synthetic oligonucleotide
  Target: ATXN1; (+) strand; PAM type: NRG; PAM sequence: CAG
gttcggaagcttcatgccag

SEQ ID NO: 118399 - DNA, 20 bp, Artificial Sequence
  Description of Artificial Sequence: Synthetic oligonucleotide
  Target: ATXN1; (+) strand; PAM type: NRG; PAM sequence: AGG
ttcggaagcttcatgccagc

SEQ ID NO: 118400 - DNA, 20 bp, Artificial Sequence
  Description of Artificial Sequence: Synthetic oligonucleotide
  Target: ATXN1; (+) strand; PAM type: NRG; PAM sequence: TAG
ttcatgccagcaggctactc

SEQ ID NO: 118401 - DNA, 20 bp, Artificial Sequence
  Description of Artificial Sequence: Synthetic oligonucleotide
  Target: ATXN1; (+) strand; PAM type: NRG; PAM sequence: TAG
tctagatctcttgaactttc

SEQ ID NO: 118402 - DNA, 20 bp, Artificial Sequence
  Description of Artificial Sequence: Synthetic oligonucleotide
  Target: ATXN1; (+) strand; PAM type: NRG; PAM sequence: AAG
cttgaactttctagctaatc

SEQ ID NO: 118403 - DNA, 20 bp, Artificial Sequence
  Description of Artificial Sequence: Synthetic oligonucleotide
  Target: ATXN1; (+) strand; PAM type: NRG; PAM sequence: AGG
ttgaactttctagctaatca

SEQ ID NO: 118404 - DNA, 20 bp, Artificial Sequence
  Description of Artificial Sequence: Synthetic oligonucleotide
  Target: ATXN1; (+) strand; PAM type: NRG; PAM sequence: GGG
tgaactttctagctaatcaa

SEQ ID NO: 118405 - DNA, 20 bp, Artificial Sequence
  Description of Artificial Sequence: Synthetic oligonucleotide
  Target: ATXN1; (+) strand; PAM type: NRG; PAM sequence: AAG
ttctagctaatcaagggtac

SEQ ID NO: 118406 - DNA, 20 bp, Artificial Sequence
  Description of Artificial Sequence: Synthetic oligonucleotide
  Target: ATXN1; (+) strand; PAM type: NRG; PAM sequence: AGG
tctagctaatcaagggtaca

SEQ ID NO: 118407 - DNA, 20 bp, Artificial Sequence
  Description of Artificial Sequence: Synthetic oligonucleotide
  Target: ATXN1; (+) strand; PAM type: NRG; PAM sequence: AAG
ggtacaaggcatctaaatcg

SEQ ID NO: 118408 - DNA, 20 bp, Artificial Sequence
  Description of Artificial Sequence: Synthetic oligonucleotide
  Target: ATXN1; (+) strand; PAM type: NRG; PAM sequence: AGG
gtacaaggcatctaaatcga

SEQ ID NO: 118409 - DNA, 20 bp, Artificial Sequence
  Description of Artificial Sequence: Synthetic oligonucleotide
  Target: ATXN1; (+) strand; PAM type: NRG; PAM sequence: CAG
aggcatctaaatcgaaggcc

SEQ ID NO: 118410 - DNA, 20 bp, Artificial Sequence
  Description of Artificial Sequence: Synthetic oligonucleotide
  Target: ATXN1; (+) strand; PAM type: NRG; PAM sequence: AAG
ggcccagctctgcctacaac

SEQ ID NO: 118411 - DNA, 20 bp, Artificial Sequence
  Description of Artificial Sequence: Synthetic oligonucleotide
  Target: ATXN1; (+) strand; PAM type: NRG; PAM sequence: AAG
ctacaacaagtcaaatatct

SEQ ID NO: 118412 - DNA, 20 bp, Artificial Sequence
  Description of Artificial Sequence: Synthetic oligonucleotide
  Target: ATXN1; (+) strand; PAM type: NRG; PAM sequence: TAG
caaatatctaagcctaatcc

SEQ ID NO: 118413 - DNA, 20 bp, Artificial Sequence
  Description of Artificial Sequence: Synthetic oligonucleotide
  Target: ATXN1; (+) strand; PAM type: NRG; PAM sequence: CAG
tatctaagcctaatcctagc

SEQ ID NO: 118414 - DNA, 20 bp, Artificial Sequence
  Description of Artificial Sequence: Synthetic oligonucleotide
  Target: ATXN1; (+) strand; PAM type: NRG; PAM sequence: GAG
tctaagcctaatcctagcca

SEQ ID NO: 118415 - DNA, 20 bp, Artificial Sequence
  Description of Artificial Sequence: Synthetic oligonucleotide
  Target: ATXN1; (+) strand; PAM type: NRG; PAM sequence: AGG
ctaagcctaatcctagccag

SEQ ID NO: 118416 - DNA, 20 bp, Artificial Sequence
  Description of Artificial Sequence: Synthetic oligonucleotide
  Target: ATXN1; (+) strand; PAM type: NRG; PAM sequence: CAG
ctaatcctagccagaggaac

SEQ ID NO: 118417 - DNA, 20 bp, Artificial Sequence
  Description of Artificial Sequence: Synthetic oligonucleotide
  Target: ATXN1; (+) strand; PAM type: NRG; PAM sequence: AGG
taatcctagccagaggaacc

SEQ ID NO: 118418 - DNA, 20 bp, Artificial Sequence
  Description of Artificial Sequence: Synthetic oligonucleotide
  Target: ATXN1; (+) strand; PAM type: NRG; PAM sequence: GGG
aatcctagccagaggaacca

SEQ ID NO: 118419 - DNA, 20 bp, Artificial Sequence
  Description of Artificial Sequence: Synthetic oligonucleotide
  Target: ATXN1; (+) strand; PAM type: NRG; PAM sequence: CAG
gccagaggaaccagggccct

SEQ ID NO: 118420 - DNA, 20 bp, Artificial Sequence
  Description of Artificial Sequence: Synthetic oligonucleotide
  Target: ATXN1; (+) strand; PAM type: NRG; PAM sequence: AAG
aggaaccagggccctcagca

SEQ ID NO: 118421 - DNA, 20 bp, Artificial Sequence
  Description of Artificial Sequence: Synthetic oligonucleotide
  Target: ATXN1; (+) strand; PAM type: NRG; PAM sequence: CAG
ccctcagcaaagaacaaata

SEQ ID NO: 118422 - DNA, 20 bp, Artificial Sequence
  Description of Artificial Sequence: Synthetic oligonucleotide
  Target: ATXN1; (+) strand; PAM type: NRG; PAM sequence: TGG
agaacaaatacagcctatac

SEQ ID NO: 118423 - DNA, 20 bp, Artificial Sequence
  Description of Artificial Sequence: Synthetic oligonucleotide
  Target: ATXN1; (+) strand; PAM type: NRG; PAM sequence: CAG
cttgccctaacacattaaaa

SEQ ID NO: 118424 - DNA, 20 bp, Artificial Sequence
  Description of Artificial Sequence: Synthetic oligonucleotide
  Target: ATXN1; (+) strand; PAM type: NRG; PAM sequence: TGG
ctaacacattaaaacagttg

SEQ ID NO: 118425 - DNA, 20 bp, Artificial Sequence
  Description of Artificial Sequence: Synthetic oligonucleotide
  Target: ATXN1; (+) strand; PAM type: NRG; PAM sequence: GGG
taacacattaaaacagttgt

SEQ ID NO: 118426 - DNA, 20 bp, Artificial Sequence
  Description of Artificial Sequence: Synthetic oligonucleotide
  Target: ATXN1; (+) strand; PAM type: NRG; PAM sequence: GGG
aacacattaaaacagttgtg

SEQ ID NO: 118427 - DNA, 20 bp, Artificial Sequence
  Description of Artificial Sequence: Synthetic oligonucleotide
  Target: ATXN1; (+) strand; PAM type: NRG; PAM sequence: GGG
acacattaaaacagttgtgg

SEQ ID NO: 118428 - DNA, 20 bp, Artificial Sequence
  Description of Artificial Sequence: Synthetic oligonucleotide
  Target: ATXN1; (+) strand; PAM type: NRG; PAM sequence: TGG
aaacagttgtgggggttcct

SEQ ID NO: 118429 - DNA, 20 bp, Artificial Sequence
  Description of Artificial Sequence: Synthetic oligonucleotide
  Target: ATXN1; (+) strand; PAM type: NRG; PAM sequence: GGG
aacagttgtgggggttcctt

SEQ ID NO: 118430 - DNA, 20 bp, Artificial Sequence
  Description of Artificial Sequence: Synthetic oligonucleotide
  Target: ATXN1; (+) strand; PAM type: NRG; PAM sequence: TGG
tgggggttccttgggatcac

SEQ ID NO: 118431 - DNA, 20 bp, Artificial Sequence
  Description of Artificial Sequence: Synthetic oligonucleotide
  Target: ATXN1; (+) strand; PAM type: NRG; PAM sequence: TGG
tcactggcttttaccgacta

SEQ ID NO: 118432 - DNA, 20 bp, Artificial Sequence
  Description of Artificial Sequence: Synthetic oligonucleotide
  Target: ATXN1; (+) strand; PAM type: NRG; PAM sequence: CGG
ttttaccgactatggatccc

SEQ ID NO: 118433 - DNA, 20 bp, Artificial Sequence
  Description of Artificial Sequence: Synthetic oligonucleotide
  Target: ATXN1; (+) strand; PAM type: NRG; PAM sequence: CAG
cgactatggatccccggata

SEQ ID NO: 118434 - DNA, 20 bp, Artificial Sequence
  Description of Artificial Sequence: Synthetic oligonucleotide
  Target: ATXN1; (+) strand; PAM type: NRG; PAM sequence: GAG
tatggatccccggatacagc

SEQ ID NO: 118435 - DNA, 20 bp, Artificial Sequence
  Description of Artificial Sequence: Synthetic oligonucleotide
  Target: ATXN1; (+) strand; PAM type: NRG; PAM sequence: TGG
gatccccggatacagcgaga

SEQ ID NO: 118436 - DNA, 20 bp, Artificial Sequence
  Description of Artificial Sequence: Synthetic oligonucleotide
  Target: ATXN1; (+) strand; PAM type: NRG; PAM sequence: CAG
cccggatacagcgagatggc

SEQ ID NO: 118437 - DNA, 20 bp, Artificial Sequence
  Description of Artificial Sequence: Synthetic oligonucleotide
  Target: ATXN1; (+) strand; PAM type: NRG; PAM sequence: AGG
ccggatacagcgagatggcc

SEQ ID NO: 118438 - DNA, 20 bp, Artificial Sequence
  Description of Artificial Sequence: Synthetic oligonucleotide
  Target: ATXN1; (+) strand; PAM type: NRG; PAM sequence: AAG
ggccactctatactctaatc

SEQ ID NO: 118439 - DNA, 20 bp, Artificial Sequence
  Description of Artificial Sequence: Synthetic oligonucleotide
  Target: ATXN1; (+) strand; PAM type: NRG; PAM sequence: AGG
gccactctatactctaatca

SEQ ID NO: 118440 - DNA, 20 bp, Artificial Sequence
  Description of Artificial Sequence: Synthetic oligonucleotide
  Target: ATXN1; (+) strand; PAM type: NRG; PAM sequence: GAG
cactctatactctaatcaag

SEQ ID NO: 118441 - DNA, 20 bp, Artificial Sequence
  Description of Artificial Sequence: Synthetic oligonucleotide
  Target: ATXN1; (+) strand; PAM type: NRG; PAM sequence: GAG
atactctaatcaaggagacc

SEQ ID NO: 118442 - DNA, 20 bp, Artificial Sequence
  Description of Artificial Sequence: Synthetic oligonucleotide
  Target: ATXN1; (+) strand; PAM type: NRG; PAM sequence: GAG
actctaatcaaggagaccga

SEQ ID NO: 118443 - DNA, 20 bp, Artificial Sequence
  Description of Artificial Sequence: Synthetic oligonucleotide
  Target: ATXN1; (+) strand; PAM type: NRG; PAM sequence: AGG
ctctaatcaaggagaccgag

SEQ ID NO: 118444 - DNA, 20 bp, Artificial Sequence
  Description of Artificial Sequence: Synthetic oligonucleotide
  Target: ATXN1; (+) strand; PAM type: NRG; PAM sequence: GGG
tctaatcaaggagaccgaga

SEQ ID NO: 118445 - DNA, 20 bp, Artificial Sequence
  Description of Artificial Sequence: Synthetic oligonucleotide
  Target: ATXN1; (+) strand; PAM type: NRG; PAM sequence: TAG
cgagagggcaaatattcatc

SEQ ID NO: 118446 - DNA, 20 bp, Artificial Sequence
  Description of Artificial Sequence: Synthetic oligonucleotide
  Target: ATXN1; (+) strand; PAM type: NRG; PAM sequence: TAG
gagggcaaatattcatctag

SEQ ID NO: 118447 - DNA, 20 bp, Artificial Sequence
  Description of Artificial Sequence: Synthetic oligonucleotide
  Target: ATXN1; (+) strand; PAM type: NRG; PAM sequence: TGG
caaatattcatctagtagaa

SEQ ID NO: 118448 - DNA, 20 bp, Artificial Sequence
  Description of Artificial Sequence: Synthetic oligonucleotide
  Target: ATXN1; (+) strand; PAM type: NRG; PAM sequence: GGG
aaatattcatctagtagaat

SEQ ID NO: 118449 - DNA, 20 bp, Artificial Sequence
  Description of Artificial Sequence: Synthetic oligonucleotide
  Target: ATXN1; (+) strand; PAM type: NRG; PAM sequence: CAG
tcatctagtagaatgggaac

SEQ ID NO: 118450 - DNA, 20 bp, Artificial Sequence
  Description of Artificial Sequence: Synthetic oligonucleotide
  Target: ATXN1; (+) strand; PAM type: NRG; PAM sequence: GAG
atctagtagaatgggaacca

SEQ ID NO: 118451 - DNA, 20 bp, Artificial Sequence
  Description of Artificial Sequence: Synthetic oligonucleotide
  Target: ATXN1; (+) strand; PAM type: NRG; PAM sequence: AGG
tctagtagaatgggaaccag

SEQ ID NO: 118452 - DNA, 20 bp, Artificial Sequence
  Description of Artificial Sequence: Synthetic oligonucleotide
  Target: ATXN1; (+) strand; PAM type: NRG; PAM sequence: CAG
agtagaatgggaaccagagg

SEQ ID NO: 118453 - DNA, 20 bp, Artificial Sequence
  Description of Artificial Sequence: Synthetic oligonucleotide
  Target: ATXN1; (+) strand; PAM type: NRG; PAM sequence: CAG
atgggaaccagaggcagaaa

SEQ ID NO: 118454 - DNA, 20 bp, Artificial Sequence
  Description of Artificial Sequence: Synthetic oligonucleotide
  Target: ATXN1; (+) strand; PAM type: NRG; PAM sequence: AAG
aaacagccttcaaaacctta

SEQ ID NO: 118455 - DNA, 20 bp, Artificial Sequence
  Description of Artificial Sequence: Synthetic oligonucleotide
  Target: ATXN1; (+) strand; PAM type: NRG; PAM sequence: CAG
cagccttcaaaaccttaaag

SEQ ID NO: 118456 - DNA, 20 bp, Artificial Sequence
  Description of Artificial Sequence: Synthetic oligonucleotide
  Target: ATXN1; (+) strand; PAM type: NRG; PAM sequence: AGG
agccttcaaaaccttaaagc

SEQ ID NO: 118457 - DNA, 20 bp, Artificial Sequence
  Description of Artificial Sequence: Synthetic oligonucleotide
  Target: ATXN1; (+) strand; PAM type: NRG; PAM sequence: TAG
caaaaccttaaagcaggccc

SEQ ID NO: 118458 - DNA, 20 bp, Artificial Sequence
  Description of Artificial Sequence: Synthetic oligonucleotide
  Target: ATXN1; (+) strand; PAM type: NRG; PAM sequence: AAG
gcaggccctagtacaaactc

SEQ ID NO: 118459 - DNA, 20 bp, Artificial Sequence
  Description of Artificial Sequence: Synthetic oligonucleotide
  Target: ATXN1; (+) strand; PAM type: NRG; PAM sequence: AAG
ctagtacaaactcaagactt

SEQ ID NO: 118460 - DNA, 20 bp, Artificial Sequence
  Description of Artificial Sequence: Synthetic oligonucleotide
  Target: ATXN1; (+) strand; PAM type: NRG; PAM sequence: CAG
ctcaagacttaagccttccc

SEQ ID NO: 118461 - DNA, 20 bp, Artificial Sequence
  Description of Artificial Sequence: Synthetic oligonucleotide
  Target: ATXN1; (+) strand; PAM type: NRG; PAM sequence: AGG
tcaagacttaagccttcccc

SEQ ID NO: 118462 - DNA, 20 bp, Artificial Sequence
  Description of Artificial Sequence: Synthetic oligonucleotide
  Target: ATXN1; (+) strand; PAM type: NRG; PAM sequence: CAG
aaacttctctttatacctca

SEQ ID NO: 118463 - DNA, 20 bp, Artificial Sequence
  Description of Artificial Sequence: Synthetic oligonucleotide
  Target: ATXN1; (+) strand; PAM type: NRG; PAM sequence: GAG
acttctctttatacctcaca

SEQ ID NO: 118464 - DNA, 20 bp, Artificial Sequence
  Description of Artificial Sequence: Synthetic oligonucleotide
  Target: ATXN1; (+) strand; PAM type: NRG; PAM sequence: GAG
ttctctttatacctcacaga

SEQ ID NO: 118465 - DNA, 20 bp, Artificial Sequence
  Description of Artificial Sequence: Synthetic oligonucleotide
  Target: ATXN1; (+) strand; PAM type: NRG; PAM sequence: GAG
ctctttatacctcacagaga

SEQ ID NO: 118466 - DNA, 20 bp, Artificial Sequence
  Description of Artificial Sequence: Synthetic oligonucleotide
  Target: ATXN1; (+) strand; PAM type: NRG; PAM sequence: CGG
tttatacctcacagagagag

SEQ ID NO: 118467 - DNA, 20 bp, Artificial Sequence
  Description of Artificial Sequence: Synthetic oligonucleotide
  Target: ATXN1; (+) strand; PAM type: NRG; PAM sequence: GGG
ttatacctcacagagagagc

SEQ ID NO: 118468 - DNA, 20 bp, Artificial Sequence
  Description of Artificial Sequence: Synthetic oligonucleotide
  Target: ATXN1; (+) strand; PAM type: NRG; PAM sequence: TAG
cctcacagagagagcgggaa

SEQ ID NO: 118469 - DNA, 20 bp, Artificial Sequence
  Description of Artificial Sequence: Synthetic oligonucleotide
  Target: ATXN1; (+) strand; PAM type: NRG; PAM sequence: TGG
gagagagcgggaatagctct

SEQ ID NO: 118470 - DNA, 20 bp, Artificial Sequence
  Description of Artificial Sequence: Synthetic oligonucleotide
  Target: ATXN1; (+) strand; PAM type: NRG; PAM sequence: GAG
gagagcgggaatagctcttg

SEQ ID NO: 118471 - DNA, 20 bp, Artificial Sequence
  Description of Artificial Sequence: Synthetic oligonucleotide
  Target: ATXN1; (+) strand; PAM type: NRG; PAM sequence: CAG
tagctcttggagtccttact

SEQ ID NO: 118472 - DNA, 20 bp, Artificial Sequence
  Description of Artificial Sequence: Synthetic oligonucleotide
  Target: ATXN1; (+) strand; PAM type: NRG; PAM sequence: TAG
ggagtccttactcagacttg

SEQ ID NO: 118473 - DNA, 20 bp, Artificial Sequence
  Description of Artificial Sequence: Synthetic oligonucleotide
  Target: ATXN1; (+) strand; PAM type: NRG; PAM sequence: AGG
gagtccttactcagacttgt

SEQ ID NO: 118474 - DNA, 20 bp, Artificial Sequence
  Description of Artificial Sequence: Synthetic oligonucleotide
  Target: ATXN1; (+) strand; PAM type: NRG; PAM sequence: CAG
ttgtaggacaaccccacaac

SEQ ID NO: 118475 - DNA, 20 bp, Artificial Sequence
  Description of Artificial Sequence: Synthetic oligonucleotide
  Target: ATXN1; (+) strand; PAM type: NRG; PAM sequence: AAG
aggacaaccccacaaccagt

SEQ ID NO: 118476 - DNA, 20 bp, Artificial Sequence
  Description of Artificial Sequence: Synthetic oligonucleotide
  Target: ATXN1; (+) strand; PAM type: NRG; PAM sequence: AGG
ggacaaccccacaaccagta

SEQ ID NO: 118477 - DNA, 20 bp, Artificial Sequence
  Description of Artificial Sequence: Synthetic oligonucleotide
  Target: ATXN1; (+) strand; PAM type: NRG; PAM sequence: AAG
caaccccacaaccagtaagg

SEQ ID NO: 118478 - DNA, 20 bp, Artificial Sequence
  Description of Artificial Sequence: Synthetic oligonucleotide
  Target: ATXN1; (+) strand; PAM type: NRG; PAM sequence: AGG
aaccccacaaccagtaagga

SEQ ID NO: 118479 - DNA, 20 bp, Artificial Sequence
  Description of Artificial Sequence: Synthetic oligonucleotide
  Target: ATXN1; (+) strand; PAM type: NRG; PAM sequence: AAG
aggaaggaaccccacaacct

SEQ ID NO: 118480 - DNA, 20 bp, Artificial Sequence
  Description of Artificial Sequence: Synthetic oligonucleotide
  Target: ATXN1; (+) strand; PAM type: NRG; PAM sequence: AAG
aggaaccccacaacctaagt

SEQ ID NO: 118481 - DNA, 20 bp, Artificial Sequence
  Description of Artificial Sequence: Synthetic oligonucleotide
  Target: ATXN1; (+) strand; PAM type: NRG; PAM sequence: AGG
ggaaccccacaacctaagta

SEQ ID NO: 118482 - DNA, 20 bp, Artificial Sequence
  Description of Artificial Sequence: Synthetic oligonucleotide
  Target: ATXN1; (+) strand; PAM type: NRG; PAM sequence: TAG
cctaagtaaggaaattgatg

SEQ ID NO: 118483 - DNA, 20 bp, Artificial Sequence
  Description of Artificial Sequence: Synthetic oligonucleotide
  Target: ATXN1; (+) strand; PAM type: NRG; PAM sequence: TAG
aagtaaggaaattgatgtag

SEQ ID NO: 118484 - DNA, 20 bp, Artificial Sequence
  Description of Artificial Sequence: Synthetic oligonucleotide
  Target: ATXN1; (+) strand; PAM type: NRG; PAM sequence: AAG
ggaaattgatgtagtagcaa

SEQ ID NO: 118485 - DNA, 20 bp, Artificial Sequence
  Description of Artificial Sequence: Synthetic oligonucleotide
  Target: ATXN1; (+) strand; PAM type: NRG; PAM sequence: AGG
gaaattgatgtagtagcaaa

SEQ ID NO: 118486 - DNA, 20 bp, Artificial Sequence
  Description of Artificial Sequence: Synthetic oligonucleotide
  Target: ATXN1; (+) strand; PAM type: NRG; PAM sequence: TGG
ttgatgtagtagcaaaaggc

SEQ ID NO: 118487 - DNA, 20 bp, Artificial Sequence
  Description of Artificial Sequence: Synthetic oligonucleotide
  Target: ATXN1; (+) strand; PAM type: NRG; PAM sequence: CGG
aaggctggcctcactgttta

SEQ ID NO: 118488 - DNA, 20 bp, Artificial Sequence
  Description of Artificial Sequence: Synthetic oligonucleotide
  Target: ATXN1; (+) strand; PAM type: NRG; PAM sequence: GGG
aggctggcctcactgtttac

SEQ ID NO: 118489 - DNA, 20 bp, Artificial Sequence
  Description of Artificial Sequence: Synthetic oligonucleotide
  Target: ATXN1; (+) strand; PAM type: NRG; PAM sequence: TAG
ctggcctcactgtttacggg

SEQ ID NO: 118490 - DNA, 20 bp, Artificial Sequence
  Description of Artificial Sequence: Synthetic oligonucleotide
  Target: ATXN1; (+) strand; PAM type: NRG; PAM sequence: TGG
tcactgtttacgggtagttg

SEQ ID NO: 118491 - DNA, 20 bp, Artificial Sequence
  Description of Artificial Sequence: Synthetic oligonucleotide
  Target: ATXN1; (+) strand; PAM type: NRG; PAM sequence: CAG
ctgtttacgggtagttgtgg

SEQ ID NO: 118492 - DNA, 20 bp, Artificial Sequence
  Description of Artificial Sequence: Synthetic oligonucleotide
  Target: ATXN1; (+) strand; PAM type: NRG; PAM sequence: TGG
tttacgggtagttgtggcag

SEQ ID NO: 118493 - DNA, 20 bp, Artificial Sequence
  Description of Artificial Sequence: Synthetic oligonucleotide
  Target: ATXN1; (+) strand; PAM type: NRG; PAM sequence: TAG
agttgtggcagtggctatct

SEQ ID NO: 118494 - DNA, 20 bp, Artificial Sequence
  Description of Artificial Sequence: Synthetic oligonucleotide
  Target: ATXN1; (+) strand; PAM type: NRG; PAM sequence: CAG
ggcagtggctatcttagtgt

SEQ ID NO: 118495 - DNA, 20 bp, Artificial Sequence
  Description of Artificial Sequence: Synthetic oligonucleotide
  Target: ATXN1; (+) strand; PAM type: NRG; PAM sequence: GAG
cagtggctatcttagtgtca

SEQ ID NO: 118496 - DNA, 20 bp, Artificial Sequence
  Description of Artificial Sequence: Synthetic oligonucleotide
  Target: ATXN1; (+) strand; PAM type: NRG; PAM sequence: AGG
agtggctatcttagtgtcag

SEQ ID NO: 118497 - DNA, 20 bp, Artificial Sequence
  Description of Artificial Sequence: Synthetic oligonucleotide
  Target: ATXN1; (+) strand; PAM type: NRG; PAM sequence: AAG
agaggctatcaaaataatac

SEQ ID NO: 118498 - DNA, 20 bp, Artificial Sequence
  Description of Artificial Sequence: Synthetic oligonucleotide
  Target: ATXN1; (+) strand; PAM type: NRG; PAM sequence: AGG
gaggctatcaaaataataca

SEQ ID NO: 118499 - DNA, 20 bp, Artificial Sequence
  Description of Artificial Sequence: Synthetic oligonucleotide
  Target: ATXN1; (+) strand; PAM type: NRG; PAM sequence: AAG
ctatcaaaataatacaagga

SEQ ID NO: 118500 - DNA, 20 bp, Artificial Sequence
  Description of Artificial Sequence: Synthetic oligonucleotide
  Target: ATXN1; (+) strand; PAM type: NRG; PAM sequence: AGG
tatcaaaataatacaaggaa

SEQ ID NO: 118501 - DNA, 20 bp, Artificial Sequence
  Description of Artificial Sequence: Synthetic oligonucleotide
  Target: ATXN1; (+) strand; PAM type: NRG; PAM sequence: TAG
aaggaaaggatctcaccatc

SEQ ID NO: 118502 - DNA, 20 bp, Artificial Sequence
  Description of Artificial Sequence: Synthetic oligonucleotide
  Target: ATXN1; (+) strand; PAM type: NRG; PAM sequence: TGG
tagactactcatgatgtaaa

SEQ ID NO: 118503 - DNA, 20 bp, Artificial Sequence
  Description of Artificial Sequence: Synthetic oligonucleotide
  Target: ATXN1; (+) strand; PAM type: NRG; PAM sequence: CAG
tcatgatgtaaatggcatac

SEQ ID NO: 118504 - DNA, 20 bp, Artificial Sequence
  Description of Artificial Sequence: Synthetic oligonucleotide
  Target: ATXN1; (+) strand; PAM type: NRG; PAM sequence: AGG
catgatgtaaatggcatacc

SEQ ID NO: 118505 - DNA, 20 bp, Artificial Sequence
  Description of Artificial Sequence: Synthetic oligonucleotide
  Target: ATXN1; (+) strand; PAM type: NRG; PAM sequence: AAG
aaatggcataccaggtgcca

SEQ ID NO: 118506 - DNA, 20 bp, Artificial Sequence
  Description of Artificial Sequence: Synthetic oligonucleotide
  Target: ATXN1; (+) strand; PAM type: NRG; PAM sequence: AGG
aatggcataccaggtgccaa

SEQ ID NO: 118507 - DNA, 20 bp, Artificial Sequence
  Description of Artificial Sequence: Synthetic oligonucleotide
  Target: ATXN1; (+) strand; PAM type: NRG; PAM sequence: TGG
caggtgccaaaggaaattta

SEQ ID NO: 118508 - DNA, 20 bp, Artificial Sequence
  Description of Artificial Sequence: Synthetic oligonucleotide
  Target: ATXN1; (+) strand; PAM type: NRG; PAM sequence: CAG
caaaggaaatttatggctat

SEQ ID NO: 118509 - DNA, 20 bp, Artificial Sequence
  Description of Artificial Sequence: Synthetic oligonucleotide
  Target: ATXN1; (+) strand; PAM type: NRG; PAM sequence: CAG
ctatcagaaaaccacctact

SEQ ID NO: 118510 - DNA, 20 bp, Artificial Sequence
  Description of Artificial Sequence: Synthetic oligonucleotide
  Target: ATXN1; (+) strand; PAM type: NRG; PAM sequence: AGG
tatcagaaaaccacctactc

SEQ ID NO: 118511 - DNA, 20 bp, Artificial Sequence
  Description of Artificial Sequence: Synthetic oligonucleotide
  Target: ATXN1; (+) strand; PAM type: NRG; PAM sequence: CAG
aaaaccacctactcaggtac

SEQ ID NO: 118512 - DNA, 20 bp, Artificial Sequence
  Description of Artificial Sequence: Synthetic oligonucleotide
  Target: ATXN1; (+) strand; PAM type: NRG; PAM sequence: AGG
aaaccacctactcaggtacc

SEQ ID NO: 118513 - DNA, 20 bp, Artificial Sequence
  Description of Artificial Sequence: Synthetic oligonucleotide
  Target: ATXN1; (+) strand; PAM type: NRG; PAM sequence: CAG
ggtaccaggcgctactcatt

SEQ ID NO: 118514 - DNA, 20 bp, Artificial Sequence
  Description of Artificial Sequence: Synthetic oligonucleotide
  Target: ATXN1; (+) strand; PAM type: NRG; PAM sequence: AGG
gtaccaggcgctactcattc

SEQ ID NO: 118515 - DNA, 20 bp, Artificial Sequence
  Description of Artificial Sequence: Synthetic oligonucleotide
  Target: ATXN1; (+) strand; PAM type: NRG; PAM sequence: GGG
taccaggcgctactcattca

SEQ ID NO: 118516 - DNA, 20 bp, Artificial Sequence
  Description of Artificial Sequence: Synthetic oligonucleotide
  Target: ATXN1; (+) strand; PAM type: NRG; PAM sequence: TGG
ggcgctactcattcagggac

SEQ ID NO: 118517 - DNA, 20 bp, Artificial Sequence
  Description of Artificial Sequence: Synthetic oligonucleotide
  Target: ATXN1; (+) strand; PAM type: NRG; PAM sequence: CAG
gcttgaaatacacacgtgtg

SEQ ID NO: 118518 - DNA, 20 bp, Artificial Sequence
  Description of Artificial Sequence: Synthetic oligonucleotide
  Target: ATXN1; (+) strand; PAM type: NRG; PAM sequence: CAG
caaccctgctacttttctcc

SEQ ID NO: 118519 - DNA, 20 bp, Artificial Sequence
  Description of Artificial Sequence: Synthetic oligonucleotide
  Target: ATXN1; (+) strand; PAM type: NRG; PAM sequence: GAG
accctgctacttttctccca

SEQ ID NO: 118520 - DNA, 20 bp, Artificial Sequence
  Description of Artificial Sequence: Synthetic oligonucleotide
  Target: ATXN1; (+) strand; PAM type: NRG; PAM sequence: AGG
ccctgctacttttctcccag

SEQ ID NO: 118521 - DNA, 20 bp, Artificial Sequence
  Description of Artificial Sequence: Synthetic oligonucleotide
  Target: ATXN1; (+) strand; PAM type: NRG; PAM sequence: TGG
gctacttttctcccagagga

SEQ ID NO: 118522 - DNA, 20 bp, Artificial Sequence
  Description of Artificial Sequence: Synthetic oligonucleotide
  Target: ATXN1; (+) strand; PAM type: NRG; PAM sequence: GAG
tacttttctcccagaggatg

SEQ ID NO: 118523 - DNA, 20 bp, Artificial Sequence
  Description of Artificial Sequence: Synthetic oligonucleotide
  Target: ATXN1; (+) strand; PAM type: NRG; PAM sequence: GAG
cagaggatggagaaccaatc

SEQ ID NO: 118524 - DNA, 20 bp, Artificial Sequence
  Description of Artificial Sequence: Synthetic oligonucleotide
  Target: ATXN1; (+) strand; PAM type: NRG; PAM sequence: TAG
gtatgactgccaacaaattg

SEQ ID NO: 118525 - DNA, 20 bp, Artificial Sequence
  Description of Artificial Sequence: Synthetic oligonucleotide
  Target: ATXN1; (+) strand; PAM type: NRG; PAM sequence: CAG
actgccaacaaattgtagcc

SEQ ID NO: 118526 - DNA, 20 bp, Artificial Sequence
  Description of Artificial Sequence: Synthetic oligonucleotide
  Target: ATXN1; (+) strand; PAM type: NRG; PAM sequence: CAG
cccagacttatgcttcccaa

SEQ ID NO: 118527 - DNA, 20 bp, Artificial Sequence
  Description of Artificial Sequence: Synthetic oligonucleotide
  Target: ATXN1; (+) strand; PAM type: NRG; PAM sequence: AGG
ccagacttatgcttcccaac

SEQ ID NO: 118528 - DNA, 20 bp, Artificial Sequence
  Description of Artificial Sequence: Synthetic oligonucleotide
  Target: ATXN1; (+) strand; PAM type: NRG; PAM sequence: TAG
tgcttcccaacaggatctct

SEQ ID NO: 118529 - DNA, 20 bp, Artificial Sequence
  Description of Artificial Sequence: Synthetic oligonucleotide
  Target: ATXN1; (+) strand; PAM type: NRG; PAM sequence: AAG
ttcccaacaggatctcttag

SEQ ID NO: 118530 - DNA, 20 bp, Artificial Sequence
  Description of Artificial Sequence: Synthetic oligonucleotide
  Target: ATXN1; (+) strand; PAM type: NRG; PAM sequence: TAG
ggatctcttagaagtaccct

SEQ ID NO: 118531 - DNA, 20 bp, Artificial Sequence
  Description of Artificial Sequence: Synthetic oligonucleotide
  Target: ATXN1; (+) strand; PAM type: NRG; PAM sequence: TGG
gaccttaacctatataccga

SEQ ID NO: 118532 - DNA, 20 bp, Artificial Sequence
  Description of Artificial Sequence: Synthetic oligonucleotide
  Target: ATXN1; (+) strand; PAM type: NRG; PAM sequence: AAG
cttaacctatataccgatgg

SEQ ID NO: 118533 - DNA, 20 bp, Artificial Sequence
  Description of Artificial Sequence: Synthetic oligonucleotide
  Target: ATXN1; (+) strand; PAM type: NRG; PAM sequence: TGG
taccgatggaagttcatttg

SEQ ID NO: 118534 - DNA, 20 bp, Artificial Sequence
  Description of Artificial Sequence: Synthetic oligonucleotide
  Target: ATXN1; (+) strand; PAM type: NRG; PAM sequence: GAG
ccgatggaagttcatttgtg

SEQ ID NO: 118535 - DNA, 20 bp, Artificial Sequence
  Description of Artificial Sequence: Synthetic oligonucleotide
  Target: ATXN1; (+) strand; PAM type: NRG; PAM sequence: TGG
ggaagttcatttgtggagaa

SEQ ID NO: 118536 - DNA, 20 bp, Artificial Sequence
  Description of Artificial Sequence: Synthetic oligonucleotide
  Target: ATXN1; (+) strand; PAM type: NRG; PAM sequence: GGG
gaagttcatttgtggagaat

SEQ ID NO: 118537 - DNA, 20 bp, Artificial Sequence
  Description of Artificial Sequence: Synthetic oligonucleotide
  Target: ATXN1; (+) strand; PAM type: NRG; PAM sequence: AAG
tttgtggagaatgggatatg

SEQ ID NO: 118538 - DNA, 20 bp, Artificial Sequence
  Description of Artificial Sequence: Synthetic oligonucleotide
  Target: ATXN1; (+) strand; PAM type: NRG; PAM sequence: AGG
ttgtggagaatgggatatga

SEQ ID NO: 118539 - DNA, 20 bp, Artificial Sequence
  Description of Artificial Sequence: Synthetic oligonucleotide
  Target: ATXN1; (+) strand; PAM type: NRG; PAM sequence: GGG
tgtggagaatgggatatgaa

SEQ ID NO: 118540 - DNA, 20 bp, Artificial Sequence
  Description of Artificial Sequence: Synthetic oligonucleotide
  Target: ATXN1; (+) strand; PAM type: NRG; PAM sequence: CAG
ggagaatgggatatgaaggg

SEQ ID NO: 118541 - DNA, 20 bp, Artificial Sequence
  Description of Artificial Sequence: Synthetic oligonucleotide
  Target: ATXN1; (+) strand; PAM type: NRG; PAM sequence: AGG
gagaatgggatatgaagggc

SEQ ID NO: 118542 - DNA, 20 bp, Artificial Sequence
  Description of Artificial Sequence: Synthetic oligonucleotide
  Target: ATXN1; (+) strand; PAM type: NRG; PAM sequence: TAG
atgaagggcaggttatgcca

SEQ ID NO: 118543 - DNA, 20 bp, Artificial Sequence
  Description of Artificial Sequence: Synthetic oligonucleotide
  Target: ATXN1; (+) strand; PAM type: NRG; PAM sequence: TAG
agggcaggttatgccatagt

SEQ ID NO: 118544 - DNA, 20 bp, Artificial Sequence
  Description of Artificial Sequence: Synthetic oligonucleotide
  Target: ATXN1; (+) strand; PAM type: NRG; PAM sequence: CAG
tgccatagttagtgatgtaa

SEQ ID NO: 118545 - DNA, 20 bp, Artificial Sequence
  Description of Artificial Sequence: Synthetic oligonucleotide
  Target: ATXN1; (+) strand; PAM type: NRG; PAM sequence: AAG
agtgatgtaacagtacttga

SEQ ID NO: 118546 - DNA, 20 bp, Artificial Sequence
  Description of Artificial Sequence: Synthetic oligonucleotide
  Target: ATXN1; (+) strand; PAM type: NRG; PAM sequence: AAG
atgtaacagtacttgaaagt

SEQ ID NO: 118547 - DNA, 20 bp, Artificial Sequence
  Description of Artificial Sequence: Synthetic oligonucleotide
  Target: ATXN1; (+) strand; PAM type: NRG; PAM sequence: CGG
aagtaagtctcttcccccca

SEQ ID NO: 118548 - DNA, 20 bp, Artificial Sequence
  Description of Artificial Sequence: Synthetic oligonucleotide
  Target: ATXN1; (+) strand; PAM type: NRG; PAM sequence: CAG
agtctcttccccccacggac

SEQ ID NO: 118549 - DNA, 20 bp, Artificial Sequence
  Description of Artificial Sequence: Synthetic oligonucleotide
  Target: ATXN1; (+) strand; PAM type: NRG; PAM sequence: TAG
tccccccacggaccagcgcc

SEQ ID NO: 118550 - DNA, 20 bp, Artificial Sequence
  Description of Artificial Sequence: Synthetic oligonucleotide
  Target: ATXN1; (+) strand; PAM type: NRG; PAM sequence: TAG
cccacggaccagcgcctagt

SEQ ID NO: 118551 - DNA, 20 bp, Artificial Sequence
  Description of Artificial Sequence: Synthetic oligonucleotide
  Target: ATXN1; (+) strand; PAM type: NRG; PAM sequence: CAG
acggaccagcgcctagttag

SEQ ID NO: 118552 - DNA, 20 bp, Artificial Sequence
  Description of Artificial Sequence: Synthetic oligonucleotide
  Target: ATXN1; (+) strand; PAM type: NRG; PAM sequence: AAG
ctagttagcagaacttaccc

SEQ ID NO: 118553 - DNA, 20 bp, Artificial Sequence
  Description of Artificial Sequence: Synthetic oligonucleotide
  Target: ATXN1; (+) strand; PAM type: NRG; PAM sequence: TAG
agcagaacttacccaagcct

SEQ ID NO: 118554 - DNA, 20 bp, Artificial Sequence
  Description of Artificial Sequence: Synthetic oligonucleotide
  Target: ATXN1; (+) strand; PAM type: NRG; PAM sequence: CGG
acttacccaagccttagaac

SEQ ID NO: 118555 - DNA, 20 bp, Artificial Sequence
  Description of Artificial Sequence: Synthetic oligonucleotide
  Target: ATXN1; (+) strand; PAM type: NRG; PAM sequence: GGG
cttacccaagccttagaacc

SEQ ID NO: 118556 - DNA, 20 bp, Artificial Sequence
  Description of Artificial Sequence: Synthetic oligonucleotide
  Target: ATXN1; (+) strand; PAM type: NRG; PAM sequence: AAG
cccaagccttagaaccggga

SEQ ID NO: 118557 - DNA, 20 bp, Artificial Sequence
  Description of Artificial Sequence: Synthetic oligonucleotide
  Target: ATXN1; (+) strand; PAM type: NRG; PAM sequence: AGG
ccaagccttagaaccgggaa

SEQ ID NO: 118558 - DNA, 20 bp, Artificial Sequence
  Description of Artificial Sequence: Synthetic oligonucleotide
  Target: ATXN1; (+) strand; PAM type: NRG; PAM sequence: AAG
ttagaaccgggaaaggaaaa

SEQ ID NO: 118559 - DNA, 20 bp, Artificial Sequence
  Description of Artificial Sequence: Synthetic oligonucleotide
  Target: ATXN1; (+) strand; PAM type: NRG; PAM sequence: CAG
aaaaagaataaatgtgtata

SEQ ID NO: 118560 - DNA, 20 bp, Artificial Sequence
  Description of Artificial Sequence: Synthetic oligonucleotide
  Target: ATXN1; (+) strand; PAM type: NRG; PAM sequence: TAG
agaataaatgtgtatacaga

SEQ ID NO: 118561 - DNA, 20 bp, Artificial Sequence
  Description of Artificial Sequence: Synthetic oligonucleotide
  Target: ATXN1; (+) strand; PAM type: NRG; PAM sequence: AAG
taaatgtgtatacagatagc

SEQ ID NO: 118562 - DNA, 20 bp, Artificial Sequence
  Description of Artificial Sequence: Synthetic oligonucleotide
  Target: ATXN1; (+) strand; PAM type: NRG; PAM sequence: TGG
tacatgcccatgctgcaata

SEQ ID NO: 118563 - DNA, 20 bp, Artificial Sequence
  Description of Artificial Sequence: Synthetic oligonucleotide
  Target: ATXN1; (+) strand; PAM type: NRG; PAM sequence: AAG
tgcccatgctgcaatatgga

SEQ ID NO: 118564 - DNA, 20 bp, Artificial Sequence
  Description of Artificial Sequence: Synthetic oligonucleotide
  Target: ATXN1; (+) strand; PAM type: NRG; PAM sequence: AAG
catgctgcaatatggaaaga

SEQ ID NO: 118565 - DNA, 20 bp, Artificial Sequence
  Description of Artificial Sequence: Synthetic oligonucleotide
  Target: ATXN1; (+) strand; PAM type: NRG; PAM sequence: AGG
atgctgcaatatggaaagaa

SEQ ID NO: 118566 - DNA, 20 bp, Artificial Sequence
  Description of Artificial Sequence: Synthetic oligonucleotide
  Target: ATXN1; (+) strand; PAM type: NRG; PAM sequence: GGG
tgctgcaatatggaaagaaa

SEQ ID NO: 118567 - DNA, 20 bp, Artificial Sequence
  Description of Artificial Sequence: Synthetic oligonucleotide
  Target: ATXN1; (+) strand; PAM type: NRG; PAM sequence: GAG
ctgcaatatggaaagaaagg

SEQ ID NO: 118568 - DNA, 20 bp, Artificial Sequence
  Description of Artificial Sequence: Synthetic oligonucleotide
  Target: ATXN1; (+) strand; PAM type: NRG; PAM sequence: TGG
gaaagggagttcctaacctc

SEQ ID NO: 118569 - DNA, 20 bp, Artificial Sequence
  Description of Artificial Sequence: Synthetic oligonucleotide
  Target: ATXN1; (+) strand; PAM type: NRG; PAM sequence: GGG
aaagggagttcctaacctct

SEQ ID NO: 118570 - DNA, 20 bp, Artificial Sequence
  Description of Artificial Sequence: Synthetic oligonucleotide
  Target: ATXN1; (+) strand; PAM type: NRG; PAM sequence: GGG
aagggagttcctaacctctg

SEQ ID NO: 118571 - DNA, 20 bp, Artificial Sequence
  Description of Artificial Sequence: Synthetic oligonucleotide
  Target: ATXN1; (+) strand; PAM type: NRG; PAM sequence: GGG
agggagttcctaacctctgg

SEQ ID NO: 118572 - DNA, 20 bp, Artificial Sequence
  Description of Artificial Sequence: Synthetic oligonucleotide
  Target: ATXN1; (+) strand; PAM type: NRG; PAM sequence: AAG
gaacccccattaaataccac

SEQ ID NO: 118573 - DNA, 20 bp, Artificial Sequence
  Description of Artificial Sequence: Synthetic oligonucleotide
  Target: ATXN1; (+) strand; PAM type: NRG; PAM sequence: AGG
aacccccattaaataccaca

SEQ ID NO: 118574 - DNA, 20 bp, Artificial Sequence
  Description of Artificial Sequence: Synthetic oligonucleotide
  Target: ATXN1; (+) strand; PAM type: NRG; PAM sequence: TGG
taaataccacaaggaaatta

SEQ ID NO: 118575 - DNA, 20 bp, Artificial Sequence
  Description of Artificial Sequence: Synthetic oligonucleotide
  Target: ATXN1; (+) strand; PAM type: NRG; PAM sequence: GAG
aataccacaaggaaattatg

SEQ ID NO: 118576 - DNA, 20 bp, Artificial Sequence
  Description of Artificial Sequence: Synthetic oligonucleotide
  Target: ATXN1; (+) strand; PAM type: NRG; PAM sequence: CAG
aattatggagttattgcaca

SEQ ID NO: 118577 - DNA, 20 bp, Artificial Sequence
  Description of Artificial Sequence: Synthetic oligonucleotide
  Target: ATXN1; (+) strand; PAM type: NRG; PAM sequence: AAG
tgcacacagtgcaaaaaccc

SEQ ID NO: 118578 - DNA, 20 bp, Artificial Sequence
  Description of Artificial Sequence: Synthetic oligonucleotide
  Target: ATXN1; (+) strand; PAM type: NRG; PAM sequence: AGG
gcacacagtgcaaaaaccca

SEQ ID NO: 118579 - DNA, 20 bp, Artificial Sequence
  Description of Artificial Sequence: Synthetic oligonucleotide
  Target: ATXN1; (+) strand; PAM type: NRG; PAM sequence: GAG
acacagtgcaaaaacccaag

SEQ ID NO: 118580 - DNA, 20 bp, Artificial Sequence
  Description of Artificial Sequence: Synthetic oligonucleotide
  Target: ATXN1; (+) strand; PAM type: NRG; PAM sequence: AGG
cacagtgcaaaaacccaagg

SEQ ID NO: 118581 - DNA, 20 bp, Artificial Sequence
  Description of Artificial Sequence: Synthetic oligonucleotide
  Target: ATXN1; (+) strand; PAM type: NRG; PAM sequence: TGG
agtgcaaaaacccaaggagg

SEQ ID NO: 118582 - DNA, 20 bp, Artificial Sequence
  Description of Artificial Sequence: Synthetic oligonucleotide
  Target: ATXN1; (+) strand; PAM type: NRG; PAM sequence: CAG
gcaaaaacccaaggaggtgg

SEQ ID NO: 118583 - DNA, 20 bp, Artificial Sequence
  Description of Artificial Sequence: Synthetic oligonucleotide
  Target: ATXN1; (+) strand; PAM type: NRG; PAM sequence: AAG
gtggcagtgttacactgctg

SEQ ID NO: 118584 - DNA, 20 bp, Artificial Sequence
  Description of Artificial Sequence: Synthetic oligonucleotide
  Target: ATXN1; (+) strand; PAM type: NRG; PAM sequence: AAG
acactgctgaagccatcaaa

SEQ ID NO: 118585 - DNA, 20 bp, Artificial Sequence
  Description of Artificial Sequence: Synthetic oligonucleotide
  Target: ATXN1; (+) strand; PAM type: NRG; PAM sequence: AGG
cactgctgaagccatcaaaa

SEQ ID NO: 118586 - DNA, 20 bp, Artificial Sequence
  Description of Artificial Sequence: Synthetic oligonucleotide
  Target: ATXN1; (+) strand; PAM type: NRG; PAM sequence: AAG
ctgaagccatcaaaaaggtg

SEQ ID NO: 118587 - DNA, 20 bp, Artificial Sequence
  Description of Artificial Sequence: Synthetic oligonucleotide
  Target: ATXN1; (+) strand; PAM type: NRG; PAM sequence: AGG
tgaagccatcaaaaaggtga

SEQ ID NO: 118588 - DNA, 20 bp, Artificial Sequence
  Description of Artificial Sequence: Synthetic oligonucleotide
  Target: ATXN1; (+) strand; PAM type: NRG; PAM sequence: GAG
aagccatcaaaaaggtgaag

SEQ ID NO: 118589 - DNA, 20 bp, Artificial Sequence
  Description of Artificial Sequence: Synthetic oligonucleotide
  Target: ATXN1; (+) strand; PAM type: NRG; PAM sequence: AAG
atcaaaaaggtgaaggagaa

SEQ ID NO: 118590 - DNA, 20 bp, Artificial Sequence
  Description of Artificial Sequence: Synthetic oligonucleotide
  Target: ATXN1; (+) strand; PAM type: NRG; PAM sequence: AGG
tcaaaaaggtgaaggagaaa

SEQ ID NO: 118591 - DNA, 20 bp, Artificial Sequence
  Description of Artificial Sequence: Synthetic oligonucleotide
  Target: ATXN1; (+) strand; PAM type: NRG; PAM sequence: CAG
aaaaggtgaaggagaaaagg

SEQ ID NO: 118592 - DNA, 20 bp, Artificial Sequence
  Description of Artificial Sequence: Synthetic oligonucleotide
  Target: ATXN1; (+) strand; PAM type: NRG; PAM sequence: AAG
aggtgaaggagaaaaggcag

SEQ ID NO: 118593 - DNA, 20 bp, Artificial Sequence
  Description of Artificial Sequence: Synthetic oligonucleotide
  Target: ATXN1; (+) strand; PAM type: NRG; PAM sequence: AGG
ggtgaaggagaaaaggcaga

SEQ ID NO: 118594 - DNA, 20 bp, Artificial Sequence
  Description of Artificial Sequence: Synthetic oligonucleotide
  Target: ATXN1; (+) strand; PAM type: NRG; PAM sequence: TGG
aaaaggcagaaggaaaccac

SEQ ID NO: 118595 - DNA, 20 bp, Artificial Sequence
  Description of Artificial Sequence: Synthetic oligonucleotide
  Target: ATXN1; (+) strand; PAM type: NRG; PAM sequence: GGG
aaaggcagaaggaaaccact

SEQ ID NO: 118596 - DNA, 20 bp, Artificial Sequence
  Description of Artificial Sequence: Synthetic oligonucleotide
  Target: ATXN1; (+) strand; PAM type: NRG; PAM sequence: CAG
ggcagaaggaaaccactggg

SEQ ID NO: 118597 - DNA, 20 bp, Artificial Sequence
  Description of Artificial Sequence: Synthetic oligonucleotide
  Target: ATXN1; (+) strand; PAM type: NRG; PAM sequence: GAG
gaaaccactgggcagatgct

SEQ ID NO: 118598 - DNA, 20 bp, Artificial Sequence
  Description of Artificial Sequence: Synthetic oligonucleotide
  Target: ATXN1; (+) strand; PAM type: NRG; PAM sequence: AGG
aaaccactgggcagatgctg

SEQ ID NO: 118599 - DNA, 20 bp, Artificial Sequence
  Description of Artificial Sequence: Synthetic oligonucleotide
  Target: ATXN1; (+) strand; PAM type: NRG; PAM sequence: CAG
gctgaggccaaaattgctgc

SEQ ID NO: 118600 - DNA, 20 bp, Artificial Sequence
  Description of Artificial Sequence: Synthetic oligonucleotide
  Target: ATXN1; (+) strand; PAM type: NRG; PAM sequence: AGG
ctgaggccaaaattgctgcc

SEQ ID NO: 118601 - DNA, 20 bp, Artificial Sequence
  Description of Artificial Sequence: Synthetic oligonucleotide
  Target: ATXN1; (+) strand; PAM type: NRG; PAM sequence: CAG
aggccaaaattgctgccagg

SEQ ID NO: 118602 - DNA, 20 bp, Artificial Sequence
  Description of Artificial Sequence: Synthetic oligonucleotide
  Target: ATXN1; (+) strand; PAM type: NRG; PAM sequence: TAG
tgccaggcagaacctcccat

SEQ ID NO: 118603 - DNA, 20 bp, Artificial Sequence
  Description of Artificial Sequence: Synthetic oligonucleotide
  Target: ATXN1; (+) strand; PAM type: NRG; PAM sequence: TGG
cctcccattagaaataccta

SEQ ID NO: 118604 - DNA, 20 bp, Artificial Sequence
  Description of Artificial Sequence: Synthetic oligonucleotide
  Target: ATXN1; (+) strand; PAM type: NRG; PAM sequence: AAG
cccattagaaatacctatgg

SEQ ID NO: 118605 - DNA, 20 bp, Artificial Sequence
  Description of Artificial Sequence: Synthetic oligonucleotide
  Target: ATXN1; (+) strand; PAM type: NRG; PAM sequence: AGG
ccattagaaatacctatgga

SEQ ID NO: 118606 - DNA, 20 bp, Artificial Sequence
  Description of Artificial Sequence: Synthetic oligonucleotide
  Target: ATXN1; (+) strand; PAM type: NRG; PAM sequence: TGG
aatacctatggaaggaccca

SEQ ID NO: 118607 - DNA, 20 bp, Artificial Sequence
  Description of Artificial Sequence: Synthetic oligonucleotide
  Target: ATXN1; (+) strand; PAM type: NRG; PAM sequence: TGG
ctatggaaggacccatggta

SEQ ID NO: 118608 - DNA, 20 bp, Artificial Sequence
  Description of Artificial Sequence: Synthetic oligonucleotide
  Target: ATXN1; (+) strand; PAM type: NRG; PAM sequence: AAG
ggtatggaacaaccccctcc

SEQ ID NO: 118609 - DNA, 20 bp, Artificial Sequence
  Description of Artificial Sequence: Synthetic oligonucleotide
  Target: ATXN1; (+) strand; PAM type: NRG; PAM sequence: GAG
tatggaacaaccccctccaa

SEQ ID NO: 118610 - DNA, 20 bp, Artificial Sequence
  Description of Artificial Sequence: Synthetic oligonucleotide
  Target: ATXN1; (+) strand; PAM type: NRG; PAM sequence: AAG
acaaccccctccaagagatt

SEQ ID NO: 118611 - DNA, 20 bp, Artificial Sequence
  Description of Artificial Sequence: Synthetic oligonucleotide
  Target: ATXN1; (+) strand; PAM type: NRG; PAM sequence: CAG
ccctccaagagattaagccc

SEQ ID NO: 118612 - DNA, 20 bp, Artificial Sequence
  Description of Artificial Sequence: Synthetic oligonucleotide
  Target: ATXN1; (+) strand; PAM type: NRG; PAM sequence: CAG
ccagtactccctgatcgaaa

SEQ ID NO: 118613 - DNA, 20 bp, Artificial Sequence
  Description of Artificial Sequence: Synthetic oligonucleotide
  Target: ATXN1; (+) strand; PAM type: NRG; PAM sequence: TGG
actccctgatcgaaacagaa

SEQ ID NO: 118614 - DNA, 20 bp, Artificial Sequence
  Description of Artificial Sequence: Synthetic oligonucleotide
  Target: ATXN1; (+) strand; PAM type: NRG; PAM sequence: GGG
ctccctgatcgaaacagaat

SEQ ID NO: 118615 - DNA, 20 bp, Artificial Sequence
  Description of Artificial Sequence: Synthetic oligonucleotide
  Target: ATXN1; (+) strand; PAM type: NRG; PAM sequence: GGG
tccctgatcgaaacagaatg

SEQ ID NO: 118616 - DNA, 20 bp, Artificial Sequence
  Description of Artificial Sequence: Synthetic oligonucleotide
  Target: ATXN1; (+) strand; PAM type: NRG; PAM sequence: CGG
aaacagaatggggactttca

SEQ ID NO: 118617 - DNA, 20 bp, Artificial Sequence
  Description of Artificial Sequence: Synthetic oligonucleotide
  Target: ATXN1; (+) strand; PAM type: NRG; PAM sequence: GGG
aacagaatggggactttcac

SEQ ID NO: 118618 - DNA, 20 bp, Artificial Sequence
  Description of Artificial Sequence: Synthetic oligonucleotide
  Target: ATXN1; (+) strand; PAM type: NRG; PAM sequence: GGG
acagaatggggactttcacg

SEQ ID NO: 118619 - DNA, 20 bp, Artificial Sequence
  Description of Artificial Sequence: Synthetic oligonucleotide
  Target: ATXN1; (+) strand; PAM type: NRG; PAM sequence: GGG
cagaatggggactttcacgg

SEQ ID NO: 118620 - DNA, 20 bp, Artificial Sequence
  Description of Artificial Sequence: Synthetic oligonucleotide
  Target: ATXN1; (+) strand; PAM type: NRG; PAM sequence: TAG
tggggactttcacgggggca

SEQ ID NO: 118621 - DNA, 20 bp, Artificial Sequence
  Description of Artificial Sequence: Synthetic oligonucleotide
  Target: ATXN1; (+) strand; PAM type: NRG; PAM sequence: TGG
ggggcatagttttctcccct

SEQ ID NO: 118622 - DNA, 20 bp, Artificial Sequence
  Description of Artificial Sequence: Synthetic oligonucleotide
  Target: ATXN1; (+) strand; PAM type: NRG; PAM sequence: GGG
gggcatagttttctcccctt

SEQ ID NO: 118623 - DNA, 20 bp, Artificial Sequence
  Description of Artificial Sequence: Synthetic oligonucleotide
  Target: ATXN1; (+) strand; PAM type: NRG; PAM sequence: GGG
ggcatagttttctccccttg

SEQ ID NO: 118624 - DNA, 20 bp, Artificial Sequence
  Description of Artificial Sequence: Synthetic oligonucleotide
  Target: ATXN1; (+) strand; PAM type: NRG; PAM sequence: TGG
atagttttctccccttgggg

SEQ ID NO: 118625 - DNA, 20 bp, Artificial Sequence
  Description of Artificial Sequence: Synthetic oligonucleotide
  Target: ATXN1; (+) strand; PAM type: NRG; PAM sequence: CGG
tctccccttggggtggttaa

SEQ ID NO: 118626 - DNA, 20 bp, Artificial Sequence
  Description of Artificial Sequence: Synthetic oligonucleotide
  Target: ATXN1; (+) strand; PAM type: NRG; PAM sequence: CAG
ccccttggggtggttaacgg

SEQ ID NO: 118627 - DNA, 20 bp, Artificial Sequence
  Description of Artificial Sequence: Synthetic oligonucleotide
  Target: ATXN1; (+) strand; PAM type: NRG; PAM sequence: AAG
cttggggtggttaacggcag

SEQ ID NO: 118628 - DNA, 20 bp, Artificial Sequence
  Description of Artificial Sequence: Synthetic oligonucleotide
  Target: ATXN1; (+) strand; PAM type: NRG; PAM sequence: GAG
tggggtggttaacggcagaa

SEQ ID NO: 118629 - DNA, 20 bp, Artificial Sequence
  Description of Artificial Sequence: Synthetic oligonucleotide
  Target: ATXN1; (+) strand; PAM type: NRG; PAM sequence: AGG
ggggtggttaacggcagaag

SEQ ID NO: 118630 - DNA, 20 bp, Artificial Sequence
  Description of Artificial Sequence: Synthetic oligonucleotide
  Target: ATXN1; (+) strand; PAM type: NRG; PAM sequence: GGG
gggtggttaacggcagaaga

SEQ ID NO: 118631 - DNA, 20 bp, Artificial Sequence
  Description of Artificial Sequence: Synthetic oligonucleotide
  Target: ATXN1; (+) strand; PAM type: NRG; PAM sequence: AAG
ggttaacggcagaagaggga

SEQ ID NO: 118632 - DNA, 20 bp, Artificial Sequence
  Description of Artificial Sequence: Synthetic oligonucleotide
  Target: ATXN1; (+) strand; PAM type: NRG; PAM sequence: AGG
gttaacggcagaagagggaa

SEQ ID NO: 118633 - DNA, 20 bp, Artificial Sequence
  Description of Artificial Sequence: Synthetic oligonucleotide
  Target: ATXN1; (+) strand; PAM type: NRG; PAM sequence: AAG
gggaaaggtactcatatccg

SEQ ID NO: 118634 - DNA, 20 bp, Artificial Sequence
  Description of Artificial Sequence: Synthetic oligonucleotide
  Target: ATXN1; (+) strand; PAM type: NRG; PAM sequence: CAG
aaggtactcatatccgaagc

SEQ ID NO: 118635 - DNA, 20 bp, Artificial Sequence
  Description of Artificial Sequence: Synthetic oligonucleotide
  Target: ATXN1; (+) strand; PAM type: NRG; PAM sequence: CAG
tactcatatccgaagccagc

SEQ ID NO: 118636 - DNA, 20 bp, Artificial Sequence
  Description of Artificial Sequence: Synthetic oligonucleotide
  Target: ATXN1; (+) strand; PAM type: NRG; PAM sequence: TGG
tcatatccgaagccagccag

SEQ ID NO: 118637 - DNA, 20 bp, Artificial Sequence
  Description of Artificial Sequence: Synthetic oligonucleotide
  Target: ATXN1; (+) strand; PAM type: NRG; PAM sequence: AAG
ccagccagtggaaaatactt

SEQ ID NO: 118638 - DNA, 20 bp, Artificial Sequence
  Description of Artificial Sequence: Synthetic oligonucleotide
  Target: ATXN1; (+) strand; PAM type: NRG; PAM sequence: TGG
cccctgccaaacttttcaca

SEQ ID NO: 118639 - DNA, 20 bp, Artificial Sequence
  Description of Artificial Sequence: Synthetic oligonucleotide
  Target: ATXN1; (+) strand; PAM type: NRG; PAM sequence: GGG
ccctgccaaacttttcacat

SEQ ID NO: 118640 - DNA, 20 bp, Artificial Sequence
  Description of Artificial Sequence: Synthetic oligonucleotide
  Target: ATXN1; (+) strand; PAM type: NRG; PAM sequence: GAG
caaacttttcacatgggttt

SEQ ID NO: 118641 - DNA, 20 bp, Artificial Sequence
  Description of Artificial Sequence: Synthetic oligonucleotide
  Target: ATXN1; (+) strand; PAM type: NRG; PAM sequence: TGG
gtttgagaacactcatcaaa

SEQ ID NO: 118642 - DNA, 20 bp, Artificial Sequence
  Description of Artificial Sequence: Synthetic oligonucleotide
  Target: ATXN1; (+) strand; PAM type: NRG; PAM sequence: TGG
aatggccaaatccctattta

SEQ ID NO: 118643 - DNA, 20 bp, Artificial Sequence
  Description of Artificial Sequence: Synthetic oligonucleotide
  Target: ATXN1; (+) strand; PAM type: NRG; PAM sequence: GGG
atggccaaatccctatttat

SEQ ID NO: 118644 - DNA, 20 bp, Artificial Sequence
  Description of Artificial Sequence: Synthetic oligonucleotide
  Target: ATXN1; (+) strand; PAM type: NRG; PAM sequence: GGG
tggccaaatccctatttatg

SEQ ID NO: 118645 - DNA, 20 bp, Artificial Sequence
  Description of Artificial Sequence: Synthetic oligonucleotide
  Target: ATXN1; (+) strand; PAM type: NRG; PAM sequence: CAG
ttatggggccatatctcctc

SEQ ID NO: 118646 - DNA, 20 bp, Artificial Sequence
  Description of Artificial Sequence: Synthetic oligonucleotide
  Target: ATXN1; (+) strand; PAM type: NRG; PAM sequence: AAG
tctcctccagaccatccaac

SEQ ID NO: 118647 - DNA, 20 bp, Artificial Sequence
  Description of Artificial Sequence: Synthetic oligonucleotide
  Target: ATXN1; (+) strand; PAM type: NRG; PAM sequence: TAG
cctccagaccatccaacaag

SEQ ID NO: 118648 - DNA, 20 bp, Artificial Sequence
  Description of Artificial Sequence: Synthetic oligonucleotide
  Target: ATXN1; (+) strand; PAM type: NRG; PAM sequence: AAG
gaccatccaacaagtagtca

SEQ ID NO: 118649 - DNA, 20 bp, Artificial Sequence
  Description of Artificial Sequence: Synthetic oligonucleotide
  Target: ATXN1; (+) strand; PAM type: NRG; PAM sequence: GAG
aacaagtagtcaaagcctgt

SEQ ID NO: 118650 - DNA, 20 bp, Artificial Sequence
  Description of Artificial Sequence: Synthetic oligonucleotide
  Target: ATXN1; (+) strand; PAM type: NRG; PAM sequence: AGG
acaagtagtcaaagcctgtg

SEQ ID NO: 118651 - DNA, 20 bp, Artificial Sequence
  Description of Artificial Sequence: Synthetic oligonucleotide
  Target: ATXN1; (+) strand; PAM type: NRG; PAM sequence: AAG
aaagcctgtgaggtgtgcca

SEQ ID NO: 118652 - DNA, 20 bp, Artificial Sequence
  Description of Artificial Sequence: Synthetic oligonucleotide
  Target: ATXN1; (+) strand; PAM type: NRG; PAM sequence: AGG
aagcctgtgaggtgtgccaa

SEQ ID NO: 118653 - DNA, 20 bp, Artificial Sequence
  Description of Artificial Sequence: Synthetic oligonucleotide
  Target: ATXN1; (+) strand; PAM type: NRG; PAM sequence: TGG
gtgccaaaggaaaaatctct

SEQ ID NO: 118654 - DNA, 20 bp, Artificial Sequence
  Description of Artificial Sequence: Synthetic oligonucleotide
  Target: ATXN1; (+) strand; PAM type: NRG; PAM sequence: AAG
aaaatctcttggtccatcgt

SEQ ID NO: 118655 - DNA, 20 bp, Artificial Sequence
  Description of Artificial Sequence: Synthetic oligonucleotide
  Target: ATXN1; (+) strand; PAM type: NRG; PAM sequence: AGG
aaatctcttggtccatcgta

SEQ ID NO: 118656 - DNA, 20 bp, Artificial Sequence
  Description of Artificial Sequence: Synthetic oligonucleotide
  Target: ATXN1; (+) strand; PAM type: NRG; PAM sequence: TGG
gtccatcgtaaggccccttt

SEQ ID NO: 118657 - DNA, 20 bp, Artificial Sequence
  Description of Artificial Sequence: Synthetic oligonucleotide
  Target: ATXN1; (+) strand; PAM type: NRG; PAM sequence: GGG
tccatcgtaaggcccctttt

SEQ ID NO: 118658 - DNA, 20 bp, Artificial Sequence
  Description of Artificial Sequence: Synthetic oligonucleotide
  Target: ATXN1; (+) strand; PAM type: NRG; PAM sequence: GGG
ccatcgtaaggccccttttg

SEQ ID NO: 118659 - DNA, 20 bp, Artificial Sequence
  Description of Artificial Sequence: Synthetic oligonucleotide
  Target: ATXN1; (+) strand; PAM type: NRG; PAM sequence: AAG
aaggccccttttggggaaca

SEQ ID NO: 118660 - DNA, 20 bp, Artificial Sequence
  Description of Artificial Sequence: Synthetic oligonucleotide
  Target: ATXN1; (+) strand; PAM type: NRG; PAM sequence: TAG
cccttttggggaacaaagaa

SEQ ID NO: 118661 - DNA, 20 bp, Artificial Sequence
  Description of Artificial Sequence: Synthetic oligonucleotide
  Target: ATXN1; (+) strand; PAM type: NRG; PAM sequence: AGG
ccttttggggaacaaagaat

SEQ ID NO: 118662 - DNA, 20 bp, Artificial Sequence
  Description of Artificial Sequence: Synthetic oligonucleotide
  Target: ATXN1; (+) strand; PAM type: NRG; PAM sequence: TGG
caaagaataggtcactatcc

SEQ ID NO: 118663 - DNA, 20 bp, Artificial Sequence
  Description of Artificial Sequence: Synthetic oligonucleotide
  Target: ATXN1; (+) strand; PAM type: NRG; PAM sequence: GAG
aagaataggtcactatcctg

SEQ ID NO: 118664 - DNA, 20 bp, Artificial Sequence
  Description of Artificial Sequence: Synthetic oligonucleotide
  Target: ATXN1; (+) strand; PAM type: NRG; PAM sequence: GAG
gaataggtcactatcctgga

SEQ ID NO: 118665 - DNA, 20 bp, Artificial Sequence
  Description of Artificial Sequence: Synthetic oligonucleotide
  Target: ATXN1; (+) strand; PAM type: NRG; PAM sequence: AGG
aataggtcactatcctggag

SEQ ID NO: 118666 - DNA, 20 bp, Artificial Sequence
  Description of Artificial Sequence: Synthetic oligonucleotide
  Target: ATXN1; (+) strand; PAM type: NRG; PAM sequence: TGG
gtcactatcctggagaggac

SEQ ID NO: 118667 - DNA, 20 bp, Artificial Sequence
  Description of Artificial Sequence: Synthetic oligonucleotide
  Target: ATXN1; (+) strand; PAM type: NRG; PAM sequence: CAG
actatcctggagaggactgg

SEQ ID NO: 118668 - DNA, 20 bp, Artificial Sequence
  Description of Artificial Sequence: Synthetic oligonucleotide
  Target: ATXN1; (+) strand; PAM type: NRG; PAM sequence: TAG
tcctggagaggactggcagt

SEQ ID NO: 118669 - DNA, 20 bp, Artificial Sequence
  Description of Artificial Sequence: Synthetic oligonucleotide
  Target: ATXN1; (+) strand; PAM type: NRG; PAM sequence: AAG
tagacttcacccatatgcct

SEQ ID NO: 118670 - DNA, 20 bp, Artificial Sequence
  Description of Artificial Sequence: Synthetic oligonucleotide
  Target: ATXN1; (+) strand; PAM type: NRG; PAM sequence: AAG
ttcacccatatgcctaagtc

SEQ ID NO: 118671 - DNA, 20 bp, Artificial Sequence
  Description of Artificial Sequence: Synthetic oligonucleotide
  Target: ATXN1; (+) strand; PAM type: NRG; PAM sequence: AGG
tcacccatatgcctaagtca

SEQ ID NO: 118672 - DNA, 20 bp, Artificial Sequence
  Description of Artificial Sequence: Synthetic oligonucleotide
  Target: ATXN1; (+) strand; PAM type: NRG; PAM sequence: GGG
cacccatatgcctaagtcaa

SEQ ID NO: 118673 - DNA, 20 bp, Artificial Sequence
  Description of Artificial Sequence: Synthetic oligonucleotide
  Target: ATXN1; (+) strand; PAM type: NRG; PAM sequence: GGG
acccatatgcctaagtcaag

SEQ ID NO: 118674 - DNA, 20 bp, Artificial Sequence
  Description of Artificial Sequence: Synthetic oligonucleotide
  Target: ATXN1; (+) strand; PAM type: NRG; PAM sequence: TGG
aaggggatttcaatacttgt

SEQ ID NO: 118675 - DNA, 20 bp, Artificial Sequence
  Description of Artificial Sequence: Synthetic oligonucleotide
  Target: ATXN1; (+) strand; PAM type: NRG; PAM sequence: TGG
tctgtgttgaccaaccaaat

SEQ ID NO: 118676 - DNA, 20 bp, Artificial Sequence
  Description of Artificial Sequence: Synthetic oligonucleotide
  Target: ATXN1; (+) strand; PAM type: NRG; PAM sequence: TAG
tgttgaccaaccaaattgga

SEQ ID NO: 118677 - DNA, 20 bp, Artificial Sequence
  Description of Artificial Sequence: Synthetic oligonucleotide
  Target: ATXN1; (+) strand; PAM type: NRG; PAM sequence: AAG
tgaccaaccaaattggatag

SEQ ID NO: 118678 - DNA, 20 bp, Artificial Sequence
  Description of Artificial Sequence: Synthetic oligonucleotide
  Target: ATXN1; (+) strand; PAM type: NRG; PAM sequence: AAG
ggatagaagccttcccctgc

SEQ ID NO: 118679 - DNA, 20 bp, Artificial Sequence
  Description of Artificial Sequence: Synthetic oligonucleotide
  Target: ATXN1; (+) strand; PAM type: NRG; PAM sequence: CGG
agaagccttcccctgcaaga

SEQ ID NO: 118680 - DNA, 20 bp, Artificial Sequence
  Description of Artificial Sequence: Synthetic oligonucleotide
  Target: ATXN1; (+) strand; PAM type: NRG; PAM sequence: GAG
aagccttcccctgcaagacg

SEQ ID NO: 118681 - DNA, 20 bp, Artificial Sequence
  Description of Artificial Sequence: Synthetic oligonucleotide
  Target: ATXN1; (+) strand; PAM type: NRG; PAM sequence: AAG
ccttcccctgcaagacggag

SEQ ID NO: 118682 - DNA, 20 bp, Artificial Sequence
  Description of Artificial Sequence: Synthetic oligonucleotide
  Target: ATXN1; (+) strand; PAM type: NRG; PAM sequence: AGG
cttcccctgcaagacggaga

SEQ ID NO: 118683 - DNA, 20 bp, Artificial Sequence
  Description of Artificial Sequence: Synthetic oligonucleotide
  Target: ATXN1; (+) strand; PAM type: NRG; PAM sequence: CAG
cctgcaagacggagaaggct

SEQ ID NO: 118684 - DNA, 20 bp, Artificial Sequence
  Description of Artificial Sequence: Synthetic oligonucleotide
  Target: ATXN1; (+) strand; PAM type: NRG; PAM sequence: AGG
ctgcaagacggagaaggctc

SEQ ID NO: 118685 - DNA, 20 bp, Artificial Sequence
  Description of Artificial Sequence: Synthetic oligonucleotide
  Target: ATXN1; (+) strand; PAM type: NRG; PAM sequence: AAG
caagacggagaaggctcagg

SEQ ID NO: 118686 - DNA, 20 bp, Artificial Sequence
  Description of Artificial Sequence: Synthetic oligonucleotide
  Target: ATXN1; (+) strand; PAM type: NRG; PAM sequence: TGG
gacggagaaggctcaggaag

SEQ ID NO: 118687 - DNA, 20 bp, Artificial Sequence
  Description of Artificial Sequence: Synthetic oligonucleotide
  Target: ATXN1; (+) strand; PAM type: NRG; PAM sequence: AAG
gaaggctcaggaagtggtta

SEQ ID NO: 118688 - DNA, 20 bp, Artificial Sequence
  Description of Artificial Sequence: Synthetic oligonucleotide
  Target: ATXN1; (+) strand; PAM type: NRG; PAM sequence: CAG
ctaactcatgaaataattcc

SEQ ID NO: 118689 - DNA, 20 bp, Artificial Sequence
  Description of Artificial Sequence: Synthetic oligonucleotide
  Target: ATXN1; (+) strand; PAM type: NRG; PAM sequence: TGG
catgaaataattcccagatt

SEQ ID NO: 118690 - DNA, 20 bp, Artificial Sequence
  Description of Artificial Sequence: Synthetic oligonucleotide
  Target: ATXN1; (+) strand; PAM type: NRG; PAM sequence: GGG
atgaaataattcccagattt

SEQ ID NO: 118691 - DNA, 20 bp, Artificial Sequence
  Description of Artificial Sequence: Synthetic oligonucleotide
  Target: ATXN1; (+) strand; PAM type: NRG; PAM sequence: AAG
cccagatttgggcttcccca

SEQ ID NO: 118692 - DNA, 20 bp, Artificial Sequence
  Description of Artificial Sequence: Synthetic oligonucleotide
  Target: ATXN1; (+) strand; PAM type: NRG; PAM sequence: TGG
caaagcttacaaaacgacaa

SEQ ID NO: 118693 - DNA, 20 bp, Artificial Sequence
  Description of Artificial Sequence: Synthetic oligonucleotide
  Target: ATXN1; (+) strand; PAM type: NRG; PAM sequence: CGG
cttacaaaacgacaatggtc

SEQ ID NO: 118694 - DNA, 20 bp, Artificial Sequence
  Description of Artificial Sequence: Synthetic oligonucleotide
  Target: ATXN1; (+) strand; PAM type: NRG; PAM sequence: AAG
cgacaatggtccggctctta

SEQ ID NO: 118695 - DNA, 20 bp, Artificial Sequence
  Description of Artificial Sequence: Synthetic oligonucleotide
  Target: ATXN1; (+) strand; PAM type: NRG; PAM sequence: CGG
tggtccggctcttaaagcca

SEQ ID NO: 118696 - DNA, 20 bp, Artificial Sequence
  Description of Artificial Sequence: Synthetic oligonucleotide
  Target: ATXN1; (+) strand; PAM type: NRG; PAM sequence: CAG
ctcttaaagccacggtaact

SEQ ID NO: 118697 - DNA, 20 bp, Artificial Sequence
  Description of Artificial Sequence: Synthetic oligonucleotide
  Target: ATXN1; (+) strand; PAM type: NRG; PAM sequence: AGG
tcttaaagccacggtaactc

SEQ ID NO: 118698 - DNA, 20 bp, Artificial Sequence
  Description of Artificial Sequence: Synthetic oligonucleotide
  Target: ATXN1; (+) strand; PAM type: NRG; PAM sequence: GGG
cttaaagccacggtaactca

SEQ ID NO: 118699 - DNA, 20 bp, Artificial Sequence
  Description of Artificial Sequence: Synthetic oligonucleotide
  Target: ATXN1; (+) strand; PAM type: NRG; PAM sequence: CAG
acggtaactcagggaatttc

SEQ ID NO: 118700 - DNA, 20 bp, Artificial Sequence
  Description of Artificial Sequence: Synthetic oligonucleotide
  Target: ATXN1; (+) strand; PAM type: NRG; PAM sequence: AGG
cggtaactcagggaatttcc

SEQ ID NO: 118701 - DNA, 20 bp, Artificial Sequence
  Description of Artificial Sequence: Synthetic oligonucleotide
  Target: ATXN1; (+) strand; PAM type: NRG; PAM sequence: GGG
ggtaactcagggaatttcca

SEQ ID NO: 118702 - DNA, 20 bp, Artificial Sequence
  Description of Artificial Sequence: Synthetic oligonucleotide
  Target: ATXN1; (+) strand; PAM type: NRG; PAM sequence: TAG
tcagggaatttccagggcac

SEQ ID NO: 118703 - DNA, 20 bp, Artificial Sequence
  Description of Artificial Sequence: Synthetic oligonucleotide
  Target: ATXN1; (+) strand; PAM type: NRG; PAM sequence: AGG
cagggaatttccagggcact

SEQ ID NO: 118704 - DNA, 20 bp, Artificial Sequence
  Description of Artificial Sequence: Synthetic oligonucleotide
  Target: ATXN1; (+) strand; PAM type: NRG; PAM sequence: GGG
agggaatttccagggcacta

SEQ ID NO: 118705 - DNA, 20 bp, Artificial Sequence
  Description of Artificial Sequence: Synthetic oligonucleotide
  Target: ATXN1; (+) strand; PAM type: NRG; PAM sequence: TGG
aatatcactttcactgtgcc

SEQ ID NO: 118706 - DNA, 20 bp, Artificial Sequence
  Description of Artificial Sequence: Synthetic oligonucleotide
  Target: ATXN1; (+) strand; PAM type: NRG; PAM sequence: GAG
tatcactttcactgtgcctg

SEQ ID NO: 118707 - DNA, 20 bp, Artificial Sequence
  Description of Artificial Sequence: Synthetic oligonucleotide
  Target: ATXN1; (+) strand; PAM type: NRG; PAM sequence: AGG
atcactttcactgtgcctgg

SEQ ID NO: 118708 - DNA, 20 bp, Artificial Sequence
  Description of Artificial Sequence: Synthetic oligonucleotide
  Target: ATXN1; (+) strand; PAM type: NRG; PAM sequence: CAG
tgcctggaggccacaatcct

SEQ ID NO: 118709 - DNA, 20 bp, Artificial Sequence
  Description of Artificial Sequence: Synthetic oligonucleotide
  Target: ATXN1; (+) strand; PAM type: NRG; PAM sequence: AGG
gcctggaggccacaatcctc

SEQ ID NO: 118710 - DNA, 20 bp, Artificial Sequence
  Description of Artificial Sequence: Synthetic oligonucleotide
  Target: ATXN1; (+) strand; PAM type: NRG; PAM sequence: GGG
cctggaggccacaatcctca

SEQ ID NO: 118711 - DNA, 20 bp, Artificial Sequence
  Description of Artificial Sequence: Synthetic oligonucleotide
  Target: ATXN1; (+) strand; PAM type: NRG; PAM sequence: AAG
ggaggccacaatcctcaggg

SEQ ID NO: 118712 - DNA, 20 bp, Artificial Sequence
  Description of Artificial Sequence: Synthetic oligonucleotide
  Target: ATXN1; (+) strand; PAM type: NRG; PAM sequence: AGG
gaggccacaatcctcaggga

SEQ ID NO: 118713 - DNA, 20 bp, Artificial Sequence
  Description of Artificial Sequence: Synthetic oligonucleotide
  Target: ATXN1; (+) strand; PAM type: NRG; PAM sequence: GAG
cacaatcctcagggaaggct

SEQ ID NO: 118714 - DNA, 20 bp, Artificial Sequence
  Description of Artificial Sequence: Synthetic oligonucleotide
  Target: ATXN1; (+) strand; PAM type: NRG; PAM sequence: AAG
aatcctcagggaaggctgag

SEQ ID NO: 118715 - DNA, 20 bp, Artificial Sequence
  Description of Artificial Sequence: Synthetic oligonucleotide
  Target: ATXN1; (+) strand; PAM type: NRG; PAM sequence: AGG
atcctcagggaaggctgaga

SEQ ID NO: 118716 - DNA, 20 bp, Artificial Sequence
  Description of Artificial Sequence: Synthetic oligonucleotide
  Target: ATXN1; (+) strand; PAM type: NRG; PAM sequence: AAG
agaaggcaaacgaaacactc

SEQ ID NO: 118717 - DNA, 20 bp, Artificial Sequence
  Description of Artificial Sequence: Synthetic oligonucleotide
  Target: ATXN1; (+) strand; PAM type: NRG; PAM sequence: GAG
aaggcaaacgaaacactcaa

SEQ ID NO: 118718 - DNA, 20 bp, Artificial Sequence
  Description of Artificial Sequence: Synthetic oligonucleotide
  Target: ATXN1; (+) strand; PAM type: NRG; PAM sequence: AGG
aggcaaacgaaacactcaag

SEQ ID NO: 118719 - DNA, 20 bp, Artificial Sequence
  Description of Artificial Sequence: Synthetic oligonucleotide
  Target: ATXN1; (+) strand; PAM type: NRG; PAM sequence: AAG
gaaacactcaagaggcactt

SEQ ID NO: 118720 - DNA, 20 bp, Artificial Sequence
  Description of Artificial Sequence: Synthetic oligonucleotide
  Target: ATXN1; (+) strand; PAM type: NRG; PAM sequence: AGG
aaacactcaagaggcactta

SEQ ID NO: 118721 - DNA, 20 bp, Artificial Sequence
  Description of Artificial Sequence: Synthetic oligonucleotide
  Target: ATXN1; (+) strand; PAM type: NRG; PAM sequence: AAG
gcacttaaggaaacgaacac

SEQ ID NO: 118722 - DNA, 20 bp, Artificial Sequence
  Description of Artificial Sequence: Synthetic oligonucleotide
  Target: ATXN1; (+) strand; PAM type: NRG; PAM sequence: TGG
cacaagaaactcatctccca

SEQ ID NO: 118723 - DNA, 20 bp, Artificial Sequence
  Description of Artificial Sequence: Synthetic oligonucleotide
  Target: ATXN1; (+) strand; PAM type: NRG; PAM sequence: TGG
atggcctactctcttgccca

SEQ ID NO: 118724 - DNA, 20 bp, Artificial Sequence
  Description of Artificial Sequence: Synthetic oligonucleotide
  Target: ATXN1; (+) strand; PAM type: NRG; PAM sequence: GAG
ctcttgcccatggccttgtt

SEQ ID NO: 118725 - DNA, 20 bp, Artificial Sequence
  Description of Artificial Sequence: Synthetic oligonucleotide
  Target: ATXN1; (+) strand; PAM type: NRG; PAM sequence: TGG
ccaaaattctcctcacaaaa

SEQ ID NO: 118726 - DNA, 20 bp, Artificial Sequence
  Description of Artificial Sequence: Synthetic oligonucleotide
  Target: ATXN1; (+) strand; PAM type: NRG; PAM sequence: GGG
caaaattctcctcacaaaat

SEQ ID NO: 118727 - DNA, 20 bp, Artificial Sequence
  Description of Artificial Sequence: Synthetic oligonucleotide
  Target: ATXN1; (+) strand; PAM type: NRG; PAM sequence: GGG
aaaattctcctcacaaaatg

SEQ ID NO: 118728 - DNA, 20 bp, Artificial Sequence
  Description of Artificial Sequence: Synthetic oligonucleotide
  Target: ATXN1; (+) strand; PAM type: NRG; PAM sequence: CAG
tctcctcacaaaatggggct

SEQ ID NO: 118729 - DNA, 20 bp, Artificial Sequence
  Description of Artificial Sequence: Synthetic oligonucleotide
  Target: ATXN1; (+) strand; PAM type: NRG; PAM sequence: AAG
aatggggctcagtccatatg

SEQ ID NO: 118730 - DNA, 20 bp, Artificial Sequence
  Description of Artificial Sequence: Synthetic oligonucleotide
  Target: ATXN1; (+) strand; PAM type: NRG; PAM sequence: TGG
agtccatatgaagtgctgta

SEQ ID NO: 118731 - DNA, 20 bp, Artificial Sequence
  Description of Artificial Sequence: Synthetic oligonucleotide
  Target: ATXN1; (+) strand; PAM type: NRG; PAM sequence: CAG
caaatgacctcctacttgat

SEQ ID NO: 118732 - DNA, 20 bp, Artificial Sequence
  Description of Artificial Sequence: Synthetic oligonucleotide
  Target: ATXN1; (+) strand; PAM type: NRG; PAM sequence: AGG
aaatgacctcctacttgatc

SEQ ID NO: 118733 - DNA, 20 bp, Artificial Sequence
  Description of Artificial Sequence: Synthetic oligonucleotide
  Target: ATXN1; (+) strand; PAM type: NRG; PAM sequence: CGG
cctcctacttgatcaggaaa

SEQ ID NO: 118734 - DNA, 20 bp, Artificial Sequence
  Description of Artificial Sequence: Synthetic oligonucleotide
  Target: ATXN1; (+) strand; PAM type: NRG; PAM sequence: AAG
tacttgatcaggaaacggcc

SEQ ID NO: 118735 - DNA, 20 bp, Artificial Sequence
  Description of Artificial Sequence: Synthetic oligonucleotide
  Target: ATXN1; (+) strand; PAM type: NRG; PAM sequence: TGG
tgatcaggaaacggccaagt

SEQ ID NO: 118736 - DNA, 20 bp, Artificial Sequence
  Description of Artificial Sequence: Synthetic oligonucleotide
  Target: ATXN1; (+) strand; PAM type: NRG; PAM sequence: AAG
ggaaacggccaagttggtca

SEQ ID NO: 118737 - DNA, 20 bp, Artificial Sequence
  Description of Artificial Sequence: Synthetic oligonucleotide
  Target: ATXN1; (+) strand; PAM type: NRG; PAM sequence: TGG
ggtcaaagatataacttctt

SEQ ID NO: 118738 - DNA, 20 bp, Artificial Sequence
  Description of Artificial Sequence: Synthetic oligonucleotide
  Target: ATXN1; (+) strand; PAM type: NRG; PAM sequence: AAG
aaacgttaaaaacctaccca

SEQ ID NO: 118739 - DNA, 20 bp, Artificial Sequence
  Description of Artificial Sequence: Synthetic oligonucleotide
  Target: ATXN1; (+) strand; PAM type: NRG; PAM sequence: AGG
aacgttaaaaacctacccaa

SEQ ID NO: 118740 - DNA, 20 bp, Artificial Sequence
  Description of Artificial Sequence: Synthetic oligonucleotide
  Target: ATXN1; (+) strand; PAM type: NRG; PAM sequence: CAG
aacctacccaaaggatgtca

SEQ ID NO: 118741 - DNA, 20 bp, Artificial Sequence
  Description of Artificial Sequence: Synthetic oligonucleotide
  Target: ATXN1; (+) strand; PAM type: NRG; PAM sequence: GAG
cctacccaaaggatgtcaca

SEQ ID NO: 118742 - DNA, 20 bp, Artificial Sequence
  Description of Artificial Sequence: Synthetic oligonucleotide
  Target: ATXN1; (+) strand; PAM type: NRG; PAM sequence: AAG
ccaaaggatgtcacagagac

SEQ ID NO: 118743 - DNA, 20 bp, Artificial Sequence
  Description of Artificial Sequence: Synthetic oligonucleotide
  Target: ATXN1; (+) strand; PAM type: NRG; PAM sequence: AGG
caaaggatgtcacagagaca

SEQ ID NO: 118744 - DNA, 20 bp, Artificial Sequence
  Description of Artificial Sequence: Synthetic oligonucleotide
  Target: ATXN1; (+) strand; PAM type: NRG; PAM sequence: GGG
aaaggatgtcacagagacaa

SEQ ID NO: 118745 - DNA, 20 bp, Artificial Sequence
  Description of Artificial Sequence: Synthetic oligonucleotide
  Target: ATXN1; (+) strand; PAM type: NRG; PAM sequence: CAG
atgtcacagagacaagggaa

SEQ ID NO: 118746 - DNA, 20 bp, Artificial Sequence
  Description of Artificial Sequence: Synthetic oligonucleotide
  Target: ATXN1; (+) strand; PAM type: NRG; PAM sequence: GAG
gtcacagagacaagggaaca

SEQ ID NO: 118747 - DNA, 20 bp, Artificial Sequence
  Description of Artificial Sequence: Synthetic oligonucleotide
  Target: ATXN1; (+) strand; PAM type: NRG; PAM sequence: CAG
gggaacagagttgttccaac

SEQ ID NO: 118748 - DNA, 20 bp, Artificial Sequence
  Description of Artificial Sequence: Synthetic oligonucleotide
  Target: ATXN1; (+) strand; PAM type: NRG; PAM sequence: AGG
ggaacagagttgttccaacc

SEQ ID NO: 118749 - DNA, 20 bp, Artificial Sequence
  Description of Artificial Sequence: Synthetic oligonucleotide
  Target: ATXN1; (+) strand; PAM type: NRG; PAM sequence: GAG
aacagagttgttccaaccag

SEQ ID NO: 118750 - DNA, 20 bp, Artificial Sequence
  Description of Artificial Sequence: Synthetic oligonucleotide
  Target: ATXN1; (+) strand; PAM type: NRG; PAM sequence: TGG
ccaaccaggagatttactgt

SEQ ID NO: 118751 - DNA, 20 bp, Artificial Sequence
  Description of Artificial Sequence: Synthetic oligonucleotide
  Target: ATXN1; (+) strand; PAM type: NRG; PAM sequence: AAG
caggagatttactgttggtc

SEQ ID NO: 118752 - DNA, 20 bp, Artificial Sequence
  Description of Artificial Sequence: Synthetic oligonucleotide
  Target: ATXN1; (+) strand; PAM type: NRG; PAM sequence: TGG
cccctcttcctcctcatcta

SEQ ID NO: 118753 - DNA, 20 bp, Artificial Sequence
  Description of Artificial Sequence: Synthetic oligonucleotide
  Target: ATXN1; (+) strand; PAM type: NRG; PAM sequence: TGG
cctcatctatggattccttg

SEQ ID NO: 118754 - DNA, 20 bp, Artificial Sequence
  Description of Artificial Sequence: Synthetic oligonucleotide
  Target: ATXN1; (+) strand; PAM type: NRG; PAM sequence: GGG
ctcatctatggattccttgt

SEQ ID NO: 118755 - DNA, 20 bp, Artificial Sequence
  Description of Artificial Sequence: Synthetic oligonucleotide
  Target: ATXN1; (+) strand; PAM type: NRG; PAM sequence: AAG
atctatggattccttgtggg

SEQ ID NO: 118756 - DNA, 20 bp, Artificial Sequence
  Description of Artificial Sequence: Synthetic oligonucleotide
  Target: ATXN1; (+) strand; PAM type: NRG; PAM sequence: AGG
tctatggattccttgtggga

SEQ ID NO: 118757 - DNA, 20 bp, Artificial Sequence
  Description of Artificial Sequence: Synthetic oligonucleotide
  Target: ATXN1; (+) strand; PAM type: NRG; PAM sequence: CAG
cttgtgggaaggaccatact

SEQ ID NO: 118758 - DNA, 20 bp, Artificial Sequence
  Description of Artificial Sequence: Synthetic oligonucleotide
  Target: ATXN1; (+) strand; PAM type: NRG; PAM sequence: CAG
aatcctctctacccccactg

SEQ ID NO: 118759 - DNA, 20 bp, Artificial Sequence
  Description of Artificial Sequence: Synthetic oligonucleotide
  Target: ATXN1; (+) strand; PAM type: NRG; PAM sequence: AAG
tctctacccccactgcagtt

SEQ ID NO: 118760 - DNA, 20 bp, Artificial Sequence
  Description of Artificial Sequence: Synthetic oligonucleotide
  Target: ATXN1; (+) strand; PAM type: NRG; PAM sequence: AGG
ctctacccccactgcagtta

SEQ ID NO: 118761 - DNA, 20 bp, Artificial Sequence
  Description of Artificial Sequence: Synthetic oligonucleotide
  Target: ATXN1; (+) strand; PAM type: NRG; PAM sequence: TGG
tacccccactgcagttaagg

SEQ ID NO: 118762 - DNA, 20 bp, Artificial Sequence
  Description of Artificial Sequence: Synthetic oligonucleotide
  Target: ATXN1; (+) strand; PAM type: NRG; PAM sequence: CAG
ccccactgcagttaaggtgg

SEQ ID NO: 118763 - DNA, 20 bp, Artificial Sequence
  Description of Artificial Sequence: Synthetic oligonucleotide
  Target: ATXN1; (+) strand; PAM type: NRG; PAM sequence: AGG
cccactgcagttaaggtggc

SEQ ID NO: 118764 - DNA, 20 bp, Artificial Sequence
  Description of Artificial Sequence: Synthetic oligonucleotide
  Target: ATXN1; (+) strand; PAM type: NRG; PAM sequence: GAG
cactgcagttaaggtggcag

SEQ ID NO: 118765 - DNA, 20 bp, Artificial Sequence
  Description of Artificial Sequence: Synthetic oligonucleotide
  Target: ATXN1; (+) strand; PAM type: NRG; PAM sequence: TGG
tgcagttaaggtggcaggag

SEQ ID NO: 118766 - DNA, 20 bp, Artificial Sequence
  Description of Artificial Sequence: Synthetic oligonucleotide
  Target: ATXN1; (+) strand; PAM type: NRG; PAM sequence: TGG
aggtggcaggagtggaatct

SEQ ID NO: 118767 - DNA, 20 bp, Artificial Sequence
  Description of Artificial Sequence: Synthetic oligonucleotide
  Target: ATXN1; (+) strand; PAM type: NRG; PAM sequence: GAG
atcttggattcactacatgc

SEQ ID NO: 118768 - DNA, 20 bp, Artificial Sequence
  Description of Artificial Sequence: Synthetic oligonucleotide
  Target: ATXN1; (+) strand; PAM type: NRG; PAM sequence: TGG
actacatgcgagttaaactt

SEQ ID NO: 118769 - DNA, 20 bp, Artificial Sequence
  Description of Artificial Sequence: Synthetic oligonucleotide
  Target: ATXN1; (+) strand; PAM type: NRG; PAM sequence: AAG
taaactttggacaccccctg

SEQ ID NO: 118770 - DNA, 20 bp, Artificial Sequence
  Description of Artificial Sequence: Synthetic oligonucleotide
  Target: ATXN1; (+) strand; PAM type: NRG; PAM sequence: TAG
gacaccccctgaagaacctg

SEQ ID NO: 118771 - DNA, 20 bp, Artificial Sequence
  Description of Artificial Sequence: Synthetic oligonucleotide
  Target: ATXN1; (+) strand; PAM type: NRG; PAM sequence: AGG
acaccccctgaagaacctgt

SEQ ID NO: 118772 - DNA, 20 bp, Artificial Sequence
  Description of Artificial Sequence: Synthetic oligonucleotide
  Target: ATXN1; (+) strand; PAM type: NRG; PAM sequence: CAG
tgaagaacctgtaggaccat

SEQ ID NO: 118773 - DNA, 20 bp, Artificial Sequence
  Description of Artificial Sequence: Synthetic oligonucleotide
  Target: ATXN1; (+) strand; PAM type: NRG; PAM sequence: CAG
aacctgtaggaccatcagct

SEQ ID NO: 118774 - DNA, 20 bp, Artificial Sequence
  Description of Artificial Sequence: Synthetic oligonucleotide
  Target: ATXN1; (+) strand; PAM type: NRG; PAM sequence: AGG
acctgtaggaccatcagctc

SEQ ID NO: 118775 - DNA, 20 bp, Artificial Sequence
  Description of Artificial Sequence: Synthetic oligonucleotide
  Target: ATXN1; (+) strand; PAM type: NRG; PAM sequence: GAG
ctgtaggaccatcagctcag

SEQ ID NO: 118776 - DNA, 20 bp, Artificial Sequence
  Description of Artificial Sequence: Synthetic oligonucleotide
  Target: ATXN1; (+) strand; PAM type: NRG; PAM sequence: AAG
accatcagctcaggagtccc

SEQ ID NO: 118777 - DNA, 20 bp, Artificial Sequence
  Description of Artificial Sequence: Synthetic oligonucleotide
  Target: ATXN1; (+) strand; PAM type: NRG; PAM sequence: CAG
cagctcaggagtcccaagat

SEQ ID NO: 118778 - DNA, 20 bp, Artificial Sequence
  Description of Artificial Sequence: Synthetic oligonucleotide
  Target: ATXN1; (+) strand; PAM type: NRG; PAM sequence: CAG
tcaggagtcccaagatcagc

SEQ ID NO: 118779 - DNA, 20 bp, Artificial Sequence
  Description of Artificial Sequence: Synthetic oligonucleotide
  Target: ATXN1; (+) strand; PAM type: NRG; PAM sequence: CAG
agtcccaagatcagccagac

SEQ ID NO: 118780 - DNA, 20 bp, Artificial Sequence
  Description of Artificial Sequence: Synthetic oligonucleotide
  Target: ATXN1; (+) strand; PAM type: NRG; PAM sequence: TGG
tcgataaacctgtgaaccat

SEQ ID NO: 118781 - DNA, 20 bp, Artificial Sequence
  Description of Artificial Sequence: Synthetic oligonucleotide
  Target: ATXN1; (+) strand; PAM type: NRG; PAM sequence: AAG
ataaacctgtgaaccattgg

SEQ ID NO: 118782 - DNA, 20 bp, Artificial Sequence
  Description of Artificial Sequence: Synthetic oligonucleotide
  Target: ATXN1; (+) strand; PAM type: NRG; PAM sequence: CAG
aagatttgtgtctcctattt

SEQ ID NO: 118783 - DNA, 20 bp, Artificial Sequence
  Description of Artificial Sequence: Synthetic oligonucleotide
  Target: ATXN1; (+) strand; PAM type: NRG; PAM sequence: AAG
atttgtgtctcctatttcag

SEQ ID NO: 118784 - DNA, 20 bp, Artificial Sequence
  Description of Artificial Sequence: Synthetic oligonucleotide
  Target: ATXN1; (+) strand; PAM type: NRG; PAM sequence: AGG
tttgtgtctcctatttcaga

SEQ ID NO: 118785 - DNA, 20 bp, Artificial Sequence
  Description of Artificial Sequence: Synthetic oligonucleotide
  Target: ATXN1; (+) strand; PAM type: NRG; PAM sequence: CAG
tatttcagaaggaaacatcc

SEQ ID NO: 118786 - DNA, 20 bp, Artificial Sequence
  Description of Artificial Sequence: Synthetic oligonucleotide
  Target: ATXN1; (+) strand; PAM type: NRG; PAM sequence: AAG
aggaaacatcccagactaaa

SEQ ID NO: 118787 - DNA, 20 bp, Artificial Sequence
  Description of Artificial Sequence: Synthetic oligonucleotide
  Target: ATXN1; (+) strand; PAM type: NRG; PAM sequence: AGG
ggaaacatcccagactaaaa

SEQ ID NO: 118788 - DNA, 20 bp, Artificial Sequence
  Description of Artificial Sequence: Synthetic oligonucleotide
  Target: ATXN1; (+) strand; PAM type: NRG; PAM sequence: TAG
ccagactaaaaaggccccta

SEQ ID NO: 118789 - DNA, 20 bp, Artificial Sequence
  Description of Artificial Sequence: Synthetic oligonucleotide
  Target: ATXN1; (+) strand; PAM type: NRG; PAM sequence: AAG
aggcccctatagctgatcct

SEQ ID NO: 118790 - DNA, 20 bp, Artificial Sequence
  Description of Artificial Sequence: Synthetic oligonucleotide
  Target: ATXN1; (+) strand; PAM type: NRG; PAM sequence: AGG
ggcccctatagctgatccta

SEQ ID NO: 118791 - DNA, 20 bp, Artificial Sequence
  Description of Artificial Sequence: Synthetic oligonucleotide
  Target: ATXN1; (+) strand; PAM type: NRG; PAM sequence: AAG
aaaactctttcctatttaaa

SEQ ID NO: 118792 - DNA, 20 bp, Artificial Sequence
  Description of Artificial Sequence: Synthetic oligonucleotide
  Target: ATXN1; (+) strand; PAM type: NRG; PAM sequence: AGG
aaactctttcctatttaaaa

SEQ ID NO: 118793 - DNA, 20 bp, Artificial Sequence
  Description of Artificial Sequence: Synthetic oligonucleotide
  Target: ATXN1; (+) strand; PAM type: NRG; PAM sequence: AAG
ctttcctatttaaaaaggat

SEQ ID NO: 118794 - DNA, 20 bp, Artificial Sequence
  Description of Artificial Sequence: Synthetic oligonucleotide
  Target: ATXN1; (+) strand; PAM type: NRG; PAM sequence: TGG
accactccttgcccctttaa

SEQ ID NO: 118795 - DNA, 20 bp, Artificial Sequence
  Description of Artificial Sequence: Synthetic oligonucleotide
  Target: ATXN1; (+) strand; PAM type: NRG; PAM sequence: CAG
cctttaatggaatcctttta

SEQ ID NO: 118796 - DNA, 20 bp, Artificial Sequence
  Description of Artificial Sequence: Synthetic oligonucleotide
  Target: ATXN1; (+) strand; PAM type: NRG; PAM sequence: AAG
tacagtttcatcacattatt

SEQ ID NO: 118797 - DNA, 20 bp, Artificial Sequence
  Description of Artificial Sequence: Synthetic oligonucleotide
  Target: ATXN1; (+) strand; PAM type: NRG; PAM sequence: CAG
agtttcatcacattattaag

SEQ ID NO: 118798 - DNA, 20 bp, Artificial Sequence
  Description of Artificial Sequence: Synthetic oligonucleotide
  Target: ATXN1; (+) strand; PAM type: NRG; PAM sequence: CAG
tatactaaccattctctttg

SEQ ID NO: 118799 - DNA, 20 bp, Artificial Sequence
  Description of Artificial Sequence: Synthetic oligonucleotide
  Target: ATXN1; (+) strand; PAM type: NRG; PAM sequence: CAG
actaaccattctctttgcag

SEQ ID NO: 118800 - DNA, 20 bp, Artificial Sequence
  Description of Artificial Sequence: Synthetic oligonucleotide
  Target: ATXN1; (+) strand; PAM type: NRG; PAM sequence: AGG
ctaaccattctctttgcagc

SEQ ID NO: 118801 - DNA, 20 bp, Artificial Sequence
  Description of Artificial Sequence: Synthetic oligonucleotide
  Target: ATXN1; (+) strand; PAM type: NRG; PAM sequence: TAG
tgcagcaggactatatactg

SEQ ID NO: 118802 - DNA, 20 bp, Artificial Sequence
  Description of Artificial Sequence: Synthetic oligonucleotide
  Target: ATXN1; (+) strand; PAM type: NRG; PAM sequence: CGG
ctatatactgtagctcctgc

SEQ ID NO: 118803 - DNA, 20 bp, Artificial Sequence
  Description of Artificial Sequence: Synthetic oligonucleotide
  Target: ATXN1; (+) strand; PAM type: NRG; PAM sequence: GGG
tatatactgtagctcctgcc

SEQ ID NO: 118804 - DNA, 20 bp, Artificial Sequence
  Description of Artificial Sequence: Synthetic oligonucleotide
  Target: ATXN1; (+) strand; PAM type: NRG; PAM sequence: CAG
aaccttttttacatgcaatc

SEQ ID NO: 118805 - DNA, 20 bp, Artificial Sequence
  Description of Artificial Sequence: Synthetic oligonucleotide
  Target: ATXN1; (+) strand; PAM type: NRG; PAM sequence: GAG
tccaacctcacctattacat

SEQ ID NO: 118806 - DNA, 20 bp, Artificial Sequence
  Description of Artificial Sequence: Synthetic oligonucleotide
  Target: ATXN1; (+) strand; PAM type: NRG; PAM sequence: AAG
cctattacatgagcaatgaa

SEQ ID NO: 118807 - DNA, 20 bp, Artificial Sequence
  Description of Artificial Sequence: Synthetic oligonucleotide
  Target: ATXN1; (+) strand; PAM type: NRG; PAM sequence: AAG
gaataccatcttaactttcc

SEQ ID NO: 118808 - DNA, 20 bp, Artificial Sequence
  Description of Artificial Sequence: Synthetic oligonucleotide
  Target: ATXN1; (+) strand; PAM type: NRG; PAM sequence: CAG
catccaacgcaacctgttat

SEQ ID NO: 118809 - DNA, 20 bp, Artificial Sequence
  Description of Artificial Sequence: Synthetic oligonucleotide
  Target: ATXN1; (+) strand; PAM type: NRG; PAM sequence: AGG
atccaacgcaacctgttatc

SEQ ID NO: 118810 - DNA, 20 bp, Artificial Sequence
  Description of Artificial Sequence: Synthetic oligonucleotide
  Target: ATXN1; (+) strand; PAM type: NRG; PAM sequence: TGG
cctgttatcaggcctgcccc

SEQ ID NO: 118811 - DNA, 20 bp, Artificial Sequence
  Description of Artificial Sequence: Synthetic oligonucleotide
  Target: ATXN1; (+) strand; PAM type: NRG; PAM sequence: GGG
ctgttatcaggcctgcccct

SEQ ID NO: 118812 - DNA, 20 bp, Artificial Sequence
  Description of Artificial Sequence: Synthetic oligonucleotide
  Target: ATXN1; (+) strand; PAM type: NRG; PAM sequence: GGG
tgttatcaggcctgcccctg

SEQ ID NO: 118813 - DNA, 20 bp, Artificial Sequence
  Description of Artificial Sequence: Synthetic oligonucleotide
  Target: ATXN1; (+) strand; PAM type: NRG; PAM sequence: CAG
tggggcacctactatcccat

SEQ ID NO: 118814 - DNA, 20 bp, Artificial Sequence
  Description of Artificial Sequence: Synthetic oligonucleotide
  Target: ATXN1; (+) strand; PAM type: NRG; PAM sequence: AAG
taattacactctccaacttc

SEQ ID NO: 118815 - DNA, 20 bp, Artificial Sequence
  Description of Artificial Sequence: Synthetic oligonucleotide
  Target: ATXN1; (+) strand; PAM type: NRG; PAM sequence: TAG
cttcaagccccaaatgatca

SEQ ID NO: 118816 - DNA, 20 bp, Artificial Sequence
  Description of Artificial Sequence: Synthetic oligonucleotide
  Target: ATXN1; (+) strand; PAM type: NRG; PAM sequence: AAG
aaatgatcatagtaacttcc

SEQ ID NO: 118817 - DNA, 20 bp, Artificial Sequence
  Description of Artificial Sequence: Synthetic oligonucleotide
  Target: ATXN1; (+) strand; PAM type: NRG; PAM sequence: AGG
aatgatcatagtaacttcca

SEQ ID NO: 118818 - DNA, 20 bp, Artificial Sequence
  Description of Artificial Sequence: Synthetic oligonucleotide
  Target: ATXN1; (+) strand; PAM type: NRG; PAM sequence: CAG
ggcacccaaaccgctctatt

SEQ ID NO: 118819 - DNA, 20 bp, Artificial Sequence
  Description of Artificial Sequence: Synthetic oligonucleotide
  Target: ATXN1; (+) strand; PAM type: NRG; PAM sequence: TGG
cccaaaccgctctattcaga

SEQ ID NO: 118820 - DNA, 20 bp, Artificial Sequence
  Description of Artificial Sequence: Synthetic oligonucleotide
  Target: ATXN1; (+) strand; PAM type: NRG; PAM sequence: CAG
cagatggcttgtccgcttct

SEQ ID NO: 118821 - DNA, 20 bp, Artificial Sequence
  Description of Artificial Sequence: Synthetic oligonucleotide
  Target: ATXN1; (+) strand; PAM type: NRG; PAM sequence: AGG
agatggcttgtccgcttctc

SEQ ID NO: 118822 - DNA, 20 bp, Artificial Sequence
  Description of Artificial Sequence: Synthetic oligonucleotide
  Target: ATXN1; (+) strand; PAM type: NRG; PAM sequence: GGG
gatggcttgtccgcttctca

SEQ ID NO: 118823 - DNA, 20 bp, Artificial Sequence
  Description of Artificial Sequence: Synthetic oligonucleotide
  Target: ATXN1; (+) strand; PAM type: NRG; PAM sequence: CAG
cctcctccctgcttaacaaa

SEQ ID NO: 118824 - DNA, 20 bp, Artificial Sequence
  Description of Artificial Sequence: Synthetic oligonucleotide
  Target: ATXN1; (+) strand; PAM type: NRG; PAM sequence: CAG
tccctgcttaacaaacagtc

SEQ ID NO: 118825 - DNA, 20 bp, Artificial Sequence
  Description of Artificial Sequence: Synthetic oligonucleotide
  Target: ATXN1; (+) strand; PAM type: NRG; PAM sequence: AGG
ccctgcttaacaaacagtcc

SEQ ID NO: 118826 - DNA, 20 bp, Artificial Sequence
  Description of Artificial Sequence: Synthetic oligonucleotide
  Target: ATXN1; (+) strand; PAM type: NRG; PAM sequence: TGG
aaacagtccaggttttgtaa

SEQ ID NO: 118827 - DNA, 20 bp, Artificial Sequence
  Description of Artificial Sequence: Synthetic oligonucleotide
  Target: ATXN1; (+) strand; PAM type: NRG; PAM sequence: TGG
cctgtatgactattcacccc

SEQ ID NO: 118828 - DNA, 20 bp, Artificial Sequence
  Description of Artificial Sequence: Synthetic oligonucleotide
  Target: ATXN1; (+) strand; PAM type: NRG; PAM sequence: CAG
attcacccctggaccccctg

SEQ ID NO: 118829 - DNA, 20 bp, Artificial Sequence
  Description of Artificial Sequence: Synthetic oligonucleotide
  Target: ATXN1; (+) strand; PAM type: NRG; PAM sequence: CAG
cacccctggaccccctgcag

SEQ ID NO: 118830 - DNA, 20 bp, Artificial Sequence
  Description of Artificial Sequence: Synthetic oligonucleotide
  Target: ATXN1; (+) strand; PAM type: NRG; PAM sequence: AAG
gcagcagcacccccaccact

SEQ ID NO: 118831 - DNA, 20 bp, Artificial Sequence
  Description of Artificial Sequence: Synthetic oligonucleotide
  Target: ATXN1; (+) strand; PAM type: NRG; PAM sequence: AGG
cagcagcacccccaccacta

SEQ ID NO: 118832 - DNA, 20 bp, Artificial Sequence
  Description of Artificial Sequence: Synthetic oligonucleotide
  Target: ATXN1; (+) strand; PAM type: NRG; PAM sequence: TGG
ctttcaatcactctcttgaa

SEQ ID NO: 118833 - DNA, 20 bp, Artificial Sequence
  Description of Artificial Sequence: Synthetic oligonucleotide
  Target: ATXN1; (+) strand; PAM type: NRG; PAM sequence: TAG
tcactctcttgaatggttcc

SEQ ID NO: 118834 - DNA, 20 bp, Artificial Sequence
  Description of Artificial Sequence: Synthetic oligonucleotide
  Target: ATXN1; (+) strand; PAM type: NRG; PAM sequence: TAG
ctctcttgaatggttcctag

SEQ ID NO: 118835 - DNA, 20 bp, Artificial Sequence
  Description of Artificial Sequence: Synthetic oligonucleotide
  Target: ATXN1; (+) strand; PAM type: NRG; PAM sequence: CAG
ggttcctagtagatacaaaa

SEQ ID NO: 118836 - DNA, 20 bp, Artificial Sequence
  Description of Artificial Sequence: Synthetic oligonucleotide
  Target: ATXN1; (+) strand; PAM type: NRG; PAM sequence: TGG
caaaacagttttttctccaa

SEQ ID NO: 118837 - DNA, 20 bp, Artificial Sequence
  Description of Artificial Sequence: Synthetic oligonucleotide
  Target: ATXN1; (+) strand; PAM type: NRG; PAM sequence: GGG
aaaacagttttttctccaat

SEQ ID NO: 118838 - DNA, 20 bp, Artificial Sequence
  Description of Artificial Sequence: Synthetic oligonucleotide
  Target: ATXN1; (+) strand; PAM type: NRG; PAM sequence: TAG
ttttttctccaatgggaaaa

SEQ ID NO: 118839 - DNA, 20 bp, Artificial Sequence
  Description of Artificial Sequence: Synthetic oligonucleotide
  Target: ATXN1; (+) strand; PAM type: NRG; PAM sequence: GAG
ttttctccaatgggaaaata

SEQ ID NO: 118840 - DNA, 20 bp, Artificial Sequence
  Description of Artificial Sequence: Synthetic oligonucleotide
  Target: ATXN1; (+) strand; PAM type: NRG; PAM sequence: CAG
tccaatgggaaaatagagca

SEQ ID NO: 118841 - DNA, 20 bp, Artificial Sequence
  Description of Artificial Sequence: Synthetic oligonucleotide
  Target: ATXN1; (+) strand; PAM type: NRG; PAM sequence: AGG
ccaatgggaaaatagagcac

SEQ ID NO: 118842 - DNA, 20 bp, Artificial Sequence
  Description of Artificial Sequence: Synthetic oligonucleotide
  Target: ATXN1; (+) strand; PAM type: NRG; PAM sequence: GGG
caatgggaaaatagagcaca

SEQ ID NO: 118843 - DNA, 20 bp, Artificial Sequence
  Description of Artificial Sequence: Synthetic oligonucleotide
  Target: ATXN1; (+) strand; PAM type: NRG; PAM sequence: GAG
atgggaaaatagagcacagg

SEQ ID NO: 118844 - DNA, 20 bp, Artificial Sequence
  Description of Artificial Sequence: Synthetic oligonucleotide
  Target: ATXN1; (+) strand; PAM type: NRG; PAM sequence: CAG
atagagcacagggagtcact

SEQ ID NO: 118845 - DNA, 20 bp, Artificial Sequence
  Description of Artificial Sequence: Synthetic oligonucleotide
  Target: ATXN1; (+) strand; PAM type: NRG; PAM sequence: CAG
ttgctcccaacacccctttc

SEQ ID NO: 118846 - DNA, 20 bp, Artificial Sequence
  Description of Artificial Sequence: Synthetic oligonucleotide
  Target: ATXN1; (+) strand; PAM type: NRG; PAM sequence: CAG
acccctttccagccactcac

SEQ ID NO: 118847 - DNA, 20 bp, Artificial Sequence
  Description of Artificial Sequence: Synthetic oligonucleotide
  Target: ATXN1; (+) strand; PAM type: NRG; PAM sequence: TGG
agccactcaccagactacct

SEQ ID NO: 118848 - DNA, 20 bp, Artificial Sequence
  Description of Artificial Sequence: Synthetic oligonucleotide
  Target: ATXN1; (+) strand; PAM type: NRG; PAM sequence: AAG
actcaccagactaccttggc

SEQ ID NO: 118849 - DNA, 20 bp, Artificial Sequence
  Description of Artificial Sequence: Synthetic oligonucleotide
  Target: ATXN1; (+) strand; PAM type: NRG; PAM sequence: TAG
gactaccttggcaagtactc

SEQ ID NO: 118850 - DNA, 20 bp, Artificial Sequence
  Description of Artificial Sequence: Synthetic oligonucleotide
  Target: ATXN1; (+) strand; PAM type: NRG; PAM sequence: AGG
actaccttggcaagtactct

SEQ ID NO: 118851 - DNA, 20 bp, Artificial Sequence
  Description of Artificial Sequence: Synthetic oligonucleotide
  Target: ATXN1; (+) strand; PAM type: NRG; PAM sequence: GAG
taccttggcaagtactctag

SEQ ID NO: 118852 - DNA, 20 bp, Artificial Sequence
  Description of Artificial Sequence: Synthetic oligonucleotide
  Target: ATXN1; (+) strand; PAM type: NRG; PAM sequence: TGG
tggcaagtactctaggagta

SEQ ID NO: 118853 - DNA, 20 bp, Artificial Sequence
  Description of Artificial Sequence: Synthetic oligonucleotide
  Target: ATXN1; (+) strand; PAM type: NRG; PAM sequence: GGG
ggcaagtactctaggagtat

SEQ ID NO: 118854 - DNA, 20 bp, Artificial Sequence
  Description of Artificial Sequence: Synthetic oligonucleotide
  Target: ATXN1; (+) strand; PAM type: NRG; PAM sequence: CAG
acctttttaacatacacaac

SEQ ID NO: 118855 - DNA, 20 bp, Artificial Sequence
  Description of Artificial Sequence: Synthetic oligonucleotide
  Target: ATXN1; (+) strand; PAM type: NRG; PAM sequence: CAG
cacaaccagttctgtctacc

SEQ ID NO: 118856 - DNA, 20 bp, Artificial Sequence
  Description of Artificial Sequence: Synthetic oligonucleotide
  Target: ATXN1; (+) strand; PAM type: NRG; PAM sequence: AAG
ccagttctgtctacccagcc

SEQ ID NO: 118857 - DNA, 20 bp, Artificial Sequence
  Description of Artificial Sequence: Synthetic oligonucleotide
  Target: ATXN1; (+) strand; PAM type: NRG; PAM sequence: AGG
cagttctgtctacccagcca

SEQ ID NO: 118858 - DNA, 20 bp, Artificial Sequence
  Description of Artificial Sequence: Synthetic oligonucleotide
  Target: ATXN1; (+) strand; PAM type: NRG; PAM sequence: TGG
agccaaggcatattcttatg

SEQ ID NO: 118859 - DNA, 20 bp, Artificial Sequence
  Description of Artificial Sequence: Synthetic oligonucleotide
  Target: ATXN1; (+) strand; PAM type: NRG; PAM sequence: TGG
acatctgcctccccactaac

SEQ ID NO: 118860 - DNA, 20 bp, Artificial Sequence
  Description of Artificial Sequence: Synthetic oligonucleotide
  Target: ATXN1; (+) strand; PAM type: NRG; PAM sequence: CAG
ctgcctccccactaactgga

SEQ ID NO: 118861 - DNA, 20 bp, Artificial Sequence
  Description of Artificial Sequence: Synthetic oligonucleotide
  Target: ATXN1; (+) strand; PAM type: NRG; PAM sequence: AGG
tgcctccccactaactggac

SEQ ID NO: 118862 - DNA, 20 bp, Artificial Sequence
  Description of Artificial Sequence: Synthetic oligonucleotide
  Target: ATXN1; (+) strand; PAM type: NRG; PAM sequence: TAG
ctggacaggcacctgtacct

SEQ ID NO: 118863 - DNA, 20 bp, Artificial Sequence
  Description of Artificial Sequence: Synthetic oligonucleotide
  Target: ATXN1; (+) strand; PAM type: NRG; PAM sequence: AAG
acctgtaccttagtcttcct

SEQ ID NO: 118864 - DNA, 20 bp, Artificial Sequence
  Description of Artificial Sequence: Synthetic oligonucleotide
  Target: ATXN1; (+) strand; PAM type: NRG; PAM sequence: CAG
tcccaacattaacattaccg

SEQ ID NO: 118865 - DNA, 20 bp, Artificial Sequence
  Description of Artificial Sequence: Synthetic oligonucleotide
  Target: ATXN1; (+) strand; PAM type: NRG; PAM sequence: AGG
cccaacattaacattaccgc

SEQ ID NO: 118866 - DNA, 20 bp, Artificial Sequence
  Description of Artificial Sequence: Synthetic oligonucleotide
  Target: ATXN1; (+) strand; PAM type: NRG; PAM sequence: CAG
ttaacattaccgcaggaaat

SEQ ID NO: 118867 - DNA, 20 bp, Artificial Sequence
  Description of Artificial Sequence: Synthetic oligonucleotide
  Target: ATXN1; (+) strand; PAM type: NRG; PAM sequence: CAG
cgcaggaaatcagaccctat

SEQ ID NO: 118868 - DNA, 20 bp, Artificial Sequence
  Description of Artificial Sequence: Synthetic oligonucleotide
  Target: ATXN1; (+) strand; PAM type: NRG; PAM sequence: AAG
gaccctatcagtgcccctca

SEQ ID NO: 118869 - DNA, 20 bp, Artificial Sequence
  Description of Artificial Sequence: Synthetic oligonucleotide
  Target: ATXN1; (+) strand; PAM type: NRG; PAM sequence: CAG
tatcagtgcccctcaaagct

SEQ ID NO: 118870 - DNA, 20 bp, Artificial Sequence
  Description of Artificial Sequence: Synthetic oligonucleotide
  Target: ATXN1; (+) strand; PAM type: NRG; PAM sequence: AGG
atcagtgcccctcaaagctc

SEQ ID NO: 118871 - DNA, 20 bp, Artificial Sequence
  Description of Artificial Sequence: Synthetic oligonucleotide
  Target: ATXN1; (+) strand; PAM type: NRG; PAM sequence: CAG
ccctcaaagctcaggtccgt

SEQ ID NO: 118872 - DNA, 20 bp, Artificial Sequence
  Description of Artificial Sequence: Synthetic oligonucleotide
  Target: ATXN1; (+) strand; PAM type: NRG; PAM sequence: CAG
aaagctcaggtccgtcagta

SEQ ID NO: 118873 - DNA, 20 bp, Artificial Sequence
  Description of Artificial Sequence: Synthetic oligonucleotide
  Target: ATXN1; (+) strand; PAM type: NRG; PAM sequence: AGG
aagctcaggtccgtcagtac

SEQ ID NO: 118874 - DNA, 20 bp, Artificial Sequence
  Description of Artificial Sequence: Synthetic oligonucleotide
  Target: ATXN1; (+) strand; PAM type: NRG; PAM sequence: GGG
agctcaggtccgtcagtaca

SEQ ID NO: 118875 - DNA, 20 bp, Artificial Sequence
  Description of Artificial Sequence: Synthetic oligonucleotide
  Target: ATXN1; (+) strand; PAM type: NRG; PAM sequence: CGG
aactaatacccctacttata

SEQ ID NO: 118876 - DNA, 20 bp, Artificial Sequence
  Description of Artificial Sequence: Synthetic oligonucleotide
  Target: ATXN1; (+) strand; PAM type: NRG; PAM sequence: AAG
atacccctacttatacggtt

SEQ ID NO: 118877 - DNA, 20 bp, Artificial Sequence
  Description of Artificial Sequence: Synthetic oligonucleotide
  Target: ATXN1; (+) strand; PAM type: NRG; PAM sequence: TAG
cctacttatacggttaagaa

SEQ ID NO: 118878 - DNA, 20 bp, Artificial Sequence
  Description of Artificial Sequence: Synthetic oligonucleotide
  Target: ATXN1; (+) strand; PAM type: NRG; PAM sequence: CAG
gttaagaatagccactgcta

SEQ ID NO: 118879 - DNA, 20 bp, Artificial Sequence
  Description of Artificial Sequence: Synthetic oligonucleotide
  Target: ATXN1; (+) strand; PAM type: NRG; PAM sequence: AGG
ttaagaatagccactgctac

SEQ ID NO: 118880 - DNA, 20 bp, Artificial Sequence
  Description of Artificial Sequence: Synthetic oligonucleotide
  Target: ATXN1; (+) strand; PAM type: NRG; PAM sequence: CAG
atagccactgctacaggaac

SEQ ID NO: 118881 - DNA, 20 bp, Artificial Sequence
  Description of Artificial Sequence: Synthetic oligonucleotide
  Target: ATXN1; (+) strand; PAM type: NRG; PAM sequence: TAG
cactgctacaggaaccagaa

SEQ ID NO: 118882 - DNA, 20 bp, Artificial Sequence
  Description of Artificial Sequence: Synthetic oligonucleotide
  Target: ATXN1; (+) strand; PAM type: NRG; PAM sequence: CAG
gctacaggaaccagaatagc

SEQ ID NO: 118883 - DNA, 20 bp, Artificial Sequence
  Description of Artificial Sequence: Synthetic oligonucleotide
  Target: ATXN1; (+) strand; PAM type: NRG; PAM sequence: AAG
cctactaccacacactctca

SEQ ID NO: 118884 - DNA, 20 bp, Artificial Sequence
  Description of Artificial Sequence: Synthetic oligonucleotide
  Target: ATXN1; (+) strand; PAM type: NRG; PAM sequence: AGG
ctactaccacacactctcaa

SEQ ID NO: 118885 - DNA, 20 bp, Artificial Sequence
  Description of Artificial Sequence: Synthetic oligonucleotide
  Target: ATXN1; (+) strand; PAM type: NRG; PAM sequence: AAG
acactctcaaaggatttctc

SEQ ID NO: 118886 - DNA, 20 bp, Artificial Sequence
  Description of Artificial Sequence: Synthetic oligonucleotide
  Target: ATXN1; (+) strand; PAM type: NRG; PAM sequence: CAG
tctcaaaggatttctcaaga

SEQ ID NO: 118887 - DNA, 20 bp, Artificial Sequence
  Description of Artificial Sequence: Synthetic oligonucleotide
  Target: ATXN1; (+) strand; PAM type: NRG; PAM sequence: AAG
gatttctcaagacagtttgc

SEQ ID NO: 118888 - DNA, 20 bp, Artificial Sequence
  Description of Artificial Sequence: Synthetic oligonucleotide
  Target: ATXN1; (+) strand; PAM type: NRG; PAM sequence: TAG
ccttactctgcaatcccaaa

SEQ ID NO: 118889 - DNA, 20 bp, Artificial Sequence
  Description of Artificial Sequence: Synthetic oligonucleotide
  Target: ATXN1; (+) strand; PAM type: NRG; PAM sequence: TGG
gcaatcccaaatagactctt

SEQ ID NO: 118890 - DNA, 20 bp, Artificial Sequence
  Description of Artificial Sequence: Synthetic oligonucleotide
  Target: ATXN1; (+) strand; PAM type: NRG; PAM sequence: CAG
atcccaaatagactctttgg

SEQ ID NO: 118891 - DNA, 20 bp, Artificial Sequence
  Description of Artificial Sequence: Synthetic oligonucleotide
  Target: ATXN1; (+) strand; PAM type: NRG; PAM sequence: TAG
ccaaatagactctttggcag

SEQ ID NO: 118892 - DNA, 20 bp, Artificial Sequence
  Description of Artificial Sequence: Synthetic oligonucleotide
  Target: ATXN1; (+) strand; PAM type: NRG; PAM sequence: AAG
agtgaatatccaaaaccgcc

SEQ ID NO: 118893 - DNA, 20 bp, Artificial Sequence
  Description of Artificial Sequence: Synthetic oligonucleotide
  Target: ATXN1; (+) strand; PAM type: NRG; PAM sequence: AGG
gtgaatatccaaaaccgcca

SEQ ID NO: 118894 - DNA, 20 bp, Artificial Sequence
  Description of Artificial Sequence: Synthetic oligonucleotide
  Target: ATXN1; (+) strand; PAM type: NRG; PAM sequence: TAG
tatccaaaaccgccaaggcc

SEQ ID NO: 118895 - DNA, 20 bp, Artificial Sequence
  Description of Artificial Sequence: Synthetic oligonucleotide
  Target: ATXN1; (+) strand; PAM type: NRG; PAM sequence: GAG
gcctagacctcctcactgct

SEQ ID NO: 118896 - DNA, 20 bp, Artificial Sequence
  Description of Artificial Sequence: Synthetic oligonucleotide
  Target: ATXN1; (+) strand; PAM type: NRG; PAM sequence: AAG
agacctcctcactgctgaga

SEQ ID NO: 118897 - DNA, 20 bp, Artificial Sequence
  Description of Artificial Sequence: Synthetic oligonucleotide
  Target: ATXN1; (+) strand; PAM type: NRG; PAM sequence: AGG
gacctcctcactgctgagaa

SEQ ID NO: 118898 - DNA, 20 bp, Artificial Sequence
  Description of Artificial Sequence: Synthetic oligonucleotide
  Target: ATXN1; (+) strand; PAM type: NRG; PAM sequence: AAG
ctcctcactgctgagaaagg

SEQ ID NO: 118899 - DNA, 20 bp, Artificial Sequence
  Description of Artificial Sequence: Synthetic oligonucleotide
  Target: ATXN1; (+) strand; PAM type: NRG; PAM sequence: TAG
aggaagactctgcaccttct

SEQ ID NO: 118900 - DNA, 20 bp, Artificial Sequence
  Description of Artificial Sequence: Synthetic oligonucleotide
  Target: ATXN1; (+) strand; PAM type: NRG; PAM sequence: AGG
ggaagactctgcaccttctt

SEQ ID NO: 118901 - DNA, 20 bp, Artificial Sequence
  Description of Artificial Sequence: Synthetic oligonucleotide
  Target: ATXN1; (+) strand; PAM type: NRG; PAM sequence: GAG
aagactctgcaccttcttag

SEQ ID NO: 118902 - DNA, 20 bp, Artificial Sequence
  Description of Artificial Sequence: Synthetic oligonucleotide
  Target: ATXN1; (+) strand; PAM type: NRG; PAM sequence: AAG
actctgcaccttcttaggag

SEQ ID NO: 118903 - DNA, 20 bp, Artificial Sequence
  Description of Artificial Sequence: Synthetic oligonucleotide
  Target: ATXN1; (+) strand; PAM type: NRG; PAM sequence: CAG
ttgtttttacactaaccact

SEQ ID NO: 118904 - DNA, 20 bp, Artificial Sequence
  Description of Artificial Sequence: Synthetic oligonucleotide
  Target: ATXN1; (+) strand; PAM type: NRG; PAM sequence: AGG
tgtttttacactaaccactc

SEQ ID NO: 118905 - DNA, 20 bp, Artificial Sequence
  Description of Artificial Sequence: Synthetic oligonucleotide
  Target: ATXN1; (+) strand; PAM type: NRG; PAM sequence: GGG
gtttttacactaaccactca

SEQ ID NO: 118906 - DNA, 20 bp, Artificial Sequence
  Description of Artificial Sequence: Synthetic oligonucleotide
  Target: ATXN1; (+) strand; PAM type: NRG; PAM sequence: TAG
ttacactaaccactcaggga

SEQ ID NO: 118907 - DNA, 20 bp, Artificial Sequence
  Description of Artificial Sequence: Synthetic oligonucleotide
  Target: ATXN1; (+) strand; PAM type: NRG; PAM sequence: AAG
taaccactcagggatagtac

SEQ ID NO: 118908 - DNA, 20 bp, Artificial Sequence
  Description of Artificial Sequence: Synthetic oligonucleotide
  Target: ATXN1; (+) strand; PAM type: NRG; PAM sequence: CAG
ggatagtacaagatgctgcc

SEQ ID NO: 118909 - DNA, 20 bp, Artificial Sequence
  Description of Artificial Sequence: Synthetic oligonucleotide
  Target: ATXN1; (+) strand; PAM type: NRG; PAM sequence: CAG
tagtacaagatgctgcccag

SEQ ID NO: 118910 - DNA, 20 bp, Artificial Sequence
  Description of Artificial Sequence: Synthetic oligonucleotide
  Target: ATXN1; (+) strand; PAM type: NRG; PAM sequence: CAG
aagatgctgcccagcagtta

SEQ ID NO: 118911 - DNA, 20 bp, Artificial Sequence
  Description of Artificial Sequence: Synthetic oligonucleotide
  Target: ATXN1; (+) strand; PAM type: NRG; PAM sequence: AGG
agatgctgcccagcagttac

SEQ ID NO: 118912 - DNA, 20 bp, Artificial Sequence
  Description of Artificial Sequence: Synthetic oligonucleotide
  Target: ATXN1; (+) strand; PAM type: NRG; PAM sequence: AAG
ctgcccagcagttacaggaa

SEQ ID NO: 118913 - DNA, 20 bp, Artificial Sequence
  Description of Artificial Sequence: Synthetic oligonucleotide
  Target: ATXN1; (+) strand; PAM type: NRG; PAM sequence: AGG
tgcccagcagttacaggaaa

SEQ ID NO: 118914 - DNA, 20 bp, Artificial Sequence
  Description of Artificial Sequence: Synthetic oligonucleotide
  Target: ATXN1; (+) strand; PAM type: NRG; PAM sequence: CAG
caggaaaaggcttctgaaat

SEQ ID NO: 118915 - DNA, 20 bp, Artificial Sequence
  Description of Artificial Sequence: Synthetic oligonucleotide
  Target: ATXN1; (+) strand; PAM type: NRG; PAM sequence: TAG
caaactcttataccaacctc

SEQ ID NO: 118916 - DNA, 20 bp, Artificial Sequence
  Description of Artificial Sequence: Synthetic oligonucleotide
  Target: ATXN1; (+) strand; PAM type: NRG; PAM sequence: GAG
aactcttataccaacctcta

SEQ ID NO: 118917 - DNA, 20 bp, Artificial Sequence
  Description of Artificial Sequence: Synthetic oligonucleotide
  Target: ATXN1; (+) strand; PAM type: NRG; PAM sequence: TGG
cttataccaacctctagagt

SEQ ID NO: 118918 - DNA, 20 bp, Artificial Sequence
  Description of Artificial Sequence: Synthetic oligonucleotide
  Target: ATXN1; (+) strand; PAM type: NRG; PAM sequence: GGG
ttataccaacctctagagtt

SEQ ID NO: 118919 - DNA, 20 bp, Artificial Sequence
  Description of Artificial Sequence: Synthetic oligonucleotide
  Target: ATXN1; (+) strand; PAM type: NRG; PAM sequence: TGG
acctctagagttgggcaaca

SEQ ID NO: 118920 - DNA, 20 bp, Artificial Sequence
  Description of Artificial Sequence: Synthetic oligonucleotide
  Target: ATXN1; (+) strand; PAM type: NRG; PAM sequence: CAG
cccctttctacgtcccatga

SEQ ID NO: 118921 - DNA, 20 bp, Artificial Sequence
  Description of Artificial Sequence: Synthetic oligonucleotide
  Target: ATXN1; (+) strand; PAM type: NRG; PAM sequence: CGG
atcttgctattactcacctt

SEQ ID NO: 118922 - DNA, 20 bp, Artificial Sequence
  Description of Artificial Sequence: Synthetic oligonucleotide
  Target: ATXN1; (+) strand; PAM type: NRG; PAM sequence: GGG
tcttgctattactcaccttc

SEQ ID NO: 118923 - DNA, 20 bp, Artificial Sequence
  Description of Artificial Sequence: Synthetic oligonucleotide
  Target: ATXN1; (+) strand; PAM type: NRG; PAM sequence: CAG
tttgtcaaatttgtttcctc

SEQ ID NO: 118924 - DNA, 20 bp, Artificial Sequence
  Description of Artificial Sequence: Synthetic oligonucleotide
  Target: ATXN1; (+) strand; PAM type: NRG; PAM sequence: AGG
ttgtcaaatttgtttcctcc

SEQ ID NO: 118925 - DNA, 20 bp, Artificial Sequence
  Description of Artificial Sequence: Synthetic oligonucleotide
  Target: ATXN1; (+) strand; PAM type: NRG; PAM sequence: AAG
cctccaggatcgataccatc

SEQ ID NO: 118926 - DNA, 20 bp, Artificial Sequence
  Description of Artificial Sequence: Synthetic oligonucleotide
  Target: ATXN1; (+) strand; PAM type: NRG; PAM sequence: CAG
ggatcgataccatcaagcta

SEQ ID NO: 118927 - DNA, 20 bp, Artificial Sequence
  Description of Artificial Sequence: Synthetic oligonucleotide
  Target: ATXN1; (+) strand; PAM type: NRG; PAM sequence: TGG
cgataccatcaagctacaga

SEQ ID NO: 118928 - DNA, 20 bp, Artificial Sequence
  Description of Artificial Sequence: Synthetic oligonucleotide
  Target: ATXN1; (+) strand; PAM type: NRG; PAM sequence: TGG
gctacagatggtcttacaaa

SEQ ID NO: 118929 - DNA, 20 bp, Artificial Sequence
  Description of Artificial Sequence: Synthetic oligonucleotide
  Target: ATXN1; (+) strand; PAM type: NRG; PAM sequence: GAG
ttacaaatggaaccccaaat

SEQ ID NO: 118930 - DNA, 20 bp, Artificial Sequence
  Description of Artificial Sequence: Synthetic oligonucleotide
  Target: ATXN1; (+) strand; PAM type: NRG; PAM sequence: AAG
ctcaactcacaacttctacc

SEQ ID NO: 118931 - DNA, 20 bp, Artificial Sequence
  Description of Artificial Sequence: Synthetic oligonucleotide
  Target: ATXN1; (+) strand; PAM type: NRG; PAM sequence: AGG
tcaactcacaacttctacca

SEQ ID NO: 118932 - DNA, 20 bp, Artificial Sequence
  Description of Artificial Sequence: Synthetic oligonucleotide
  Target: ATXN1; (+) strand; PAM type: NRG; PAM sequence: TGG
caacttctaccaaggacccc

SEQ ID NO: 118933 - DNA, 20 bp, Artificial Sequence
  Description of Artificial Sequence: Synthetic oligonucleotide
  Target: ATXN1; (+) strand; PAM type: NRG; PAM sequence: CAG
ggacccctggactgacccac

SEQ ID NO: 118934 - DNA, 20 bp, Artificial Sequence
  Description of Artificial Sequence: Synthetic oligonucleotide
  Target: ATXN1; (+) strand; PAM type: NRG; PAM sequence: TGG
ggactgacccaccagccctt

SEQ ID NO: 118935 - DNA, 20 bp, Artificial Sequence
  Description of Artificial Sequence: Synthetic oligonucleotide
  Target: ATXN1; (+) strand; PAM type: NRG; PAM sequence: TAG
gacccaccagccctttggcc

SEQ ID NO: 118936 - DNA, 20 bp, Artificial Sequence
  Description of Artificial Sequence: Synthetic oligonucleotide
  Target: ATXN1; (+) strand; PAM type: NRG; PAM sequence: GAG
cccaccagccctttggccta

SEQ ID NO: 118937 - DNA, 20 bp, Artificial Sequence
  Description of Artificial Sequence: Synthetic oligonucleotide
  Target: ATXN1; (+) strand; PAM type: NRG; PAM sequence: TGG
tggcctagagtgttcccctc

SEQ ID NO: 118938 - DNA, 20 bp, Artificial Sequence
  Description of Artificial Sequence: Synthetic oligonucleotide
  Target: ATXN1; (+) strand; PAM type: NRG; PAM sequence: GAG
gcctagagtgttcccctctg

SEQ ID NO: 118939 - DNA, 20 bp, Artificial Sequence
  Description of Artificial Sequence: Synthetic oligonucleotide
  Target: ATXN1; (+) strand; PAM type: NRG; PAM sequence: AGG
cctagagtgttcccctctgg

SEQ ID NO: 118940 - DNA, 20 bp, Artificial Sequence
  Description of Artificial Sequence: Synthetic oligonucleotide
  Target: ATXN1; (+) strand; PAM type: NRG; PAM sequence: GGG
ctagagtgttcccctctgga

SEQ ID NO: 118941 - DNA, 20 bp, Artificial Sequence
  Description of Artificial Sequence: Synthetic oligonucleotide
  Target: ATXN1; (+) strand; PAM type: NRG; PAM sequence: CAG
tctggagggcactacaactg

SEQ ID NO: 118942 - DNA, 20 bp, Artificial Sequence
  Description of Artificial Sequence: Synthetic oligonucleotide
  Target: ATXN1; (+) strand; PAM type: NRG; PAM sequence: AGG
ctggagggcactacaactgc

SEQ ID NO: 118943 - DNA, 20 bp, Artificial Sequence
  Description of Artificial Sequence: Synthetic oligonucleotide
  Target: ATXN1; (+) strand; PAM type: NRG; PAM sequence: GGG
tggagggcactacaactgca

SEQ ID NO: 118944 - DNA, 20 bp, Artificial Sequence
  Description of Artificial Sequence: Synthetic oligonucleotide
  Target: ATXN1; (+) strand; PAM type: NRG; PAM sequence: CAG
gccccttcttcacccctatc

SEQ ID NO: 118945 - DNA, 20 bp, Artificial Sequence
  Description of Artificial Sequence: Synthetic oligonucleotide
  Target: ATXN1; (+) strand; PAM type: NRG; PAM sequence: CAG
ccttcttcacccctatccag

SEQ ID NO: 118946 - DNA, 20 bp, Artificial Sequence
  Description of Artificial Sequence: Synthetic oligonucleotide
  Target: ATXN1; (+) strand; PAM type: NRG; PAM sequence: AGG
cttcttcacccctatccagc

SEQ ID NO: 118947 - DNA, 20 bp, Artificial Sequence
  Description of Artificial Sequence: Synthetic oligonucleotide
  Target: ATXN1; (+) strand; PAM type: NRG; PAM sequence: AAG
cttcacccctatccagcagg

SEQ ID NO: 118948 - DNA, 20 bp, Artificial Sequence
  Description of Artificial Sequence: Synthetic oligonucleotide
  Target: ATXN1; (+) strand; PAM type: NRG; PAM sequence: TAG
cacccctatccagcaggaag

SEQ ID NO: 118949 - DNA, 20 bp, Artificial Sequence
  Description of Artificial Sequence: Synthetic oligonucleotide
  Target: ATXN1; (+) strand; PAM type: NRG; PAM sequence: TAG
cctatccagcaggaagtagc

SEQ ID NO: 118950 - DNA, 20 bp, Artificial Sequence
  Description of Artificial Sequence: Synthetic oligonucleotide
  Target: ATXN1; (+) strand; PAM type: NRG; PAM sequence: GAG
tatccagcaggaagtagcta

SEQ ID NO: 118951 - DNA, 20 bp, Artificial Sequence
  Description of Artificial Sequence: Synthetic oligonucleotide
  Target: ATXN1; (+) strand; PAM type: NRG; PAM sequence: CAG
ccagcaggaagtagctagag

SEQ ID NO: 118952 - DNA, 20 bp, Artificial Sequence
  Description of Artificial Sequence: Synthetic oligonucleotide
  Target: ATXN1; (+) strand; PAM type: NRG; PAM sequence: CAG
tagctagagcagtcatcacc

SEQ ID NO: 118953 - DNA, 20 bp, Artificial Sequence
  Description of Artificial Sequence: Synthetic oligonucleotide
  Target: ATXN1; (+) strand; PAM type: NRG; PAM sequence: CAG
agtcatcacccagttcccaa

SEQ ID NO: 118954 - DNA, 20 bp, Artificial Sequence
  Description of Artificial Sequence: Synthetic oligonucleotide
  Target: ATXN1; (+) strand; PAM type: NRG; PAM sequence: CAG
catcacccagttcccaacag

SEQ ID NO: 118955 - DNA, 20 bp, Artificial Sequence
  Description of Artificial Sequence: Synthetic oligonucleotide
  Target: ATXN1; (+) strand; PAM type: NRG; PAM sequence: TGG
acccagttcccaacagcagc

SEQ ID NO: 118956 - DNA, 20 bp, Artificial Sequence
  Description of Artificial Sequence: Synthetic oligonucleotide
  Target: ATXN1; (+) strand; PAM type: NRG; PAM sequence: GGG
cccagttcccaacagcagct

SEQ ID NO: 118957 - DNA, 20 bp, Artificial Sequence
  Description of Artificial Sequence: Synthetic oligonucleotide
  Target: ATXN1; (+) strand; PAM type: NRG; PAM sequence: GGG
ccagttcccaacagcagctg

SEQ ID NO: 118958 - DNA, 20 bp, Artificial Sequence
  Description of Artificial Sequence: Synthetic oligonucleotide
  Target: ATXN1; (+) strand; PAM type: NRG; PAM sequence: TAG
agcagctggggtgtcctgtt

SEQ ID NO: 118959 - DNA, 20 bp, Artificial Sequence
  Description of Artificial Sequence: Synthetic oligonucleotide
  Target: ATXN1; (+) strand; PAM type: NRG; PAM sequence: GAG
cagctggggtgtcctgttta

SEQ ID NO: 118960 - DNA, 20 bp, Artificial Sequence
  Description of Artificial Sequence: Synthetic oligonucleotide
  Target: ATXN1; (+) strand; PAM type: NRG; PAM sequence: AGG
agctggggtgtcctgtttag

SEQ ID NO: 118961 - DNA, 20 bp, Artificial Sequence
  Description of Artificial Sequence: Synthetic oligonucleotide
  Target: ATXN1; (+) strand; PAM type: NRG; PAM sequence: GGG
gctggggtgtcctgtttaga

SEQ ID NO: 118962 - DNA, 20 bp, Artificial Sequence
  Description of Artificial Sequence: Synthetic oligonucleotide
  Target: ATXN1; (+) strand; PAM type: NRG; PAM sequence: GGG
ctggggtgtcctgtttagag

SEQ ID NO: 118963 - DNA, 20 bp, Artificial Sequence
  Description of Artificial Sequence: Synthetic oligonucleotide
  Target: ATXN1; (+) strand; PAM type: NRG; PAM sequence: GGG
tggggtgtcctgtttagagg

SEQ ID NO: 118964 - DNA, 20 bp, Artificial Sequence
  Description of Artificial Sequence: Synthetic oligonucleotide
  Target: ATXN1; (+) strand; PAM type: NRG; PAM sequence: GGG
ggggtgtcctgtttagaggg

SEQ ID NO: 118965 - DNA, 20 bp, Artificial Sequence
  Description of Artificial Sequence: Synthetic oligonucleotide
  Target: ATXN1; (+) strand; PAM type: NRG; PAM sequence: GAG
tcctgtttagaggggggatt

SEQ ID NO: 118966 - DNA, 20 bp, Artificial Sequence
  Description of Artificial Sequence: Synthetic oligonucleotide
  Target: ATXN1; (+) strand; PAM type: NRG; PAM sequence: GAG
ctgtttagaggggggattga

SEQ ID NO: 118967 - DNA, 20 bp, Artificial Sequence
  Description of Artificial Sequence: Synthetic oligonucleotide
  Target: ATXN1; (+) strand; PAM type: NRG; PAM sequence: AGG
tgtttagaggggggattgag

SEQ ID NO: 118968 - DNA, 20 bp, Artificial Sequence
  Description of Artificial Sequence: Synthetic oligonucleotide
  Target: ATXN1; (+) strand; PAM type: NRG; PAM sequence: GAG
tagaggggggattgagaggt

SEQ ID NO: 118969 - DNA, 20 bp, Artificial Sequence
  Description of Artificial Sequence: Synthetic oligonucleotide
  Target: ATXN1; (+) strand; PAM type: NRG; PAM sequence: AGG
agaggggggattgagaggtg

SEQ ID NO: 118970 - DNA, 20 bp, Artificial Sequence
  Description of Artificial Sequence: Synthetic oligonucleotide
  Target: ATXN1; (+) strand; PAM type: NRG; PAM sequence: CAG
gggggattgagaggtgaggc

SEQ ID NO: 118971 - DNA, 20 bp, Artificial Sequence
  Description of Artificial Sequence: Synthetic oligonucleotide
  Target: ATXN1; (+) strand; PAM type: NRG; PAM sequence: TGG
gattgagaggtgaggccagc

SEQ ID NO: 118972 - DNA, 20 bp, Artificial Sequence
  Description of Artificial Sequence: Synthetic oligonucleotide
  Target: ATXN1; (+) strand; PAM type: NRG; PAM sequence: TGG
gtgaggccagctggacttcc

SEQ ID NO: 118973 - DNA, 20 bp, Artificial Sequence
  Description of Artificial Sequence: Synthetic oligonucleotide
  Target: ATXN1; (+) strand; PAM type: NRG; PAM sequence: GGG
tgaggccagctggacttcct

SEQ ID NO: 118974 - DNA, 20 bp, Artificial Sequence
  Description of Artificial Sequence: Synthetic oligonucleotide
  Target: ATXN1; (+) strand; PAM type: NRG; PAM sequence: AAG
ccagctggacttcctgggtc

SEQ ID NO: 118975 - DNA, 20 bp, Artificial Sequence
  Description of Artificial Sequence: Synthetic oligonucleotide
  Target: ATXN1; (+) strand; PAM type: NRG; PAM sequence: TAG
gctggacttcctgggtcaag

SEQ ID NO: 118976 - DNA, 20 bp, Artificial Sequence
  Description of Artificial Sequence: Synthetic oligonucleotide
  Target: ATXN1; (+) strand; PAM type: NRG; PAM sequence: AGG
ctggacttcctgggtcaagt

SEQ ID NO: 118977 - DNA, 20 bp, Artificial Sequence
  Description of Artificial Sequence: Synthetic oligonucleotide
  Target: ATXN1; (+) strand; PAM type: NRG; PAM sequence: GGG
tggacttcctgggtcaagta

SEQ ID NO: 118978 - DNA, 20 bp, Artificial Sequence
  Description of Artificial Sequence: Synthetic oligonucleotide
  Target: ATXN1; (+) strand; PAM type: NRG; PAM sequence: GAG
cctgggtcaagtagggactt

SEQ ID NO: 118979 - DNA, 20 bp, Artificial Sequence
  Description of Artificial Sequence: Synthetic oligonucleotide
  Target: ATXN1; (+) strand; PAM type: NRG; PAM sequence: AGG
ctgggtcaagtagggacttg

SEQ ID NO: 118980 - DNA, 20 bp, Artificial Sequence
  Description of Artificial Sequence: Synthetic oligonucleotide
  Target: ATXN1; (+) strand; PAM type: NRG; PAM sequence: AAG
gaggaactttcctgtcttac

SEQ ID NO: 118981 - DNA, 20 bp, Artificial Sequence
  Description of Artificial Sequence: Synthetic oligonucleotide
  Target: ATXN1; (+) strand; PAM type: NRG; PAM sequence: GAG
ggaactttcctgtcttacaa

SEQ ID NO: 118982 - DNA, 20 bp, Artificial Sequence
  Description of Artificial Sequence: Synthetic oligonucleotide
  Target: ATXN1; (+) strand; PAM type: NRG; PAM sequence: AGG
gaactttcctgtcttacaag

SEQ ID NO: 118983 - DNA, 20 bp, Artificial Sequence
  Description of Artificial Sequence: Synthetic oligonucleotide
  Target: ATXN1; (+) strand; PAM type: NRG; PAM sequence: CAG
aggatgtaaaatgcaccaat

SEQ ID NO: 118984 - DNA, 20 bp, Artificial Sequence
  Description of Artificial Sequence: Synthetic oligonucleotide
  Target: ATXN1; (+) strand; PAM type: NRG; PAM sequence: AGG
ggatgtaaaatgcaccaatc

SEQ ID NO: 118985 - DNA, 20 bp, Artificial Sequence
  Description of Artificial Sequence: Synthetic oligonucleotide
  Target: ATXN1; (+) strand; PAM type: NRG; PAM sequence: AAG
caggaactttcctgtcttac

SEQ ID NO: 118986 - DNA, 20 bp, Artificial Sequence
  Description of Artificial Sequence: Synthetic oligonucleotide
  Target: ATXN1; (+) strand; PAM type: NRG; PAM sequence: GAG
ggaactttcctgtcttacaa

SEQ ID NO: 118987 - DNA, 20 bp, Artificial Sequence
  Description of Artificial Sequence: Synthetic oligonucleotide
  Target: ATXN1; (+) strand; PAM type: NRG; PAM sequence: AGG
gaactttcctgtcttacaag

SEQ ID NO: 118988 - DNA, 20 bp, Artificial Sequence
  Description of Artificial Sequence: Synthetic oligonucleotide
  Target: ATXN1; (+) strand; PAM type: NRG; PAM sequence: CAG
ggttcgtaaaatgcaccaat

SEQ ID NO: 118989 - DNA, 20 bp, Artificial Sequence
  Description of Artificial Sequence: Synthetic oligonucleotide
  Target: ATXN1; (+) strand; PAM type: NRG; PAM sequence: AAG
actttgtaaaatgcaccaat

SEQ ID NO: 118990 - DNA, 20 bp, Artificial Sequence
  Description of Artificial Sequence: Synthetic oligonucleotide
  Target: ATXN1; (+) strand; PAM type: NRG; PAM sequence: TAG
gctctgtaaaacgcaccaat

SEQ ID NO: 118991 - DNA, 20 bp, Artificial Sequence
  Description of Artificial Sequence: Synthetic oligonucleotide
  Target: ATXN1; (+) strand; PAM type: NRG; PAM sequence: CAG
gctctgtaaaatgcatcaat

SEQ ID NO: 118992 - DNA, 20 bp, Artificial Sequence
  Description of Artificial Sequence: Synthetic oligonucleotide
  Target: ATXN1; (+) strand; PAM type: NRG; PAM sequence: CAG
ctgtaaaatgcatcaatcag

SEQ ID NO: 118993 - DNA, 20 bp, Artificial Sequence
  Description of Artificial Sequence: Synthetic oligonucleotide
  Target: ATXN1; (+) strand; PAM type: NRG; PAM sequence: AGG
tgtaaaatgcatcaatcagc

SEQ ID NO: 118994 - DNA, 20 bp, Artificial Sequence
  Description of Artificial Sequence: Synthetic oligonucleotide
  Target: ATXN1; (+) strand; PAM type: NRG; PAM sequence: AAG
catcaatcagcaggattcta

SEQ ID NO: 118995 - DNA, 20 bp, Artificial Sequence
  Description of Artificial Sequence: Synthetic oligonucleotide
  Target: ATXN1; (+) strand; PAM type: NRG; PAM sequence: AGG
atcaatcagcaggattctaa

SEQ ID NO: 118996 - DNA, 20 bp, Artificial Sequence
  Description of Artificial Sequence: Synthetic oligonucleotide
  Target: ATXN1; (+) strand; PAM type: NRG; PAM sequence: TAG
aatcagcaggattctaaagg

SEQ ID NO: 118997 - DNA, 20 bp, Artificial Sequence
  Description of Artificial Sequence: Synthetic oligonucleotide
  Target: ATXN1; (+) strand; PAM type: NRG; PAM sequence: CAG
attctaaaggtagccaatcg

SEQ ID NO: 118998 - DNA, 20 bp, Artificial Sequence
  Description of Artificial Sequence: Synthetic oligonucleotide
  Target: ATXN1; (+) strand; PAM type: NRG; PAM sequence: AGG
ttctaaaggtagccaatcgc

SEQ ID NO: 118999 - DNA, 20 bp, Artificial Sequence
  Description of Artificial Sequence: Synthetic oligonucleotide
  Target: ATXN1; (+) strand; PAM type: NRG; PAM sequence: GGG
tctaaaggtagccaatcgca

SEQ ID NO: 119000 - DNA, 20 bp, Artificial Sequence
  Description of Artificial Sequence: Synthetic oligonucleotide
  Target: ATXN1; (+) strand; PAM type: NRG; PAM sequence: GAG
taaaggtagccaatcgcagg

SEQ ID NO: 119001 - DNA, 20 bp, Artificial Sequence
  Description of Artificial Sequence: Synthetic oligonucleotide
  Target: ATXN1; (+) strand; PAM type: NRG; PAM sequence: AGG
aaaggtagccaatcgcaggg

SEQ ID NO: 119002 - DNA, 20 bp, Artificial Sequence
  Description of Artificial Sequence: Synthetic oligonucleotide
  Target: ATXN1; (+) strand; PAM type: NRG; PAM sequence: AAG
tcgcagggaggattgaaaaa

SEQ ID NO: 119003 - DNA, 20 bp, Artificial Sequence
  Description of Artificial Sequence: Synthetic oligonucleotide
  Target: ATXN1; (+) strand; PAM type: NRG; PAM sequence: AGG
cgcagggaggattgaaaaaa

SEQ ID NO: 119004 - DNA, 20 bp, Artificial Sequence
  Description of Artificial Sequence: Synthetic oligonucleotide
  Target: ATXN1; (+) strand; PAM type: NRG; PAM sequence: GGG
gcagggaggattgaaaaaaa

SEQ ID NO: 119005 - DNA, 20 bp, Artificial Sequence
  Description of Artificial Sequence: Synthetic oligonucleotide
  Target: ATXN1; (+) strand; PAM type: NRG; PAM sequence: CAG
tgaaaaaaagggcactctga

SEQ ID NO: 119006 - DNA, 20 bp, Artificial Sequence
  Description of Artificial Sequence: Synthetic oligonucleotide
  Target: ATXN1; (+) strand; PAM type: NRG; PAM sequence: CAG
aaaagggcactctgacagaa

SEQ ID NO: 119007 - DNA, 20 bp, Artificial Sequence
  Description of Artificial Sequence: Synthetic oligonucleotide
  Target: ATXN1; (+) strand; PAM type: NRG; PAM sequence: TGG
gcactctgacagaacagaaa

SEQ ID NO: 119008 - DNA, 20 bp, Artificial Sequence
  Description of Artificial Sequence: Synthetic oligonucleotide
  Target: ATXN1; (+) strand; PAM type: NRG; PAM sequence: TGG
gacagaacagaaatggaaca

SEQ ID NO: 119009 - DNA, 20 bp, Artificial Sequence
  Description of Artificial Sequence: Synthetic oligonucleotide
  Target: ATXN1; (+) strand; PAM type: NRG; PAM sequence: GGG
acagaacagaaatggaacat

SEQ ID NO: 119010 - DNA, 20 bp, Artificial Sequence
  Description of Artificial Sequence: Synthetic oligonucleotide
  Target: ATXN1; (+) strand; PAM type: NRG; PAM sequence: CAG
gaacagaaatggaacatggg

SEQ ID NO: 119011 - DNA, 20 bp, Artificial Sequence
  Description of Artificial Sequence: Synthetic oligonucleotide
  Target: ATXN1; (+) strand; PAM type: NRG; PAM sequence: AGG
aacagaaatggaacatgggc

SEQ ID NO: 119012 - DNA, 20 bp, Artificial Sequence
  Description of Artificial Sequence: Synthetic oligonucleotide
  Target: ATXN1; (+) strand; PAM type: NRG; PAM sequence: GGG
acagaaatggaacatgggca

SEQ ID NO: 119013 - DNA, 20 bp, Artificial Sequence
  Description of Artificial Sequence: Synthetic oligonucleotide
  Target: ATXN1; (+) strand; PAM type: NRG; PAM sequence: AAG
gaacatgggcagggacaaat

SEQ ID NO: 119014 - DNA, 20 bp, Artificial Sequence
  Description of Artificial Sequence: Synthetic oligonucleotide
  Target: ATXN1; (+) strand; PAM type: NRG; PAM sequence: AGG
aacatgggcagggacaaata

SEQ ID NO: 119015 - DNA, 20 bp, Artificial Sequence
  Description of Artificial Sequence: Synthetic oligonucleotide
  Target: ATXN1; (+) strand; PAM type: NRG; PAM sequence: GGG
acatgggcagggacaaataa

SEQ ID NO: 119016 - DNA, 20 bp, Artificial Sequence
  Description of Artificial Sequence: Synthetic oligonucleotide
  Target: ATXN1; (+) strand; PAM type: NRG; PAM sequence: AAG
agggacaaataagggaataa

SEQ ID NO: 119017 - DNA, 20 bp, Artificial Sequence
  Description of Artificial Sequence: Synthetic oligonucleotide
  Target: ATXN1; (+) strand; PAM type: NRG; PAM sequence: TGG
acaaataagggaataaaagc

SEQ ID NO: 119018 - DNA, 20 bp, Artificial Sequence
  Description of Artificial Sequence: Synthetic oligonucleotide
  Target: ATXN1; (+) strand; PAM type: NRG; PAM sequence: CAG
ggaataaaagctggccacca

SEQ ID NO: 119019 - DNA, 20 bp, Artificial Sequence
  Description of Artificial Sequence: Synthetic oligonucleotide
  Target: ATXN1; (+) strand; PAM type: NRG; PAM sequence: CAG
taaaagctggccaccacagc

SEQ ID NO: 119020 - DNA, 20 bp, Artificial Sequence
  Description of Artificial Sequence: Synthetic oligonucleotide
  Target: ATXN1; (+) strand; PAM type: NRG; PAM sequence: CAG
aagctggccaccacagccag

SEQ ID NO: 119021 - DNA, 20 bp, Artificial Sequence
  Description of Artificial Sequence: Synthetic oligonucleotide
  Target: ATXN1; (+) strand; PAM type: NRG; PAM sequence: CAG
ctggccaccacagccagcag

SEQ ID NO: 119022 - DNA, 20 bp, Artificial Sequence
  Description of Artificial Sequence: Synthetic oligonucleotide
  Target: ATXN1; (+) strand; PAM type: NRG; PAM sequence: TGG
gccagcagcagcaacccact

SEQ ID NO: 119023 - DNA, 20 bp, Artificial Sequence
  Description of Artificial Sequence: Synthetic oligonucleotide
  Target: ATXN1; (+) strand; PAM type: NRG; PAM sequence: GGG
ccagcagcagcaacccactt

SEQ ID NO: 119024 - DNA, 20 bp, Artificial Sequence
  Description of Artificial Sequence: Synthetic oligonucleotide
  Target: ATXN1; (+) strand; PAM type: NRG; PAM sequence: TGG
ttgggtccccttccacgctg

SEQ ID NO: 119025 - DNA, 20 bp, Artificial Sequence
  Description of Artificial Sequence: Synthetic oligonucleotide
  Target: ATXN1; (+) strand; PAM type: NRG; PAM sequence: AAG
ggtccccttccacgctgtgg

SEQ ID NO: 119026 - DNA, 20 bp, Artificial Sequence
  Description of Artificial Sequence: Synthetic oligonucleotide
  Target: ATXN1; (+) strand; PAM type: NRG; PAM sequence: TGG
ccttgctactgctcactctt

SEQ ID NO: 119027 - DNA, 20 bp, Artificial Sequence
  Description of Artificial Sequence: Synthetic oligonucleotide
  Target: ATXN1; (+) strand; PAM type: NRG; PAM sequence: GGG
cttgctactgctcactcttt

SEQ ID NO: 119028 - DNA, 20 bp, Artificial Sequence
  Description of Artificial Sequence: Synthetic oligonucleotide
  Target: ATXN1; (+) strand; PAM type: NRG; PAM sequence: AAG
tttgggtccatgccatcttt

SEQ ID NO: 119029 - DNA, 20 bp, Artificial Sequence
  Description of Artificial Sequence: Synthetic oligonucleotide
  Target: ATXN1; (+) strand; PAM type: NRG; PAM sequence: GAG
tgggtccatgccatctttaa

SEQ ID NO: 119030 - DNA, 20 bp, Artificial Sequence
  Description of Artificial Sequence: Synthetic oligonucleotide
  Target: ATXN1; (+) strand; PAM type: NRG; PAM sequence: AAG
gagctgtaacactcaccatg

SEQ ID NO: 119031 - DNA, 20 bp, Artificial Sequence
  Description of Artificial Sequence: Synthetic oligonucleotide
  Target: ATXN1; (+) strand; PAM type: NRG; PAM sequence: AGG
agctgtaacactcaccatga

SEQ ID NO: 119032 - DNA, 20 bp, Artificial Sequence
  Description of Artificial Sequence: Synthetic oligonucleotide
  Target: ATXN1; (+) strand; PAM type: NRG; PAM sequence: CAG
acactcaccatgaaggtccg

SEQ ID NO: 119033 - DNA, 20 bp, Artificial Sequence
  Description of Artificial Sequence: Synthetic oligonucleotide
  Target: ATXN1; (+) strand; PAM type: NRG; PAM sequence: AAG
ggtccgcagctccattcttg

SEQ ID NO: 119034 - DNA, 20 bp, Artificial Sequence
  Description of Artificial Sequence: Synthetic oligonucleotide
  Target: ATXN1; (+) strand; PAM type: NRG; PAM sequence: CAG
cgcagctccattcttgaagt

SEQ ID NO: 119035 - DNA, 20 bp, Artificial Sequence
  Description of Artificial Sequence: Synthetic oligonucleotide
  Target: ATXN1; (+) strand; PAM type: NRG; PAM sequence: GAG
gctccattcttgaagtcagc

SEQ ID NO: 119036 - DNA, 20 bp, Artificial Sequence
  Description of Artificial Sequence: Synthetic oligonucleotide
  Target: ATXN1; (+) strand; PAM type: NRG; PAM sequence: CGG
cagcgagaccataaacccac

SEQ ID NO: 119037 - DNA, 20 bp, Artificial Sequence
  Description of Artificial Sequence: Synthetic oligonucleotide
  Target: ATXN1; (+) strand; PAM type: NRG; PAM sequence: TAG
cgagaccataaacccaccgg

SEQ ID NO: 119038 - DNA, 20 bp, Artificial Sequence
  Description of Artificial Sequence: Synthetic oligonucleotide
  Target: ATXN1; (+) strand; PAM type: NRG; PAM sequence: AGG
gagaccataaacccaccggt

SEQ ID NO: 119039 - DNA, 20 bp, Artificial Sequence
  Description of Artificial Sequence: Synthetic oligonucleotide
  Target: ATXN1; (+) strand; PAM type: NRG; PAM sequence: CAG
ccaccggtaggaaccaactc

SEQ ID NO: 119040 - DNA, 20 bp, Artificial Sequence
  Description of Artificial Sequence: Synthetic oligonucleotide
  Target: ATXN1; (+) strand; PAM type: NRG; PAM sequence: AAG
gaaccaactccagacacaaa

SEQ ID NO: 119041 - DNA, 20 bp, Artificial Sequence
  Description of Artificial Sequence: Synthetic oligonucleotide
  Target: ATXN1; (+) strand; PAM type: NRG; PAM sequence: TAG
actccagacacaaaaagaca

SEQ ID NO: 119042 - DNA, 20 bp, Artificial Sequence
  Description of Artificial Sequence: Synthetic oligonucleotide
  Target: ATXN1; (+) strand; PAM type: NRG; PAM sequence: GAG
tccagacacaaaaagacata

SEQ ID NO: 119043 - DNA, 20 bp, Artificial Sequence
  Description of Artificial Sequence: Synthetic oligonucleotide
  Target: ATXN1; (+) strand; PAM type: NRG; PAM sequence: AGG
ccagacacaaaaagacatag

SEQ ID NO: 119044 - DNA, 20 bp, Artificial Sequence
  Description of Artificial Sequence: Synthetic oligonucleotide
  Target: ATXN1; (+) strand; PAM type: NRG; PAM sequence: AAG
acacgcatattgccacatga

SEQ ID NO: 119045 - DNA, 20 bp, Artificial Sequence
  Description of Artificial Sequence: Synthetic oligonucleotide
  Target: ATXN1; (+) strand; PAM type: NRG; PAM sequence: AAG
cgcatattgccacatgaaag

SEQ ID NO: 119046 - DNA, 20 bp, Artificial Sequence
  Description of Artificial Sequence: Synthetic oligonucleotide
  Target: ATXN1; (+) strand; PAM type: NRG; PAM sequence: AAG
atgaaagaagccaatgtgaa

SEQ ID NO: 119047 - DNA, 20 bp, Artificial Sequence
  Description of Artificial Sequence: Synthetic oligonucleotide
  Target: ATXN1; (+) strand; PAM type: NRG; PAM sequence: AGG
tgaaagaagccaatgtgaaa

SEQ ID NO: 119048 - DNA, 20 bp, Artificial Sequence
  Description of Artificial Sequence: Synthetic oligonucleotide
  Target: ATXN1; (+) strand; PAM type: NRG; PAM sequence: GGG
gaaagaagccaatgtgaaaa

SEQ ID NO: 119049 - DNA, 20 bp, Artificial Sequence
  Description of Artificial Sequence: Synthetic oligonucleotide
  Target: ATXN1; (+) strand; PAM type: NRG; PAM sequence: TGG
attccaactttatgacattt

SEQ ID NO: 119050 - DNA, 20 bp, Artificial Sequence
  Description of Artificial Sequence: Synthetic oligonucleotide
  Target: ATXN1; (+) strand; PAM type: NRG; PAM sequence: AAG
aactttatgacattttggaa

SEQ ID NO: 119051 - DNA, 20 bp, Artificial Sequence
  Description of Artificial Sequence: Synthetic oligonucleotide
  Target: ATXN1; (+) strand; PAM type: NRG; PAM sequence: AGG
actttatgacattttggaaa

SEQ ID NO: 119052 - DNA, 20 bp, Artificial Sequence
  Description of Artificial Sequence: Synthetic oligonucleotide
  Target: ATXN1; (+) strand; PAM type: NRG; PAM sequence: AAG
atgacattttggaaaaggca

SEQ ID NO: 119053 - DNA, 20 bp, Artificial Sequence
  Description of Artificial Sequence: Synthetic oligonucleotide
  Target: ATXN1; (+) strand; PAM type: NRG; PAM sequence: CAG
ttttggaaaaggcaaagcta

SEQ ID NO: 119054 - DNA, 20 bp, Artificial Sequence
  Description of Artificial Sequence: Synthetic oligonucleotide
  Target: ATXN1; (+) strand; PAM type: NRG; PAM sequence: AGG
tttggaaaaggcaaagctac

SEQ ID NO: 119055 - DNA, 20 bp, Artificial Sequence
  Description of Artificial Sequence: Synthetic oligonucleotide
  Target: ATXN1; (+) strand; PAM type: NRG; PAM sequence: GGG
ttggaaaaggcaaagctaca

SEQ ID NO: 119056 - DNA, 20 bp, Artificial Sequence
  Description of Artificial Sequence: Synthetic oligonucleotide
  Target: ATXN1; (+) strand; PAM type: NRG; PAM sequence: TAG
aaaaggcaaagctacaggga

SEQ ID NO: 119057 - DNA, 20 bp, Artificial Sequence
  Description of Artificial Sequence: Synthetic oligonucleotide
  Target: ATXN1; (+) strand; PAM type: NRG; PAM sequence: CAG
gtaaaaaaaaaaaaaaaaat

SEQ ID NO: 119058 - DNA, 20 bp, Artificial Sequence
  Description of Artificial Sequence: Synthetic oligonucleotide
  Target: ATXN1; (+) strand; PAM type: NRG; PAM sequence: AGG
taaaaaaaaaaaaaaaaatc

SEQ ID NO: 119059 - DNA, 20 bp, Artificial Sequence
  Description of Artificial Sequence: Synthetic oligonucleotide
  Target: ATXN1; (+) strand; PAM type: NRG; PAM sequence: GGG
aaaaaaaaaaaaaaaaatca

SEQ ID NO: 119060 - DNA, 20 bp, Artificial Sequence
  Description of Artificial Sequence: Synthetic oligonucleotide
  Target: ATXN1; (+) strand; PAM type: NRG; PAM sequence: GGG
aaaaaaaaaaaaaaaatcag

SEQ ID NO: 119061 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaaaatcaggggttt

SEQ ID NO: 119062 - DNA, 20 bp, Artificial Sequence
  Description of Artificial Sequence: Synthetic oligonucleotide
  Target: ATXN1; (+) strand; PAM type: NRG; PAM sequence: GGG
aaaaaaaaatcaggggtttt

SEQ ID NO: 119063 - DNA, 20 bp, Artificial Sequence
  Description of Artificial Sequence: Synthetic oligonucleotide
  Target: ATXN1; (+) strand; PAM type: NRG; PAM sequence: GGG
aaaaaaaatcaggggttttg

SEQ ID NO: 119064 - DNA, 20 bp, Artificial Sequence
  Description of Artificial Sequence: Synthetic oligonucleotide
  Target: ATXN1; (+) strand; PAM type: NRG; PAM sequence: TGG
aaatcaggggttttggggat

SEQ ID NO: 119065 - DNA, 20 bp, Artificial Sequence
  Description of Artificial Sequence: Synthetic oligonucleotide
  Target: ATXN1; (+) strand; PAM type: NRG; PAM sequence: GGG
aatcaggggttttggggatt

SEQ ID NO: 119066 - DNA, 20 bp, Artificial Sequence
  Description of Artificial Sequence: Synthetic oligonucleotide
  Target: ATXN1; (+) strand; PAM type: NRG; PAM sequence: GAG
tcaggggttttggggattgg

SEQ ID NO: 119067 - DNA, 20 bp, Artificial Sequence
  Description of Artificial Sequence: Synthetic oligonucleotide
  Target: ATXN1; (+) strand; PAM type: NRG; PAM sequence: AGG
caggggttttggggattggg

SEQ ID NO: 119068 - DNA, 20 bp, Artificial Sequence
  Description of Artificial Sequence: Synthetic oligonucleotide
  Target: ATXN1; (+) strand; PAM type: NRG; PAM sequence: AAG
ggggattgggaggaacaaat

SEQ ID NO: 119069 - DNA, 20 bp, Artificial Sequence
  Description of Artificial Sequence: Synthetic oligonucleotide
  Target: ATXN1; (+) strand; PAM type: NRG; PAM sequence: CAG
gattgggaggaacaaataag

SEQ ID NO: 119070 - DNA, 20 bp, Artificial Sequence
  Description of Artificial Sequence: Synthetic oligonucleotide
  Target: ATXN1; (+) strand; PAM type: NRG; PAM sequence: GAG
ttgggaggaacaaataagca

SEQ ID NO: 119071 - DNA, 20 bp, Artificial Sequence
  Description of Artificial Sequence: Synthetic oligonucleotide
  Target: ATXN1; (+) strand; PAM type: NRG; PAM sequence: AAG
gaacaaataagcagagcaca

SEQ ID NO: 119072 - DNA, 20 bp, Artificial Sequence
  Description of Artificial Sequence: Synthetic oligonucleotide
  Target: ATXN1; (+) strand; PAM type: NRG; PAM sequence: GAG
acaaataagcagagcacaaa

SEQ ID NO: 119073 - DNA, 20 bp, Artificial Sequence
  Description of Artificial Sequence: Synthetic oligonucleotide
  Target: ATXN1; (+) strand; PAM type: NRG; PAM sequence: TAG
agcagagcacaaagagttgt

SEQ ID NO: 119074 - DNA, 20 bp, Artificial Sequence
  Description of Artificial Sequence: Synthetic oligonucleotide
  Target: ATXN1; (+) strand; PAM type: NRG; PAM sequence: AGG
gcagagcacaaagagttgtt

SEQ ID NO: 119075 - DNA, 20 bp, Artificial Sequence
  Description of Artificial Sequence: Synthetic oligonucleotide
  Target: ATXN1; (+) strand; PAM type: NRG; PAM sequence: CAG
tgtcatctatttgtcaaaca

SEQ ID NO: 119076 - DNA, 20 bp, Artificial Sequence
  Description of Artificial Sequence: Synthetic oligonucleotide
  Target: ATXN1; (+) strand; PAM type: NRG; PAM sequence: CAG
gtcaaacacagaatgtacaa

SEQ ID NO: 119077 - DNA, 20 bp, Artificial Sequence
  Description of Artificial Sequence: Synthetic oligonucleotide
  Target: ATXN1; (+) strand; PAM type: NRG; PAM sequence: AGG
tcaaacacagaatgtacaac

SEQ ID NO: 119078 - DNA, 20 bp, Artificial Sequence
  Description of Artificial Sequence: Synthetic oligonucleotide
  Target: ATXN1; (+) strand; PAM type: NRG; PAM sequence: AAG
aacacagaatgtacaacagg

SEQ ID NO: 119079 - DNA, 20 bp, Artificial Sequence
  Description of Artificial Sequence: Synthetic oligonucleotide
  Target: ATXN1; (+) strand; PAM type: NRG; PAM sequence: TAG
atgaactctaacatgaacta

SEQ ID NO: 119080 - DNA, 20 bp, Artificial Sequence
  Description of Artificial Sequence: Synthetic oligonucleotide
  Target: ATXN1; (+) strand; PAM type: NRG; PAM sequence: TAG
ctaacatgaactatagactt

SEQ ID NO: 119081 - DNA, 20 bp, Artificial Sequence
  Description of Artificial Sequence: Synthetic oligonucleotide
  Target: ATXN1; (+) strand; PAM type: NRG; PAM sequence: TAG
taataataatgtatccatat

SEQ ID NO: 119082 - DNA, 20 bp, Artificial Sequence
  Description of Artificial Sequence: Synthetic oligonucleotide
  Target: ATXN1; (+) strand; PAM type: NRG; PAM sequence: AAG
agttcaatttcaacaaatgt

SEQ ID NO: 119083 - DNA, 20 bp, Artificial Sequence
  Description of Artificial Sequence: Synthetic oligonucleotide
  Target: ATXN1; (+) strand; PAM type: NRG; PAM sequence: AAG
tttcaacaaatgtaagatgc

SEQ ID NO: 119084 - DNA, 20 bp, Artificial Sequence
  Description of Artificial Sequence: Synthetic oligonucleotide
  Target: ATXN1; (+) strand; PAM type: NRG; PAM sequence: TAG
aaatgtaagatgcaagatgt

SEQ ID NO: 119085 - DNA, 20 bp, Artificial Sequence
  Description of Artificial Sequence: Synthetic oligonucleotide
  Target: ATXN1; (+) strand; PAM type: NRG; PAM sequence: CAG
tgtaagatgcaagatgttag

SEQ ID NO: 119086 - DNA, 20 bp, Artificial Sequence
  Description of Artificial Sequence: Synthetic oligonucleotide
  Target: ATXN1; (+) strand; PAM type: NRG; PAM sequence: TAG
aagatgcaagatgttagcag

SEQ ID NO: 119087 - DNA, 20 bp, Artificial Sequence
  Description of Artificial Sequence: Synthetic oligonucleotide
  Target: ATXN1; (+) strand; PAM type: NRG; PAM sequence: AGG
agatgcaagatgttagcagt

SEQ ID NO: 119088 - DNA, 20 bp, Artificial Sequence
  Description of Artificial Sequence: Synthetic oligonucleotide
  Target: ATXN1; (+) strand; PAM type: NRG; PAM sequence: GGG
gatgcaagatgttagcagta

SEQ ID NO: 119089 - DNA, 20 bp, Artificial Sequence
  Description of Artificial Sequence: Synthetic oligonucleotide
  Target: ATXN1; (+) strand; PAM type: NRG; PAM sequence: CAG
gcagtagggacactgtttgt

SEQ ID NO: 119090 - DNA, 20 bp, Artificial Sequence
  Description of Artificial Sequence: Synthetic oligonucleotide
  Target: ATXN1; (+) strand; PAM type: NRG; PAM sequence: AGG
cagtagggacactgtttgtc

SEQ ID NO: 119091 - DNA, 20 bp, Artificial Sequence
  Description of Artificial Sequence: Synthetic oligonucleotide
  Target: ATXN1; (+) strand; PAM type: NRG; PAM sequence: GGG
agtagggacactgtttgtca

SEQ ID NO: 119092 - DNA, 20 bp, Artificial Sequence
  Description of Artificial Sequence: Synthetic oligonucleotide
  Target: ATXN1; (+) strand; PAM type: NRG; PAM sequence: GGG
gtagggacactgtttgtcag

SEQ ID NO: 119093 - DNA, 20 bp, Artificial Sequence
  Description of Artificial Sequence: Synthetic oligonucleotide
  Target: ATXN1; (+) strand; PAM type: NRG; PAM sequence: CGG
ggacactgtttgtcaggggt

SEQ ID NO: 119094 - DNA, 20 bp, Artificial Sequence
  Description of Artificial Sequence: Synthetic oligonucleotide
  Target: ATXN1; (+) strand; PAM type: NRG; PAM sequence: GGG
gacactgtttgtcaggggtc

SEQ ID NO: 119095 - DNA, 20 bp, Artificial Sequence
  Description of Artificial Sequence: Synthetic oligonucleotide
  Target: ATXN1; (+) strand; PAM type: NRG; PAM sequence: GGG
acactgtttgtcaggggtcg

SEQ ID NO: 119096 - DNA, 20 bp, Artificial Sequence
  Description of Artificial Sequence: Synthetic oligonucleotide
  Target: ATXN1; (+) strand; PAM type: NRG; PAM sequence: GAG
actgtttgtcaggggtcggg

SEQ ID NO: 119097 - DNA, 20 bp, Artificial Sequence
  Description of Artificial Sequence: Synthetic oligonucleotide
  Target: ATXN1; (+) strand; PAM type: NRG; PAM sequence: AGG
ctgtttgtcaggggtcgggg

SEQ ID NO: 119098 - DNA, 20 bp, Artificial Sequence
  Description of Artificial Sequence: Synthetic oligonucleotide
  Target: ATXN1; (+) strand; PAM type: NRG; PAM sequence: TAG
ttgtcaggggtcggggaggc

SEQ ID NO: 119099 - DNA, 20 bp, Artificial Sequence
  Description of Artificial Sequence: Synthetic oligonucleotide
  Target: ATXN1; (+) strand; PAM type: NRG; PAM sequence: AGG
tgtcaggggtcggggaggct

SEQ ID NO: 119100 - DNA, 20 bp, Artificial Sequence
  Description of Artificial Sequence: Synthetic oligonucleotide
  Target: ATXN1; (+) strand; PAM type: NRG; PAM sequence: TAG
ggtcggggaggctaggaata

SEQ ID NO: 119101 - DNA, 20 bp, Artificial Sequence
  Description of Artificial Sequence: Synthetic oligonucleotide
  Target: ATXN1; (+) strand; PAM type: NRG; PAM sequence: AGG
gtcggggaggctaggaatat

SEQ ID NO: 119102 - DNA, 20 bp, Artificial Sequence
  Description of Artificial Sequence: Synthetic oligonucleotide
  Target: ATXN1; (+) strand; PAM type: NRG; PAM sequence: AAG
cctaaaactgttctataaaa

SEQ ID NO: 119103 - DNA, 20 bp, Artificial Sequence
  Description of Artificial Sequence: Synthetic oligonucleotide
  Target: ATXN1; (+) strand; PAM type: NRG; PAM sequence: CAG
caacaacaacactgcactga

SEQ ID NO: 119104 - DNA, 20 bp, Artificial Sequence
  Description of Artificial Sequence: Synthetic oligonucleotide
  Target: ATXN1; (+) strand; PAM type: NRG; PAM sequence: AAG
actgcactgacagctgtttg

SEQ ID NO: 119105 - DNA, 20 bp, Artificial Sequence
  Description of Artificial Sequence: Synthetic oligonucleotide
  Target: ATXN1; (+) strand; PAM type: NRG; PAM sequence: CAG
gctgtttgaagtgttcctcc

SEQ ID NO: 119106 - DNA, 20 bp, Artificial Sequence
  Description of Artificial Sequence: Synthetic oligonucleotide
  Target: ATXN1; (+) strand; PAM type: NRG; PAM sequence: AGG
ctgtttgaagtgttcctccc

SEQ ID NO: 119107 - DNA, 20 bp, Artificial Sequence
  Description of Artificial Sequence: Synthetic oligonucleotide
  Target: ATXN1; (+) strand; PAM type: NRG; PAM sequence: CAG
gttcctcccaggtgtccttc

SEQ ID NO: 119108 - DNA, 20 bp, Artificial Sequence
  Description of Artificial Sequence: Synthetic oligonucleotide
  Target: ATXN1; (+) strand; PAM type: NRG; PAM sequence: TAG
ccaggtgtccttccagatac

SEQ ID NO: 119109 - DNA, 20 bp, Artificial Sequence
  Description of Artificial Sequence: Synthetic oligonucleotide
  Target: ATXN1; (+) strand; PAM type: NRG; PAM sequence: TAG
gtgtccttccagatactagc

SEQ ID NO: 119110 - DNA, 20 bp, Artificial Sequence
  Description of Artificial Sequence: Synthetic oligonucleotide
  Target: ATXN1; (+) strand; PAM type: NRG; PAM sequence: GAG
gtccttccagatactagcta

SEQ ID NO: 119111 - DNA, 20 bp, Artificial Sequence
  Description of Artificial Sequence: Synthetic oligonucleotide
  Target: ATXN1; (+) strand; PAM type: NRG; PAM sequence: AAG
tccagatactagctagagcc

SEQ ID NO: 119112 - DNA, 20 bp, Artificial Sequence
  Description of Artificial Sequence: Synthetic oligonucleotide
  Target: ATXN1; (+) strand; PAM type: NRG; PAM sequence: TGG
agatactagctagagccaag

SEQ ID NO: 119113 - DNA, 20 bp, Artificial Sequence
  Description of Artificial Sequence: Synthetic oligonucleotide
  Target: ATXN1; (+) strand; PAM type: NRG; PAM sequence: CAG
tagagccaagtggaattaat

SEQ ID NO: 119114 - DNA, 20 bp, Artificial Sequence
  Description of Artificial Sequence: Synthetic oligonucleotide
  Target: ATXN1; (+) strand; PAM type: NRG; PAM sequence: AGG
agagccaagtggaattaatc

SEQ ID NO: 119115 - DNA, 20 bp, Artificial Sequence
  Description of Artificial Sequence: Synthetic oligonucleotide
  Target: ATXN1; (+) strand; PAM type: NRG; PAM sequence: AAG
ccaagtggaattaatcaggc

SEQ ID NO: 119116 - DNA, 20 bp, Artificial Sequence
  Description of Artificial Sequence: Synthetic oligonucleotide
  Target: ATXN1; (+) strand; PAM type: NRG; PAM sequence: AGG
caagtggaattaatcaggca

SEQ ID NO: 119117 - DNA, 20 bp, Artificial Sequence
  Description of Artificial Sequence: Synthetic oligonucleotide
  Target: ATXN1; (+) strand; PAM type: NRG; PAM sequence: CGG
attaatcaggcaaggtgcaa

SEQ ID NO: 119118 - DNA, 20 bp, Artificial Sequence
  Description of Artificial Sequence: Synthetic oligonucleotide
  Target: ATXN1; (+) strand; PAM type: NRG; PAM sequence: TGG
atcaggcaaggtgcaacggc

SEQ ID NO: 119119 - DNA, 20 bp, Artificial Sequence
  Description of Artificial Sequence: Synthetic oligonucleotide
  Target: ATXN1; (+) strand; PAM type: NRG; PAM sequence: GGG
tcaggcaaggtgcaacggct

SEQ ID NO: 119120 - DNA, 20 bp, Artificial Sequence
  Description of Artificial Sequence: Synthetic oligonucleotide
  Target: ATXN1; (+) strand; PAM type: NRG; PAM sequence: TGG
caaggtgcaacggctgggtg

SEQ ID NO: 119121 - DNA, 20 bp, Artificial Sequence
  Description of Artificial Sequence: Synthetic oligonucleotide
  Target: ATXN1; (+) strand; PAM type: NRG; PAM sequence: TAG
ggtgcaacggctgggtgtgg

SEQ ID NO: 119122 - DNA, 20 bp, Artificial Sequence
  Description of Artificial Sequence: Synthetic oligonucleotide
  Target: ATXN1; (+) strand; PAM type: NRG; PAM sequence: CAG
gtagctgatgcctgtaatcc

SEQ ID NO: 119123 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagcactt

SEQ ID NO: 119124 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 119125 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 119126 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 119127 - DNA, 20 bp, Artificial Sequence
  Description of Artificial Sequence: Synthetic oligonucleotide
  Target: ATXN1; (+) strand; PAM type: NRG; PAM sequence: AAG
tcccagcactttgggaggcc

SEQ ID NO: 119128 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggcca

SEQ ID NO: 119129 - DNA, 20 bp, Artificial Sequence
  Description of Artificial Sequence: Synthetic oligonucleotide
  Target: ATXN1; (+) strand; PAM type: NRG; PAM sequence: CAG
agcactttgggaggccaagg

SEQ ID NO: 119130 - DNA, 20 bp, Artificial Sequence
  Description of Artificial Sequence: Synthetic oligonucleotide
  Target: ATXN1; (+) strand; PAM type: NRG; PAM sequence: AGG
gcactttgggaggccaaggc

SEQ ID NO: 119131 - DNA, 20 bp, Artificial Sequence
  Description of Artificial Sequence: Synthetic oligonucleotide
  Target: ATXN1; (+) strand; PAM type: NRG; PAM sequence: AAG
ccaaggcaggttgatcacca

SEQ ID NO: 119132 - DNA, 20 bp, Artificial Sequence
  Description of Artificial Sequence: Synthetic oligonucleotide
  Target: ATXN1; (+) strand; PAM type: NRG; PAM sequence: AGG
caaggcaggttgatcaccaa

SEQ ID NO: 119133 - DNA, 20 bp, Artificial Sequence
  Description of Artificial Sequence: Synthetic oligonucleotide
  Target: ATXN1; (+) strand; PAM type: NRG; PAM sequence: GGG
aaggcaggttgatcaccaaa

SEQ ID NO: 119134 - DNA, 20 bp, Artificial Sequence
  Description of Artificial Sequence: Synthetic oligonucleotide
  Target: ATXN1; (+) strand; PAM type: NRG; PAM sequence: CAG
gcaggttgatcaccaaaggg

SEQ ID NO: 119135 - DNA, 20 bp, Artificial Sequence
  Description of Artificial Sequence: Synthetic oligonucleotide
  Target: ATXN1; (+) strand; PAM type: NRG; PAM sequence: AGG
caggttgatcaccaaagggc

SEQ ID NO: 119136 - DNA, 20 bp, Artificial Sequence
  Description of Artificial Sequence: Synthetic oligonucleotide
  Target: ATXN1; (+) strand; PAM type: NRG; PAM sequence: GAG
ggttgatcaccaaagggcag

SEQ ID NO: 119137 - DNA, 20 bp, Artificial Sequence
  Description of Artificial Sequence: Synthetic oligonucleotide
  Target: ATXN1; (+) strand; PAM type: NRG; PAM sequence: CAG
atcaccaaagggcaggagac

SEQ ID NO: 119138 - DNA, 20 bp, Artificial Sequence
  Description of Artificial Sequence: Synthetic oligonucleotide
  Target: ATXN1; (+) strand; PAM type: NRG; PAM sequence: TGG
caaagggcaggagaccagcc

SEQ ID NO: 119139 - DNA, 20 bp, Artificial Sequence
  Description of Artificial Sequence: Synthetic oligonucleotide
  Target: ATXN1; (+) strand; PAM type: NRG; PAM sequence: TGG
ggagaccagcctggccaaca

SEQ ID NO: 119140 - DNA, 20 bp, Artificial Sequence
  Description of Artificial Sequence: Synthetic oligonucleotide
  Target: ATXN1; (+) strand; PAM type: NRG; PAM sequence: TAG
aaccccgtctctactaaaaa

SEQ ID NO: 119141 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatagaaaaat

SEQ ID NO: 119142 - DNA, 20 bp, Artificial Sequence
  Description of Artificial Sequence: Synthetic oligonucleotide
  Target: ATXN1; (+) strand; PAM type: NRG; PAM sequence: TGG
ctaaaaatagaaaaattagc

SEQ ID NO: 119143 - DNA, 20 bp, Artificial Sequence
  Description of Artificial Sequence: Synthetic oligonucleotide
  Target: ATXN1; (+) strand; PAM type: NRG; PAM sequence: GGG
taaaaatagaaaaattagct

SEQ ID NO: 119144 - DNA, 20 bp, Artificial Sequence
  Description of Artificial Sequence: Synthetic oligonucleotide
  Target: ATXN1; (+) strand; PAM type: NRG; PAM sequence: TGG
atagaaaaattagctgggca

SEQ ID NO: 119145 - DNA, 20 bp, Artificial Sequence
  Description of Artificial Sequence: Synthetic oligonucleotide
  Target: ATXN1; (+) strand; PAM type: NRG; PAM sequence: TGG
gaaaaattagctgggcatgg

SEQ ID NO: 119146 - DNA, 20 bp, Artificial Sequence
  Description of Artificial Sequence: Synthetic oligonucleotide
  Target: ATXN1; (+) strand; PAM type: NRG; PAM sequence: CAG
aaattagctgggcatggtgg

SEQ ID NO: 119147 - DNA, 20 bp, Artificial Sequence
  Description of Artificial Sequence: Synthetic oligonucleotide
  Target: ATXN1; (+) strand; PAM type: NRG; PAM sequence: AGG
aattagctgggcatggtggc

SEQ ID NO: 119148 - DNA, 20 bp, Artificial Sequence
  Description of Artificial Sequence: Synthetic oligonucleotide
  Target: ATXN1; (+) strand; PAM type: NRG; PAM sequence: TAG
ggcatggtggcaggtgtctg

SEQ ID NO: 119149 - DNA, 20 bp, Artificial Sequence
  Description of Artificial Sequence: Synthetic oligonucleotide
  Target: ATXN1; (+) strand; PAM type: NRG; PAM sequence: CAG
gtggcaggtgtctgtagtcc

SEQ ID NO: 119150 - DNA, 20 bp, Artificial Sequence
  Description of Artificial Sequence: Synthetic oligonucleotide
  Target: ATXN1; (+) strand; PAM type: NRG; PAM sequence: TGG
tgtctgtagtcccagctact

SEQ ID NO: 119151 - DNA, 20 bp, Artificial Sequence
  Description of Artificial Sequence: Synthetic oligonucleotide
  Target: ATXN1; (+) strand; PAM type: NRG; PAM sequence: GGG
gtctgtagtcccagctactt

SEQ ID NO: 119152 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagctacttgg

SEQ ID NO: 119153 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagctacttggg

SEQ ID NO: 119154 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttgggaggct

SEQ ID NO: 119155 - DNA, 20 bp, Artificial Sequence
  Description of Artificial Sequence: Synthetic oligonucleotide
  Target: ATXN1; (+) strand; PAM type: NRG; PAM sequence: AGG
cccagctacttgggaggctg

SEQ ID NO: 119156 - DNA, 20 bp, Artificial Sequence
  Description of Artificial Sequence: Synthetic oligonucleotide
  Target: ATXN1; (+) strand; PAM type: NRG; PAM sequence: CAG
agctacttgggaggctgagg

SEQ ID NO: 119157 - DNA, 20 bp, Artificial Sequence
  Description of Artificial Sequence: Synthetic oligonucleotide
  Target: ATXN1; (+) strand; PAM type: NRG; PAM sequence: AGG
gctacttgggaggctgaggc

SEQ ID NO: 119158 - DNA, 20 bp, Artificial Sequence
  Description of Artificial Sequence: Synthetic oligonucleotide
  Target: ATXN1; (+) strand; PAM type: NRG; PAM sequence: GAG
tacttgggaggctgaggcag

SEQ ID NO: 119159 - DNA, 20 bp, Artificial Sequence
  Description of Artificial Sequence: Synthetic oligonucleotide
  Target: ATXN1; (+) strand; PAM type: NRG; PAM sequence: CAG
gcaggagaattgcttgaacc

SEQ ID NO: 119160 - DNA, 20 bp, Artificial Sequence
  Description of Artificial Sequence: Synthetic oligonucleotide
  Target: ATXN1; (+) strand; PAM type: NRG; PAM sequence: AGG
caggagaattgcttgaaccc

SEQ ID NO: 119161 - DNA, 20 bp, Artificial Sequence
  Description of Artificial Sequence: Synthetic oligonucleotide
  Target: ATXN1; (+) strand; PAM type: NRG; PAM sequence: GAG
ggagaattgcttgaacccag

SEQ ID NO: 119162 - DNA, 20 bp, Artificial Sequence
  Description of Artificial Sequence: Synthetic oligonucleotide
  Target: ATXN1; (+) strand; PAM type: NRG; PAM sequence: CGG
aattgcttgaacccaggaga

SEQ ID NO: 119163 - DNA, 20 bp, Artificial Sequence
  Description of Artificial Sequence: Synthetic oligonucleotide
  Target: ATXN1; (+) strand; PAM type: NRG; PAM sequence: GAG
ttgcttgaacccaggagacg

SEQ ID NO: 119164 - DNA, 20 bp, Artificial Sequence
  Description of Artificial Sequence: Synthetic oligonucleotide
  Target: ATXN1; (+) strand; PAM type: NRG; PAM sequence: AGG
tgcttgaacccaggagacgg

SEQ ID NO: 119165 - DNA, 20 bp, Artificial Sequence
  Description of Artificial Sequence: Synthetic oligonucleotide
  Target: ATXN1; (+) strand; PAM type: NRG; PAM sequence: GAG
caggagacggaggttgccgt

SEQ ID NO: 119166 - DNA, 20 bp, Artificial Sequence
  Description of Artificial Sequence: Synthetic oligonucleotide
  Target: ATXN1; (+) strand; PAM type: NRG; PAM sequence: AAG
gacggaggttgccgtgagcc

SEQ ID NO: 119167 - DNA, 20 bp, Artificial Sequence
  Description of Artificial Sequence: Synthetic oligonucleotide
  Target: ATXN1; (+) strand; PAM type: NRG; PAM sequence: CAG
aagatcgtgccactgcactc

SEQ ID NO: 119168 - DNA, 20 bp, Artificial Sequence
  Description of Artificial Sequence: Synthetic oligonucleotide
  Target: ATXN1; (+) strand; PAM type: NRG; PAM sequence: TGG
cgtgccactgcactccagcc

SEQ ID NO: 119169 - DNA, 20 bp, Artificial Sequence
  Description of Artificial Sequence: Synthetic oligonucleotide
  Target: ATXN1; (+) strand; PAM type: NRG; PAM sequence: GGG
gtgccactgcactccagcct

SEQ ID NO: 119170 - DNA, 20 bp, Artificial Sequence
  Description of Artificial Sequence: Synthetic oligonucleotide
  Target: ATXN1; (+) strand; PAM type: NRG; PAM sequence: AAG
tgcactccagcctgggtgac

SEQ ID NO: 119171 - DNA, 20 bp, Artificial Sequence
  Description of Artificial Sequence: Synthetic oligonucleotide
  Target: ATXN1; (+) strand; PAM type: NRG; PAM sequence: GAG
cactccagcctgggtgacaa

SEQ ID NO: 119172 - DNA, 20 bp, Artificial Sequence
  Description of Artificial Sequence: Synthetic oligonucleotide
  Target: ATXN1; (+) strand; PAM type: NRG; PAM sequence: CAG
aacaaaacaaaacaaaaaat

SEQ ID NO: 119173 - DNA, 20 bp, Artificial Sequence
  Description of Artificial Sequence: Synthetic oligonucleotide
  Target: ATXN1; (+) strand; PAM type: NRG; PAM sequence: AGG
acaaaacaaaacaaaaaatc

SEQ ID NO: 119174 - DNA, 20 bp, Artificial Sequence
  Description of Artificial Sequence: Synthetic oligonucleotide
  Target: ATXN1; (+) strand; PAM type: NRG; PAM sequence: GGG
caaaacaaaacaaaaaatca

SEQ ID NO: 119175 - DNA, 20 bp, Artificial Sequence
  Description of Artificial Sequence: Synthetic oligonucleotide
  Target: ATXN1; (+) strand; PAM type: NRG; PAM sequence: AAG
aacaaaacaaaaaatcaggg

SEQ ID NO: 119176 - DNA, 20 bp, Artificial Sequence
  Description of Artificial Sequence: Synthetic oligonucleotide
  Target: ATXN1; (+) strand; PAM type: NRG; PAM sequence: AGG
acaaaacaaaaaatcaggga

SEQ ID NO: 119177 - DNA, 20 bp, Artificial Sequence
  Description of Artificial Sequence: Synthetic oligonucleotide
  Target: ATXN1; (+) strand; PAM type: NRG; PAM sequence: AAG
aaatcagggaaggtgccata

SEQ ID NO: 119178 - DNA, 20 bp, Artificial Sequence
  Description of Artificial Sequence: Synthetic oligonucleotide
  Target: ATXN1; (+) strand; PAM type: NRG; PAM sequence: CAG
ggtgccataaagatgactcc

SEQ ID NO: 119179 - DNA, 20 bp, Artificial Sequence
  Description of Artificial Sequence: Synthetic oligonucleotide
  Target: ATXN1; (+) strand; PAM type: NRG; PAM sequence: AGG
gtgccataaagatgactccc

SEQ ID NO: 119180 - DNA, 20 bp, Artificial Sequence
  Description of Artificial Sequence: Synthetic oligonucleotide
  Target: ATXN1; (+) strand; PAM type: NRG; PAM sequence: AAG
cataaagatgactcccaggc

SEQ ID NO: 119181 - DNA, 20 bp, Artificial Sequence
  Description of Artificial Sequence: Synthetic oligonucleotide
  Target: ATXN1; (+) strand; PAM type: NRG; PAM sequence: AGG
ataaagatgactcccaggca

SEQ ID NO: 119182 - DNA, 20 bp, Artificial Sequence
  Description of Artificial Sequence: Synthetic oligonucleotide
  Target: ATXN1; (+) strand; PAM type: NRG; PAM sequence: AAG
tgactcccaggcaaggtttg

SEQ ID NO: 119183 - DNA, 20 bp, Artificial Sequence
  Description of Artificial Sequence: Synthetic oligonucleotide
  Target: ATXN1; (+) strand; PAM type: NRG; PAM sequence: AGG
gactcccaggcaaggtttga

SEQ ID NO: 119184 - DNA, 20 bp, Artificial Sequence
  Description of Artificial Sequence: Synthetic oligonucleotide
  Target: ATXN1; (+) strand; PAM type: NRG; PAM sequence: GGG
actcccaggcaaggtttgaa

SEQ ID NO: 119185 - DNA, 20 bp, Artificial Sequence
  Description of Artificial Sequence: Synthetic oligonucleotide
  Target: ATXN1; (+) strand; PAM type: NRG; PAM sequence: TAG
ccaggcaaggtttgaagggc

SEQ ID NO: 119186 - DNA, 20 bp, Artificial Sequence
  Description of Artificial Sequence: Synthetic oligonucleotide
  Target: ATXN1; (+) strand; PAM type: NRG; PAM sequence: GAG
aggcaaggtttgaagggcta

SEQ ID NO: 119187 - DNA, 20 bp, Artificial Sequence
  Description of Artificial Sequence: Synthetic oligonucleotide
  Target: ATXN1; (+) strand; PAM type: NRG; PAM sequence: AGG
ggcaaggtttgaagggctag

SEQ ID NO: 119188 - DNA, 20 bp, Artificial Sequence
  Description of Artificial Sequence: Synthetic oligonucleotide
  Target: ATXN1; (+) strand; PAM type: NRG; PAM sequence: GAG
caaggtttgaagggctagag

SEQ ID NO: 119189 - DNA, 20 bp, Artificial Sequence
  Description of Artificial Sequence: Synthetic oligonucleotide
  Target: ATXN1; (+) strand; PAM type: NRG; PAM sequence: GAG
aggtttgaagggctagagga

SEQ ID NO: 119190 - DNA, 20 bp, Artificial Sequence
  Description of Artificial Sequence: Synthetic oligonucleotide
  Target: ATXN1; (+) strand; PAM type: NRG; PAM sequence: CAG
ttgaagggctagaggagagc

SEQ ID NO: 119191 - DNA, 20 bp, Artificial Sequence
  Description of Artificial Sequence: Synthetic oligonucleotide
  Target: ATXN1; (+) strand; PAM type: NRG; PAM sequence: TGG
ctagaggagagccagttttt

SEQ ID NO: 119192 - DNA, 20 bp, Artificial Sequence
  Description of Artificial Sequence: Synthetic oligonucleotide
  Target: ATXN1; (+) strand; PAM type: NRG; PAM sequence: AAG
ggagagccagttttttggcc

SEQ ID NO: 119193 - DNA, 20 bp, Artificial Sequence
  Description of Artificial Sequence: Synthetic oligonucleotide
  Target: ATXN1; (+) strand; PAM type: NRG; PAM sequence: TAG
ccagttttttggccaagaac

SEQ ID NO: 119194 - DNA, 20 bp, Artificial Sequence
  Description of Artificial Sequence: Synthetic oligonucleotide
  Target: ATXN1; (+) strand; PAM type: NRG; PAM sequence: AGG
cagttttttggccaagaact

SEQ ID NO: 119195 - DNA, 20 bp, Artificial Sequence
  Description of Artificial Sequence: Synthetic oligonucleotide
  Target: ATXN1; (+) strand; PAM type: NRG; PAM sequence: GAG
gttttttggccaagaactag

SEQ ID NO: 119196 - DNA, 20 bp, Artificial Sequence
  Description of Artificial Sequence: Synthetic oligonucleotide
  Target: ATXN1; (+) strand; PAM type: NRG; PAM sequence: AGG
ttttttggccaagaactagg

SEQ ID NO: 119197 - DNA, 20 bp, Artificial Sequence
  Description of Artificial Sequence: Synthetic oligonucleotide
  Target: ATXN1; (+) strand; PAM type: NRG; PAM sequence: CAG
actaggaggatgcaatgatt

SEQ ID NO: 119198 - DNA, 20 bp, Artificial Sequence
  Description of Artificial Sequence: Synthetic oligonucleotide
  Target: ATXN1; (+) strand; PAM type: NRG; PAM sequence: TGG
ggaggatgcaatgattcaga

SEQ ID NO: 119199 - DNA, 20 bp, Artificial Sequence
  Description of Artificial Sequence: Synthetic oligonucleotide
  Target: ATXN1; (+) strand; PAM type: NRG; PAM sequence: GGG
gaggatgcaatgattcagat

SEQ ID NO: 119200 - DNA, 20 bp, Artificial Sequence
  Description of Artificial Sequence: Synthetic oligonucleotide
  Target: ATXN1; (+) strand; PAM type: NRG; PAM sequence: GGG
aggatgcaatgattcagatg

SEQ ID NO: 119201 - DNA, 20 bp, Artificial Sequence
  Description of Artificial Sequence: Synthetic oligonucleotide
  Target: ATXN1; (+) strand; PAM type: NRG; PAM sequence: GAG
gcaatgattcagatggggat

SEQ ID NO: 119202 - DNA, 20 bp, Artificial Sequence
  Description of Artificial Sequence: Synthetic oligonucleotide
  Target: ATXN1; (+) strand; PAM type: NRG; PAM sequence: AGG
caatgattcagatggggatg

SEQ ID NO: 119203 - DNA, 20 bp, Artificial Sequence
  Description of Artificial Sequence: Synthetic oligonucleotide
  Target: ATXN1; (+) strand; PAM type: NRG; PAM sequence: GGG
aatgattcagatggggatga

SEQ ID NO: 119204 - DNA, 20 bp, Artificial Sequence
  Description of Artificial Sequence: Synthetic oligonucleotide
  Target: ATXN1; (+) strand; PAM type: NRG; PAM sequence: AAG
attcagatggggatgagggc

SEQ ID NO: 119205 - DNA, 20 bp, Artificial Sequence
  Description of Artificial Sequence: Synthetic oligonucleotide
  Target: ATXN1; (+) strand; PAM type: NRG; PAM sequence: AGG
ttcagatggggatgagggca

SEQ ID NO: 119206 - DNA, 20 bp, Artificial Sequence
  Description of Artificial Sequence: Synthetic oligonucleotide
  Target: ATXN1; (+) strand; PAM type: NRG; PAM sequence: GGG
tcagatggggatgagggcaa

SEQ ID NO: 119207 - DNA, 20 bp, Artificial Sequence
  Description of Artificial Sequence: Synthetic oligonucleotide
  Target: ATXN1; (+) strand; PAM type: NRG; PAM sequence: CAG
gatggggatgagggcaaggg

SEQ ID NO: 119208 - DNA, 20 bp, Artificial Sequence
  Description of Artificial Sequence: Synthetic oligonucleotide
  Target: ATXN1; (+) strand; PAM type: NRG; PAM sequence: AGG
atggggatgagggcaagggc

SEQ ID NO: 119209 - DNA, 20 bp, Artificial Sequence
  Description of Artificial Sequence: Synthetic oligonucleotide
  Target: ATXN1; (+) strand; PAM type: NRG; PAM sequence: GGG
tggggatgagggcaagggca

SEQ ID NO: 119210 - DNA, 20 bp, Artificial Sequence
  Description of Artificial Sequence: Synthetic oligonucleotide
  Target: ATXN1; (+) strand; PAM type: NRG; PAM sequence: TGG
atgagggcaagggcagggtc

SEQ ID NO: 119211 - DNA, 20 bp, Artificial Sequence
  Description of Artificial Sequence: Synthetic oligonucleotide
  Target: ATXN1; (+) strand; PAM type: NRG; PAM sequence: GGG
tgagggcaagggcagggtct

SEQ ID NO: 119212 - DNA, 20 bp, Artificial Sequence
  Description of Artificial Sequence: Synthetic oligonucleotide
  Target: ATXN1; (+) strand; PAM type: NRG; PAM sequence: GGG
gagggcaagggcagggtctg

SEQ ID NO: 119213 - DNA, 20 bp, Artificial Sequence
  Description of Artificial Sequence: Synthetic oligonucleotide
  Target: ATXN1; (+) strand; PAM type: NRG; PAM sequence: TGG
ggcaagggcagggtctgggg

SEQ ID NO: 119214 - DNA, 20 bp, Artificial Sequence
  Description of Artificial Sequence: Synthetic oligonucleotide
  Target: ATXN1; (+) strand; PAM type: NRG; PAM sequence: GGG
gcaagggcagggtctggggt

SEQ ID NO: 119215 - DNA, 20 bp, Artificial Sequence
  Description of Artificial Sequence: Synthetic oligonucleotide
  Target: ATXN1; (+) strand; PAM type: NRG; PAM sequence: TGG
tctggggtgggatgaatgca

SEQ ID NO: 119216 - DNA, 20 bp, Artificial Sequence
  Description of Artificial Sequence: Synthetic oligonucleotide
  Target: ATXN1; (+) strand; PAM type: NRG; PAM sequence: GGG
ctggggtgggatgaatgcat

SEQ ID NO: 119217 - DNA, 20 bp, Artificial Sequence
  Description of Artificial Sequence: Synthetic oligonucleotide
  Target: ATXN1; (+) strand; PAM type: NRG; PAM sequence: GGG
tggggtgggatgaatgcatg

SEQ ID NO: 119218 - DNA, 20 bp, Artificial Sequence
  Description of Artificial Sequence: Synthetic oligonucleotide
  Target: ATXN1; (+) strand; PAM type: NRG; PAM sequence: AAG
ggtgggatgaatgcatgggg

SEQ ID NO: 119219 - DNA, 20 bp, Artificial Sequence
  Description of Artificial Sequence: Synthetic oligonucleotide
  Target: ATXN1; (+) strand; PAM type: NRG; PAM sequence: GAG
tgggatgaatgcatggggaa

SEQ ID NO: 119220 - DNA, 20 bp, Artificial Sequence
  Description of Artificial Sequence: Synthetic oligonucleotide
  Target: ATXN1; (+) strand; PAM type: NRG; PAM sequence: TAG
gatgaatgcatggggaagag

SEQ ID NO: 119221 - DNA, 20 bp, Artificial Sequence
  Description of Artificial Sequence: Synthetic oligonucleotide
  Target: ATXN1; (+) strand; PAM type: NRG; PAM sequence: CAG
aatgcatggggaagagtagt

SEQ ID NO: 119222 - DNA, 20 bp, Artificial Sequence
  Description of Artificial Sequence: Synthetic oligonucleotide
  Target: ATXN1; (+) strand; PAM type: NRG; PAM sequence: CAG
gcatggggaagagtagtcag

SEQ ID NO: 119223 - DNA, 20 bp, Artificial Sequence
  Description of Artificial Sequence: Synthetic oligonucleotide
  Target: ATXN1; (+) strand; PAM type: NRG; PAM sequence: GAG
atggggaagagtagtcagca

SEQ ID NO: 119224 - DNA, 20 bp, Artificial Sequence
  Description of Artificial Sequence: Synthetic oligonucleotide
  Target: ATXN1; (+) strand; PAM type: NRG; PAM sequence: CGG
agcagagcatcatgtttgac

SEQ ID NO: 119225 - DNA, 20 bp, Artificial Sequence
  Description of Artificial Sequence: Synthetic oligonucleotide
  Target: ATXN1; (+) strand; PAM type: NRG; PAM sequence: AAG
agagcatcatgtttgaccgg

SEQ ID NO: 119226 - DNA, 20 bp, Artificial Sequence
  Description of Artificial Sequence: Synthetic oligonucleotide
  Target: ATXN1; (+) strand; PAM type: NRG; PAM sequence: AAG
atcatgtttgaccggaagac

SEQ ID NO: 119227 - DNA, 20 bp, Artificial Sequence
  Description of Artificial Sequence: Synthetic oligonucleotide
  Target: ATXN1; (+) strand; PAM type: NRG; PAM sequence: GAG
catgtttgaccggaagacaa

SEQ ID NO: 119228 - DNA, 20 bp, Artificial Sequence
  Description of Artificial Sequence: Synthetic oligonucleotide
  Target: ATXN1; (+) strand; PAM type: NRG; PAM sequence: AAG
gaccggaagacaagagccac

SEQ ID NO: 119229 - DNA, 20 bp, Artificial Sequence
  Description of Artificial Sequence: Synthetic oligonucleotide
  Target: ATXN1; (+) strand; PAM type: NRG; PAM sequence: CAG
agacaagagccacaagcctc

SEQ ID NO: 119230 - DNA, 20 bp, Artificial Sequence
  Description of Artificial Sequence: Synthetic oligonucleotide
  Target: ATXN1; (+) strand; PAM type: NRG; PAM sequence: TAG
gccacaagcctccagttctt

SEQ ID NO: 119231 - DNA, 20 bp, Artificial Sequence
  Description of Artificial Sequence: Synthetic oligonucleotide
  Target: ATXN1; (+) strand; PAM type: NRG; PAM sequence: CAG
acaagcctccagttctttag

SEQ ID NO: 119232 - DNA, 20 bp, Artificial Sequence
  Description of Artificial Sequence: Synthetic oligonucleotide
  Target: ATXN1; (+) strand; PAM type: NRG; PAM sequence: AAG
agcctccagttctttagcag

SEQ ID NO: 119233 - DNA, 20 bp, Artificial Sequence
  Description of Artificial Sequence: Synthetic oligonucleotide
  Target: ATXN1; (+) strand; PAM type: NRG; PAM sequence: TGG
cagttctttagcagaagaac

SEQ ID NO: 119234 - DNA, 20 bp, Artificial Sequence
  Description of Artificial Sequence: Synthetic oligonucleotide
  Target: ATXN1; (+) strand; PAM type: NRG; PAM sequence: GAG
gttctttagcagaagaactg

SEQ ID NO: 119235 - DNA, 20 bp, Artificial Sequence
  Description of Artificial Sequence: Synthetic oligonucleotide
  Target: ATXN1; (+) strand; PAM type: NRG; PAM sequence: AGG
ttctttagcagaagaactgg

SEQ ID NO: 119236 - DNA, 20 bp, Artificial Sequence
  Description of Artificial Sequence: Synthetic oligonucleotide
  Target: ATXN1; (+) strand; PAM type: NRG; PAM sequence: AAG
tagcagaagaactggaggta

SEQ ID NO: 119237 - DNA, 20 bp, Artificial Sequence
  Description of Artificial Sequence: Synthetic oligonucleotide
  Target: ATXN1; (+) strand; PAM type: NRG; PAM sequence: TAG
agaagaactggaggtaaaga

SEQ ID NO: 119238 - DNA, 20 bp, Artificial Sequence
  Description of Artificial Sequence: Synthetic oligonucleotide
  Target: ATXN1; (+) strand; PAM type: NRG; PAM sequence: AGG
gaagaactggaggtaaagat

SEQ ID NO: 119239 - DNA, 20 bp, Artificial Sequence
  Description of Artificial Sequence: Synthetic oligonucleotide
  Target: ATXN1; (+) strand; PAM type: NRG; PAM sequence: AAG
aggtaaagataggtgcatca

SEQ ID NO: 119240 - DNA, 20 bp, Artificial Sequence
  Description of Artificial Sequence: Synthetic oligonucleotide
  Target: ATXN1; (+) strand; PAM type: NRG; PAM sequence: TAG
aaagataggtgcatcaaaga

SEQ ID NO: 119241 - DNA, 20 bp, Artificial Sequence
  Description of Artificial Sequence: Synthetic oligonucleotide
  Target: ATXN1; (+) strand; PAM type: NRG; PAM sequence: TAG
catcaaagatagcctgtgat

SEQ ID NO: 119242 - DNA, 20 bp, Artificial Sequence
  Description of Artificial Sequence: Synthetic oligonucleotide
  Target: ATXN1; (+) strand; PAM type: NRG; PAM sequence: AGG
atcaaagatagcctgtgatt

SEQ ID NO: 119243 - DNA, 20 bp, Artificial Sequence
  Description of Artificial Sequence: Synthetic oligonucleotide
  Target: ATXN1; (+) strand; PAM type: NRG; PAM sequence: GAG
caaagatagcctgtgattag

SEQ ID NO: 119244 - DNA, 20 bp, Artificial Sequence
  Description of Artificial Sequence: Synthetic oligonucleotide
  Target: ATXN1; (+) strand; PAM type: NRG; PAM sequence: AGG
aaagatagcctgtgattagg

SEQ ID NO: 119245 - DNA, 20 bp, Artificial Sequence
  Description of Artificial Sequence: Synthetic oligonucleotide
  Target: ATXN1; (+) strand; PAM type: NRG; PAM sequence: AAG
gaggttaaaatgaaatctga

SEQ ID NO: 119246 - DNA, 20 bp, Artificial Sequence
  Description of Artificial Sequence: Synthetic oligonucleotide
  Target: ATXN1; (+) strand; PAM type: NRG; PAM sequence: CAG
ttaaaatgaaatctgaaaga

SEQ ID NO: 119247 - DNA, 20 bp, Artificial Sequence
  Description of Artificial Sequence: Synthetic oligonucleotide
  Target: ATXN1; (+) strand; PAM type: NRG; PAM sequence: GAG
aaaatgaaatctgaaagaca

SEQ ID NO: 119248 - DNA, 20 bp, Artificial Sequence
  Description of Artificial Sequence: Synthetic oligonucleotide
  Target: ATXN1; (+) strand; PAM type: NRG; PAM sequence: CAG
tctgaaagacagagtcactc

SEQ ID NO: 119249 - DNA, 20 bp, Artificial Sequence
  Description of Artificial Sequence: Synthetic oligonucleotide
  Target: ATXN1; (+) strand; PAM type: NRG; PAM sequence: TGG
gacagagtcactccagactc

SEQ ID NO: 119250 - DNA, 20 bp, Artificial Sequence
  Description of Artificial Sequence: Synthetic oligonucleotide
  Target: ATXN1; (+) strand; PAM type: NRG; PAM sequence: GGG
acagagtcactccagactct

SEQ ID NO: 119251 - DNA, 20 bp, Artificial Sequence
  Description of Artificial Sequence: Synthetic oligonucleotide
  Target: ATXN1; (+) strand; PAM type: NRG; PAM sequence: AAG
agtcactccagactctggga

SEQ ID NO: 119252 - DNA, 20 bp, Artificial Sequence
  Description of Artificial Sequence: Synthetic oligonucleotide
  Target: ATXN1; (+) strand; PAM type: NRG; PAM sequence: AAG
tgcaatcaaaatgatgtacc

SEQ ID NO: 119253 - DNA, 20 bp, Artificial Sequence
  Description of Artificial Sequence: Synthetic oligonucleotide
  Target: ATXN1; (+) strand; PAM type: NRG; PAM sequence: GAG
caatcaaaatgatgtaccaa

SEQ ID NO: 119254 - DNA, 20 bp, Artificial Sequence
  Description of Artificial Sequence: Synthetic oligonucleotide
  Target: ATXN1; (+) strand; PAM type: NRG; PAM sequence: AGG
aatcaaaatgatgtaccaag

SEQ ID NO: 119255 - DNA, 20 bp, Artificial Sequence
  Description of Artificial Sequence: Synthetic oligonucleotide
  Target: ATXN1; (+) strand; PAM type: NRG; PAM sequence: AAG
taccaagaggtgtctctgct

SEQ ID NO: 119256 - DNA, 20 bp, Artificial Sequence
  Description of Artificial Sequence: Synthetic oligonucleotide
  Target: ATXN1; (+) strand; PAM type: NRG; PAM sequence: CGG
agaggtgtctctgctaagtc

SEQ ID NO: 119257 - DNA, 20 bp, Artificial Sequence
  Description of Artificial Sequence: Synthetic oligonucleotide
  Target: ATXN1; (+) strand; PAM type: NRG; PAM sequence: GGG
gaggtgtctctgctaagtcc

SEQ ID NO: 119258 - DNA, 20 bp, Artificial Sequence
  Description of Artificial Sequence: Synthetic oligonucleotide
  Target: ATXN1; (+) strand; PAM type: NRG; PAM sequence: AAG
tgctaagtccgggccacata

SEQ ID NO: 119259 - DNA, 20 bp, Artificial Sequence
  Description of Artificial Sequence: Synthetic oligonucleotide
  Target: ATXN1; (+) strand; PAM type: NRG; PAM sequence: GAG
tccgggccacataaagacat

SEQ ID NO: 119260 - DNA, 20 bp, Artificial Sequence
  Description of Artificial Sequence: Synthetic oligonucleotide
  Target: ATXN1; (+) strand; PAM type: NRG; PAM sequence: GAG
cgggccacataaagacatga

SEQ ID NO: 119261 - DNA, 20 bp, Artificial Sequence
  Description of Artificial Sequence: Synthetic oligonucleotide
  Target: ATXN1; (+) strand; PAM type: NRG; PAM sequence: TGG
ccacataaagacatgagaga

SEQ ID NO: 119262 - DNA, 20 bp, Artificial Sequence
  Description of Artificial Sequence: Synthetic oligonucleotide
  Target: ATXN1; (+) strand; PAM type: NRG; PAM sequence: GGG
cacataaagacatgagagat

SEQ ID NO: 119263 - DNA, 20 bp, Artificial Sequence
  Description of Artificial Sequence: Synthetic oligonucleotide
  Target: ATXN1; (+) strand; PAM type: NRG; PAM sequence: GGG
acataaagacatgagagatg

SEQ ID NO: 119264 - DNA, 20 bp, Artificial Sequence
  Description of Artificial Sequence: Synthetic oligonucleotide
  Target: ATXN1; (+) strand; PAM type: NRG; PAM sequence: GAG
ataaagacatgagagatggg

SEQ ID NO: 119265 - DNA, 20 bp, Artificial Sequence
  Description of Artificial Sequence: Synthetic oligonucleotide
  Target: ATXN1; (+) strand; PAM type: NRG; PAM sequence: AGG
taaagacatgagagatgggg

SEQ ID NO: 119266 - DNA, 20 bp, Artificial Sequence
  Description of Artificial Sequence: Synthetic oligonucleotide
  Target: ATXN1; (+) strand; PAM type: NRG; PAM sequence: CAG
agagatggggaggcccacta

SEQ ID NO: 119267 - DNA, 20 bp, Artificial Sequence
  Description of Artificial Sequence: Synthetic oligonucleotide
  Target: ATXN1; (+) strand; PAM type: NRG; PAM sequence: AGG
gagatggggaggcccactac

SEQ ID NO: 119268 - DNA, 20 bp, Artificial Sequence
  Description of Artificial Sequence: Synthetic oligonucleotide
  Target: ATXN1; (+) strand; PAM type: NRG; PAM sequence: GAG
tggggaggcccactacaggt

SEQ ID NO: 119269 - DNA, 20 bp, Artificial Sequence
  Description of Artificial Sequence: Synthetic oligonucleotide
  Target: ATXN1; (+) strand; PAM type: NRG; PAM sequence: AGG
ggggaggcccactacaggtg

SEQ ID NO: 119270 - DNA, 20 bp, Artificial Sequence
  Description of Artificial Sequence: Synthetic oligonucleotide
  Target: ATXN1; (+) strand; PAM type: NRG; PAM sequence: GAG
cccactacaggtgaggtcat

SEQ ID NO: 119271 - DNA, 20 bp, Artificial Sequence
  Description of Artificial Sequence: Synthetic oligonucleotide
  Target: ATXN1; (+) strand; PAM type: NRG; PAM sequence: GAG
aggtcatgagtccttgcttt

SEQ ID NO: 119272 - DNA, 20 bp, Artificial Sequence
  Description of Artificial Sequence: Synthetic oligonucleotide
  Target: ATXN1; (+) strand; PAM type: NRG; PAM sequence: AGG
ggtcatgagtccttgctttg

SEQ ID NO: 119273 - DNA, 20 bp, Artificial Sequence
  Description of Artificial Sequence: Synthetic oligonucleotide
  Target: ATXN1; (+) strand; PAM type: NRG; PAM sequence: GGG
gtcatgagtccttgctttga

SEQ ID NO: 119274 - DNA, 20 bp, Artificial Sequence
  Description of Artificial Sequence: Synthetic oligonucleotide
  Target: ATXN1; (+) strand; PAM type: NRG; PAM sequence: AAG
tgagtccttgctttgaggga

SEQ ID NO: 119275 - DNA, 20 bp, Artificial Sequence
  Description of Artificial Sequence: Synthetic oligonucleotide
  Target: ATXN1; (+) strand; PAM type: NRG; PAM sequence: CAG
ttgctttgagggaaagtaaa

SEQ ID NO: 119276 - DNA, 20 bp, Artificial Sequence
  Description of Artificial Sequence: Synthetic oligonucleotide
  Target: ATXN1; (+) strand; PAM type: NRG; PAM sequence: AAG
ggaaagtaaacagaaaatac

SEQ ID NO: 119277 - DNA, 20 bp, Artificial Sequence
  Description of Artificial Sequence: Synthetic oligonucleotide
  Target: ATXN1; (+) strand; PAM type: NRG; PAM sequence: AGG
gaaagtaaacagaaaataca

SEQ ID NO: 119278 - DNA, 20 bp, Artificial Sequence
  Description of Artificial Sequence: Synthetic oligonucleotide
  Target: ATXN1; (+) strand; PAM type: NRG; PAM sequence: AAG
acagaaaatacaaggattct

SEQ ID NO: 119279 - DNA, 20 bp, Artificial Sequence
  Description of Artificial Sequence: Synthetic oligonucleotide
  Target: ATXN1; (+) strand; PAM type: NRG; PAM sequence: AGG
cagaaaatacaaggattcta

SEQ ID NO: 119280 - DNA, 20 bp, Artificial Sequence
  Description of Artificial Sequence: Synthetic oligonucleotide
  Target: ATXN1; (+) strand; PAM type: NRG; PAM sequence: GGG
agaaaatacaaggattctaa

SEQ ID NO: 119281 - DNA, 20 bp, Artificial Sequence
  Description of Artificial Sequence: Synthetic oligonucleotide
  Target: ATXN1; (+) strand; PAM type: NRG; PAM sequence: AAG
taagggaatgcataatttcc

SEQ ID NO: 119282 - DNA, 20 bp, Artificial Sequence
  Description of Artificial Sequence: Synthetic oligonucleotide
  Target: ATXN1; (+) strand; PAM type: NRG; PAM sequence: AAG
gaatgcataatttccaagaa

SEQ ID NO: 119283 - DNA, 20 bp, Artificial Sequence
  Description of Artificial Sequence: Synthetic oligonucleotide
  Target: ATXN1; (+) strand; PAM type: NRG; PAM sequence: TAG
ataatttccaagaaaagtca

SEQ ID NO: 119284 - DNA, 20 bp, Artificial Sequence
  Description of Artificial Sequence: Synthetic oligonucleotide
  Target: ATXN1; (+) strand; PAM type: NRG; PAM sequence: CAG
aagtcatagcgaactgtgtc

SEQ ID NO: 119285 - DNA, 20 bp, Artificial Sequence
  Description of Artificial Sequence: Synthetic oligonucleotide
  Target: ATXN1; (+) strand; PAM type: NRG; PAM sequence: AGG
agtcatagcgaactgtgtcc

SEQ ID NO: 119286 - DNA, 20 bp, Artificial Sequence
  Description of Artificial Sequence: Synthetic oligonucleotide
  Target: ATXN1; (+) strand; PAM type: NRG; PAM sequence: AAG
catagcgaactgtgtccagg

SEQ ID NO: 119287 - DNA, 20 bp, Artificial Sequence
  Description of Artificial Sequence: Synthetic oligonucleotide
  Target: ATXN1; (+) strand; PAM type: NRG; PAM sequence: GAG
cgaactgtgtccaggaagct

SEQ ID NO: 119288 - DNA, 20 bp, Artificial Sequence
  Description of Artificial Sequence: Synthetic oligonucleotide
  Target: ATXN1; (+) strand; PAM type: NRG; PAM sequence: TGG
ctgtgtccaggaagctgaga

SEQ ID NO: 119289 - DNA, 20 bp, Artificial Sequence
  Description of Artificial Sequence: Synthetic oligonucleotide
  Target: ATXN1; (+) strand; PAM type: NRG; PAM sequence: AAG
tgtccaggaagctgagatgg

SEQ ID NO: 119290 - DNA, 20 bp, Artificial Sequence
  Description of Artificial Sequence: Synthetic oligonucleotide
  Target: ATXN1; (+) strand; PAM type: NRG; PAM sequence: GAG
tccaggaagctgagatggaa

SEQ ID NO: 119291 - DNA, 20 bp, Artificial Sequence
  Description of Artificial Sequence: Synthetic oligonucleotide
  Target: ATXN1; (+) strand; PAM type: NRG; PAM sequence: AGG
ccaggaagctgagatggaag

SEQ ID NO: 119292 - DNA, 20 bp, Artificial Sequence
  Description of Artificial Sequence: Synthetic oligonucleotide
  Target: ATXN1; (+) strand; PAM type: NRG; PAM sequence: AAG
gaagaggaataacttcttaa

SEQ ID NO: 119293 - DNA, 20 bp, Artificial Sequence
  Description of Artificial Sequence: Synthetic oligonucleotide
  Target: ATXN1; (+) strand; PAM type: NRG; PAM sequence: TGG
cttcttaaaagtactaaatg

SEQ ID NO: 119294 - DNA, 20 bp, Artificial Sequence
  Description of Artificial Sequence: Synthetic oligonucleotide
  Target: ATXN1; (+) strand; PAM type: NRG; PAM sequence: CAG
ttaaaagtactaaatgtggc

SEQ ID NO: 119295 - DNA, 20 bp, Artificial Sequence
  Description of Artificial Sequence: Synthetic oligonucleotide
  Target: ATXN1; (+) strand; PAM type: NRG; PAM sequence: AGG
taaaagtactaaatgtggcc

SEQ ID NO: 119296 - DNA, 20 bp, Artificial Sequence
  Description of Artificial Sequence: Synthetic oligonucleotide
  Target: ATXN1; (+) strand; PAM type: NRG; PAM sequence: CGG
gtactaaatgtggccaggcg

SEQ ID NO: 119297 - DNA, 20 bp, Artificial Sequence
  Description of Artificial Sequence: Synthetic oligonucleotide
  Target: ATXN1; (+) strand; PAM type: NRG; PAM sequence: TGG
ctaaatgtggccaggcgcgg

SEQ ID NO: 119298 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgtaatcc

SEQ ID NO: 119299 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagcactt

SEQ ID NO: 119300 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 119301 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 119302 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 119303 - DNA, 20 bp, Artificial Sequence
  Description of Artificial Sequence: Synthetic oligonucleotide
  Target: ATXN1; (+) strand; PAM type: NRG; PAM sequence: AAG
tcccagcactttgggaggcc

SEQ ID NO: 119304 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggcca

SEQ ID NO: 119305 - DNA, 20 bp, Artificial Sequence
  Description of Artificial Sequence: Synthetic oligonucleotide
  Target: ATXN1; (+) strand; PAM type: NRG; PAM sequence: CGG
agcactttgggaggccaagg

SEQ ID NO: 119306 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccaaggc

SEQ ID NO: 119307 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccaaggcggg

SEQ ID NO: 119308 - DNA, 20 bp, Artificial Sequence
  Description of Artificial Sequence: Synthetic oligonucleotide
  Target: ATXN1; (+) strand; PAM type: NRG; PAM sequence: AAG
ggccaaggcgggtggaccac

SEQ ID NO: 119309 - DNA, 20 bp, Artificial Sequence
  Description of Artificial Sequence: Synthetic oligonucleotide
  Target: ATXN1; (+) strand; PAM type: NRG; PAM sequence: AGG
gccaaggcgggtggaccaca

SEQ ID NO: 119310 - DNA, 20 bp, Artificial Sequence
  Description of Artificial Sequence: Synthetic oligonucleotide
  Target: ATXN1; (+) strand; PAM type: NRG; PAM sequence: CAG
aggcgggtggaccacaaggt

SEQ ID NO: 119311 - DNA, 20 bp, Artificial Sequence
  Description of Artificial Sequence: Synthetic oligonucleotide
  Target: ATXN1; (+) strand; PAM type: NRG; PAM sequence: AGG
ggcgggtggaccacaaggtc

SEQ ID NO: 119312 - DNA, 20 bp, Artificial Sequence
  Description of Artificial Sequence: Synthetic oligonucleotide
  Target: ATXN1; (+) strand; PAM type: NRG; PAM sequence: GAG
cgggtggaccacaaggtcag

SEQ ID NO: 119313 - DNA, 20 bp, Artificial Sequence
  Description of Artificial Sequence: Synthetic oligonucleotide
  Target: ATXN1; (+) strand; PAM type: NRG; PAM sequence: GAG
gaccacaaggtcaggagatc

SEQ ID NO: 119314 - DNA, 20 bp, Artificial Sequence
  Description of Artificial Sequence: Synthetic oligonucleotide
  Target: ATXN1; (+) strand; PAM type: NRG; PAM sequence: TGG
tcaggagatcgagaacatcc

SEQ ID NO: 119315 - DNA, 20 bp, Artificial Sequence
  Description of Artificial Sequence: Synthetic oligonucleotide
  Target: ATXN1; (+) strand; PAM type: NRG; PAM sequence: CAG
cgagaacatcctggctaaca

SEQ ID NO: 119316 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 119317 - DNA, 20 bp, Artificial Sequence
  Description of Artificial Sequence: Synthetic oligonucleotide
  Target: ATXN1; (+) strand; PAM type: NRG; PAM sequence: TGG
ctaaaaatacaaaaattagc

SEQ ID NO: 119318 - DNA, 20 bp, Artificial Sequence
  Description of Artificial Sequence: Synthetic oligonucleotide
  Target: ATXN1; (+) strand; PAM type: NRG; PAM sequence: GGG
taaaaatacaaaaattagct

SEQ ID NO: 119319 - DNA, 20 bp, Artificial Sequence
  Description of Artificial Sequence: Synthetic oligonucleotide
  Target: ATXN1; (+) strand; PAM type: NRG; PAM sequence: CAG
atacaaaaattagctgggcg

SEQ ID NO: 119320 - DNA, 20 bp, Artificial Sequence
  Description of Artificial Sequence: Synthetic oligonucleotide
  Target: ATXN1; (+) strand; PAM type: NRG; PAM sequence: TGG
caaaaattagctgggcgcag

SEQ ID NO: 119321 - DNA, 20 bp, Artificial Sequence
  Description of Artificial Sequence: Synthetic oligonucleotide
  Target: ATXN1; (+) strand; PAM type: NRG; PAM sequence: CAG
aaattagctgggcgcagtgg

SEQ ID NO: 119322 - DNA, 20 bp, Artificial Sequence
  Description of Artificial Sequence: Synthetic oligonucleotide
  Target: ATXN1; (+) strand; PAM type: NRG; PAM sequence: AGG
aattagctgggcgcagtggc

SEQ ID NO: 119323 - DNA, 20 bp, Artificial Sequence
  Description of Artificial Sequence: Synthetic oligonucleotide
  Target: ATXN1; (+) strand; PAM type: NRG; PAM sequence: CAG
gtggcaggtgcctgtaatcc

SEQ ID NO: 119324 - DNA, 20 bp, Artificial Sequence
  Description of Artificial Sequence: Synthetic oligonucleotide
  Target: ATXN1; (+) strand; PAM type: NRG; PAM sequence: TAG
gtgcctgtaatcccagctac

SEQ ID NO: 119325 - DNA, 20 bp, Artificial Sequence
  Description of Artificial Sequence: Synthetic oligonucleotide
  Target: ATXN1; (+) strand; PAM type: NRG; PAM sequence: AGG
tgcctgtaatcccagctact

SEQ ID NO: 119326 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagctacta

SEQ ID NO: 119327 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctactagg

SEQ ID NO: 119328 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctactaggg

SEQ ID NO: 119329 - DNA, 20 bp, Artificial Sequence
  Description of Artificial Sequence: Synthetic oligonucleotide
  Target: ATXN1; (+) strand; PAM type: NRG; PAM sequence: GAG
tcccagctactagggaggct

SEQ ID NO: 119330 - DNA, 20 bp, Artificial Sequence
  Description of Artificial Sequence: Synthetic oligonucleotide
  Target: ATXN1; (+) strand; PAM type: NRG; PAM sequence: AGG
cccagctactagggaggctg

SEQ ID NO: 119331 - DNA, 20 bp, Artificial Sequence
  Description of Artificial Sequence: Synthetic oligonucleotide
  Target: ATXN1; (+) strand; PAM type: NRG; PAM sequence: CAG
agctactagggaggctgagg

SEQ ID NO: 119332 - DNA, 20 bp, Artificial Sequence
  Description of Artificial Sequence: Synthetic oligonucleotide
  Target: ATXN1; (+) strand; PAM type: NRG; PAM sequence: AGG
gctactagggaggctgaggc

SEQ ID NO: 119333 - DNA, 20 bp, Artificial Sequence
  Description of Artificial Sequence: Synthetic oligonucleotide
  Target: ATXN1; (+) strand; PAM type: NRG; PAM sequence: GAG
tactagggaggctgaggcag

SEQ ID NO: 119334 - DNA, 20 bp, Artificial Sequence
  Description of Artificial Sequence: Synthetic oligonucleotide
  Target: ATXN1; (+) strand; PAM type: NRG; PAM sequence: CAG
gcaggagaatcgcttgtacc

SEQ ID NO: 119335 - DNA, 20 bp, Artificial Sequence
  Description of Artificial Sequence: Synthetic oligonucleotide
  Target: ATXN1; (+) strand; PAM type: NRG; PAM sequence: AGG
caggagaatcgcttgtaccc

SEQ ID NO: 119336 - DNA, 20 bp, Artificial Sequence
  Description of Artificial Sequence: Synthetic oligonucleotide
  Target: ATXN1; (+) strand; PAM type: NRG; PAM sequence: CGG
gagaatcgcttgtacccagg

SEQ ID NO: 119337 - DNA, 20 bp, Artificial Sequence
  Description of Artificial Sequence: Synthetic oligonucleotide
  Target: ATXN1; (+) strand; PAM type: NRG; PAM sequence: GGG
agaatcgcttgtacccaggc

SEQ ID NO: 119338 - DNA, 20 bp, Artificial Sequence
  Description of Artificial Sequence: Synthetic oligonucleotide
  Target: ATXN1; (+) strand; PAM type: NRG; PAM sequence: GGG
gaatcgcttgtacccaggcg

SEQ ID NO: 119339 - DNA, 20 bp, Artificial Sequence
  Description of Artificial Sequence: Synthetic oligonucleotide
  Target: ATXN1; (+) strand; PAM type: NRG; PAM sequence: GGG
aatcgcttgtacccaggcgg

SEQ ID NO: 119340 - DNA, 20 bp, Artificial Sequence
  Description of Artificial Sequence: Synthetic oligonucleotide
  Target: ATXN1; (+) strand; PAM type: NRG; PAM sequence: CAG
cgcttgtacccaggcggggg

SEQ ID NO: 119341 - DNA, 20 bp, Artificial Sequence
  Description of Artificial Sequence: Synthetic oligonucleotide
  Target: ATXN1; (+) strand; PAM type: NRG; PAM sequence: GAG
cttgtacccaggcgggggca

SEQ ID NO: 119342 - DNA, 20 bp, Artificial Sequence
  Description of Artificial Sequence: Synthetic oligonucleotide
  Target: ATXN1; (+) strand; PAM type: NRG; PAM sequence: CAG
ccaggcgggggcagagattg

SEQ ID NO: 119343 - DNA, 20 bp, Artificial Sequence
  Description of Artificial Sequence: Synthetic oligonucleotide
  Target: ATXN1; (+) strand; PAM type: NRG; PAM sequence: GAG
gcgggggcagagattgcagt

SEQ ID NO: 119344 - DNA, 20 bp, Artificial Sequence
  Description of Artificial Sequence: Synthetic oligonucleotide
  Target: ATXN1; (+) strand; PAM type: NRG; PAM sequence: GAG
ggcagagattgcagtgagcc

SEQ ID NO: 119345 - DNA, 20 bp, Artificial Sequence
  Description of Artificial Sequence: Synthetic oligonucleotide
  Target: ATXN1; (+) strand; PAM type: NRG; PAM sequence: CAG
gagattgcgccactgcactc

SEQ ID NO: 119346 - DNA, 20 bp, Artificial Sequence
  Description of Artificial Sequence: Synthetic oligonucleotide
  Target: ATXN1; (+) strand; PAM type: NRG; PAM sequence: TGG
tgcgccactgcactccagtc

SEQ ID NO: 119347 - DNA, 20 bp, Artificial Sequence
  Description of Artificial Sequence: Synthetic oligonucleotide
  Target: ATXN1; (+) strand; PAM type: NRG; PAM sequence: GGG
gcgccactgcactccagtct

SEQ ID NO: 119348 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagtctgggtga

SEQ ID NO: 119349 - DNA, 20 bp, Artificial Sequence
  Description of Artificial Sequence: Synthetic oligonucleotide
  Target: ATXN1; (+) strand; PAM type: NRG; PAM sequence: GAG
gcactccagtctgggtgaca

SEQ ID NO: 119350 - DNA, 20 bp, Artificial Sequence
  Description of Artificial Sequence: Synthetic oligonucleotide
  Target: ATXN1; (+) strand; PAM type: NRG; PAM sequence: CAG
tccagtctgggtgacagagt

SEQ ID NO: 119351 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaaaaaaaaaa

SEQ ID NO: 119352 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaaaaaaaaaaaaa

SEQ ID NO: 119353 - DNA, 20 bp, Artificial Sequence
  Description of Artificial Sequence: Synthetic oligonucleotide
  Target: ATXN1; (+) strand; PAM type: NRG; PAM sequence: CAG
aaaaaaaaaggcctaaatgt

SEQ ID NO: 119354 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaggcctaaatgtc

SEQ ID NO: 119355 - DNA, 20 bp, Artificial Sequence
  Description of Artificial Sequence: Synthetic oligonucleotide
  Target: ATXN1; (+) strand; PAM type: NRG; PAM sequence: GAG
aaaaaaggcctaaatgtcag

SEQ ID NO: 119356 - DNA, 20 bp, Artificial Sequence
  Description of Artificial Sequence: Synthetic oligonucleotide
  Target: ATXN1; (+) strand; PAM type: NRG; PAM sequence: AGG
aaaaaggcctaaatgtcagg

SEQ ID NO: 119357 - DNA, 20 bp, Artificial Sequence
  Description of Artificial Sequence: Synthetic oligonucleotide
  Target: ATXN1; (+) strand; PAM type: NRG; PAM sequence: GGG
aaaaggcctaaatgtcagga

SEQ ID NO: 119358 - DNA, 20 bp, Artificial Sequence
  Description of Artificial Sequence: Synthetic oligonucleotide
  Target: ATXN1; (+) strand; PAM type: NRG; PAM sequence: AAG
taaatgtcaggagggaaccc

SEQ ID NO: 119359 - DNA, 20 bp, Artificial Sequence
  Description of Artificial Sequence: Synthetic oligonucleotide
  Target: ATXN1; (+) strand; PAM type: NRG; PAM sequence: GAG
aatgtcaggagggaacccaa

SEQ ID NO: 119360 - DNA, 20 bp, Artificial Sequence
  Description of Artificial Sequence: Synthetic oligonucleotide
  Target: ATXN1; (+) strand; PAM type: NRG; PAM sequence: AGG
atgtcaggagggaacccaag

SEQ ID NO: 119361 - DNA, 20 bp, Artificial Sequence
  Description of Artificial Sequence: Synthetic oligonucleotide
  Target: ATXN1; (+) strand; PAM type: NRG; PAM sequence: AAG
caagaggataactctctatc

SEQ ID NO: 119362 - DNA, 20 bp, Artificial Sequence
  Description of Artificial Sequence: Synthetic oligonucleotide
  Target: ATXN1; (+) strand; PAM type: NRG; PAM sequence: TAG
gaggataactctctatcaag

SEQ ID NO: 119363 - DNA, 20 bp, Artificial Sequence
  Description of Artificial Sequence: Synthetic oligonucleotide
  Target: ATXN1; (+) strand; PAM type: NRG; PAM sequence: AGG
aggataactctctatcaagt

SEQ ID NO: 119364 - DNA, 20 bp, Artificial Sequence
  Description of Artificial Sequence: Synthetic oligonucleotide
  Target: ATXN1; (+) strand; PAM type: NRG; PAM sequence: GGG
ggataactctctatcaagta

SEQ ID NO: 119365 - DNA, 20 bp, Artificial Sequence
  Description of Artificial Sequence: Synthetic oligonucleotide
  Target: ATXN1; (+) strand; PAM type: NRG; PAM sequence: TAG
tctctatcaagtagggttcc

SEQ ID NO: 119366 - DNA, 20 bp, Artificial Sequence
  Description of Artificial Sequence: Synthetic oligonucleotide
  Target: ATXN1; (+) strand; PAM type: NRG; PAM sequence: CAG
ttcctagatttcttctcttt

SEQ ID NO: 119367 - DNA, 20 bp, Artificial Sequence
  Description of Artificial Sequence: Synthetic oligonucleotide
  Target: ATXN1; (+) strand; PAM type: NRG; PAM sequence: TAG
aattctcatctgatcatatt

SEQ ID NO: 119368 - DNA, 20 bp, Artificial Sequence
  Description of Artificial Sequence: Synthetic oligonucleotide
  Target: ATXN1; (+) strand; PAM type: NRG; PAM sequence: AGG
attctcatctgatcatattt

SEQ ID NO: 119369 - DNA, 20 bp, Artificial Sequence
  Description of Artificial Sequence: Synthetic oligonucleotide
  Target: ATXN1; (+) strand; PAM type: NRG; PAM sequence: TAG
tcatctgatcatatttagga

SEQ ID NO: 119370 - DNA, 20 bp, Artificial Sequence
  Description of Artificial Sequence: Synthetic oligonucleotide
  Target: ATXN1; (+) strand; PAM type: NRG; PAM sequence: AAG
gatcatatttaggatagcgc

SEQ ID NO: 119371 - DNA, 20 bp, Artificial Sequence
  Description of Artificial Sequence: Synthetic oligonucleotide
  Target: ATXN1; (+) strand; PAM type: NRG; PAM sequence: GAG
tcatatttaggatagcgcaa

SEQ ID NO: 119372 - DNA, 20 bp, Artificial Sequence
  Description of Artificial Sequence: Synthetic oligonucleotide
  Target: ATXN1; (+) strand; PAM type: NRG; PAM sequence: AGG
catatttaggatagcgcaag

SEQ ID NO: 119373 - DNA, 20 bp, Artificial Sequence
  Description of Artificial Sequence: Synthetic oligonucleotide
  Target: ATXN1; (+) strand; PAM type: NRG; PAM sequence: GGG
atatttaggatagcgcaaga

SEQ ID NO: 119374 - DNA, 20 bp, Artificial Sequence
  Description of Artificial Sequence: Synthetic oligonucleotide
  Target: ATXN1; (+) strand; PAM type: NRG; PAM sequence: CAG
tttaggatagcgcaagaggg

SEQ ID NO: 119375 - DNA, 20 bp, Artificial Sequence
  Description of Artificial Sequence: Synthetic oligonucleotide
  Target: ATXN1; (+) strand; PAM type: NRG; PAM sequence: TGG
gagggcagtacaattgatat

SEQ ID NO: 119376 - DNA, 20 bp, Artificial Sequence
  Description of Artificial Sequence: Synthetic oligonucleotide
  Target: ATXN1; (+) strand; PAM type: NRG; PAM sequence: CAG
ggcagtacaattgatattgg

SEQ ID NO: 119377 - DNA, 20 bp, Artificial Sequence
  Description of Artificial Sequence: Synthetic oligonucleotide
  Target: ATXN1; (+) strand; PAM type: NRG; PAM sequence: AAG
tacaattgatattggcagaa

SEQ ID NO: 119378 - DNA, 20 bp, Artificial Sequence
  Description of Artificial Sequence: Synthetic oligonucleotide
  Target: ATXN1; (+) strand; PAM type: NRG; PAM sequence: GAG
caattgatattggcagaaaa

SEQ ID NO: 119379 - DNA, 20 bp, Artificial Sequence
  Description of Artificial Sequence: Synthetic oligonucleotide
  Target: ATXN1; (+) strand; PAM type: NRG; PAM sequence: AAG
gatattggcagaaaagagaa

SEQ ID NO: 119380 - DNA, 20 bp, Artificial Sequence
  Description of Artificial Sequence: Synthetic oligonucleotide
  Target: ATXN1; (+) strand; PAM type: NRG; PAM sequence: AGG
atattggcagaaaagagaaa

SEQ ID NO: 119381 - DNA, 20 bp, Artificial Sequence
  Description of Artificial Sequence: Synthetic oligonucleotide
  Target: ATXN1; (+) strand; PAM type: NRG; PAM sequence: GGG
tattggcagaaaagagaaaa

SEQ ID NO: 119382 - DNA, 20 bp, Artificial Sequence
  Description of Artificial Sequence: Synthetic oligonucleotide
  Target: ATXN1; (+) strand; PAM type: NRG; PAM sequence: GGG
attggcagaaaagagaaaag

SEQ ID NO: 119383 - DNA, 20 bp, Artificial Sequence
  Description of Artificial Sequence: Synthetic oligonucleotide
  Target: ATXN1; (+) strand; PAM type: NRG; PAM sequence: GGG
ttggcagaaaagagaaaagg

SEQ ID NO: 119384 - DNA, 20 bp, Artificial Sequence
  Description of Artificial Sequence: Synthetic oligonucleotide
  Target: ATXN1; (+) strand; PAM type: NRG; PAM sequence: TGG
gaaaagggggcatatccaac

SEQ ID NO: 119385 - DNA, 20 bp, Artificial Sequence
  Description of Artificial Sequence: Synthetic oligonucleotide
  Target: ATXN1; (+) strand; PAM type: NRG; PAM sequence: AAG
atatccaactggtgaaatcg

SEQ ID NO: 119386 - DNA, 20 bp, Artificial Sequence
  Description of Artificial Sequence: Synthetic oligonucleotide
  Target: ATXN1; (+) strand; PAM type: NRG; PAM sequence: TGG
tcactcttacattcatatac

SEQ ID NO: 119387 - DNA, 20 bp, Artificial Sequence
  Description of Artificial Sequence: Synthetic oligonucleotide
  Target: ATXN1; (+) strand; PAM type: NRG; PAM sequence: AAG
cttacattcatatactggaa

SEQ ID NO: 119388 - DNA, 20 bp, Artificial Sequence
  Description of Artificial Sequence: Synthetic oligonucleotide
  Target: ATXN1; (+) strand; PAM type: NRG; PAM sequence: CAG
cattcatatactggaaaagt

SEQ ID NO: 119389 - DNA, 20 bp, Artificial Sequence
  Description of Artificial Sequence: Synthetic oligonucleotide
  Target: ATXN1; (+) strand; PAM type: NRG; PAM sequence: TAG
tcatatactggaaaagtcag

SEQ ID NO: 119390 - DNA, 20 bp, Artificial Sequence
  Description of Artificial Sequence: Synthetic oligonucleotide
  Target: ATXN1; (+) strand; PAM type: NRG; PAM sequence: CAG
atactggaaaagtcagtagc

SEQ ID NO: 119391 - DNA, 20 bp, Artificial Sequence
  Description of Artificial Sequence: Synthetic oligonucleotide
  Target: ATXN1; (+) strand; PAM type: NRG; PAM sequence: CAG
tttgaaaatctgtaataatt

SEQ ID NO: 119392 - DNA, 20 bp, Artificial Sequence
  Description of Artificial Sequence: Synthetic oligonucleotide
  Target: ATXN1; (+) strand; PAM type: NRG; PAM sequence: TGG
aaaatctgtaataattcaga

SEQ ID NO: 119393 - DNA, 20 bp, Artificial Sequence
  Description of Artificial Sequence: Synthetic oligonucleotide
  Target: ATXN1; (+) strand; PAM type: NRG; PAM sequence: AAG
tctgtaataattcagatgga

SEQ ID NO: 119394 - DNA, 20 bp, Artificial Sequence
  Description of Artificial Sequence: Synthetic oligonucleotide
  Target: ATXN1; (+) strand; PAM type: NRG; PAM sequence: GAG
attcacaacttttgcaatgt

SEQ ID NO: 119395 - DNA, 20 bp, Artificial Sequence
  Description of Artificial Sequence: Synthetic oligonucleotide
  Target: ATXN1; (+) strand; PAM type: NRG; PAM sequence: GAG
tcacaacttttgcaatgtga

SEQ ID NO: 119396 - DNA, 20 bp, Artificial Sequence
  Description of Artificial Sequence: Synthetic oligonucleotide
  Target: ATXN1; (+) strand; PAM type: NRG; PAM sequence: AAG
caacttttgcaatgtgagag

SEQ ID NO: 119397 - DNA, 20 bp, Artificial Sequence
  Description of Artificial Sequence: Synthetic oligonucleotide
  Target: ATXN1; (+) strand; PAM type: NRG; PAM sequence: CGG
caatgtgagagaagaaattt

SEQ ID NO: 119398 - DNA, 20 bp, Artificial Sequence
  Description of Artificial Sequence: Synthetic oligonucleotide
  Target: ATXN1; (+) strand; PAM type: NRG; PAM sequence: AAG
tgagagaagaaatttcggaa

SEQ ID NO: 119399 - DNA, 20 bp, Artificial Sequence
  Description of Artificial Sequence: Synthetic oligonucleotide
  Target: ATXN1; (+) strand; PAM type: NRG; PAM sequence: TAG
gagaagaaatttcggaaaag

SEQ ID NO: 119400 - DNA, 20 bp, Artificial Sequence
  Description of Artificial Sequence: Synthetic oligonucleotide
  Target: ATXN1; (+) strand; PAM type: NRG; PAM sequence: AAG
aaatttcggaaaagtagatc

SEQ ID NO: 119401 - DNA, 20 bp, Artificial Sequence
  Description of Artificial Sequence: Synthetic oligonucleotide
  Target: ATXN1; (+) strand; PAM type: NRG; PAM sequence: AAG
agcacgattctatttctgta

SEQ ID NO: 119402 - DNA, 20 bp, Artificial Sequence
  Description of Artificial Sequence: Synthetic oligonucleotide
  Target: ATXN1; (+) strand; PAM type: NRG; PAM sequence: TAG
tttgtatatatatatatcca

SEQ ID NO: 119403 - DNA, 20 bp, Artificial Sequence
  Description of Artificial Sequence: Synthetic oligonucleotide
  Target: ATXN1; (+) strand; PAM type: NRG; PAM sequence: TGG
tatatccatagaaaatcttc

SEQ ID NO: 119404 - DNA, 20 bp, Artificial Sequence
  Description of Artificial Sequence: Synthetic oligonucleotide
  Target: ATXN1; (+) strand; PAM type: NRG; PAM sequence: AAG
atccatagaaaatcttctgg

SEQ ID NO: 119405 - DNA, 20 bp, Artificial Sequence
  Description of Artificial Sequence: Synthetic oligonucleotide
  Target: ATXN1; (+) strand; PAM type: NRG; PAM sequence: CGG
aaaacacactcaaatgctaa

SEQ ID NO: 119406 - DNA, 20 bp, Artificial Sequence
  Description of Artificial Sequence: Synthetic oligonucleotide
  Target: ATXN1; (+) strand; PAM type: NRG; PAM sequence: TGG
acacactcaaatgctaacgg

SEQ ID NO: 119407 - DNA, 20 bp, Artificial Sequence
  Description of Artificial Sequence: Synthetic oligonucleotide
  Target: ATXN1; (+) strand; PAM type: NRG; PAM sequence: TGG
ctaacggtggtgaacatcta

SEQ ID NO: 119408 - DNA, 20 bp, Artificial Sequence
  Description of Artificial Sequence: Synthetic oligonucleotide
  Target: ATXN1; (+) strand; PAM type: NRG; PAM sequence: GGG
taacggtggtgaacatctat

SEQ ID NO: 119409 - DNA, 20 bp, Artificial Sequence
  Description of Artificial Sequence: Synthetic oligonucleotide
  Target: ATXN1; (+) strand; PAM type: NRG; PAM sequence: CAG
cggtggtgaacatctatggg

SEQ ID NO: 119410 - DNA, 20 bp, Artificial Sequence
  Description of Artificial Sequence: Synthetic oligonucleotide
  Target: ATXN1; (+) strand; PAM type: NRG; PAM sequence: AGG
ggtggtgaacatctatgggc

SEQ ID NO: 119411 - DNA, 20 bp, Artificial Sequence
  Description of Artificial Sequence: Synthetic oligonucleotide
  Target: ATXN1; (+) strand; PAM type: NRG; PAM sequence: TAG
ggtgaacatctatgggcagg

SEQ ID NO: 119412 - DNA, 20 bp, Artificial Sequence
  Description of Artificial Sequence: Synthetic oligonucleotide
  Target: ATXN1; (+) strand; PAM type: NRG; PAM sequence: TGG
gcaggtagataataatgaca

SEQ ID NO: 119413 - DNA, 20 bp, Artificial Sequence
  Description of Artificial Sequence: Synthetic oligonucleotide
  Target: ATXN1; (+) strand; PAM type: NRG; PAM sequence: CAG
ggtagataataatgacatgg

SEQ ID NO: 119414 - DNA, 20 bp, Artificial Sequence
  Description of Artificial Sequence: Synthetic oligonucleotide
  Target: ATXN1; (+) strand; PAM type: NRG; PAM sequence: TAG
tggcagatttttaatattac

SEQ ID NO: 119415 - DNA, 20 bp, Artificial Sequence
  Description of Artificial Sequence: Synthetic oligonucleotide
  Target: ATXN1; (+) strand; PAM type: NRG; PAM sequence: AAG
tatttccttaatttctcttc

SEQ ID NO: 119416 - DNA, 20 bp, Artificial Sequence
  Description of Artificial Sequence: Synthetic oligonucleotide
  Target: ATXN1; (+) strand; PAM type: NRG; PAM sequence: CAG
aatttctcttcaagctatta

SEQ ID NO: 119417 - DNA, 20 bp, Artificial Sequence
  Description of Artificial Sequence: Synthetic oligonucleotide
  Target: ATXN1; (+) strand; PAM type: NRG; PAM sequence: GAG
tttctcttcaagctattaca

SEQ ID NO: 119418 - DNA, 20 bp, Artificial Sequence
  Description of Artificial Sequence: Synthetic oligonucleotide
  Target: ATXN1; (+) strand; PAM type: NRG; PAM sequence: AAG
attacagagaatccatgtaa

SEQ ID NO: 119419 - DNA, 20 bp, Artificial Sequence
  Description of Artificial Sequence: Synthetic oligonucleotide
  Target: ATXN1; (+) strand; PAM type: NRG; PAM sequence: AAG
aagactaatgttttcaatga

SEQ ID NO: 119420 - DNA, 20 bp, Artificial Sequence
  Description of Artificial Sequence: Synthetic oligonucleotide
  Target: ATXN1; (+) strand; PAM type: NRG; PAM sequence: AGG
agactaatgttttcaatgaa

SEQ ID NO: 119421 - DNA, 20 bp, Artificial Sequence
  Description of Artificial Sequence: Synthetic oligonucleotide
  Target: ATXN1; (+) strand; PAM type: NRG; PAM sequence: AAG
ttctttccatctcataactc

SEQ ID NO: 119422 - DNA, 20 bp, Artificial Sequence
  Description of Artificial Sequence: Synthetic oligonucleotide
  Target: ATXN1; (+) strand; PAM type: NRG; PAM sequence: GAG
ccaataacgtcttcctcgct

SEQ ID NO: 119423 - DNA, 20 bp, Artificial Sequence
  Description of Artificial Sequence: Synthetic oligonucleotide
  Target: ATXN1; (+) strand; PAM type: NRG; PAM sequence: AGG
caataacgtcttcctcgctg

SEQ ID NO: 119424 - DNA, 20 bp, Artificial Sequence
  Description of Artificial Sequence: Synthetic oligonucleotide
  Target: ATXN1; (+) strand; PAM type: NRG; PAM sequence: GGG
aataacgtcttcctcgctga

SEQ ID NO: 119425 - DNA, 20 bp, Artificial Sequence
  Description of Artificial Sequence: Synthetic oligonucleotide
  Target: ATXN1; (+) strand; PAM type: NRG; PAM sequence: TAG
aacgtcttcctcgctgaggg

SEQ ID NO: 119426 - DNA, 20 bp, Artificial Sequence
  Description of Artificial Sequence: Synthetic oligonucleotide
  Target: ATXN1; (+) strand; PAM type: NRG; PAM sequence: TAG
cttcctcgctgagggtagaa

SEQ ID NO: 119427 - DNA, 20 bp, Artificial Sequence
  Description of Artificial Sequence: Synthetic oligonucleotide
  Target: ATXN1; (+) strand; PAM type: NRG; PAM sequence: CAG
ctcgctgagggtagaatagt

SEQ ID NO: 119428 - DNA, 20 bp, Artificial Sequence
  Description of Artificial Sequence: Synthetic oligonucleotide
  Target: ATXN1; (+) strand; PAM type: NRG; PAM sequence: AAG
atagtcagtgccttacacaa

SEQ ID NO: 119429 - DNA, 20 bp, Artificial Sequence
  Description of Artificial Sequence: Synthetic oligonucleotide
  Target: ATXN1; (+) strand; PAM type: NRG; PAM sequence: CAG
tcagtgccttacacaaaagc

SEQ ID NO: 119430 - DNA, 20 bp, Artificial Sequence
  Description of Artificial Sequence: Synthetic oligonucleotide
  Target: ATXN1; (+) strand; PAM type: NRG; PAM sequence: TGG
gtgtttgcattaaatgactg

SEQ ID NO: 119431 - DNA, 20 bp, Artificial Sequence
  Description of Artificial Sequence: Synthetic oligonucleotide
  Target: ATXN1; (+) strand; PAM type: NRG; PAM sequence: CAG
tgcattaaatgactgtggtg

SEQ ID NO: 119432 - DNA, 20 bp, Artificial Sequence
  Description of Artificial Sequence: Synthetic oligonucleotide
  Target: ATXN1; (+) strand; PAM type: NRG; PAM sequence: CAG
cataacataaatgacttcaa

SEQ ID NO: 119433 - DNA, 20 bp, Artificial Sequence
  Description of Artificial Sequence: Synthetic oligonucleotide
  Target: ATXN1; (+) strand; PAM type: NRG; PAM sequence: AAG
acagccacatcctgatgcac

SEQ ID NO: 119434 - DNA, 20 bp, Artificial Sequence
  Description of Artificial Sequence: Synthetic oligonucleotide
  Target: ATXN1; (+) strand; PAM type: NRG; PAM sequence: AGG
cagccacatcctgatgcaca

SEQ ID NO: 119435 - DNA, 20 bp, Artificial Sequence
  Description of Artificial Sequence: Synthetic oligonucleotide
  Target: ATXN1; (+) strand; PAM type: NRG; PAM sequence: GGG
agccacatcctgatgcacaa

SEQ ID NO: 119436 - DNA, 20 bp, Artificial Sequence
  Description of Artificial Sequence: Synthetic oligonucleotide
  Target: ATXN1; (+) strand; PAM type: NRG; PAM sequence: AAG
ctgatgcacaagggaaaaca

SEQ ID NO: 119437 - DNA, 20 bp, Artificial Sequence
  Description of Artificial Sequence: Synthetic oligonucleotide
  Target: ATXN1; (+) strand; PAM type: NRG; PAM sequence: AGG
tgatgcacaagggaaaacaa

SEQ ID NO: 119438 - DNA, 20 bp, Artificial Sequence
  Description of Artificial Sequence: Synthetic oligonucleotide
  Target: ATXN1; (+) strand; PAM type: NRG; PAM sequence: TGG
cacaagggaaaacaaaggaa

SEQ ID NO: 119439 - DNA, 20 bp, Artificial Sequence
  Description of Artificial Sequence: Synthetic oligonucleotide
  Target: ATXN1; (+) strand; PAM type: NRG; PAM sequence: AAG
aaaggaatggaaatttcaaa

SEQ ID NO: 119440 - DNA, 20 bp, Artificial Sequence
  Description of Artificial Sequence: Synthetic oligonucleotide
  Target: ATXN1; (+) strand; PAM type: NRG; PAM sequence: AAG
atggaaatttcaaaaagcta

SEQ ID NO: 119441 - DNA, 20 bp, Artificial Sequence
  Description of Artificial Sequence: Synthetic oligonucleotide
  Target: ATXN1; (+) strand; PAM type: NRG; PAM sequence: AAG
caaaaagctaaagtcacaaa

SEQ ID NO: 119442 - DNA, 20 bp, Artificial Sequence
  Description of Artificial Sequence: Synthetic oligonucleotide
  Target: ATXN1; (+) strand; PAM type: NRG; PAM sequence: TGG
gctaaagtcacaaaaagtaa

SEQ ID NO: 119443 - DNA, 20 bp, Artificial Sequence
  Description of Artificial Sequence: Synthetic oligonucleotide
  Target: ATXN1; (+) strand; PAM type: NRG; PAM sequence: AAG
aaagtcacaaaaagtaatgg

SEQ ID NO: 119444 - DNA, 20 bp, Artificial Sequence
  Description of Artificial Sequence: Synthetic oligonucleotide
  Target: ATXN1; (+) strand; PAM type: NRG; PAM sequence: AGG
aagtcacaaaaagtaatgga

SEQ ID NO: 119445 - DNA, 20 bp, Artificial Sequence
  Description of Artificial Sequence: Synthetic oligonucleotide
  Target: ATXN1; (+) strand; PAM type: NRG; PAM sequence: GAG
gtcacaaaaagtaatggaag

SEQ ID NO: 119446 - DNA, 20 bp, Artificial Sequence
  Description of Artificial Sequence: Synthetic oligonucleotide
  Target: ATXN1; (+) strand; PAM type: NRG; PAM sequence: TAG
acaaaaagtaatggaaggag

SEQ ID NO: 119447 - DNA, 20 bp, Artificial Sequence
  Description of Artificial Sequence: Synthetic oligonucleotide
  Target: ATXN1; (+) strand; PAM type: NRG; PAM sequence: CAG
aatggaaggagtagtaacaa

SEQ ID NO: 119448 - DNA, 20 bp, Artificial Sequence
  Description of Artificial Sequence: Synthetic oligonucleotide
  Target: ATXN1; (+) strand; PAM type: NRG; PAM sequence: CAG
ggaaggagtagtaacaacag

SEQ ID NO: 119449 - DNA, 20 bp, Artificial Sequence
  Description of Artificial Sequence: Synthetic oligonucleotide
  Target: ATXN1; (+) strand; PAM type: NRG; PAM sequence: AAG
gagtagtaacaacagcagca

SEQ ID NO: 119450 - DNA, 20 bp, Artificial Sequence
  Description of Artificial Sequence: Synthetic oligonucleotide
  Target: ATXN1; (+) strand; PAM type: NRG; PAM sequence: AGG
agtagtaacaacagcagcaa

SEQ ID NO: 119451 - DNA, 20 bp, Artificial Sequence
  Description of Artificial Sequence: Synthetic oligonucleotide
  Target: ATXN1; (+) strand; PAM type: NRG; PAM sequence: GGG
gtagtaacaacagcagcaaa

SEQ ID NO: 119452 - DNA, 20 bp, Artificial Sequence
  Description of Artificial Sequence: Synthetic oligonucleotide
  Target: ATXN1; (+) strand; PAM type: NRG; PAM sequence: TGG
agcagcaaagggaaatgccc

SEQ ID NO: 119453 - DNA, 20 bp, Artificial Sequence
  Description of Artificial Sequence: Synthetic oligonucleotide
  Target: ATXN1; (+) strand; PAM type: NRG; PAM sequence: GGG
gcagcaaagggaaatgccct

SEQ ID NO: 119454 - DNA, 20 bp, Artificial Sequence
  Description of Artificial Sequence: Synthetic oligonucleotide
  Target: ATXN1; (+) strand; PAM type: NRG; PAM sequence: CGG
gcaaagggaaatgccctggg

SEQ ID NO: 119455 - DNA, 20 bp, Artificial Sequence
  Description of Artificial Sequence: Synthetic oligonucleotide
  Target: ATXN1; (+) strand; PAM type: NRG; PAM sequence: GGG
caaagggaaatgccctgggc

SEQ ID NO: 119456 - DNA, 20 bp, Artificial Sequence
  Description of Artificial Sequence: Synthetic oligonucleotide
  Target: ATXN1; (+) strand; PAM type: NRG; PAM sequence: GGG
aaagggaaatgccctgggcg

SEQ ID NO: 119457 - DNA, 20 bp, Artificial Sequence
  Description of Artificial Sequence: Synthetic oligonucleotide
  Target: ATXN1; (+) strand; PAM type: NRG; PAM sequence: GAG
agggaaatgccctgggcggg

SEQ ID NO: 119458 - DNA, 20 bp, Artificial Sequence
  Description of Artificial Sequence: Synthetic oligonucleotide
  Target: ATXN1; (+) strand; PAM type: NRG; PAM sequence: CAG
aaatgccctgggcggggaga

SEQ ID NO: 119459 - DNA, 20 bp, Artificial Sequence
  Description of Artificial Sequence: Synthetic oligonucleotide
  Target: ATXN1; (+) strand; PAM type: NRG; PAM sequence: CAG
gacccccacccacacatccc

SEQ ID NO: 119460 - DNA, 20 bp, Artificial Sequence
  Description of Artificial Sequence: Synthetic oligonucleotide
  Target: ATXN1; (+) strand; PAM type: NRG; PAM sequence: TGG
agcacttgttttcttgactc

SEQ ID NO: 119461 - DNA, 20 bp, Artificial Sequence
  Description of Artificial Sequence: Synthetic oligonucleotide
  Target: ATXN1; (+) strand; PAM type: NRG; PAM sequence: GAG
cacttgttttcttgactctg

SEQ ID NO: 119462 - DNA, 20 bp, Artificial Sequence
  Description of Artificial Sequence: Synthetic oligonucleotide
  Target: ATXN1; (+) strand; PAM type: NRG; PAM sequence: AGG
acttgttttcttgactctgg

SEQ ID NO: 119463 - DNA, 20 bp, Artificial Sequence
  Description of Artificial Sequence: Synthetic oligonucleotide
  Target: ATXN1; (+) strand; PAM type: NRG; PAM sequence: TAG
tctggaggcgctttcttgat

SEQ ID NO: 119464 - DNA, 20 bp, Artificial Sequence
  Description of Artificial Sequence: Synthetic oligonucleotide
  Target: ATXN1; (+) strand; PAM type: NRG; PAM sequence: TAG
tgttattgttttaaaaattg

SEQ ID NO: 119465 - DNA, 20 bp, Artificial Sequence
  Description of Artificial Sequence: Synthetic oligonucleotide
  Target: ATXN1; (+) strand; PAM type: NRG; PAM sequence: CAG
atcaaaatgcacaacatatg

SEQ ID NO: 119466 - DNA, 20 bp, Artificial Sequence
  Description of Artificial Sequence: Synthetic oligonucleotide
  Target: ATXN1; (+) strand; PAM type: NRG; PAM sequence: AAG
catgatgcaaattatgtatg

SEQ ID NO: 119467 - DNA, 20 bp, Artificial Sequence
  Description of Artificial Sequence: Synthetic oligonucleotide
  Target: ATXN1; (+) strand; PAM type: NRG; PAM sequence: GAG
tgatgcaaattatgtatgaa

SEQ ID NO: 119468 - DNA, 20 bp, Artificial Sequence
  Description of Artificial Sequence: Synthetic oligonucleotide
  Target: ATXN1; (+) strand; PAM type: NRG; PAM sequence: AGG
gatgcaaattatgtatgaag

SEQ ID NO: 119469 - DNA, 20 bp, Artificial Sequence
  Description of Artificial Sequence: Synthetic oligonucleotide
  Target: ATXN1; (+) strand; PAM type: NRG; PAM sequence: CAG
aattatgtatgaagaggatg

SEQ ID NO: 119470 - DNA, 20 bp, Artificial Sequence
  Description of Artificial Sequence: Synthetic oligonucleotide
  Target: ATXN1; (+) strand; PAM type: NRG; PAM sequence: TGG
atgaagaggatgcagcgatg

SEQ ID NO: 119471 - DNA, 20 bp, Artificial Sequence
  Description of Artificial Sequence: Synthetic oligonucleotide
  Target: ATXN1; (+) strand; PAM type: NRG; PAM sequence: CGG
agaggatgcagcgatgtggc

SEQ ID NO: 119472 - DNA, 20 bp, Artificial Sequence
  Description of Artificial Sequence: Synthetic oligonucleotide
  Target: ATXN1; (+) strand; PAM type: NRG; PAM sequence: GGG
gaggatgcagcgatgtggcc

SEQ ID NO: 119473 - DNA, 20 bp, Artificial Sequence
  Description of Artificial Sequence: Synthetic oligonucleotide
  Target: ATXN1; (+) strand; PAM type: NRG; PAM sequence: GAG
ggatgcagcgatgtggccgg

SEQ ID NO: 119474 - DNA, 20 bp, Artificial Sequence
  Description of Artificial Sequence: Synthetic oligonucleotide
  Target: ATXN1; (+) strand; PAM type: NRG; PAM sequence: TAG
gcagcgatgtggccgggagt

SEQ ID NO: 119475 - DNA, 20 bp, Artificial Sequence
  Description of Artificial Sequence: Synthetic oligonucleotide
  Target: ATXN1; (+) strand; PAM type: NRG; PAM sequence: AAG
tgtggccgggagttagcatg

SEQ ID NO: 119476 - DNA, 20 bp, Artificial Sequence
  Description of Artificial Sequence: Synthetic oligonucleotide
  Target: ATXN1; (+) strand; PAM type: NRG; PAM sequence: TGG
ccgggagttagcatgaagcg

SEQ ID NO: 119477 - DNA, 20 bp, Artificial Sequence
  Description of Artificial Sequence: Synthetic oligonucleotide
  Target: ATXN1; (+) strand; PAM type: NRG; PAM sequence: CGG
gaagcgtggttattctatca

SEQ ID NO: 119478 - DNA, 20 bp, Artificial Sequence
  Description of Artificial Sequence: Synthetic oligonucleotide
  Target: ATXN1; (+) strand; PAM type: NRG; PAM sequence: GAG
agcgtggttattctatcacg

SEQ ID NO: 119479 - DNA, 20 bp, Artificial Sequence
  Description of Artificial Sequence: Synthetic oligonucleotide
  Target: ATXN1; (+) strand; PAM type: NRG; PAM sequence: CAG
tatgctcctcatccacaaac

SEQ ID NO: 119480 - DNA, 20 bp, Artificial Sequence
  Description of Artificial Sequence: Synthetic oligonucleotide
  Target: ATXN1; (+) strand; PAM type: NRG; PAM sequence: GAG
tgctcctcatccacaaacca

SEQ ID NO: 119481 - DNA, 20 bp, Artificial Sequence
  Description of Artificial Sequence: Synthetic oligonucleotide
  Target: ATXN1; (+) strand; PAM type: NRG; PAM sequence: AGG
gctcctcatccacaaaccag

SEQ ID NO: 119482 - DNA, 20 bp, Artificial Sequence
  Description of Artificial Sequence: Synthetic oligonucleotide
  Target: ATXN1; (+) strand; PAM type: NRG; PAM sequence: GGG
ctcctcatccacaaaccaga

SEQ ID NO: 119483 - DNA, 20 bp, Artificial Sequence
  Description of Artificial Sequence: Synthetic oligonucleotide
  Target: ATXN1; (+) strand; PAM type: NRG; PAM sequence: CGG
ccacaaaccagagggacgca

SEQ ID NO: 119484 - DNA, 20 bp, Artificial Sequence
  Description of Artificial Sequence: Synthetic oligonucleotide
  Target: ATXN1; (+) strand; PAM type: NRG; PAM sequence: CAG
gggacgcacggtccaatcac

SEQ ID NO: 119485 - DNA, 20 bp, Artificial Sequence
  Description of Artificial Sequence: Synthetic oligonucleotide
  Target: ATXN1; (+) strand; PAM type: NRG; PAM sequence: CAG
cacggtccaatcaccagtgt

SEQ ID NO: 119486 - DNA, 20 bp, Artificial Sequence
  Description of Artificial Sequence: Synthetic oligonucleotide
  Target: ATXN1; (+) strand; PAM type: NRG; PAM sequence: AGG
acggtccaatcaccagtgtc

SEQ ID NO: 119487 - DNA, 20 bp, Artificial Sequence
  Description of Artificial Sequence: Synthetic oligonucleotide
  Target: ATXN1; (+) strand; PAM type: NRG; PAM sequence: TGG
cagtgtcaggttttactgtt

SEQ ID NO: 119488 - DNA, 20 bp, Artificial Sequence
  Description of Artificial Sequence: Synthetic oligonucleotide
  Target: ATXN1; (+) strand; PAM type: NRG; PAM sequence: CAG
caaaactactgctttacatg

SEQ ID NO: 119489 - DNA, 20 bp, Artificial Sequence
  Description of Artificial Sequence: Synthetic oligonucleotide
  Target: ATXN1; (+) strand; PAM type: NRG; PAM sequence: GAG
aaactactgctttacatgca

SEQ ID NO: 119490 - DNA, 20 bp, Artificial Sequence
  Description of Artificial Sequence: Synthetic oligonucleotide
  Target: ATXN1; (+) strand; PAM type: NRG; PAM sequence: AGG
aactactgctttacatgcag

SEQ ID NO: 119491 - DNA, 20 bp, Artificial Sequence
  Description of Artificial Sequence: Synthetic oligonucleotide
  Target: ATXN1; (+) strand; PAM type: NRG; PAM sequence: GAG
ctactgctttacatgcagag

SEQ ID NO: 119492 - DNA, 20 bp, Artificial Sequence
  Description of Artificial Sequence: Synthetic oligonucleotide
  Target: ATXN1; (+) strand; PAM type: NRG; PAM sequence: AGG
tactgctttacatgcagagg

SEQ ID NO: 119493 - DNA, 20 bp, Artificial Sequence
  Description of Artificial Sequence: Synthetic oligonucleotide
  Target: ATXN1; (+) strand; PAM type: NRG; PAM sequence: GGG
actgctttacatgcagagga

SEQ ID NO: 119494 - DNA, 20 bp, Artificial Sequence
  Description of Artificial Sequence: Synthetic oligonucleotide
  Target: ATXN1; (+) strand; PAM type: NRG; PAM sequence: GAG
tgctttacatgcagaggagg

SEQ ID NO: 119495 - DNA, 20 bp, Artificial Sequence
  Description of Artificial Sequence: Synthetic oligonucleotide
  Target: ATXN1; (+) strand; PAM type: NRG; PAM sequence: AGG
gctttacatgcagaggaggg

SEQ ID NO: 119496 - DNA, 20 bp, Artificial Sequence
  Description of Artificial Sequence: Synthetic oligonucleotide
  Target: ATXN1; (+) strand; PAM type: NRG; PAM sequence: GAG
tttacatgcagaggagggag

SEQ ID NO: 119497 - DNA, 20 bp, Artificial Sequence
  Description of Artificial Sequence: Synthetic oligonucleotide
  Target: ATXN1; (+) strand; PAM type: NRG; PAM sequence: CGG
gggaggagtgtgtgtttctt

SEQ ID NO: 119498 - DNA, 20 bp, Artificial Sequence
  Description of Artificial Sequence: Synthetic oligonucleotide
  Target: ATXN1; (+) strand; PAM type: NRG; PAM sequence: GGG
ggaggagtgtgtgtttcttc

SEQ ID NO: 119499 - DNA, 20 bp, Artificial Sequence
  Description of Artificial Sequence: Synthetic oligonucleotide
  Target: ATXN1; (+) strand; PAM type: NRG; PAM sequence: TGG
ggagtgtgtgtttcttcggg

SEQ ID NO: 119500 - DNA, 20 bp, Artificial Sequence
  Description of Artificial Sequence: Synthetic oligonucleotide
  Target: ATXN1; (+) strand; PAM type: NRG; PAM sequence: GGG
gagtgtgtgtttcttcgggt

SEQ ID NO: 119501 - DNA, 20 bp, Artificial Sequence
  Description of Artificial Sequence: Synthetic oligonucleotide
  Target: ATXN1; (+) strand; PAM type: NRG; PAM sequence: GGG
agtgtgtgtttcttcgggtg

SEQ ID NO: 119502 - DNA, 20 bp, Artificial Sequence
  Description of Artificial Sequence: Synthetic oligonucleotide
  Target: ATXN1; (+) strand; PAM type: NRG; PAM sequence: GGG
gtgtgtgtttcttcgggtgg

SEQ ID NO: 119503 - DNA, 20 bp, Artificial Sequence
  Description of Artificial Sequence: Synthetic oligonucleotide
  Target: ATXN1; (+) strand; PAM type: NRG; PAM sequence: TGG
gtgtttcttcgggtggggga

SEQ ID NO: 119504 - DNA, 20 bp, Artificial Sequence
  Description of Artificial Sequence: Synthetic oligonucleotide
  Target: ATXN1; (+) strand; PAM type: NRG; PAM sequence: GAG
gtttcttcgggtgggggatg

SEQ ID NO: 119505 - DNA, 20 bp, Artificial Sequence
  Description of Artificial Sequence: Synthetic oligonucleotide
  Target: ATXN1; (+) strand; PAM type: NRG; PAM sequence: AGG
tttcttcgggtgggggatgg

SEQ ID NO: 119506 - DNA, 20 bp, Artificial Sequence
  Description of Artificial Sequence: Synthetic oligonucleotide
  Target: ATXN1; (+) strand; PAM type: NRG; PAM sequence: GGG
ttcttcgggtgggggatgga

SEQ ID NO: 119507 - DNA, 20 bp, Artificial Sequence
  Description of Artificial Sequence: Synthetic oligonucleotide
  Target: ATXN1; (+) strand; PAM type: NRG; PAM sequence: GAG
cttcgggtgggggatggagg

SEQ ID NO: 119508 - DNA, 20 bp, Artificial Sequence
  Description of Artificial Sequence: Synthetic oligonucleotide
  Target: ATXN1; (+) strand; PAM type: NRG; PAM sequence: TAG
gggggatggagggagcatta

SEQ ID NO: 119509 - DNA, 20 bp, Artificial Sequence
  Description of Artificial Sequence: Synthetic oligonucleotide
  Target: ATXN1; (+) strand; PAM type: NRG; PAM sequence: AAG
ggatggagggagcattatag

SEQ ID NO: 119510 - DNA, 20 bp, Artificial Sequence
  Description of Artificial Sequence: Synthetic oligonucleotide
  Target: ATXN1; (+) strand; PAM type: NRG; PAM sequence: CAG
ttatagaagaacacgcatcc

SEQ ID NO: 119511 - DNA, 20 bp, Artificial Sequence
  Description of Artificial Sequence: Synthetic oligonucleotide
  Target: ATXN1; (+) strand; PAM type: NRG; PAM sequence: CAG
aagaacacgcatcccagtga

SEQ ID NO: 119512 - DNA, 20 bp, Artificial Sequence
  Description of Artificial Sequence: Synthetic oligonucleotide
  Target: ATXN1; (+) strand; PAM type: NRG; PAM sequence: AAG
tcccagtgacagtattttta

SEQ ID NO: 119513 - DNA, 20 bp, Artificial Sequence
  Description of Artificial Sequence: Synthetic oligonucleotide
  Target: ATXN1; (+) strand; PAM type: NRG; PAM sequence: AAG
accttgaaatctgttacaat

SEQ ID NO: 119514 - DNA, 20 bp, Artificial Sequence
  Description of Artificial Sequence: Synthetic oligonucleotide
  Target: ATXN1; (+) strand; PAM type: NRG; PAM sequence: AAG
caataagtacctttaatcaa

SEQ ID NO: 119515 - DNA, 20 bp, Artificial Sequence
  Description of Artificial Sequence: Synthetic oligonucleotide
  Target: ATXN1; (+) strand; PAM type: NRG; PAM sequence: TGG
ttgttttccattcttttcta

SEQ ID NO: 119516 - DNA, 20 bp, Artificial Sequence
  Description of Artificial Sequence: Synthetic oligonucleotide
  Target: ATXN1; (+) strand; PAM type: NRG; PAM sequence: GGG
tgttttccattcttttctat

SEQ ID NO: 119517 - DNA, 20 bp, Artificial Sequence
  Description of Artificial Sequence: Synthetic oligonucleotide
  Target: ATXN1; (+) strand; PAM type: NRG; PAM sequence: TAG
ctatgggcatacattcacta

SEQ ID NO: 119518 - DNA, 20 bp, Artificial Sequence
  Description of Artificial Sequence: Synthetic oligonucleotide
  Target: ATXN1; (+) strand; PAM type: NRG; PAM sequence: TAG
ttcactatagctatttactg

SEQ ID NO: 119519 - DNA, 20 bp, Artificial Sequence
  Description of Artificial Sequence: Synthetic oligonucleotide
  Target: ATXN1; (+) strand; PAM type: NRG; PAM sequence: CAG
tttactgtagttcattattt

SEQ ID NO: 119520 - DNA, 20 bp, Artificial Sequence
  Description of Artificial Sequence: Synthetic oligonucleotide
  Target: ATXN1; (+) strand; PAM type: NRG; PAM sequence: TAG
tattgcaattatcattgttg

SEQ ID NO: 119521 - DNA, 20 bp, Artificial Sequence
  Description of Artificial Sequence: Synthetic oligonucleotide
  Target: ATXN1; (+) strand; PAM type: NRG; PAM sequence: TAG
tcaatcctattgcattaatg

SEQ ID NO: 119522 - DNA, 20 bp, Artificial Sequence
  Description of Artificial Sequence: Synthetic oligonucleotide
  Target: ATXN1; (+) strand; PAM type: NRG; PAM sequence: AGG
caatcctattgcattaatgt

SEQ ID NO: 119523 - DNA, 20 bp, Artificial Sequence
  Description of Artificial Sequence: Synthetic oligonucleotide
  Target: ATXN1; (+) strand; PAM type: NRG; PAM sequence: GAG
atcctattgcattaatgtag

SEQ ID NO: 119524 - DNA, 20 bp, Artificial Sequence
  Description of Artificial Sequence: Synthetic oligonucleotide
  Target: ATXN1; (+) strand; PAM type: NRG; PAM sequence: AAG
attaatgtaggagtatgaaa

SEQ ID NO: 119525 - DNA, 20 bp, Artificial Sequence
  Description of Artificial Sequence: Synthetic oligonucleotide
  Target: ATXN1; (+) strand; PAM type: NRG; PAM sequence: CAG
atgtaggagtatgaaaaagt

SEQ ID NO: 119526 - DNA, 20 bp, Artificial Sequence
  Description of Artificial Sequence: Synthetic oligonucleotide
  Target: ATXN1; (+) strand; PAM type: NRG; PAM sequence: AAG
aggagtatgaaaaagtcaga

SEQ ID NO: 119527 - DNA, 20 bp, Artificial Sequence
  Description of Artificial Sequence: Synthetic oligonucleotide
  Target: ATXN1; (+) strand; PAM type: NRG; PAM sequence: AGG
ggagtatgaaaaagtcagaa

SEQ ID NO: 119528 - DNA, 20 bp, Artificial Sequence
  Description of Artificial Sequence: Synthetic oligonucleotide
  Target: ATXN1; (+) strand; PAM type: NRG; PAM sequence: CAG
tcagaaaggaaaacttaaaa

SEQ ID NO: 119529 - DNA, 20 bp, Artificial Sequence
  Description of Artificial Sequence: Synthetic oligonucleotide
  Target: ATXN1; (+) strand; PAM type: NRG; PAM sequence: TAG
aacaaccctgtccaaaattt

SEQ ID NO: 119530 - DNA, 20 bp, Artificial Sequence
  Description of Artificial Sequence: Synthetic oligonucleotide
  Target: ATXN1; (+) strand; PAM type: NRG; PAM sequence: TAG
aaccctgtccaaaattttag

SEQ ID NO: 119531 - DNA, 20 bp, Artificial Sequence
  Description of Artificial Sequence: Synthetic oligonucleotide
  Target: ATXN1; (+) strand; PAM type: NRG; PAM sequence: AGG
accctgtccaaaattttagt

SEQ ID NO: 119532 - DNA, 20 bp, Artificial Sequence
  Description of Artificial Sequence: Synthetic oligonucleotide
  Target: ATXN1; (+) strand; PAM type: NRG; PAM sequence: AAG
caaaattttagtaggtaaaa

SEQ ID NO: 119533 - DNA, 20 bp, Artificial Sequence
  Description of Artificial Sequence: Synthetic oligonucleotide
  Target: ATXN1; (+) strand; PAM type: NRG; PAM sequence: AAG
aaagctgaaccactgcctac

SEQ ID NO: 119534 - DNA, 20 bp, Artificial Sequence
  Description of Artificial Sequence: Synthetic oligonucleotide
  Target: ATXN1; (+) strand; PAM type: NRG; PAM sequence: AAG
gctgaaccactgcctacaag

SEQ ID NO: 119535 - DNA, 20 bp, Artificial Sequence
  Description of Artificial Sequence: Synthetic oligonucleotide
  Target: ATXN1; (+) strand; PAM type: NRG; PAM sequence: AAG
actgcctacaagaagaccaa

SEQ ID NO: 119536 - DNA, 20 bp, Artificial Sequence
  Description of Artificial Sequence: Synthetic oligonucleotide
  Target: ATXN1; (+) strand; PAM type: NRG; PAM sequence: AAG
gaagaccaaaagattgtctg

SEQ ID NO: 119537 - DNA, 20 bp, Artificial Sequence
  Description of Artificial Sequence: Synthetic oligonucleotide
  Target: ATXN1; (+) strand; PAM type: NRG; PAM sequence: TAG
gattgtctgaagattccatt

SEQ ID NO: 119538 - DNA, 20 bp, Artificial Sequence
  Description of Artificial Sequence: Synthetic oligonucleotide
  Target: ATXN1; (+) strand; PAM type: NRG; PAM sequence: CGG
ttcctgttctctgtaaaaca

SEQ ID NO: 119539 - DNA, 20 bp, Artificial Sequence
  Description of Artificial Sequence: Synthetic oligonucleotide
  Target: ATXN1; (+) strand; PAM type: NRG; PAM sequence: TGG
gtaaaacacggatattctct

SEQ ID NO: 119540 - DNA, 20 bp, Artificial Sequence
  Description of Artificial Sequence: Synthetic oligonucleotide
  Target: ATXN1; (+) strand; PAM type: NRG; PAM sequence: AAG
acacggatattctcttggta

SEQ ID NO: 119541 - DNA, 20 bp, Artificial Sequence
  Description of Artificial Sequence: Synthetic oligonucleotide
  Target: ATXN1; (+) strand; PAM type: NRG; PAM sequence: TAG
attccatttctatttctatc

SEQ ID NO: 119542 - DNA, 20 bp, Artificial Sequence
  Description of Artificial Sequence: Synthetic oligonucleotide
  Target: ATXN1; (+) strand; PAM type: NRG; PAM sequence: TAG
taacttgtttacctattaaa

SEQ ID NO: 119543 - DNA, 20 bp, Artificial Sequence
  Description of Artificial Sequence: Synthetic oligonucleotide
  Target: ATXN1; (+) strand; PAM type: NRG; PAM sequence: AGG
aacttgtttacctattaaat

SEQ ID NO: 119544 - DNA, 20 bp, Artificial Sequence
  Description of Artificial Sequence: Synthetic oligonucleotide
  Target: ATXN1; (+) strand; PAM type: NRG; PAM sequence: GGG
acttgtttacctattaaata

SEQ ID NO: 119545 - DNA, 20 bp, Artificial Sequence
  Description of Artificial Sequence: Synthetic oligonucleotide
  Target: ATXN1; (+) strand; PAM type: NRG; PAM sequence: TAG
acctattaaatagggaatta

SEQ ID NO: 119546 - DNA, 20 bp, Artificial Sequence
  Description of Artificial Sequence: Synthetic oligonucleotide
  Target: ATXN1; (+) strand; PAM type: NRG; PAM sequence: TAG
gggaattatagcaataatca

SEQ ID NO: 119547 - DNA, 20 bp, Artificial Sequence
  Description of Artificial Sequence: Synthetic oligonucleotide
  Target: ATXN1; (+) strand; PAM type: NRG; PAM sequence: AGG
ggaattatagcaataatcat

SEQ ID NO: 119548 - DNA, 20 bp, Artificial Sequence
  Description of Artificial Sequence: Synthetic oligonucleotide
  Target: ATXN1; (+) strand; PAM type: NRG; PAM sequence: CAG
agcaataatcataggaattg

SEQ ID NO: 119549 - DNA, 20 bp, Artificial Sequence
  Description of Artificial Sequence: Synthetic oligonucleotide
  Target: ATXN1; (+) strand; PAM type: NRG; PAM sequence: TGG
aataatcataggaattgcag

SEQ ID NO: 119550 - DNA, 20 bp, Artificial Sequence
  Description of Artificial Sequence: Synthetic oligonucleotide
  Target: ATXN1; (+) strand; PAM type: NRG; PAM sequence: CAG
aatcataggaattgcagtgg

SEQ ID NO: 119551 - DNA, 20 bp, Artificial Sequence
  Description of Artificial Sequence: Synthetic oligonucleotide
  Target: ATXN1; (+) strand; PAM type: NRG; PAM sequence: CAG
gtggcagtaacaataaaaac

SEQ ID NO: 119552 - DNA, 20 bp, Artificial Sequence
  Description of Artificial Sequence: Synthetic oligonucleotide
  Target: ATXN1; (+) strand; PAM type: NRG; PAM sequence: TAG
ttgtctcctatttgccttca

SEQ ID NO: 119553 - DNA, 20 bp, Artificial Sequence
  Description of Artificial Sequence: Synthetic oligonucleotide
  Target: ATXN1; (+) strand; PAM type: NRG; PAM sequence: AAG
gccttcatagtaacattact

SEQ ID NO: 119554 - DNA, 20 bp, Artificial Sequence
  Description of Artificial Sequence: Synthetic oligonucleotide
  Target: ATXN1; (+) strand; PAM type: NRG; PAM sequence: GAG
actaagaactaataaactct

SEQ ID NO: 119555 - DNA, 20 bp, Artificial Sequence
  Description of Artificial Sequence: Synthetic oligonucleotide
  Target: ATXN1; (+) strand; PAM type: NRG; PAM sequence: AGG
ctaagaactaataaactctg

SEQ ID NO: 119556 - DNA, 20 bp, Artificial Sequence
  Description of Artificial Sequence: Synthetic oligonucleotide
  Target: ATXN1; (+) strand; PAM type: NRG; PAM sequence: TAG
gaactaataaactctgaggc

SEQ ID NO: 119557 - DNA, 20 bp, Artificial Sequence
  Description of Artificial Sequence: Synthetic oligonucleotide
  Target: ATXN1; (+) strand; PAM type: NRG; PAM sequence: GAG
actaataaactctgaggcta

SEQ ID NO: 119558 - DNA, 20 bp, Artificial Sequence
  Description of Artificial Sequence: Synthetic oligonucleotide
  Target: ATXN1; (+) strand; PAM type: NRG; PAM sequence: AAG
aactctgaggctagagacta

SEQ ID NO: 119559 - DNA, 20 bp, Artificial Sequence
  Description of Artificial Sequence: Synthetic oligonucleotide
  Target: ATXN1; (+) strand; PAM type: NRG; PAM sequence: AAG
ctgaggctagagactaaagt

SEQ ID NO: 119560 - DNA, 20 bp, Artificial Sequence
  Description of Artificial Sequence: Synthetic oligonucleotide
  Target: ATXN1; (+) strand; PAM type: NRG; PAM sequence: TGG
tagagactaaagtaagaatt

SEQ ID NO: 119561 - DNA, 20 bp, Artificial Sequence
  Description of Artificial Sequence: Synthetic oligonucleotide
  Target: ATXN1; (+) strand; PAM type: NRG; PAM sequence: TAG
actaaagtaagaatttggtt

SEQ ID NO: 119562 - DNA, 20 bp, Artificial Sequence
  Description of Artificial Sequence: Synthetic oligonucleotide
  Target: ATXN1; (+) strand; PAM type: NRG; PAM sequence: AGG
ctaaagtaagaatttggttt

SEQ ID NO: 119563 - DNA, 20 bp, Artificial Sequence
  Description of Artificial Sequence: Synthetic oligonucleotide
  Target: ATXN1; (+) strand; PAM type: NRG; PAM sequence: TGG
gtaagaatttggtttaggac

SEQ ID NO: 119564 - DNA, 20 bp, Artificial Sequence
  Description of Artificial Sequence: Synthetic oligonucleotide
  Target: ATXN1; (+) strand; PAM type: NRG; PAM sequence: GAG
tttttattttattttatttt

SEQ ID NO: 119565 - DNA, 20 bp, Artificial Sequence
  Description of Artificial Sequence: Synthetic oligonucleotide
  Target: ATXN1; (+) strand; PAM type: NRG; PAM sequence: CGG
tattttattttattttgaga

SEQ ID NO: 119566 - DNA, 20 bp, Artificial Sequence
  Description of Artificial Sequence: Synthetic oligonucleotide
  Target: ATXN1; (+) strand; PAM type: NRG; PAM sequence: GAG
ttttattttattttgagacg

SEQ ID NO: 119567 - DNA, 20 bp, Artificial Sequence
  Description of Artificial Sequence: Synthetic oligonucleotide
  Target: ATXN1; (+) strand; PAM type: NRG; PAM sequence: CAG
cggagtctcactctgtcgcc

SEQ ID NO: 119568 - DNA, 20 bp, Artificial Sequence
  Description of Artificial Sequence: Synthetic oligonucleotide
  Target: ATXN1; (+) strand; PAM type: NRG; PAM sequence: AGG
ggagtctcactctgtcgccc

SEQ ID NO: 119569 - DNA, 20 bp, Artificial Sequence
  Description of Artificial Sequence: Synthetic oligonucleotide
  Target: ATXN1; (+) strand; PAM type: NRG; PAM sequence: TGG
tctcactctgtcgcccaggc

SEQ ID NO: 119570 - DNA, 20 bp, Artificial Sequence
  Description of Artificial Sequence: Synthetic oligonucleotide
  Target: ATXN1; (+) strand; PAM type: NRG; PAM sequence: GAG
tcactctgtcgcccaggctg

SEQ ID NO: 119571 - DNA, 20 bp, Artificial Sequence
  Description of Artificial Sequence: Synthetic oligonucleotide
  Target: ATXN1; (+) strand; PAM type: NRG; PAM sequence: CAG
ctgtcgcccaggctggagtg

SEQ ID NO: 119572 - DNA, 20 bp, Artificial Sequence
  Description of Artificial Sequence: Synthetic oligonucleotide
  Target: ATXN1; (+) strand; PAM type: NRG; PAM sequence: TGG
tcgcccaggctggagtgcag

SEQ ID NO: 119573 - DNA, 20 bp, Artificial Sequence
  Description of Artificial Sequence: Synthetic oligonucleotide
  Target: ATXN1; (+) strand; PAM type: NRG; PAM sequence: TGG
ggagtgcagtggcacgatct

SEQ ID NO: 119574 - DNA, 20 bp, Artificial Sequence
  Description of Artificial Sequence: Synthetic oligonucleotide
  Target: ATXN1; (+) strand; PAM type: NRG; PAM sequence: AAG
gcacgatcttggctcactgc

SEQ ID NO: 119575 - DNA, 20 bp, Artificial Sequence
  Description of Artificial Sequence: Synthetic oligonucleotide
  Target: ATXN1; (+) strand; PAM type: NRG; PAM sequence: CAG
tcactgcaagctccacttcc

SEQ ID NO: 119576 - DNA, 20 bp, Artificial Sequence
  Description of Artificial Sequence: Synthetic oligonucleotide
  Target: ATXN1; (+) strand; PAM type: NRG; PAM sequence: AGG
cactgcaagctccacttccc

SEQ ID NO: 119577 - DNA, 20 bp, Artificial Sequence
  Description of Artificial Sequence: Synthetic oligonucleotide
  Target: ATXN1; (+) strand; PAM type: NRG; PAM sequence: CAG
ttcacgccattctcccgcct

SEQ ID NO: 119578 - DNA, 20 bp, Artificial Sequence
  Description of Artificial Sequence: Synthetic oligonucleotide
  Target: ATXN1; (+) strand; PAM type: NRG; PAM sequence: GAG
ttctcccgcctcagcctcct

SEQ ID NO: 119579 - DNA, 20 bp, Artificial Sequence
  Description of Artificial Sequence: Synthetic oligonucleotide
  Target: ATXN1; (+) strand; PAM type: NRG; PAM sequence: TAG
tcccgcctcagcctcctgag

SEQ ID NO: 119580 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcctgagtagc

SEQ ID NO: 119581 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcctgagtagct

SEQ ID NO: 119582 - DNA, 20 bp, Artificial Sequence
  Description of Artificial Sequence: Synthetic oligonucleotide
  Target: ATXN1; (+) strand; PAM type: NRG; PAM sequence: CAG
ctcctgagtagctgggacta

SEQ ID NO: 119583 - DNA, 20 bp, Artificial Sequence
  Description of Artificial Sequence: Synthetic oligonucleotide
  Target: ATXN1; (+) strand; PAM type: NRG; PAM sequence: AGG
tcctgagtagctgggactac

SEQ ID NO: 119584 - DNA, 20 bp, Artificial Sequence
  Description of Artificial Sequence: Synthetic oligonucleotide
  Target: ATXN1; (+) strand; PAM type: NRG; PAM sequence: TGG
caggcgcatgccaccacgcg

SEQ ID NO: 119585 - DNA, 20 bp, Artificial Sequence
  Description of Artificial Sequence: Synthetic oligonucleotide
  Target: ATXN1; (+) strand; PAM type: NRG; PAM sequence: TGG
gccaccacgcgtggctaatt

SEQ ID NO: 119586 - DNA, 20 bp, Artificial Sequence
  Description of Artificial Sequence: Synthetic oligonucleotide
  Target: ATXN1; (+) strand; PAM type: NRG; PAM sequence: TAG
taatttggtttttgtatttt

SEQ ID NO: 119587 - DNA, 20 bp, Artificial Sequence
  Description of Artificial Sequence: Synthetic oligonucleotide
  Target: ATXN1; (+) strand; PAM type: NRG; PAM sequence: TAG
tttggtttttgtatttttag

SEQ ID NO: 119588 - DNA, 20 bp, Artificial Sequence
  Description of Artificial Sequence: Synthetic oligonucleotide
  Target: ATXN1; (+) strand; PAM type: NRG; PAM sequence: GAG
tggtttttgtatttttagta

SEQ ID NO: 119589 - DNA, 20 bp, Artificial Sequence
  Description of Artificial Sequence: Synthetic oligonucleotide
  Target: ATXN1; (+) strand; PAM type: NRG; PAM sequence: CGG
ttttgtatttttagtagaga

SEQ ID NO: 119590 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtagagac

SEQ ID NO: 119591 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagacg

SEQ ID NO: 119592 - DNA, 20 bp, Artificial Sequence
  Description of Artificial Sequence: Synthetic oligonucleotide
  Target: ATXN1; (+) strand; PAM type: NRG; PAM sequence: TAG
gagacggggtttcactgtgt

SEQ ID NO: 119593 - DNA, 20 bp, Artificial Sequence
  Description of Artificial Sequence: Synthetic oligonucleotide
  Target: ATXN1; (+) strand; PAM type: NRG; PAM sequence: CAG
cggggtttcactgtgttagt

SEQ ID NO: 119594 - DNA, 20 bp, Artificial Sequence
  Description of Artificial Sequence: Synthetic oligonucleotide
  Target: ATXN1; (+) strand; PAM type: NRG; PAM sequence: AGG
ggggtttcactgtgttagtc

SEQ ID NO: 119595 - DNA, 20 bp, Artificial Sequence
  Description of Artificial Sequence: Synthetic oligonucleotide
  Target: ATXN1; (+) strand; PAM type: NRG; PAM sequence: TGG
tttcactgtgttagtcagga

SEQ ID NO: 119596 - DNA, 20 bp, Artificial Sequence
  Description of Artificial Sequence: Synthetic oligonucleotide
  Target: ATXN1; (+) strand; PAM type: NRG; PAM sequence: CGG
acatcgtgatctgcccgcct

SEQ ID NO: 119597 - DNA, 20 bp, Artificial Sequence
  Description of Artificial Sequence: Synthetic oligonucleotide
  Target: ATXN1; (+) strand; PAM type: NRG; PAM sequence: AAG
ctgcccgcctcggcctccta

SEQ ID NO: 119598 - DNA, 20 bp, Artificial Sequence
  Description of Artificial Sequence: Synthetic oligonucleotide
  Target: ATXN1; (+) strand; PAM type: NRG; PAM sequence: TGG
gcctcggcctcctaaagtgc

SEQ ID NO: 119599 - DNA, 20 bp, Artificial Sequence
  Description of Artificial Sequence: Synthetic oligonucleotide
  Target: ATXN1; (+) strand; PAM type: NRG; PAM sequence: GGG
cctcggcctcctaaagtgct

SEQ ID NO: 119600 - DNA, 20 bp, Artificial Sequence
  Description of Artificial Sequence: Synthetic oligonucleotide
  Target: ATXN1; (+) strand; PAM type: NRG; PAM sequence: CAG
ctcctaaagtgctgggatta

SEQ ID NO: 119601 - DNA, 20 bp, Artificial Sequence
  Description of Artificial Sequence: Synthetic oligonucleotide
  Target: ATXN1; (+) strand; PAM type: NRG; PAM sequence: AGG
tcctaaagtgctgggattac

SEQ ID NO: 119602 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggcgt

SEQ ID NO: 119603 - DNA, 20 bp, Artificial Sequence
  Description of Artificial Sequence: Synthetic oligonucleotide
  Target: ATXN1; (+) strand; PAM type: NRG; PAM sequence: TGG
caggcgtgagccaccatgcc

SEQ ID NO: 119604 - DNA, 20 bp, Artificial Sequence
  Description of Artificial Sequence: Synthetic oligonucleotide
  Target: ATXN1; (+) strand; PAM type: NRG; PAM sequence: CGG
gtgagccaccatgcctggcc

SEQ ID NO: 119605 - DNA, 20 bp, Artificial Sequence
  Description of Artificial Sequence: Synthetic oligonucleotide
  Target: ATXN1; (+) strand; PAM type: NRG; PAM sequence: TGG
ccaccatgcctggcccggac

SEQ ID NO: 119606 - DNA, 20 bp, Artificial Sequence
  Description of Artificial Sequence: Synthetic oligonucleotide
  Target: ATXN1; (+) strand; PAM type: NRG; PAM sequence: AAG
ggactggttattaccttata

SEQ ID NO: 119607 - DNA, 20 bp, Artificial Sequence
  Description of Artificial Sequence: Synthetic oligonucleotide
  Target: ATXN1; (+) strand; PAM type: NRG; PAM sequence: AGG
gactggttattaccttataa

SEQ ID NO: 119608 - DNA, 20 bp, Artificial Sequence
  Description of Artificial Sequence: Synthetic oligonucleotide
  Target: ATXN1; (+) strand; PAM type: NRG; PAM sequence: GGG
actggttattaccttataaa

SEQ ID NO: 119609 - DNA, 20 bp, Artificial Sequence
  Description of Artificial Sequence: Synthetic oligonucleotide
  Target: ATXN1; (+) strand; PAM type: NRG; PAM sequence: AAG
ggttattaccttataaaggg

SEQ ID NO: 119610 - DNA, 20 bp, Artificial Sequence
  Description of Artificial Sequence: Synthetic oligonucleotide
  Target: ATXN1; (+) strand; PAM type: NRG; PAM sequence: CAG
aagtaccatcaaattgttat

SEQ ID NO: 119611 - DNA, 20 bp, Artificial Sequence
  Description of Artificial Sequence: Synthetic oligonucleotide
  Target: ATXN1; (+) strand; PAM type: NRG; PAM sequence: GAG
gtaccatcaaattgttatca

SEQ ID NO: 119612 - DNA, 20 bp, Artificial Sequence
  Description of Artificial Sequence: Synthetic oligonucleotide
  Target: ATXN1; (+) strand; PAM type: NRG; PAM sequence: CAG
ttatcagagtaacttgtttc

SEQ ID NO: 119613 - DNA, 20 bp, Artificial Sequence
  Description of Artificial Sequence: Synthetic oligonucleotide
  Target: ATXN1; (+) strand; PAM type: NRG; PAM sequence: AGG
tatcagagtaacttgtttcc

SEQ ID NO: 119614 - DNA, 20 bp, Artificial Sequence
  Description of Artificial Sequence: Synthetic oligonucleotide
  Target: ATXN1; (+) strand; PAM type: NRG; PAM sequence: GGG
atcagagtaacttgtttcca

SEQ ID NO: 119615 - DNA, 20 bp, Artificial Sequence
  Description of Artificial Sequence: Synthetic oligonucleotide
  Target: ATXN1; (+) strand; PAM type: NRG; PAM sequence: AAG
agagtaacttgtttccaggg

SEQ ID NO: 119616 - DNA, 20 bp, Artificial Sequence
  Description of Artificial Sequence: Synthetic oligonucleotide
  Target: ATXN1; (+) strand; PAM type: NRG; PAM sequence: TGG
tgtttccagggaagccactg

SEQ ID NO: 119617 - DNA, 20 bp, Artificial Sequence
  Description of Artificial Sequence: Synthetic oligonucleotide
  Target: ATXN1; (+) strand; PAM type: NRG; PAM sequence: GGG
gtttccagggaagccactgt

SEQ ID NO: 119618 - DNA, 20 bp, Artificial Sequence
  Description of Artificial Sequence: Synthetic oligonucleotide
  Target: ATXN1; (+) strand; PAM type: NRG; PAM sequence: CAG
gccactgtgggatgaatgaa

SEQ ID NO: 119619 - DNA, 20 bp, Artificial Sequence
  Description of Artificial Sequence: Synthetic oligonucleotide
  Target: ATXN1; (+) strand; PAM type: NRG; PAM sequence: TGG
tgggatgaatgaacagtcac

SEQ ID NO: 119620 - DNA, 20 bp, Artificial Sequence
  Description of Artificial Sequence: Synthetic oligonucleotide
  Target: ATXN1; (+) strand; PAM type: NRG; PAM sequence: CAG
gaatgaacagtcactggaac

SEQ ID NO: 119621 - DNA, 20 bp, Artificial Sequence
  Description of Artificial Sequence: Synthetic oligonucleotide
  Target: ATXN1; (+) strand; PAM type: NRG; PAM sequence: AAG
gaacagtcactggaaccagt

SEQ ID NO: 119622 - DNA, 20 bp, Artificial Sequence
  Description of Artificial Sequence: Synthetic oligonucleotide
  Target: ATXN1; (+) strand; PAM type: NRG; PAM sequence: GAG
agtcactggaaccagtaagc

SEQ ID NO: 119623 - DNA, 20 bp, Artificial Sequence
  Description of Artificial Sequence: Synthetic oligonucleotide
  Target: ATXN1; (+) strand; PAM type: NRG; PAM sequence: TGG
aagcgagtatatgctatccc

SEQ ID NO: 119624 - DNA, 20 bp, Artificial Sequence
  Description of Artificial Sequence: Synthetic oligonucleotide
  Target: ATXN1; (+) strand; PAM type: NRG; PAM sequence: GGG
agcgagtatatgctatccct

SEQ ID NO: 119625 - DNA, 20 bp, Artificial Sequence
  Description of Artificial Sequence: Synthetic oligonucleotide
  Target: ATXN1; (+) strand; PAM type: NRG; PAM sequence: TAG
agtatatgctatccctgggc

SEQ ID NO: 119626 - DNA, 20 bp, Artificial Sequence
  Description of Artificial Sequence: Synthetic oligonucleotide
  Target: ATXN1; (+) strand; PAM type: NRG; PAM sequence: AGG
gtatatgctatccctgggct

SEQ ID NO: 119627 - DNA, 20 bp, Artificial Sequence
  Description of Artificial Sequence: Synthetic oligonucleotide
  Target: ATXN1; (+) strand; PAM type: NRG; PAM sequence: GAG
atatgctatccctgggctag

SEQ ID NO: 119628 - DNA, 20 bp, Artificial Sequence
  Description of Artificial Sequence: Synthetic oligonucleotide
  Target: ATXN1; (+) strand; PAM type: NRG; PAM sequence: TGG
atccctgggctaggagttgc

SEQ ID NO: 119629 - DNA, 20 bp, Artificial Sequence
  Description of Artificial Sequence: Synthetic oligonucleotide
  Target: ATXN1; (+) strand; PAM type: NRG; PAM sequence: AAG
ggagttgctggtatatactg

SEQ ID NO: 119630 - DNA, 20 bp, Artificial Sequence
  Description of Artificial Sequence: Synthetic oligonucleotide
  Target: ATXN1; (+) strand; PAM type: NRG; PAM sequence: CAG
ctggtatatactgaagtaca

SEQ ID NO: 119631 - DNA, 20 bp, Artificial Sequence
  Description of Artificial Sequence: Synthetic oligonucleotide
  Target: ATXN1; (+) strand; PAM type: NRG; PAM sequence: AAG
cacagttacaaatcaatgca

SEQ ID NO: 119632 - DNA, 20 bp, Artificial Sequence
  Description of Artificial Sequence: Synthetic oligonucleotide
  Target: ATXN1; (+) strand; PAM type: NRG; PAM sequence: TAG
caaatcaatgcaaagcaaat

SEQ ID NO: 119633 - DNA, 20 bp, Artificial Sequence
  Description of Artificial Sequence: Synthetic oligonucleotide
  Target: ATXN1; (+) strand; PAM type: NRG; PAM sequence: AAG
atgcaaagcaaattagccaa

SEQ ID NO: 119634 - DNA, 20 bp, Artificial Sequence
  Description of Artificial Sequence: Synthetic oligonucleotide
  Target: ATXN1; (+) strand; PAM type: NRG; PAM sequence: GAG
gcaaagcaaattagccaaaa

SEQ ID NO: 119635 - DNA, 20 bp, Artificial Sequence
  Description of Artificial Sequence: Synthetic oligonucleotide
  Target: ATXN1; (+) strand; PAM type: NRG; PAM sequence: AGG
caaagcaaattagccaaaag

SEQ ID NO: 119636 - DNA, 20 bp, Artificial Sequence
  Description of Artificial Sequence: Synthetic oligonucleotide
  Target: ATXN1; (+) strand; PAM type: NRG; PAM sequence: AAG
aaattagccaaaagaggcaa

SEQ ID NO: 119637 - DNA, 20 bp, Artificial Sequence
  Description of Artificial Sequence: Synthetic oligonucleotide
  Target: ATXN1; (+) strand; PAM type: NRG; PAM sequence: AAG
caaaagtcactcccctttct

SEQ ID NO: 119638 - DNA, 20 bp, Artificial Sequence
  Description of Artificial Sequence: Synthetic oligonucleotide
  Target: ATXN1; (+) strand; PAM type: NRG; PAM sequence: CAG
aagtcactcccctttctaag

SEQ ID NO: 119639 - DNA, 20 bp, Artificial Sequence
  Description of Artificial Sequence: Synthetic oligonucleotide
  Target: ATXN1; (+) strand; PAM type: NRG; PAM sequence: AAG
cagattgttaacaatgtcct

SEQ ID NO: 119640 - DNA, 20 bp, Artificial Sequence
  Description of Artificial Sequence: Synthetic oligonucleotide
  Target: ATXN1; (+) strand; PAM type: NRG; PAM sequence: GAG
gattgttaacaatgtcctaa

SEQ ID NO: 119641 - DNA, 20 bp, Artificial Sequence
  Description of Artificial Sequence: Synthetic oligonucleotide
  Target: ATXN1; (+) strand; PAM type: NRG; PAM sequence: AAG
acaatgtcctaagagaatgc

SEQ ID NO: 119642 - DNA, 20 bp, Artificial Sequence
  Description of Artificial Sequence: Synthetic oligonucleotide
  Target: ATXN1; (+) strand; PAM type: NRG; PAM sequence: TGG
aagcatttaaaaactgtaca

SEQ ID NO: 119643 - DNA, 20 bp, Artificial Sequence
  Description of Artificial Sequence: Synthetic oligonucleotide
  Target: ATXN1; (+) strand; PAM type: NRG; PAM sequence: TGG
aaactgtacatggctgatat

SEQ ID NO: 119644 - DNA, 20 bp, Artificial Sequence
  Description of Artificial Sequence: Synthetic oligonucleotide
  Target: ATXN1; (+) strand; PAM type: NRG; PAM sequence: GAG
tggctgatattggaaatatt

SEQ ID NO: 119645 - DNA, 20 bp, Artificial Sequence
  Description of Artificial Sequence: Synthetic oligonucleotide
  Target: ATXN1; (+) strand; PAM type: NRG; PAM sequence: TAG
atattggaaatattgagatt

SEQ ID NO: 119646 - DNA, 20 bp, Artificial Sequence
  Description of Artificial Sequence: Synthetic oligonucleotide
  Target: ATXN1; (+) strand; PAM type: NRG; PAM sequence: GAG
attggaaatattgagattta

SEQ ID NO: 119647 - DNA, 20 bp, Artificial Sequence
  Description of Artificial Sequence: Synthetic oligonucleotide
  Target: ATXN1; (+) strand; PAM type: NRG; PAM sequence: TAG
atattgagatttagagcaac

SEQ ID NO: 119648 - DNA, 20 bp, Artificial Sequence
  Description of Artificial Sequence: Synthetic oligonucleotide
  Target: ATXN1; (+) strand; PAM type: NRG; PAM sequence: GAG
attgagatttagagcaacta

SEQ ID NO: 119649 - DNA, 20 bp, Artificial Sequence
  Description of Artificial Sequence: Synthetic oligonucleotide
  Target: ATXN1; (+) strand; PAM type: NRG; PAM sequence: AAG
gagatttagagcaactagag

SEQ ID NO: 119650 - DNA, 20 bp, Artificial Sequence
  Description of Artificial Sequence: Synthetic oligonucleotide
  Target: ATXN1; (+) strand; PAM type: NRG; PAM sequence: CAG
agagcaactagagaagtttt

SEQ ID NO: 119651 - DNA, 20 bp, Artificial Sequence
  Description of Artificial Sequence: Synthetic oligonucleotide
  Target: ATXN1; (+) strand; PAM type: NRG; PAM sequence: GAG
agagaagttttcagatgctt

SEQ ID NO: 119652 - DNA, 20 bp, Artificial Sequence
  Description of Artificial Sequence: Synthetic oligonucleotide
  Target: ATXN1; (+) strand; PAM type: NRG; PAM sequence: CAG
aacatcaccttacttttgaa

SEQ ID NO: 119653 - DNA, 20 bp, Artificial Sequence
  Description of Artificial Sequence: Synthetic oligonucleotide
  Target: ATXN1; (+) strand; PAM type: NRG; PAM sequence: TAG
gaacagaacacaaacttact

SEQ ID NO: 119654 - DNA, 20 bp, Artificial Sequence
  Description of Artificial Sequence: Synthetic oligonucleotide
  Target: ATXN1; (+) strand; PAM type: NRG; PAM sequence: TAG
agatcgatgcttcttctgaa

SEQ ID NO: 119655 - DNA, 20 bp, Artificial Sequence
  Description of Artificial Sequence: Synthetic oligonucleotide
  Target: ATXN1; (+) strand; PAM type: NRG; PAM sequence: AAG
tcgatgcttcttctgaatag

SEQ ID NO: 119656 - DNA, 20 bp, Artificial Sequence
  Description of Artificial Sequence: Synthetic oligonucleotide
  Target: ATXN1; (+) strand; PAM type: NRG; PAM sequence: CAG
atgcttcttctgaatagaag

SEQ ID NO: 119657 - DNA, 20 bp, Artificial Sequence
  Description of Artificial Sequence: Synthetic oligonucleotide
  Target: ATXN1; (+) strand; PAM type: NRG; PAM sequence: AAG
atagaagcagaaaaaaaaaa

SEQ ID NO: 119658 - DNA, 20 bp, Artificial Sequence
  Description of Artificial Sequence: Synthetic oligonucleotide
  Target: ATXN1; (+) strand; PAM type: NRG; PAM sequence: AGG
tagaagcagaaaaaaaaaaa

SEQ ID NO: 119659 - DNA, 20 bp, Artificial Sequence
  Description of Artificial Sequence: Synthetic oligonucleotide
  Target: ATXN1; (+) strand; PAM type: NRG; PAM sequence: TAG
aagcagaaaaaaaaaaaagg

SEQ ID NO: 119660 - DNA, 20 bp, Artificial Sequence
  Description of Artificial Sequence: Synthetic oligonucleotide
  Target: ATXN1; (+) strand; PAM type: NRG; PAM sequence: AGG
agcagaaaaaaaaaaaaggt

SEQ ID NO: 119661 - DNA, 20 bp, Artificial Sequence
  Description of Artificial Sequence: Synthetic oligonucleotide
  Target: ATXN1; (+) strand; PAM type: NRG; PAM sequence: TAG
aaaaaaaggtaggactgtga

SEQ ID NO: 119662 - DNA, 20 bp, Artificial Sequence
  Description of Artificial Sequence: Synthetic oligonucleotide
  Target: ATXN1; (+) strand; PAM type: NRG; PAM sequence: CAG
actgtgatagaaaactattt

SEQ ID NO: 119663 - DNA, 20 bp, Artificial Sequence
  Description of Artificial Sequence: Synthetic oligonucleotide
  Target: ATXN1; (+) strand; PAM type: NRG; PAM sequence: GAG
tgtgatagaaaactatttca

SEQ ID NO: 119664 - DNA, 20 bp, Artificial Sequence
  Description of Artificial Sequence: Synthetic oligonucleotide
  Target: ATXN1; (+) strand; PAM type: NRG; PAM sequence: AGG
gtgatagaaaactatttcag

SEQ ID NO: 119665 - DNA, 20 bp, Artificial Sequence
  Description of Artificial Sequence: Synthetic oligonucleotide
  Target: ATXN1; (+) strand; PAM type: NRG; PAM sequence: TGG
cagaggttgatccactcatc

SEQ ID NO: 119666 - DNA, 20 bp, Artificial Sequence
  Description of Artificial Sequence: Synthetic oligonucleotide
  Target: ATXN1; (+) strand; PAM type: NRG; PAM sequence: AAG
ttgatccactcatctggacc

SEQ ID NO: 119667 - DNA, 20 bp, Artificial Sequence
  Description of Artificial Sequence: Synthetic oligonucleotide
  Target: ATXN1; (+) strand; PAM type: NRG; PAM sequence: CAG
agtccctgcacctaaaaata

SEQ ID NO: 119668 - DNA, 20 bp, Artificial Sequence
  Description of Artificial Sequence: Synthetic oligonucleotide
  Target: ATXN1; (+) strand; PAM type: NRG; PAM sequence: AGG
gtccctgcacctaaaaatac

SEQ ID NO: 119669 - DNA, 20 bp, Artificial Sequence
  Description of Artificial Sequence: Synthetic oligonucleotide
  Target: ATXN1; (+) strand; PAM type: NRG; PAM sequence: AAG
cctgcacctaaaaatacagg

SEQ ID NO: 119670 - DNA, 20 bp, Artificial Sequence
  Description of Artificial Sequence: Synthetic oligonucleotide
  Target: ATXN1; (+) strand; PAM type: NRG; PAM sequence: TAG
cacctaaaaatacaggaagt

SEQ ID NO: 119671 - DNA, 20 bp, Artificial Sequence
  Description of Artificial Sequence: Synthetic oligonucleotide
  Target: ATXN1; (+) strand; PAM type: NRG; PAM sequence: AAG
aatacaggaagttagatttt

SEQ ID NO: 119672 - DNA, 20 bp, Artificial Sequence
  Description of Artificial Sequence: Synthetic oligonucleotide
  Target: ATXN1; (+) strand; PAM type: NRG; PAM sequence: AGG
atacaggaagttagatttta

SEQ ID NO: 119673 - DNA, 20 bp, Artificial Sequence
  Description of Artificial Sequence: Synthetic oligonucleotide
  Target: ATXN1; (+) strand; PAM type: NRG; PAM sequence: CAG
aatctgccaaaactgtgcaa

SEQ ID NO: 119674 - DNA, 20 bp, Artificial Sequence
  Description of Artificial Sequence: Synthetic oligonucleotide
  Target: ATXN1; (+) strand; PAM type: NRG; PAM sequence: GAG
tctgccaaaactgtgcaaca

SEQ ID NO: 119675 - DNA, 20 bp, Artificial Sequence
  Description of Artificial Sequence: Synthetic oligonucleotide
  Target: ATXN1; (+) strand; PAM type: NRG; PAM sequence: TGG
ccaaaactgtgcaacagagc

SEQ ID NO: 119676 - DNA, 20 bp, Artificial Sequence
  Description of Artificial Sequence: Synthetic oligonucleotide
  Target: ATXN1; (+) strand; PAM type: NRG; PAM sequence: TGG
tgtgcaacagagctggccct

SEQ ID NO: 119677 - DNA, 20 bp, Artificial Sequence
  Description of Artificial Sequence: Synthetic oligonucleotide
  Target: ATXN1; (+) strand; PAM type: NRG; PAM sequence: TAG
ccttggctgtccaaaccttc

SEQ ID NO: 119678 - DNA, 20 bp, Artificial Sequence
  Description of Artificial Sequence: Synthetic oligonucleotide
  Target: ATXN1; (+) strand; PAM type: NRG; PAM sequence: AAG
ggctgtccaaaccttctaga

SEQ ID NO: 119679 - DNA, 20 bp, Artificial Sequence
  Description of Artificial Sequence: Synthetic oligonucleotide
  Target: ATXN1; (+) strand; PAM type: NRG; PAM sequence: AGG
gctgtccaaaccttctagaa

SEQ ID NO: 119680 - DNA, 20 bp, Artificial Sequence
  Description of Artificial Sequence: Synthetic oligonucleotide
  Target: ATXN1; (+) strand; PAM type: NRG; PAM sequence: CAG
gtccaaaccttctagaaagg

SEQ ID NO: 119681 - DNA, 20 bp, Artificial Sequence
  Description of Artificial Sequence: Synthetic oligonucleotide
  Target: ATXN1; (+) strand; PAM type: NRG; PAM sequence: GAG
ccaaaccttctagaaaggca

SEQ ID NO: 119682 - DNA, 20 bp, Artificial Sequence
  Description of Artificial Sequence: Synthetic oligonucleotide
  Target: ATXN1; (+) strand; PAM type: NRG; PAM sequence: TGG
tttaaaatgcacttacaccg

SEQ ID NO: 119683 - DNA, 20 bp, Artificial Sequence
  Description of Artificial Sequence: Synthetic oligonucleotide
  Target: ATXN1; (+) strand; PAM type: NRG; PAM sequence: GGG
ttaaaatgcacttacaccgt

SEQ ID NO: 119684 - DNA, 20 bp, Artificial Sequence
  Description of Artificial Sequence: Synthetic oligonucleotide
  Target: ATXN1; (+) strand; PAM type: NRG; PAM sequence: GAG
taaatgcttgatgaataaat

SEQ ID NO: 119685 - DNA, 20 bp, Artificial Sequence
  Description of Artificial Sequence: Synthetic oligonucleotide
  Target: ATXN1; (+) strand; PAM type: NRG; PAM sequence: AAG
atgaatgaatgaatgcatga

SEQ ID NO: 119686 - DNA, 20 bp, Artificial Sequence
  Description of Artificial Sequence: Synthetic oligonucleotide
  Target: ATXN1; (+) strand; PAM type: NRG; PAM sequence: GAG
gaatgaatgcatgaaagaat

SEQ ID NO: 119687 - DNA, 20 bp, Artificial Sequence
  Description of Artificial Sequence: Synthetic oligonucleotide
  Target: ATXN1; (+) strand; PAM type: NRG; PAM sequence: GAG
gaatgcatgaaagaatgagt

SEQ ID NO: 119688 - DNA, 20 bp, Artificial Sequence
  Description of Artificial Sequence: Synthetic oligonucleotide
  Target: ATXN1; (+) strand; PAM type: NRG; PAM sequence: TAG
tgcatgaaagaatgagtgag

SEQ ID NO: 119689 - DNA, 20 bp, Artificial Sequence
  Description of Artificial Sequence: Synthetic oligonucleotide
  Target: ATXN1; (+) strand; PAM type: NRG; PAM sequence: AAG
atgagtgagtagcttattga

SEQ ID NO: 119690 - DNA, 20 bp, Artificial Sequence
  Description of Artificial Sequence: Synthetic oligonucleotide
  Target: ATXN1; (+) strand; PAM type: NRG; PAM sequence: TAG
agttgtctgtgacattctat

SEQ ID NO: 119691 - DNA, 20 bp, Artificial Sequence
  Description of Artificial Sequence: Synthetic oligonucleotide
  Target: ATXN1; (+) strand; PAM type: NRG; PAM sequence: AGG
gttgtctgtgacattctatt

SEQ ID NO: 119692 - DNA, 20 bp, Artificial Sequence
  Description of Artificial Sequence: Synthetic oligonucleotide
  Target: ATXN1; (+) strand; PAM type: NRG; PAM sequence: GGG
ttgtctgtgacattctatta

SEQ ID NO: 119693 - DNA, 20 bp, Artificial Sequence
  Description of Artificial Sequence: Synthetic oligonucleotide
  Target: ATXN1; (+) strand; PAM type: NRG; PAM sequence: CAG
attagggcctgaaaaaccaa

SEQ ID NO: 119694 - DNA, 20 bp, Artificial Sequence
  Description of Artificial Sequence: Synthetic oligonucleotide
  Target: ATXN1; (+) strand; PAM type: NRG; PAM sequence: AAG
aaaaccaacagcaattatac

SEQ ID NO: 119695 - DNA, 20 bp, Artificial Sequence
  Description of Artificial Sequence: Synthetic oligonucleotide
  Target: ATXN1; (+) strand; PAM type: NRG; PAM sequence: GAG
aaccaacagcaattatacaa

SEQ ID NO: 119696 - DNA, 20 bp, Artificial Sequence
  Description of Artificial Sequence: Synthetic oligonucleotide
  Target: ATXN1; (+) strand; PAM type: NRG; PAM sequence: AAG
tatacaagagtcttgccctt

SEQ ID NO: 119697 - DNA, 20 bp, Artificial Sequence
  Description of Artificial Sequence: Synthetic oligonucleotide
  Target: ATXN1; (+) strand; PAM type: NRG; PAM sequence: AAG
acaagagtcttgcccttaag

SEQ ID NO: 119698 - DNA, 20 bp, Artificial Sequence
  Description of Artificial Sequence: Synthetic oligonucleotide
  Target: ATXN1; (+) strand; PAM type: NRG; PAM sequence: CAG
ttaagaagcttctattctat

SEQ ID NO: 119699 - DNA, 20 bp, Artificial Sequence
  Description of Artificial Sequence: Synthetic oligonucleotide
  Target: ATXN1; (+) strand; PAM type: NRG; PAM sequence: AGG
taagaagcttctattctatc

SEQ ID NO: 119700 - DNA, 20 bp, Artificial Sequence
  Description of Artificial Sequence: Synthetic oligonucleotide
  Target: ATXN1; (+) strand; PAM type: NRG; PAM sequence: GAG
agaagcttctattctatcag

SEQ ID NO: 119701 - DNA, 20 bp, Artificial Sequence
  Description of Artificial Sequence: Synthetic oligonucleotide
  Target: ATXN1; (+) strand; PAM type: NRG; PAM sequence: AAG
agcttctattctatcaggag

SEQ ID NO: 119702 - DNA, 20 bp, Artificial Sequence
  Description of Artificial Sequence: Synthetic oligonucleotide
  Target: ATXN1; (+) strand; PAM type: NRG; PAM sequence: AAG
ggagaagcaaaaatataaat

SEQ ID NO: 119703 - DNA, 20 bp, Artificial Sequence
  Description of Artificial Sequence: Synthetic oligonucleotide
  Target: ATXN1; (+) strand; PAM type: NRG; PAM sequence: CAG
aaatataaataagtttaata

SEQ ID NO: 119704 - DNA, 20 bp, Artificial Sequence
  Description of Artificial Sequence: Synthetic oligonucleotide
  Target: ATXN1; (+) strand; PAM type: NRG; PAM sequence: CAG
ttaatacagtgtgatacttg

SEQ ID NO: 119705 - DNA, 20 bp, Artificial Sequence
  Description of Artificial Sequence: Synthetic oligonucleotide
  Target: ATXN1; (+) strand; PAM type: NRG; PAM sequence: AAG
gatacttgcagtaataatgc

SEQ ID NO: 119706 - DNA, 20 bp, Artificial Sequence
  Description of Artificial Sequence: Synthetic oligonucleotide
  Target: ATXN1; (+) strand; PAM type: NRG; PAM sequence: CAG
gtaataatgcaagaccttat

SEQ ID NO: 119707 - DNA, 20 bp, Artificial Sequence
  Description of Artificial Sequence: Synthetic oligonucleotide
  Target: ATXN1; (+) strand; PAM type: NRG; PAM sequence: AGG
taataatgcaagaccttatc

SEQ ID NO: 119708 - DNA, 20 bp, Artificial Sequence
  Description of Artificial Sequence: Synthetic oligonucleotide
  Target: ATXN1; (+) strand; PAM type: NRG; PAM sequence: GGG
aataatgcaagaccttatca

SEQ ID NO: 119709 - DNA, 20 bp, Artificial Sequence
  Description of Artificial Sequence: Synthetic oligonucleotide
  Target: ATXN1; (+) strand; PAM type: NRG; PAM sequence: GAG
taatgcaagaccttatcagg

SEQ ID NO: 119710 - DNA, 20 bp, Artificial Sequence
  Description of Artificial Sequence: Synthetic oligonucleotide
  Target: ATXN1; (+) strand; PAM type: NRG; PAM sequence: TAG
agaccttatcagggagcaat

SEQ ID NO: 119711 - DNA, 20 bp, Artificial Sequence
  Description of Artificial Sequence: Synthetic oligonucleotide
  Target: ATXN1; (+) strand; PAM type: NRG; PAM sequence: AAG
ttatcagggagcaattagtg

SEQ ID NO: 119712 - DNA, 20 bp, Artificial Sequence
  Description of Artificial Sequence: Synthetic oligonucleotide
  Target: ATXN1; (+) strand; PAM type: NRG; PAM sequence: TAG
gggagcaattagtgaagaac

SEQ ID NO: 119713 - DNA, 20 bp, Artificial Sequence
  Description of Artificial Sequence: Synthetic oligonucleotide
  Target: ATXN1; (+) strand; PAM type: NRG; PAM sequence: AGG
ggagcaattagtgaagaact

SEQ ID NO: 119714 - DNA, 20 bp, Artificial Sequence
  Description of Artificial Sequence: Synthetic oligonucleotide
  Target: ATXN1; (+) strand; PAM type: NRG; PAM sequence: AAG
caattagtgaagaactaggc

SEQ ID NO: 119715 - DNA, 20 bp, Artificial Sequence
  Description of Artificial Sequence: Synthetic oligonucleotide
  Target: ATXN1; (+) strand; PAM type: NRG; PAM sequence: AGG
aattagtgaagaactaggca

SEQ ID NO: 119716 - DNA, 20 bp, Artificial Sequence
  Description of Artificial Sequence: Synthetic oligonucleotide
  Target: ATXN1; (+) strand; PAM type: NRG; PAM sequence: GGG
attagtgaagaactaggcaa

SEQ ID NO: 119717 - DNA, 20 bp, Artificial Sequence
  Description of Artificial Sequence: Synthetic oligonucleotide
  Target: ATXN1; (+) strand; PAM type: NRG; PAM sequence: GGG
ttagtgaagaactaggcaag

SEQ ID NO: 119718 - DNA, 20 bp, Artificial Sequence
  Description of Artificial Sequence: Synthetic oligonucleotide
  Target: ATXN1; (+) strand; PAM type: NRG; PAM sequence: AAG
aagaactaggcaaggggtta

SEQ ID NO: 119719 - DNA, 20 bp, Artificial Sequence
  Description of Artificial Sequence: Synthetic oligonucleotide
  Target: ATXN1; (+) strand; PAM type: NRG; PAM sequence: AAG
actaggcaaggggttaaaga

SEQ ID NO: 119720 - DNA, 20 bp, Artificial Sequence
  Description of Artificial Sequence: Synthetic oligonucleotide
  Target: ATXN1; (+) strand; PAM type: NRG; PAM sequence: AAG
aggggttaaagaaagcttct

SEQ ID NO: 119721 - DNA, 20 bp, Artificial Sequence
  Description of Artificial Sequence: Synthetic oligonucleotide
  Target: ATXN1; (+) strand; PAM type: NRG; PAM sequence: TAG
gttaaagaaagcttctaaga

SEQ ID NO: 119722 - DNA, 20 bp, Artificial Sequence
  Description of Artificial Sequence: Synthetic oligonucleotide
  Target: ATXN1; (+) strand; PAM type: NRG; PAM sequence: AGG
ttaaagaaagcttctaagat

SEQ ID NO: 119723 - DNA, 20 bp, Artificial Sequence
  Description of Artificial Sequence: Synthetic oligonucleotide
  Target: ATXN1; (+) strand; PAM type: NRG; PAM sequence: AAG
taattaaacaaattcacacc

SEQ ID NO: 119724 - DNA, 20 bp, Artificial Sequence
  Description of Artificial Sequence: Synthetic oligonucleotide
  Target: ATXN1; (+) strand; PAM type: NRG; PAM sequence: AGG
aattaaacaaattcacacca

SEQ ID NO: 119725 - DNA, 20 bp, Artificial Sequence
  Description of Artificial Sequence: Synthetic oligonucleotide
  Target: ATXN1; (+) strand; PAM type: NRG; PAM sequence: TGG
aggtgctaatatcttatctg

SEQ ID NO: 119726 - DNA, 20 bp, Artificial Sequence
  Description of Artificial Sequence: Synthetic oligonucleotide
  Target: ATXN1; (+) strand; PAM type: NRG; PAM sequence: CAG
cttatctgtggcctctgccc

SEQ ID NO: 119727 - DNA, 20 bp, Artificial Sequence
  Description of Artificial Sequence: Synthetic oligonucleotide
  Target: ATXN1; (+) strand; PAM type: NRG; PAM sequence: AGG
ttatctgtggcctctgcccc

SEQ ID NO: 119728 - DNA, 20 bp, Artificial Sequence
  Description of Artificial Sequence: Synthetic oligonucleotide
  Target: ATXN1; (+) strand; PAM type: NRG; PAM sequence: TAG
caggatcatttgcattttaa

SEQ ID NO: 119729 - DNA, 20 bp, Artificial Sequence
  Description of Artificial Sequence: Synthetic oligonucleotide
  Target: ATXN1; (+) strand; PAM type: NRG; PAM sequence: TAG
tttgcattttaatagaaaac

SEQ ID NO: 119730 - DNA, 20 bp, Artificial Sequence
  Description of Artificial Sequence: Synthetic oligonucleotide
  Target: ATXN1; (+) strand; PAM type: NRG; PAM sequence: TGG
tttaatagaaaactagctga

SEQ ID NO: 119731 - DNA, 20 bp, Artificial Sequence
  Description of Artificial Sequence: Synthetic oligonucleotide
  Target: ATXN1; (+) strand; PAM type: NRG; PAM sequence: GAG
gatggctttgcttgatactt

SEQ ID NO: 119732 - DNA, 20 bp, Artificial Sequence
  Description of Artificial Sequence: Synthetic oligonucleotide
  Target: ATXN1; (+) strand; PAM type: NRG; PAM sequence: AGG
atggctttgcttgatacttg

SEQ ID NO: 119733 - DNA, 20 bp, Artificial Sequence
  Description of Artificial Sequence: Synthetic oligonucleotide
  Target: ATXN1; (+) strand; PAM type: NRG; PAM sequence: TAG
cttgaggactgaactactat

SEQ ID NO: 119734 - DNA, 20 bp, Artificial Sequence
  Description of Artificial Sequence: Synthetic oligonucleotide
  Target: ATXN1; (+) strand; PAM type: NRG; PAM sequence: TAG
gaggactgaactactattag

SEQ ID NO: 119735 - DNA, 20 bp, Artificial Sequence
  Description of Artificial Sequence: Synthetic oligonucleotide
  Target: ATXN1; (+) strand; PAM type: NRG; PAM sequence: CAG
aactactattagtagcattt

SEQ ID NO: 119736 - DNA, 20 bp, Artificial Sequence
  Description of Artificial Sequence: Synthetic oligonucleotide
  Target: ATXN1; (+) strand; PAM type: NRG; PAM sequence: AGG
actactattagtagcatttc

SEQ ID NO: 119737 - DNA, 20 bp, Artificial Sequence
  Description of Artificial Sequence: Synthetic oligonucleotide
  Target: ATXN1; (+) strand; PAM type: NRG; PAM sequence: CAG
attagtagcatttcaggcct

SEQ ID NO: 119738 - DNA, 20 bp, Artificial Sequence
  Description of Artificial Sequence: Synthetic oligonucleotide
  Target: ATXN1; (+) strand; PAM type: NRG; PAM sequence: AGG
ttagtagcatttcaggcctc

SEQ ID NO: 119739 - DNA, 20 bp, Artificial Sequence
  Description of Artificial Sequence: Synthetic oligonucleotide
  Target: ATXN1; (+) strand; PAM type: NRG; PAM sequence: AAG
tagcatttcaggcctcagga

SEQ ID NO: 119740 - DNA, 20 bp, Artificial Sequence
  Description of Artificial Sequence: Synthetic oligonucleotide
  Target: ATXN1; (+) strand; PAM type: NRG; PAM sequence: GAG
gcatttcaggcctcaggaaa

SEQ ID NO: 119741 - DNA, 20 bp, Artificial Sequence
  Description of Artificial Sequence: Synthetic oligonucleotide
  Target: ATXN1; (+) strand; PAM type: NRG; PAM sequence: AGG
catttcaggcctcaggaaag

SEQ ID NO: 119742 - DNA, 20 bp, Artificial Sequence
  Description of Artificial Sequence: Synthetic oligonucleotide
  Target: ATXN1; (+) strand; PAM type: NRG; PAM sequence: CAG
tcaggcctcaggaaagaggt

SEQ ID NO: 119743 - DNA, 20 bp, Artificial Sequence
  Description of Artificial Sequence: Synthetic oligonucleotide
  Target: ATXN1; (+) strand; PAM type: NRG; PAM sequence: CAG
ggcctcaggaaagaggtcag

SEQ ID NO: 119744 - DNA, 20 bp, Artificial Sequence
  Description of Artificial Sequence: Synthetic oligonucleotide
  Target: ATXN1; (+) strand; PAM type: NRG; PAM sequence: AAG
tcaggaaagaggtcagcaga

SEQ ID NO: 119745 - DNA, 20 bp, Artificial Sequence
  Description of Artificial Sequence: Synthetic oligonucleotide
  Target: ATXN1; (+) strand; PAM type: NRG; PAM sequence: AGG
caggaaagaggtcagcagaa

SEQ ID NO: 119746 - DNA, 20 bp, Artificial Sequence
  Description of Artificial Sequence: Synthetic oligonucleotide
  Target: ATXN1; (+) strand; PAM type: NRG; PAM sequence: TAG
gatgcttcaaataacactac

SEQ ID NO: 119747 - DNA, 20 bp, Artificial Sequence
  Description of Artificial Sequence: Synthetic oligonucleotide
  Target: ATXN1; (+) strand; PAM type: NRG; PAM sequence: AGG
atgcttcaaataacactact

SEQ ID NO: 119748 - DNA, 20 bp, Artificial Sequence
  Description of Artificial Sequence: Synthetic oligonucleotide
  Target: ATXN1; (+) strand; PAM type: NRG; PAM sequence: CAG
cttcaaataacactactagg

SEQ ID NO: 119749 - DNA, 20 bp, Artificial Sequence
  Description of Artificial Sequence: Synthetic oligonucleotide
  Target: ATXN1; (+) strand; PAM type: NRG; PAM sequence: AAG
aaataacactactaggcaga

SEQ ID NO: 119750 - DNA, 20 bp, Artificial Sequence
  Description of Artificial Sequence: Synthetic oligonucleotide
  Target: ATXN1; (+) strand; PAM type: NRG; PAM sequence: CAG
ctaggcagaaagtctaccta

SEQ ID NO: 119751 - DNA, 20 bp, Artificial Sequence
  Description of Artificial Sequence: Synthetic oligonucleotide
  Target: ATXN1; (+) strand; PAM type: NRG; PAM sequence: AAG
ctacagttctatcatgaaaa

SEQ ID NO: 119752 - DNA, 20 bp, Artificial Sequence
  Description of Artificial Sequence: Synthetic oligonucleotide
  Target: ATXN1; (+) strand; PAM type: NRG; PAM sequence: AGG
tacagttctatcatgaaaaa

SEQ ID NO: 119753 - DNA, 20 bp, Artificial Sequence
  Description of Artificial Sequence: Synthetic oligonucleotide
  Target: ATXN1; (+) strand; PAM type: NRG; PAM sequence: AAG
ctatcatgaaaaaaggttca

SEQ ID NO: 119754 - DNA, 20 bp, Artificial Sequence
  Description of Artificial Sequence: Synthetic oligonucleotide
  Target: ATXN1; (+) strand; PAM type: NRG; PAM sequence: TGG
tcatgaaaaaaggttcaaag

SEQ ID NO: 119755 - DNA, 20 bp, Artificial Sequence
  Description of Artificial Sequence: Synthetic oligonucleotide
  Target: ATXN1; (+) strand; PAM type: NRG; PAM sequence: GGG
catgaaaaaaggttcaaagt

SEQ ID NO: 119756 - DNA, 20 bp, Artificial Sequence
  Description of Artificial Sequence: Synthetic oligonucleotide
  Target: ATXN1; (+) strand; PAM type: NRG; PAM sequence: TAG
gaaaaaaggttcaaagtggg

SEQ ID NO: 119757 - DNA, 20 bp, Artificial Sequence
  Description of Artificial Sequence: Synthetic oligonucleotide
  Target: ATXN1; (+) strand; PAM type: NRG; PAM sequence: AAG
ggttcaaagtgggtagatgc

SEQ ID NO: 119758 - DNA, 20 bp, Artificial Sequence
  Description of Artificial Sequence: Synthetic oligonucleotide
  Target: ATXN1; (+) strand; PAM type: NRG; PAM sequence: AGG
gttcaaagtgggtagatgca

SEQ ID NO: 119759 - DNA, 20 bp, Artificial Sequence
  Description of Artificial Sequence: Synthetic oligonucleotide
  Target: ATXN1; (+) strand; PAM type: NRG; PAM sequence: AAG
tcaaacacttgtatctaata

SEQ ID NO: 119760 - DNA, 20 bp, Artificial Sequence
  Description of Artificial Sequence: Synthetic oligonucleotide
  Target: ATXN1; (+) strand; PAM type: NRG; PAM sequence: AAG
tgtatctaataaagacgtga

SEQ ID NO: 119761 - DNA, 20 bp, Artificial Sequence
  Description of Artificial Sequence: Synthetic oligonucleotide
  Target: ATXN1; (+) strand; PAM type: NRG; PAM sequence: GAG
tatctaataaagacgtgaaa

SEQ ID NO: 119762 - DNA, 20 bp, Artificial Sequence
  Description of Artificial Sequence: Synthetic oligonucleotide
  Target: ATXN1; (+) strand; PAM type: NRG; PAM sequence: GAG
tctaataaagacgtgaaaga

SEQ ID NO: 119763 - DNA, 20 bp, Artificial Sequence
  Description of Artificial Sequence: Synthetic oligonucleotide
  Target: ATXN1; (+) strand; PAM type: NRG; PAM sequence: TGG
ataaagacgtgaaagagagt

SEQ ID NO: 119764 - DNA, 20 bp, Artificial Sequence
  Description of Artificial Sequence: Synthetic oligonucleotide
  Target: ATXN1; (+) strand; PAM type: NRG; PAM sequence: AAG
gacgtgaaagagagttggtg

SEQ ID NO: 119765 - DNA, 20 bp, Artificial Sequence
  Description of Artificial Sequence: Synthetic oligonucleotide
  Target: ATXN1; (+) strand; PAM type: NRG; PAM sequence: TGG
gaaagagagttggtgaagac

SEQ ID NO: 119766 - DNA, 20 bp, Artificial Sequence
  Description of Artificial Sequence: Synthetic oligonucleotide
  Target: ATXN1; (+) strand; PAM type: NRG; PAM sequence: GGG
aaagagagttggtgaagact

SEQ ID NO: 119767 - DNA, 20 bp, Artificial Sequence
  Description of Artificial Sequence: Synthetic oligonucleotide
  Target: ATXN1; (+) strand; PAM type: NRG; PAM sequence: CGG
gagttggtgaagactgggtg

SEQ ID NO: 119768 - DNA, 20 bp, Artificial Sequence
  Description of Artificial Sequence: Synthetic oligonucleotide
  Target: ATXN1; (+) strand; PAM type: NRG; PAM sequence: TGG
ttggtgaagactgggtgcgg

SEQ ID NO: 119769 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgtaatcc

SEQ ID NO: 119770 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagtgctt

SEQ ID NO: 119771 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagtgcttt

SEQ ID NO: 119772 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagtgctttgg

SEQ ID NO: 119773 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagtgctttggg

SEQ ID NO: 119774 - DNA, 20 bp, Artificial Sequence
  Description of Artificial Sequence: Synthetic oligonucleotide
  Target: ATXN1; (+) strand; PAM type: NRG; PAM sequence: GAG
tcccagtgctttgggaggcc

SEQ ID NO: 119775 - DNA, 20 bp, Artificial Sequence
  Description of Artificial Sequence: Synthetic oligonucleotide
  Target: ATXN1; (+) strand; PAM type: NRG; PAM sequence: AGG
cccagtgctttgggaggccg

SEQ ID NO: 119776 - DNA, 20 bp, Artificial Sequence
  Description of Artificial Sequence: Synthetic oligonucleotide
  Target: ATXN1; (+) strand; PAM type: NRG; PAM sequence: CAG
agtgctttgggaggccgagg

SEQ ID NO: 119777 - DNA, 20 bp, Artificial Sequence
  Description of Artificial Sequence: Synthetic oligonucleotide
  Target: ATXN1; (+) strand; PAM type: NRG; PAM sequence: AGG
gtgctttgggaggccgaggc

SEQ ID NO: 119778 - DNA, 20 bp, Artificial Sequence
  Description of Artificial Sequence: Synthetic oligonucleotide
  Target: ATXN1; (+) strand; PAM type: NRG; PAM sequence: CAG
ctttgggaggccgaggcagg

SEQ ID NO: 119779 - DNA, 20 bp, Artificial Sequence
  Description of Artificial Sequence: Synthetic oligonucleotide
  Target: ATXN1; (+) strand; PAM type: NRG; PAM sequence: GAG
ccgaggcaggcagatcacct

SEQ ID NO: 119780 - DNA, 20 bp, Artificial Sequence
  Description of Artificial Sequence: Synthetic oligonucleotide
  Target: ATXN1; (+) strand; PAM type: NRG; PAM sequence: AGG
cgaggcaggcagatcacctg

SEQ ID NO: 119781 - DNA, 20 bp, Artificial Sequence
  Description of Artificial Sequence: Synthetic oligonucleotide
  Target: ATXN1; (+) strand; PAM type: NRG; PAM sequence: CAG
gcaggcagatcacctgaggt

SEQ ID NO: 119782 - DNA, 20 bp, Artificial Sequence
  Description of Artificial Sequence: Synthetic oligonucleotide
  Target: ATXN1; (+) strand; PAM type: NRG; PAM sequence: AGG
caggcagatcacctgaggtc

SEQ ID NO: 119783 - DNA, 20 bp, Artificial Sequence
  Description of Artificial Sequence: Synthetic oligonucleotide
  Target: ATXN1; (+) strand; PAM type: NRG; PAM sequence: GAG
tcacctgaggtcaggaattt

SEQ ID NO: 119784 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggaatttgagac

SEQ ID NO: 119785 - DNA, 20 bp, Artificial Sequence
  Description of Artificial Sequence: Synthetic oligonucleotide
  Target: ATXN1; (+) strand; PAM type: NRG; PAM sequence: TGG
tgagaccagcctgaccaaca

SEQ ID NO: 119786 - DNA, 20 bp, Artificial Sequence
  Description of Artificial Sequence: Synthetic oligonucleotide
  Target: ATXN1; (+) strand; PAM type: NRG; PAM sequence: TAG
ccctactaaaaatacaaaat

SEQ ID NO: 119787 - DNA, 20 bp, Artificial Sequence
  Description of Artificial Sequence: Synthetic oligonucleotide
  Target: ATXN1; (+) strand; PAM type: NRG; PAM sequence: TGG
ctaaaaatacaaaattagcc

SEQ ID NO: 119788 - DNA, 20 bp, Artificial Sequence
  Description of Artificial Sequence: Synthetic oligonucleotide
  Target: ATXN1; (+) strand; PAM type: NRG; PAM sequence: TGG
aatacaaaattagcctggtg

SEQ ID NO: 119789 - DNA, 20 bp, Artificial Sequence
  Description of Artificial Sequence: Synthetic oligonucleotide
  Target: ATXN1; (+) strand; PAM type: NRG; PAM sequence: TGG
acaaaattagcctggtgtgg

SEQ ID NO: 119790 - DNA, 20 bp, Artificial Sequence
  Description of Artificial Sequence: Synthetic oligonucleotide
  Target: ATXN1; (+) strand; PAM type: NRG; PAM sequence: CGG
aaattagcctggtgtggtgg

SEQ ID NO: 119791 - DNA, 20 bp, Artificial Sequence
  Description of Artificial Sequence: Synthetic oligonucleotide
  Target: ATXN1; (+) strand; PAM type: NRG; PAM sequence: GGG
aattagcctggtgtggtggc

SEQ ID NO: 119792 - DNA, 20 bp, Artificial Sequence
  Description of Artificial Sequence: Synthetic oligonucleotide
  Target: ATXN1; (+) strand; PAM type: NRG; PAM sequence: CAG
gtggcgggcacctgtaatcc

SEQ ID NO: 119793 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatcccagctact

SEQ ID NO: 119794 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccagctactt

SEQ ID NO: 119795 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctacttgg

SEQ ID NO: 119796 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctacttggg

SEQ ID NO: 119797 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttgggaggct

SEQ ID NO: 119798 - DNA, 20 bp, Artificial Sequence
  Description of Artificial Sequence: Synthetic oligonucleotide
  Target: ATXN1; (+) strand; PAM type: NRG; PAM sequence: AGG
cccagctacttgggaggctg

SEQ ID NO: 119799 - DNA, 20 bp, Artificial Sequence
  Description of Artificial Sequence: Synthetic oligonucleotide
  Target: ATXN1; (+) strand; PAM type: NRG; PAM sequence: CAG
tacttgggaggctgaggcaa

SEQ ID NO: 119800 - DNA, 20 bp, Artificial Sequence
  Description of Artificial Sequence: Synthetic oligonucleotide
  Target: ATXN1; (+) strand; PAM type: NRG; PAM sequence: TGG
gcaacagaattgcttgaacc

SEQ ID NO: 119801 - DNA, 20 bp, Artificial Sequence
  Description of Artificial Sequence: Synthetic oligonucleotide
  Target: ATXN1; (+) strand; PAM type: NRG; PAM sequence: GGG
caacagaattgcttgaacct

SEQ ID NO: 119802 - DNA, 20 bp, Artificial Sequence
  Description of Artificial Sequence: Synthetic oligonucleotide
  Target: ATXN1; (+) strand; PAM type: NRG; PAM sequence: GAG
acagaattgcttgaacctgg

SEQ ID NO: 119803 - DNA, 20 bp, Artificial Sequence
  Description of Artificial Sequence: Synthetic oligonucleotide
  Target: ATXN1; (+) strand; PAM type: NRG; PAM sequence: AGG
cagaattgcttgaacctggg

SEQ ID NO: 119804 - DNA, 20 bp, Artificial Sequence
  Description of Artificial Sequence: Synthetic oligonucleotide
  Target: ATXN1; (+) strand; PAM type: NRG; PAM sequence: CAG
aattgcttgaacctgggagg

SEQ ID NO: 119805 - DNA, 20 bp, Artificial Sequence
  Description of Artificial Sequence: Synthetic oligonucleotide
  Target: ATXN1; (+) strand; PAM type: NRG; PAM sequence: GAG
ttgcttgaacctgggaggca

SEQ ID NO: 119806 - DNA, 20 bp, Artificial Sequence
  Description of Artificial Sequence: Synthetic oligonucleotide
  Target: ATXN1; (+) strand; PAM type: NRG; PAM sequence: AGG
tgcttgaacctgggaggcag

SEQ ID NO: 119807 - DNA, 20 bp, Artificial Sequence
  Description of Artificial Sequence: Synthetic oligonucleotide
  Target: ATXN1; (+) strand; PAM type: NRG; PAM sequence: GAG
acctgggaggcagaggtttt

SEQ ID NO: 119808 - DNA, 20 bp, Artificial Sequence
  Description of Artificial Sequence: Synthetic oligonucleotide
  Target: ATXN1; (+) strand; PAM type: NRG; PAM sequence: GAG
ggaggcagaggttttgagcc

SEQ ID NO: 119809 - DNA, 20 bp, Artificial Sequence
  Description of Artificial Sequence: Synthetic oligonucleotide
  Target: ATXN1; (+) strand; PAM type: NRG; PAM sequence: CAG
gagatcacaccactgcactc

SEQ ID NO: 119810 - DNA, 20 bp, Artificial Sequence
  Description of Artificial Sequence: Synthetic oligonucleotide
  Target: ATXN1; (+) strand; PAM type: NRG; PAM sequence: TGG
cacaccactgcactccagcc

SEQ ID NO: 119811 - DNA, 20 bp, Artificial Sequence
  Description of Artificial Sequence: Synthetic oligonucleotide
  Target: ATXN1; (+) strand; PAM type: NRG; PAM sequence: GGG
acaccactgcactccagcct

SEQ ID NO: 119812 - DNA, 20 bp, Artificial Sequence
  Description of Artificial Sequence: Synthetic oligonucleotide
  Target: ATXN1; (+) strand; PAM type: NRG; PAM sequence: AAG
tgcactccagcctgggcaac

SEQ ID NO: 119813 - DNA, 20 bp, Artificial Sequence
  Description of Artificial Sequence: Synthetic oligonucleotide
  Target: ATXN1; (+) strand; PAM type: NRG; PAM sequence: GAG
cactccagcctgggcaacaa

SEQ ID NO: 119814 - DNA, 20 bp, Artificial Sequence
  Description of Artificial Sequence: Synthetic oligonucleotide
  Target: ATXN1; (+) strand; PAM type: NRG; PAM sequence: AAG
tctgtctcaaaaaaaaaaaa

SEQ ID NO: 119815 - DNA, 20 bp, Artificial Sequence
  Description of Artificial Sequence: Synthetic oligonucleotide
  Target: ATXN1; (+) strand; PAM type: NRG; PAM sequence: AAG
tcaaaaaaaaaaaaaagaaa

SEQ ID NO: 119816 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaaaaagaaaaa

SEQ ID NO: 119817 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaaagaaaaaga

SEQ ID NO: 119818 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaagaaaaagaga

SEQ ID NO: 119819 - DNA, 20 bp, Artificial Sequence
  Description of Artificial Sequence: Synthetic oligonucleotide
  Target: ATXN1; (+) strand; PAM type: NRG; PAM sequence: TGG
aaaaagagagagttgatgaa

SEQ ID NO: 119820 - DNA, 20 bp, Artificial Sequence
  Description of Artificial Sequence: Synthetic oligonucleotide
  Target: ATXN1; (+) strand; PAM type: NRG; PAM sequence: AAG
agagttgatgaatggtttca

SEQ ID NO: 119821 - DNA, 20 bp, Artificial Sequence
  Description of Artificial Sequence: Synthetic oligonucleotide
  Target: ATXN1; (+) strand; PAM type: NRG; PAM sequence: GAG
agttgatgaatggtttcaaa

SEQ ID NO: 119822 - DNA, 20 bp, Artificial Sequence
  Description of Artificial Sequence: Synthetic oligonucleotide
  Target: ATXN1; (+) strand; PAM type: NRG; PAM sequence: AAG
aatggtttcaaagagtttca

SEQ ID NO: 119823 - DNA, 20 bp, Artificial Sequence
  Description of Artificial Sequence: Synthetic oligonucleotide
  Target: ATXN1; (+) strand; PAM type: NRG; PAM sequence: GAG
tggtttcaaagagtttcaaa

SEQ ID NO: 119824 - DNA, 20 bp, Artificial Sequence
  Description of Artificial Sequence: Synthetic oligonucleotide
  Target: ATXN1; (+) strand; PAM type: NRG; PAM sequence: TAG
tatttgcacactcatatcca

SEQ ID NO: 119825 - DNA, 20 bp, Artificial Sequence
  Description of Artificial Sequence: Synthetic oligonucleotide
  Target: ATXN1; (+) strand; PAM type: NRG; PAM sequence: CAG
ttgcacactcatatccatag

SEQ ID NO: 119826 - DNA, 20 bp, Artificial Sequence
  Description of Artificial Sequence: Synthetic oligonucleotide
  Target: ATXN1; (+) strand; PAM type: NRG; PAM sequence: AAG
gcattattaacaataaacta

SEQ ID NO: 119827 - DNA, 20 bp, Artificial Sequence
  Description of Artificial Sequence: Synthetic oligonucleotide
  Target: ATXN1; (+) strand; PAM type: NRG; PAM sequence: AGG
cattattaacaataaactaa

SEQ ID NO: 119828 - DNA, 20 bp, Artificial Sequence
  Description of Artificial Sequence: Synthetic oligonucleotide
  Target: ATXN1; (+) strand; PAM type: NRG; PAM sequence: TGG
tattaacaataaactaaagg

SEQ ID NO: 119829 - DNA, 20 bp, Artificial Sequence
  Description of Artificial Sequence: Synthetic oligonucleotide
  Target: ATXN1; (+) strand; PAM type: NRG; PAM sequence: AAG
taacaataaactaaaggtgg

SEQ ID NO: 119830 - DNA, 20 bp, Artificial Sequence
  Description of Artificial Sequence: Synthetic oligonucleotide
  Target: ATXN1; (+) strand; PAM type: NRG; PAM sequence: AAG
actaaaggtggaagcaaccc

SEQ ID NO: 119831 - DNA, 20 bp, Artificial Sequence
  Description of Artificial Sequence: Synthetic oligonucleotide
  Target: ATXN1; (+) strand; PAM type: NRG; PAM sequence: TAG
gcaacccaagtgcccactga

SEQ ID NO: 119832 - DNA, 20 bp, Artificial Sequence
  Description of Artificial Sequence: Synthetic oligonucleotide
  Target: ATXN1; (+) strand; PAM type: NRG; PAM sequence: AAG
caagtgcccactgatagatg

SEQ ID NO: 119833 - DNA, 20 bp, Artificial Sequence
  Description of Artificial Sequence: Synthetic oligonucleotide
  Target: ATXN1; (+) strand; PAM type: NRG; PAM sequence: AGG
aagtgcccactgatagatga

SEQ ID NO: 119834 - DNA, 20 bp, Artificial Sequence
  Description of Artificial Sequence: Synthetic oligonucleotide
  Target: ATXN1; (+) strand; PAM type: NRG; PAM sequence: AAG
cccactgatagatgaaggat

SEQ ID NO: 119835 - DNA, 20 bp, Artificial Sequence
  Description of Artificial Sequence: Synthetic oligonucleotide
  Target: ATXN1; (+) strand; PAM type: NRG; PAM sequence: TGG
gatgaaggataagctaaatg

SEQ ID NO: 119836 - DNA, 20 bp, Artificial Sequence
  Description of Artificial Sequence: Synthetic oligonucleotide
  Target: ATXN1; (+) strand; PAM type: NRG; PAM sequence: CAG
aatgtggtctacacatacaa

SEQ ID NO: 119837 - DNA, 20 bp, Artificial Sequence
  Description of Artificial Sequence: Synthetic oligonucleotide
  Target: ATXN1; (+) strand; PAM type: NRG; PAM sequence: CAG
acatacaacagaatattatt

SEQ ID NO: 119838 - DNA, 20 bp, Artificial Sequence
  Description of Artificial Sequence: Synthetic oligonucleotide
  Target: ATXN1; (+) strand; PAM type: NRG; PAM sequence: AAG
agaatattattcagtctaaa

SEQ ID NO: 119839 - DNA, 20 bp, Artificial Sequence
  Description of Artificial Sequence: Synthetic oligonucleotide
  Target: ATXN1; (+) strand; PAM type: NRG; PAM sequence: AGG
gaatattattcagtctaaaa

SEQ ID NO: 119840 - DNA, 20 bp, Artificial Sequence
  Description of Artificial Sequence: Synthetic oligonucleotide
  Target: ATXN1; (+) strand; PAM type: NRG; PAM sequence: AAG
tattattcagtctaaaaagg

SEQ ID NO: 119841 - DNA, 20 bp, Artificial Sequence
  Description of Artificial Sequence: Synthetic oligonucleotide
  Target: ATXN1; (+) strand; PAM type: NRG; PAM sequence: AGG
attattcagtctaaaaagga

SEQ ID NO: 119842 - DNA, 20 bp, Artificial Sequence
  Description of Artificial Sequence: Synthetic oligonucleotide
  Target: ATXN1; (+) strand; PAM type: NRG; PAM sequence: TAG
aaggaaattctgacatgcta

SEQ ID NO: 119843 - DNA, 20 bp, Artificial Sequence
  Description of Artificial Sequence: Synthetic oligonucleotide
  Target: ATXN1; (+) strand; PAM type: NRG; PAM sequence: CAG
aattctgacatgctatagca

SEQ ID NO: 119844 - DNA, 20 bp, Artificial Sequence
  Description of Artificial Sequence: Synthetic oligonucleotide
  Target: ATXN1; (+) strand; PAM type: NRG; PAM sequence: CAG
ctgacatgctatagcacaga

SEQ ID NO: 119845 - DNA, 20 bp, Artificial Sequence
  Description of Artificial Sequence: Synthetic oligonucleotide
  Target: ATXN1; (+) strand; PAM type: NRG; PAM sequence: AAG
ctatagcacagacagacctg

SEQ ID NO: 119846 - DNA, 20 bp, Artificial Sequence
  Description of Artificial Sequence: Synthetic oligonucleotide
  Target: ATXN1; (+) strand; PAM type: NRG; PAM sequence: AGG
tatagcacagacagacctga

SEQ ID NO: 119847 - DNA, 20 bp, Artificial Sequence
  Description of Artificial Sequence: Synthetic oligonucleotide
  Target: ATXN1; (+) strand; PAM type: NRG; PAM sequence: CAG
gacctgaaggacattatgct

SEQ ID NO: 119848 - DNA, 20 bp, Artificial Sequence
  Description of Artificial Sequence: Synthetic oligonucleotide
  Target: ATXN1; (+) strand; PAM type: NRG; PAM sequence: GAG
gacattatgctcagtgaaat

SEQ ID NO: 119849 - DNA, 20 bp, Artificial Sequence
  Description of Artificial Sequence: Synthetic oligonucleotide
  Target: ATXN1; (+) strand; PAM type: NRG; PAM sequence: CAG
ttatgctcagtgaaatgagc

SEQ ID NO: 119850 - DNA, 20 bp, Artificial Sequence
  Description of Artificial Sequence: Synthetic oligonucleotide
  Target: ATXN1; (+) strand; PAM type: NRG; PAM sequence: AGG
tatgctcagtgaaatgagcc

SEQ ID NO: 119851 - DNA, 20 bp, Artificial Sequence
  Description of Artificial Sequence: Synthetic oligonucleotide
  Target: ATXN1; (+) strand; PAM type: NRG; PAM sequence: AAG
gtgaaatgagccaggcacaa

SEQ ID NO: 119852 - DNA, 20 bp, Artificial Sequence
  Description of Artificial Sequence: Synthetic oligonucleotide
  Target: ATXN1; (+) strand; PAM type: NRG; PAM sequence: AGG
tgaaatgagccaggcacaaa

SEQ ID NO: 119853 - DNA, 20 bp, Artificial Sequence
  Description of Artificial Sequence: Synthetic oligonucleotide
  Target: ATXN1; (+) strand; PAM type: NRG; PAM sequence: GAG
ctacatgattccacttatat

SEQ ID NO: 119854 - DNA, 20 bp, Artificial Sequence
  Description of Artificial Sequence: Synthetic oligonucleotide
  Target: ATXN1; (+) strand; PAM type: NRG; PAM sequence: CAG
ccacttatatgagccactta

SEQ ID NO: 119855 - DNA, 20 bp, Artificial Sequence
  Description of Artificial Sequence: Synthetic oligonucleotide
  Target: ATXN1; (+) strand; PAM type: NRG; PAM sequence: TAG
cttatatgagccacttacag

SEQ ID NO: 119856 - DNA, 20 bp, Artificial Sequence
  Description of Artificial Sequence: Synthetic oligonucleotide
  Target: ATXN1; (+) strand; PAM type: NRG; PAM sequence: TAG
acttacagtagtcaaaataa

SEQ ID NO: 119857 - DNA, 20 bp, Artificial Sequence
  Description of Artificial Sequence: Synthetic oligonucleotide
  Target: ATXN1; (+) strand; PAM type: NRG; PAM sequence: CAG
acagtagtcaaaataataga

SEQ ID NO: 119858 - DNA, 20 bp, Artificial Sequence
  Description of Artificial Sequence: Synthetic oligonucleotide
  Target: ATXN1; (+) strand; PAM type: NRG; PAM sequence: AAG
tagtcaaaataatagacagc

SEQ ID NO: 119859 - DNA, 20 bp, Artificial Sequence
  Description of Artificial Sequence: Synthetic oligonucleotide
  Target: ATXN1; (+) strand; PAM type: NRG; PAM sequence: TAG
tcaaaataatagacagcaag

SEQ ID NO: 119860 - DNA, 20 bp, Artificial Sequence
  Description of Artificial Sequence: Synthetic oligonucleotide
  Target: ATXN1; (+) strand; PAM type: NRG; PAM sequence: TGG
ataatagacagcaagtagaa

SEQ ID NO: 119861 - DNA, 20 bp, Artificial Sequence
  Description of Artificial Sequence: Synthetic oligonucleotide
  Target: ATXN1; (+) strand; PAM type: NRG; PAM sequence: TGG
atagacagcaagtagaatgg

SEQ ID NO: 119862 - DNA, 20 bp, Artificial Sequence
  Description of Artificial Sequence: Synthetic oligonucleotide
  Target: ATXN1; (+) strand; PAM type: NRG; PAM sequence: CGG
gcaagtagaatggtggctgc

SEQ ID NO: 119863 - DNA, 20 bp, Artificial Sequence
  Description of Artificial Sequence: Synthetic oligonucleotide
  Target: ATXN1; (+) strand; PAM type: NRG; PAM sequence: GGG
caagtagaatggtggctgcc

SEQ ID NO: 119864 - DNA, 20 bp, Artificial Sequence
  Description of Artificial Sequence: Synthetic oligonucleotide
  Target: ATXN1; (+) strand; PAM type: NRG; PAM sequence: GGG
aagtagaatggtggctgccg

SEQ ID NO: 119865 - DNA, 20 bp, Artificial Sequence
  Description of Artificial Sequence: Synthetic oligonucleotide
  Target: ATXN1; (+) strand; PAM type: NRG; PAM sequence: GGG
agtagaatggtggctgccgg

SEQ ID NO: 119866 - DNA, 20 bp, Artificial Sequence
  Description of Artificial Sequence: Synthetic oligonucleotide
  Target: ATXN1; (+) strand; PAM type: NRG; PAM sequence: TAG
gaatggtggctgccgggggc

SEQ ID NO: 119867 - DNA, 20 bp, Artificial Sequence
  Description of Artificial Sequence: Synthetic oligonucleotide
  Target: ATXN1; (+) strand; PAM type: NRG; PAM sequence: AGG
aatggtggctgccgggggct

SEQ ID NO: 119868 - DNA, 20 bp, Artificial Sequence
  Description of Artificial Sequence: Synthetic oligonucleotide
  Target: ATXN1; (+) strand; PAM type: NRG; PAM sequence: GGG
atggtggctgccgggggcta

SEQ ID NO: 119869 - DNA, 20 bp, Artificial Sequence
  Description of Artificial Sequence: Synthetic oligonucleotide
  Target: ATXN1; (+) strand; PAM type: NRG; PAM sequence: TGG
gtggctgccgggggctaggg

SEQ ID NO: 119870 - DNA, 20 bp, Artificial Sequence
  Description of Artificial Sequence: Synthetic oligonucleotide
  Target: ATXN1; (+) strand; PAM type: NRG; PAM sequence: GAG
ggctgccgggggctagggtg

SEQ ID NO: 119871 - DNA, 20 bp, Artificial Sequence
  Description of Artificial Sequence: Synthetic oligonucleotide
  Target: ATXN1; (+) strand; PAM type: NRG; PAM sequence: AGG
gctgccgggggctagggtgg

SEQ ID NO: 119872 - DNA, 20 bp, Artificial Sequence
  Description of Artificial Sequence: Synthetic oligonucleotide
  Target: ATXN1; (+) strand; PAM type: NRG; PAM sequence: GGG
ctgccgggggctagggtgga

SEQ ID NO: 119873 - DNA, 20 bp, Artificial Sequence
  Description of Artificial Sequence: Synthetic oligonucleotide
  Target: ATXN1; (+) strand; PAM type: NRG; PAM sequence: TAG
ccgggggctagggtggaggg

SEQ ID NO: 119874 - DNA, 20 bp, Artificial Sequence
  Description of Artificial Sequence: Synthetic oligonucleotide
  Target: ATXN1; (+) strand; PAM type: NRG; PAM sequence: GAG
gggggctagggtggagggta

SEQ ID NO: 119875 - DNA, 20 bp, Artificial Sequence
  Description of Artificial Sequence: Synthetic oligonucleotide
  Target: ATXN1; (+) strand; PAM type: NRG; PAM sequence: TAG
tagggtggagggtagagcat

SEQ ID NO: 119876 - DNA, 20 bp, Artificial Sequence
  Description of Artificial Sequence: Synthetic oligonucleotide
  Target: ATXN1; (+) strand; PAM type: NRG; PAM sequence: TGG
ggtagagcattagtatttta

SEQ ID NO: 119877 - DNA, 20 bp, Artificial Sequence
  Description of Artificial Sequence: Synthetic oligonucleotide
  Target: ATXN1; (+) strand; PAM type: NRG; PAM sequence: GGG
gtagagcattagtattttat

SEQ ID NO: 119878 - DNA, 20 bp, Artificial Sequence
  Description of Artificial Sequence: Synthetic oligonucleotide
  Target: ATXN1; (+) strand; PAM type: NRG; PAM sequence: TAG
gcattagtattttatgggtc

SEQ ID NO: 119879 - DNA, 20 bp, Artificial Sequence
  Description of Artificial Sequence: Synthetic oligonucleotide
  Target: ATXN1; (+) strand; PAM type: NRG; PAM sequence: CAG
gtattttatgggtctagatt

SEQ ID NO: 119880 - DNA, 20 bp, Artificial Sequence
  Description of Artificial Sequence: Synthetic oligonucleotide
  Target: ATXN1; (+) strand; PAM type: NRG; PAM sequence: CAG
gggtctagattcagttttgc

SEQ ID NO: 119881 - DNA, 20 bp, Artificial Sequence
  Description of Artificial Sequence: Synthetic oligonucleotide
  Target: ATXN1; (+) strand; PAM type: NRG; PAM sequence: AAG
attcagttttgccagaaaaa

SEQ ID NO: 119882 - DNA, 20 bp, Artificial Sequence
  Description of Artificial Sequence: Synthetic oligonucleotide
  Target: ATXN1; (+) strand; PAM type: NRG; PAM sequence: GAG
tcagttttgccagaaaaaaa

SEQ ID NO: 119883 - DNA, 20 bp, Artificial Sequence
  Description of Artificial Sequence: Synthetic oligonucleotide
  Target: ATXN1; (+) strand; PAM type: NRG; PAM sequence: AGG
cagttttgccagaaaaaaag

SEQ ID NO: 119884 - DNA, 20 bp, Artificial Sequence
  Description of Artificial Sequence: Synthetic oligonucleotide
  Target: ATXN1; (+) strand; PAM type: NRG; PAM sequence: AAG
gccagaaaaaaagaggtgtg

SEQ ID NO: 119885 - DNA, 20 bp, Artificial Sequence
  Description of Artificial Sequence: Synthetic oligonucleotide
  Target: ATXN1; (+) strand; PAM type: NRG; PAM sequence: AAG
aaaaaaagaggtgtgaagac

SEQ ID NO: 119886 - DNA, 20 bp, Artificial Sequence
  Description of Artificial Sequence: Synthetic oligonucleotide
  Target: ATXN1; (+) strand; PAM type: NRG; PAM sequence: TGG
gaggtgtgaagacaagacaa

SEQ ID NO: 119887 - DNA, 20 bp, Artificial Sequence
  Description of Artificial Sequence: Synthetic oligonucleotide
  Target: ATXN1; (+) strand; PAM type: NRG; PAM sequence: GAG
ggtgtgaagacaagacaatg

SEQ ID NO: 119888 - DNA, 20 bp, Artificial Sequence
  Description of Artificial Sequence: Synthetic oligonucleotide
  Target: ATXN1; (+) strand; PAM type: NRG; PAM sequence: TGG
tgaagacaagacaatggaga

SEQ ID NO: 119889 - DNA, 20 bp, Artificial Sequence
  Description of Artificial Sequence: Synthetic oligonucleotide
  Target: ATXN1; (+) strand; PAM type: NRG; PAM sequence: TGG
tacaactatacacttaaaaa

SEQ ID NO: 119890 - DNA, 20 bp, Artificial Sequence
  Description of Artificial Sequence: Synthetic oligonucleotide
  Target: ATXN1; (+) strand; PAM type: NRG; PAM sequence: AAG
ctatacacttaaaaatggct

SEQ ID NO: 119891 - DNA, 20 bp, Artificial Sequence
  Description of Artificial Sequence: Synthetic oligonucleotide
  Target: ATXN1; (+) strand; PAM type: NRG; PAM sequence: CAG
acacttaaaaatggctaaga

SEQ ID NO: 119892 - DNA, 20 bp, Artificial Sequence
  Description of Artificial Sequence: Synthetic oligonucleotide
  Target: ATXN1; (+) strand; PAM type: NRG; PAM sequence: TGG
tttactataataaaaaaaac

SEQ ID NO: 119893 - DNA, 20 bp, Artificial Sequence
  Description of Artificial Sequence: Synthetic oligonucleotide
  Target: ATXN1; (+) strand; PAM type: NRG; PAM sequence: TGG
aaaaaactggaaaattatgt

SEQ ID NO: 119894 - DNA, 20 bp, Artificial Sequence
  Description of Artificial Sequence: Synthetic oligonucleotide
  Target: ATXN1; (+) strand; PAM type: NRG; PAM sequence: TAG
tatgttggtgaactatacca

SEQ ID NO: 119895 - DNA, 20 bp, Artificial Sequence
  Description of Artificial Sequence: Synthetic oligonucleotide
  Target: ATXN1; (+) strand; PAM type: NRG; PAM sequence: AAG
agctttgaaacttacatgca

SEQ ID NO: 119896 - DNA, 20 bp, Artificial Sequence
  Description of Artificial Sequence: Synthetic oligonucleotide
  Target: ATXN1; (+) strand; PAM type: NRG; PAM sequence: TAG
ttatctgattattattatgt

SEQ ID NO: 119897 - DNA, 20 bp, Artificial Sequence
  Description of Artificial Sequence: Synthetic oligonucleotide
  Target: ATXN1; (+) strand; PAM type: NRG; PAM sequence: TGG
attatgttagctattttata

SEQ ID NO: 119898 - DNA, 20 bp, Artificial Sequence
  Description of Artificial Sequence: Synthetic oligonucleotide
  Target: ATXN1; (+) strand; PAM type: NRG; PAM sequence: AAG
tgttagctattttatatgga

SEQ ID NO: 119899 - DNA, 20 bp, Artificial Sequence
  Description of Artificial Sequence: Synthetic oligonucleotide
  Target: ATXN1; (+) strand; PAM type: NRG; PAM sequence: TGG
tattttatatggaaagttat

SEQ ID NO: 119900 - DNA, 20 bp, Artificial Sequence
  Description of Artificial Sequence: Synthetic oligonucleotide
  Target: ATXN1; (+) strand; PAM type: NRG; PAM sequence: CAG
ttatatggaaagttattgga

SEQ ID NO: 119901 - DNA, 20 bp, Artificial Sequence
  Description of Artificial Sequence: Synthetic oligonucleotide
  Target: ATXN1; (+) strand; PAM type: NRG; PAM sequence: AAG
tatggaaagttattggacag

SEQ ID NO: 119902 - DNA, 20 bp, Artificial Sequence
  Description of Artificial Sequence: Synthetic oligonucleotide
  Target: ATXN1; (+) strand; PAM type: NRG; PAM sequence: CAG
gaaagttattggacagaagt

SEQ ID NO: 119903 - DNA, 20 bp, Artificial Sequence
  Description of Artificial Sequence: Synthetic oligonucleotide
  Target: ATXN1; (+) strand; PAM type: NRG; PAM sequence: TGG
ttattggacagaagtcagaa

SEQ ID NO: 119904 - DNA, 20 bp, Artificial Sequence
  Description of Artificial Sequence: Synthetic oligonucleotide
  Target: ATXN1; (+) strand; PAM type: NRG; PAM sequence: GGG
tattggacagaagtcagaat

SEQ ID NO: 119905 - DNA, 20 bp, Artificial Sequence
  Description of Artificial Sequence: Synthetic oligonucleotide
  Target: ATXN1; (+) strand; PAM type: NRG; PAM sequence: TAG
tggacagaagtcagaatggg

SEQ ID NO: 119906 - DNA, 20 bp, Artificial Sequence
  Description of Artificial Sequence: Synthetic oligonucleotide
  Target: ATXN1; (+) strand; PAM type: NRG; PAM sequence: TAG
agaagtcagaatgggtagtt

SEQ ID NO: 119907 - DNA, 20 bp, Artificial Sequence
  Description of Artificial Sequence: Synthetic oligonucleotide
  Target: ATXN1; (+) strand; PAM type: NRG; PAM sequence: TAG
aatgggtagtttagactgat

SEQ ID NO: 119908 - DNA, 20 bp, Artificial Sequence
  Description of Artificial Sequence: Synthetic oligonucleotide
  Target: ATXN1; (+) strand; PAM type: NRG; PAM sequence: AGG
atgggtagtttagactgatt

SEQ ID NO: 119909 - DNA, 20 bp, Artificial Sequence
  Description of Artificial Sequence: Synthetic oligonucleotide
  Target: ATXN1; (+) strand; PAM type: NRG; PAM sequence: TAG
ggtagtttagactgattagg

SEQ ID NO: 119910 - DNA, 20 bp, Artificial Sequence
  Description of Artificial Sequence: Synthetic oligonucleotide
  Target: ATXN1; (+) strand; PAM type: NRG; PAM sequence: CAG
gtttagactgattaggtaga

SEQ ID NO: 119911 - DNA, 20 bp, Artificial Sequence
  Description of Artificial Sequence: Synthetic oligonucleotide
  Target: ATXN1; (+) strand; PAM type: NRG; PAM sequence: AAG
gtttgaaaaatgacacccaa

SEQ ID NO: 119912 - DNA, 20 bp, Artificial Sequence
  Description of Artificial Sequence: Synthetic oligonucleotide
  Target: ATXN1; (+) strand; PAM type: NRG; PAM sequence: TGG
gacacccaaaagatctcccc

SEQ ID NO: 119913 - DNA, 20 bp, Artificial Sequence
  Description of Artificial Sequence: Synthetic oligonucleotide
  Target: ATXN1; (+) strand; PAM type: NRG; PAM sequence: GGG
acacccaaaagatctcccct

SEQ ID NO: 119914 - DNA, 20 bp, Artificial Sequence
  Description of Artificial Sequence: Synthetic oligonucleotide
  Target: ATXN1; (+) strand; PAM type: NRG; PAM sequence: CAG
caaaagatctcccctgggat

SEQ ID NO: 119915 - DNA, 20 bp, Artificial Sequence
  Description of Artificial Sequence: Synthetic oligonucleotide
  Target: ATXN1; (+) strand; PAM type: NRG; PAM sequence: CAG
aaatcaccattaaaaaaatt

SEQ ID NO: 119916 - DNA, 20 bp, Artificial Sequence
  Description of Artificial Sequence: Synthetic oligonucleotide
  Target: ATXN1; (+) strand; PAM type: NRG; PAM sequence: AGG
aatcaccattaaaaaaattc

SEQ ID NO: 119917 - DNA, 20 bp, Artificial Sequence
  Description of Artificial Sequence: Synthetic oligonucleotide
  Target: ATXN1; (+) strand; PAM type: NRG; PAM sequence: CAG
tcaggccatgcttgtaattt

SEQ ID NO: 119918 - DNA, 20 bp, Artificial Sequence
  Description of Artificial Sequence: Synthetic oligonucleotide
  Target: ATXN1; (+) strand; PAM type: NRG; PAM sequence: TGG
tgcttgtaatttcagcactt

SEQ ID NO: 119919 - DNA, 20 bp, Artificial Sequence
  Description of Artificial Sequence: Synthetic oligonucleotide
  Target: ATXN1; (+) strand; PAM type: NRG; PAM sequence: GGG
gcttgtaatttcagcacttt

SEQ ID NO: 119920 - DNA, 20 bp, Artificial Sequence
  Description of Artificial Sequence: Synthetic oligonucleotide
  Target: ATXN1; (+) strand; PAM type: NRG; PAM sequence: GAG
ttgtaatttcagcactttgg

SEQ ID NO: 119921 - DNA, 20 bp, Artificial Sequence
  Description of Artificial Sequence: Synthetic oligonucleotide
  Target: ATXN1; (+) strand; PAM type: NRG; PAM sequence: AGG
tgtaatttcagcactttggg

SEQ ID NO: 119922 - DNA, 20 bp, Artificial Sequence
  Description of Artificial Sequence: Synthetic oligonucleotide
  Target: ATXN1; (+) strand; PAM type: NRG; PAM sequence: AAG
tttcagcactttgggaggtc

SEQ ID NO: 119923 - DNA, 20 bp, Artificial Sequence
  Description of Artificial Sequence: Synthetic oligonucleotide
  Target: ATXN1; (+) strand; PAM type: NRG; PAM sequence: CAG
agcactttgggaggtcaaga

SEQ ID NO: 119924 - DNA, 20 bp, Artificial Sequence
  Description of Artificial Sequence: Synthetic oligonucleotide
  Target: ATXN1; (+) strand; PAM type: NRG; PAM sequence: AGG
gcactttgggaggtcaagac

SEQ ID NO: 119925 - DNA, 20 bp, Artificial Sequence
  Description of Artificial Sequence: Synthetic oligonucleotide
  Target: ATXN1; (+) strand; PAM type: NRG; PAM sequence: GAG
actttgggaggtcaagacag

SEQ ID NO: 119926 - DNA, 20 bp, Artificial Sequence
  Description of Artificial Sequence: Synthetic oligonucleotide
  Target: ATXN1; (+) strand; PAM type: NRG; PAM sequence: AGG
ctttgggaggtcaagacagg

SEQ ID NO: 119927 - DNA, 20 bp, Artificial Sequence
  Description of Artificial Sequence: Synthetic oligonucleotide
  Target: ATXN1; (+) strand; PAM type: NRG; PAM sequence: GAG
tcaagacaggaggatcactt

SEQ ID NO: 119928 - DNA, 20 bp, Artificial Sequence
  Description of Artificial Sequence: Synthetic oligonucleotide
  Target: ATXN1; (+) strand; PAM type: NRG; PAM sequence: AGG
caagacaggaggatcacttg

SEQ ID NO: 119929 - DNA, 20 bp, Artificial Sequence
  Description of Artificial Sequence: Synthetic oligonucleotide
  Target: ATXN1; (+) strand; PAM type: NRG; PAM sequence: CAG
acaggaggatcacttgaggc

SEQ ID NO: 119930 - DNA, 20 bp, Artificial Sequence
  Description of Artificial Sequence: Synthetic oligonucleotide
  Target: ATXN1; (+) strand; PAM type: NRG; PAM sequence: AGG
caggaggatcacttgaggcc

SEQ ID NO: 119931 - DNA, 20 bp, Artificial Sequence
  Description of Artificial Sequence: Synthetic oligonucleotide
  Target: ATXN1; (+) strand; PAM type: NRG; PAM sequence: GGG
aggaggatcacttgaggcca

SEQ ID NO: 119932 - DNA, 20 bp, Artificial Sequence
  Description of Artificial Sequence: Synthetic oligonucleotide
  Target: ATXN1; (+) strand; PAM type: NRG; PAM sequence: GAG
gaggatcacttgaggccagg

SEQ ID NO: 119933 - DNA, 20 bp, Artificial Sequence
  Description of Artificial Sequence: Synthetic oligonucleotide
  Target: ATXN1; (+) strand; PAM type: NRG; PAM sequence: GAG
cacttgaggccagggagtgt

SEQ ID NO: 119934 - DNA, 20 bp, Artificial Sequence
  Description of Artificial Sequence: Synthetic oligonucleotide
  Target: ATXN1; (+) strand; PAM type: NRG; PAM sequence: CAG
gaggccagggagtgtgagtc

SEQ ID NO: 119935 - DNA, 20 bp, Artificial Sequence
  Description of Artificial Sequence: Synthetic oligonucleotide
  Target: ATXN1; (+) strand; PAM type: NRG; PAM sequence: TGG
cagggagtgtgagtccagcc

SEQ ID NO: 119936 - DNA, 20 bp, Artificial Sequence
  Description of Artificial Sequence: Synthetic oligonucleotide
  Target: ATXN1; (+) strand; PAM type: NRG; PAM sequence: GGG
agggagtgtgagtccagcct

SEQ ID NO: 119937 - DNA, 20 bp, Artificial Sequence
  Description of Artificial Sequence: Synthetic oligonucleotide
  Target: ATXN1; (+) strand; PAM type: NRG; PAM sequence: TAG
tgagtccagcctgggcaaca

SEQ ID NO: 119938 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggcaacatagt

SEQ ID NO: 119939 - DNA, 20 bp, Artificial Sequence
  Description of Artificial Sequence: Synthetic oligonucleotide
  Target: ATXN1; (+) strand; PAM type: NRG; PAM sequence: AAG
catctctataaaaaataatt

SEQ ID NO: 119940 - DNA, 20 bp, Artificial Sequence
  Description of Artificial Sequence: Synthetic oligonucleotide
  Target: ATXN1; (+) strand; PAM type: NRG; PAM sequence: GAG
tctctataaaaaataattaa

SEQ ID NO: 119941 - DNA, 20 bp, Artificial Sequence
  Description of Artificial Sequence: Synthetic oligonucleotide
  Target: ATXN1; (+) strand; PAM type: NRG; PAM sequence: TAG
aattaaatccttccaaccct

SEQ ID NO: 119942 - DNA, 20 bp, Artificial Sequence
  Description of Artificial Sequence: Synthetic oligonucleotide
  Target: ATXN1; (+) strand; PAM type: NRG; PAM sequence: TAG
tttgaaaaatgcaattatcc

SEQ ID NO: 119943 - DNA, 20 bp, Artificial Sequence
  Description of Artificial Sequence: Synthetic oligonucleotide
  Target: ATXN1; (+) strand; PAM type: NRG; PAM sequence: AAG
aaaatgcaattatcctagcc

SEQ ID NO: 119944 - DNA, 20 bp, Artificial Sequence
  Description of Artificial Sequence: Synthetic oligonucleotide
  Target: ATXN1; (+) strand; PAM type: NRG; PAM sequence: AGG
aaatgcaattatcctagcca

SEQ ID NO: 119945 - DNA, 20 bp, Artificial Sequence
  Description of Artificial Sequence: Synthetic oligonucleotide
  Target: ATXN1; (+) strand; PAM type: NRG; PAM sequence: CAG
atcctagccaaggtctctat

SEQ ID NO: 119946 - DNA, 20 bp, Artificial Sequence
  Description of Artificial Sequence: Synthetic oligonucleotide
  Target: ATXN1; (+) strand; PAM type: NRG; PAM sequence: GAG
ggtctctatcagcttaatgt

SEQ ID NO: 119947 - DNA, 20 bp, Artificial Sequence
  Description of Artificial Sequence: Synthetic oligonucleotide
  Target: ATXN1; (+) strand; PAM type: NRG; PAM sequence: AAG
cttaatgtgagtgtctcaac

SEQ ID NO: 119948 - DNA, 20 bp, Artificial Sequence
  Description of Artificial Sequence: Synthetic oligonucleotide
  Target: ATXN1; (+) strand; PAM type: NRG; PAM sequence: CAG
aacaagactgtttttctcca

SEQ ID NO: 119949 - DNA, 20 bp, Artificial Sequence
  Description of Artificial Sequence: Synthetic oligonucleotide
  Target: ATXN1; (+) strand; PAM type: NRG; PAM sequence: AGG
acaagactgtttttctccac

SEQ ID NO: 119950 - DNA, 20 bp, Artificial Sequence
  Description of Artificial Sequence: Synthetic oligonucleotide
  Target: ATXN1; (+) strand; PAM type: NRG; PAM sequence: AAG
tttttctccacaggccaacc

SEQ ID NO: 119951 - DNA, 20 bp, Artificial Sequence
  Description of Artificial Sequence: Synthetic oligonucleotide
  Target: ATXN1; (+) strand; PAM type: NRG; PAM sequence: AGG
ttttctccacaggccaacca

SEQ ID NO: 119952 - DNA, 20 bp, Artificial Sequence
  Description of Artificial Sequence: Synthetic oligonucleotide
  Target: ATXN1; (+) strand; PAM type: NRG; PAM sequence: TAG
cacaggccaaccaaggtacc

SEQ ID NO: 119953 - DNA, 20 bp, Artificial Sequence
  Description of Artificial Sequence: Synthetic oligonucleotide
  Target: ATXN1; (+) strand; PAM type: NRG; PAM sequence: GAG
caaggtacctagactgatgt

SEQ ID NO: 119954 - DNA, 20 bp, Artificial Sequence
  Description of Artificial Sequence: Synthetic oligonucleotide
  Target: ATXN1; (+) strand; PAM type: NRG; PAM sequence: AGG
aaggtacctagactgatgtg

SEQ ID NO: 119955 - DNA, 20 bp, Artificial Sequence
  Description of Artificial Sequence: Synthetic oligonucleotide
  Target: ATXN1; (+) strand; PAM type: NRG; PAM sequence: TGG
ctagactgatgtgaggcatt

SEQ ID NO: 119956 - DNA, 20 bp, Artificial Sequence
  Description of Artificial Sequence: Synthetic oligonucleotide
  Target: ATXN1; (+) strand; PAM type: NRG; PAM sequence: AAG
gactgatgtgaggcatttgg

SEQ ID NO: 119957 - DNA, 20 bp, Artificial Sequence
  Description of Artificial Sequence: Synthetic oligonucleotide
  Target: ATXN1; (+) strand; PAM type: NRG; PAM sequence: GAG
ctgatgtgaggcatttggaa

SEQ ID NO: 119958 - DNA, 20 bp, Artificial Sequence
  Description of Artificial Sequence: Synthetic oligonucleotide
  Target: ATXN1; (+) strand; PAM type: NRG; PAM sequence: AGG
tgatgtgaggcatttggaag

SEQ ID NO: 119959 - DNA, 20 bp, Artificial Sequence
  Description of Artificial Sequence: Synthetic oligonucleotide
  Target: ATXN1; (+) strand; PAM type: NRG; PAM sequence: GGG
gatgtgaggcatttggaaga

SEQ ID NO: 119960 - DNA, 20 bp, Artificial Sequence
  Description of Artificial Sequence: Synthetic oligonucleotide
  Target: ATXN1; (+) strand; PAM type: NRG; PAM sequence: GGG
atgtgaggcatttggaagag

SEQ ID NO: 119961 - DNA, 20 bp, Artificial Sequence
  Description of Artificial Sequence: Synthetic oligonucleotide
  Target: ATXN1; (+) strand; PAM type: NRG; PAM sequence: AAG
gaggcatttggaagagggga

SEQ ID NO: 119962 - DNA, 20 bp, Artificial Sequence
  Description of Artificial Sequence: Synthetic oligonucleotide
  Target: ATXN1; (+) strand; PAM type: NRG; PAM sequence: TGG
gaagaggggaaagattcgtc

SEQ ID NO: 119963 - DNA, 20 bp, Artificial Sequence
  Description of Artificial Sequence: Synthetic oligonucleotide
  Target: ATXN1; (+) strand; PAM type: NRG; PAM sequence: AAG
aggggaaagattcgtctgga

SEQ ID NO: 119964 - DNA, 20 bp, Artificial Sequence
  Description of Artificial Sequence: Synthetic oligonucleotide
  Target: ATXN1; (+) strand; PAM type: NRG; PAM sequence: AGG
ggggaaagattcgtctggaa

SEQ ID NO: 119965 - DNA, 20 bp, Artificial Sequence
  Description of Artificial Sequence: Synthetic oligonucleotide
  Target: ATXN1; (+) strand; PAM type: NRG; PAM sequence: GGG
gggaaagattcgtctggaaa

SEQ ID NO: 119966 - DNA, 20 bp, Artificial Sequence
  Description of Artificial Sequence: Synthetic oligonucleotide
  Target: ATXN1; (+) strand; PAM type: NRG; PAM sequence: CAG
agattcgtctggaaagggaa

SEQ ID NO: 119967 - DNA, 20 bp, Artificial Sequence
  Description of Artificial Sequence: Synthetic oligonucleotide
  Target: ATXN1; (+) strand; PAM type: NRG; PAM sequence: GAG
attcgtctggaaagggaaca

SEQ ID NO: 119968 - DNA, 20 bp, Artificial Sequence
  Description of Artificial Sequence: Synthetic oligonucleotide
  Target: ATXN1; (+) strand; PAM type: NRG; PAM sequence: GAG
tcgtctggaaagggaacaga

SEQ ID NO: 119969 - DNA, 20 bp, Artificial Sequence
  Description of Artificial Sequence: Synthetic oligonucleotide
  Target: ATXN1; (+) strand; PAM type: NRG; PAM sequence: CAG
gaaagggaacagagagtgac

SEQ ID NO: 119970 - DNA, 20 bp, Artificial Sequence
  Description of Artificial Sequence: Synthetic oligonucleotide
  Target: ATXN1; (+) strand; PAM type: NRG; PAM sequence: AAG
agagagtgaccagccactga

SEQ ID NO: 119971 - DNA, 20 bp, Artificial Sequence
  Description of Artificial Sequence: Synthetic oligonucleotide
  Target: ATXN1; (+) strand; PAM type: NRG; PAM sequence: AGG
gagagtgaccagccactgaa

SEQ ID NO: 119972 - DNA, 20 bp, Artificial Sequence
  Description of Artificial Sequence: Synthetic oligonucleotide
  Target: ATXN1; (+) strand; PAM type: NRG; PAM sequence: CAG
gtgaccagccactgaaagga

SEQ ID NO: 119973 - DNA, 20 bp, Artificial Sequence
  Description of Artificial Sequence: Synthetic oligonucleotide
  Target: ATXN1; (+) strand; PAM type: NRG; PAM sequence: AGG
tgaccagccactgaaaggac

SEQ ID NO: 119974 - DNA, 20 bp, Artificial Sequence
  Description of Artificial Sequence: Synthetic oligonucleotide
  Target: ATXN1; (+) strand; PAM type: NRG; PAM sequence: CAG
ccagccactgaaaggacagg

SEQ ID NO: 119975 - DNA, 20 bp, Artificial Sequence
  Description of Artificial Sequence: Synthetic oligonucleotide
  Target: ATXN1; (+) strand; PAM type: NRG; PAM sequence: AGG
cagccactgaaaggacaggc

SEQ ID NO: 119976 - DNA, 20 bp, Artificial Sequence
  Description of Artificial Sequence: Synthetic oligonucleotide
  Target: ATXN1; (+) strand; PAM type: NRG; PAM sequence: TGG
aaaggacaggcaggaaccac

SEQ ID NO: 119977 - DNA, 20 bp, Artificial Sequence
  Description of Artificial Sequence: Synthetic oligonucleotide
  Target: ATXN1; (+) strand; PAM type: NRG; PAM sequence: CAG
ctactttgaaatttccccca

SEQ ID NO: 119978 - DNA, 20 bp, Artificial Sequence
  Description of Artificial Sequence: Synthetic oligonucleotide
  Target: ATXN1; (+) strand; PAM type: NRG; PAM sequence: CAG
ttgaaatttcccccacagca

SEQ ID NO: 119979 - DNA, 20 bp, Artificial Sequence
  Description of Artificial Sequence: Synthetic oligonucleotide
  Target: ATXN1; (+) strand; PAM type: NRG; PAM sequence: AAG
cacagatgaccttttgccac

SEQ ID NO: 119980 - DNA, 20 bp, Artificial Sequence
  Description of Artificial Sequence: Synthetic oligonucleotide
  Target: ATXN1; (+) strand; PAM type: NRG; PAM sequence: AAG
tttgccacaagttttcatac

SEQ ID NO: 119981 - DNA, 20 bp, Artificial Sequence
  Description of Artificial Sequence: Synthetic oligonucleotide
  Target: ATXN1; (+) strand; PAM type: NRG; PAM sequence: AAG
ataatctccctgctatctga

SEQ ID NO: 119982 - DNA, 20 bp, Artificial Sequence
  Description of Artificial Sequence: Synthetic oligonucleotide
  Target: ATXN1; (+) strand; PAM type: NRG; PAM sequence: TGG
cctgctatctgaaagacttc

SEQ ID NO: 119983 - DNA, 20 bp, Artificial Sequence
  Description of Artificial Sequence: Synthetic oligonucleotide
  Target: ATXN1; (+) strand; PAM type: NRG; PAM sequence: AAG
cacacaattcaaaacttgaa

SEQ ID NO: 119984 - DNA, 20 bp, Artificial Sequence
  Description of Artificial Sequence: Synthetic oligonucleotide
  Target: ATXN1; (+) strand; PAM type: NRG; PAM sequence: AGG
acacaattcaaaacttgaaa

SEQ ID NO: 119985 - DNA, 20 bp, Artificial Sequence
  Description of Artificial Sequence: Synthetic oligonucleotide
  Target: ATXN1; (+) strand; PAM type: NRG; PAM sequence: GGG
cacaattcaaaacttgaaaa

SEQ ID NO: 119986 - DNA, 20 bp, Artificial Sequence
  Description of Artificial Sequence: Synthetic oligonucleotide
  Target: ATXN1; (+) strand; PAM type: NRG; PAM sequence: CAG
aaacttgaaaagggcttcat

SEQ ID NO: 119987 - DNA, 20 bp, Artificial Sequence
  Description of Artificial Sequence: Synthetic oligonucleotide
  Target: ATXN1; (+) strand; PAM type: NRG; PAM sequence: AAG
cttgaaaagggcttcatcag

SEQ ID NO: 119988 - DNA, 20 bp, Artificial Sequence
  Description of Artificial Sequence: Synthetic oligonucleotide
  Target: ATXN1; (+) strand; PAM type: NRG; PAM sequence: CAG
gggcttcatcagaagatgaa

SEQ ID NO: 119989 - DNA, 20 bp, Artificial Sequence
  Description of Artificial Sequence: Synthetic oligonucleotide
  Target: ATXN1; (+) strand; PAM type: NRG; PAM sequence: AGG
ggcttcatcagaagatgaac

SEQ ID NO: 119990 - DNA, 20 bp, Artificial Sequence
  Description of Artificial Sequence: Synthetic oligonucleotide
  Target: ATXN1; (+) strand; PAM type: NRG; PAM sequence: AAG
attcccaaccatcacaatgt

SEQ ID NO: 119991 - DNA, 20 bp, Artificial Sequence
  Description of Artificial Sequence: Synthetic oligonucleotide
  Target: ATXN1; (+) strand; PAM type: NRG; PAM sequence: CAG
atcacaatgtaagttaatca

SEQ ID NO: 119992 - DNA, 20 bp, Artificial Sequence
  Description of Artificial Sequence: Synthetic oligonucleotide
  Target: ATXN1; (+) strand; PAM type: NRG; PAM sequence: AGG
tcacaatgtaagttaatcac

SEQ ID NO: 119993 - DNA, 20 bp, Artificial Sequence
  Description of Artificial Sequence: Synthetic oligonucleotide
  Target: ATXN1; (+) strand; PAM type: NRG; PAM sequence: AAG
caatgtaagttaatcacagg

SEQ ID NO: 119994 - DNA, 20 bp, Artificial Sequence
  Description of Artificial Sequence: Synthetic oligonucleotide
  Target: ATXN1; (+) strand; PAM type: NRG; PAM sequence: CAG
aggaagtaattttgaatttt

SEQ ID NO: 119995 - DNA, 20 bp, Artificial Sequence
  Description of Artificial Sequence: Synthetic oligonucleotide
  Target: ATXN1; (+) strand; PAM type: NRG; PAM sequence: TGG
gtcatcctgaaactgaacta

SEQ ID NO: 119996 - DNA, 20 bp, Artificial Sequence
  Description of Artificial Sequence: Synthetic oligonucleotide
  Target: ATXN1; (+) strand; PAM type: NRG; PAM sequence: TAG
tcctgaaactgaactatggt

SEQ ID NO: 119997 - DNA, 20 bp, Artificial Sequence
  Description of Artificial Sequence: Synthetic oligonucleotide
  Target: ATXN1; (+) strand; PAM type: NRG; PAM sequence: GAG
tgaactatggttagtaattt

SEQ ID NO: 119998 - DNA, 20 bp, Artificial Sequence
  Description of Artificial Sequence: Synthetic oligonucleotide
  Target: ATXN1; (+) strand; PAM type: NRG; PAM sequence: GAG
atggttagtaatttgagatt

SEQ ID NO: 119999 - DNA, 20 bp, Artificial Sequence
  Description of Artificial Sequence: Synthetic oligonucleotide
  Target: ATXN1; (+) strand; PAM type: NRG; PAM sequence: AAG
atttgagattgagatgaacg

SEQ ID NO: 120000 - DNA, 20 bp, Artificial Sequence
  Description of Artificial Sequence: Synthetic oligonucleotide
  Target: ATXN1; (+) strand; PAM type: NRG; PAM sequence: TGG
attgagatgaacgaagtaaa

SEQ ID NO: 120001 - DNA, 20 bp, Artificial Sequence
  Description of Artificial Sequence: Synthetic oligonucleotide
  Target: ATXN1; (+) strand; PAM type: NRG; PAM sequence: GAG
tgagatgaacgaagtaaatg

SEQ ID NO: 120002 - DNA, 20 bp, Artificial Sequence
  Description of Artificial Sequence: Synthetic oligonucleotide
  Target: ATXN1; (+) strand; PAM type: NRG; PAM sequence: TAG
cgaagtaaatggagatgcct

SEQ ID NO: 120003 - DNA, 20 bp, Artificial Sequence
  Description of Artificial Sequence: Synthetic oligonucleotide
  Target: ATXN1; (+) strand; PAM type: NRG; PAM sequence: GAG
aagtaaatggagatgcctta

SEQ ID NO: 120004 - DNA, 20 bp, Artificial Sequence
  Description of Artificial Sequence: Synthetic oligonucleotide
  Target: ATXN1; (+) strand; PAM type: NRG; PAM sequence: CGG
aatggagatgccttagagct

SEQ ID NO: 120005 - DNA, 20 bp, Artificial Sequence
  Description of Artificial Sequence: Synthetic oligonucleotide
  Target: ATXN1; (+) strand; PAM type: NRG; PAM sequence: GAG
ccttagagctcggcattcct

SEQ ID NO: 120006 - DNA, 20 bp, Artificial Sequence
  Description of Artificial Sequence: Synthetic oligonucleotide
  Target: ATXN1; (+) strand; PAM type: NRG; PAM sequence: GAG
attcctgagtttgctgcaat

SEQ ID NO: 120007 - DNA, 20 bp, Artificial Sequence
  Description of Artificial Sequence: Synthetic oligonucleotide
  Target: ATXN1; (+) strand; PAM type: NRG; PAM sequence: TAG
cctgagtttgctgcaatgag

SEQ ID NO: 120008 - DNA, 20 bp, Artificial Sequence
  Description of Artificial Sequence: Synthetic oligonucleotide
  Target: ATXN1; (+) strand; PAM type: NRG; PAM sequence: AAG
gtttgctgcaatgagtagtt

SEQ ID NO: 120009 - DNA, 20 bp, Artificial Sequence
  Description of Artificial Sequence: Synthetic oligonucleotide
  Target: ATXN1; (+) strand; PAM type: NRG; PAM sequence: AAG
gcaatgagtagttaagtttg

SEQ ID NO: 120010 - DNA, 20 bp, Artificial Sequence
  Description of Artificial Sequence: Synthetic oligonucleotide
  Target: ATXN1; (+) strand; PAM type: NRG; PAM sequence: TAG
gtagttaagtttgaagaatc

SEQ ID NO: 120011 - DNA, 20 bp, Artificial Sequence
  Description of Artificial Sequence: Synthetic oligonucleotide
  Target: ATXN1; (+) strand; PAM type: NRG; PAM sequence: TAG
tagatatgtgaatgatgtaa

SEQ ID NO: 120012 - DNA, 20 bp, Artificial Sequence
  Description of Artificial Sequence: Synthetic oligonucleotide
  Target: ATXN1; (+) strand; PAM type: NRG; PAM sequence: AAG
atgtgaatgatgtaatagat

SEQ ID NO: 120013 - DNA, 20 bp, Artificial Sequence
  Description of Artificial Sequence: Synthetic oligonucleotide
  Target: ATXN1; (+) strand; PAM type: NRG; PAM sequence: AGG
tgtgaatgatgtaatagata

SEQ ID NO: 120014 - DNA, 20 bp, Artificial Sequence
  Description of Artificial Sequence: Synthetic oligonucleotide
  Target: ATXN1; (+) strand; PAM type: NRG; PAM sequence: CAG
gaatgatgtaatagataagg

SEQ ID NO: 120015 - DNA, 20 bp, Artificial Sequence
  Description of Artificial Sequence: Synthetic oligonucleotide
  Target: ATXN1; (+) strand; PAM type: NRG; PAM sequence: CAG
gatgtaatagataaggcaga

SEQ ID NO: 120016 - DNA, 20 bp, Artificial Sequence
  Description of Artificial Sequence: Synthetic oligonucleotide
  Target: ATXN1; (+) strand; PAM type: NRG; PAM sequence: TGG
aatagataaggcagacagat

SEQ ID NO: 120017 - DNA, 20 bp, Artificial Sequence
  Description of Artificial Sequence: Synthetic oligonucleotide
  Target: ATXN1; (+) strand; PAM type: NRG; PAM sequence: CAG
ataaggcagacagattggat

SEQ ID NO: 120018 - DNA, 20 bp, Artificial Sequence
  Description of Artificial Sequence: Synthetic oligonucleotide
  Target: ATXN1; (+) strand; PAM type: NRG; PAM sequence: GAG
aaggcagacagattggatca

SEQ ID NO: 120019 - DNA, 20 bp, Artificial Sequence
  Description of Artificial Sequence: Synthetic oligonucleotide
  Target: ATXN1; (+) strand; PAM type: NRG; PAM sequence: AGG
aggcagacagattggatcag

SEQ ID NO: 120020 - DNA, 20 bp, Artificial Sequence
  Description of Artificial Sequence: Synthetic oligonucleotide
  Target: ATXN1; (+) strand; PAM type: NRG; PAM sequence: GGG
ggcagacagattggatcaga

SEQ ID NO: 120021 - DNA, 20 bp, Artificial Sequence
  Description of Artificial Sequence: Synthetic oligonucleotide
  Target: ATXN1; (+) strand; PAM type: NRG; PAM sequence: GGG
gcagacagattggatcagag

SEQ ID NO: 120022 - DNA, 20 bp, Artificial Sequence
  Description of Artificial Sequence: Synthetic oligonucleotide
  Target: ATXN1; (+) strand; PAM type: NRG; PAM sequence: AAG
atcagaggggttttaatatt

SEQ ID NO: 120023 - DNA, 20 bp, Artificial Sequence
  Description of Artificial Sequence: Synthetic oligonucleotide
  Target: ATXN1; (+) strand; PAM type: NRG; PAM sequence: AAG
aggggttttaatattaagat

SEQ ID NO: 120024 - DNA, 20 bp, Artificial Sequence
  Description of Artificial Sequence: Synthetic oligonucleotide
  Target: ATXN1; (+) strand; PAM type: NRG; PAM sequence: TAG
attaagataagtgacaatga

SEQ ID NO: 120025 - DNA, 20 bp, Artificial Sequence
  Description of Artificial Sequence: Synthetic oligonucleotide
  Target: ATXN1; (+) strand; PAM type: NRG; PAM sequence: CAG
taagtgacaatgatagctca

SEQ ID NO: 120026 - DNA, 20 bp, Artificial Sequence
  Description of Artificial Sequence: Synthetic oligonucleotide
  Target: ATXN1; (+) strand; PAM type: NRG; PAM sequence: TAG
atgaccttatgcctatatca

SEQ ID NO: 120027 - DNA, 20 bp, Artificial Sequence
  Description of Artificial Sequence: Synthetic oligonucleotide
  Target: ATXN1; (+) strand; PAM type: NRG; PAM sequence: GAG
gaccttatgcctatatcata

SEQ ID NO: 120028 - DNA, 20 bp, Artificial Sequence
  Description of Artificial Sequence: Synthetic oligonucleotide
  Target: ATXN1; (+) strand; PAM type: NRG; PAM sequence: TAG
cctatatcatagagtgacac

SEQ ID NO: 120029 - DNA, 20 bp, Artificial Sequence
  Description of Artificial Sequence: Synthetic oligonucleotide
  Target: ATXN1; (+) strand; PAM type: NRG; PAM sequence: CAG
tatcatagagtgacactaga

SEQ ID NO: 120030 - DNA, 20 bp, Artificial Sequence
  Description of Artificial Sequence: Synthetic oligonucleotide
  Target: ATXN1; (+) strand; PAM type: NRG; PAM sequence: CAG
atagagtgacactagacagc

SEQ ID NO: 120031 - DNA, 20 bp, Artificial Sequence
  Description of Artificial Sequence: Synthetic oligonucleotide
  Target: ATXN1; (+) strand; PAM type: NRG; PAM sequence: AAG
tagacagccagtgaaatgca

SEQ ID NO: 120032 - DNA, 20 bp, Artificial Sequence
  Description of Artificial Sequence: Synthetic oligonucleotide
  Target: ATXN1; (+) strand; PAM type: NRG; PAM sequence: CAG
acagccagtgaaatgcaaag

SEQ ID NO: 120033 - DNA, 20 bp, Artificial Sequence
  Description of Artificial Sequence: Synthetic oligonucleotide
  Target: ATXN1; (+) strand; PAM type: NRG; PAM sequence: TGG
tgcaaagcagccatgtgccc

SEQ ID NO: 120034 - DNA, 20 bp, Artificial Sequence
  Description of Artificial Sequence: Synthetic oligonucleotide
  Target: ATXN1; (+) strand; PAM type: NRG; PAM sequence: TAG
agcagccatgtgccctggat

SEQ ID NO: 120035 - DNA, 20 bp, Artificial Sequence
  Description of Artificial Sequence: Synthetic oligonucleotide
  Target: ATXN1; (+) strand; PAM type: NRG; PAM sequence: TAG
attagattcgcacctctctg

SEQ ID NO: 120036 - DNA, 20 bp, Artificial Sequence
  Description of Artificial Sequence: Synthetic oligonucleotide
  Target: ATXN1; (+) strand; PAM type: NRG; PAM sequence: TGG
gattcgcacctctctgtagc

SEQ ID NO: 120037 - DNA, 20 bp, Artificial Sequence
  Description of Artificial Sequence: Synthetic oligonucleotide
  Target: ATXN1; (+) strand; PAM type: NRG; PAM sequence: GGG
attcgcacctctctgtagct

SEQ ID NO: 120038 - DNA, 20 bp, Artificial Sequence
  Description of Artificial Sequence: Synthetic oligonucleotide
  Target: ATXN1; (+) strand; PAM type: NRG; PAM sequence: CAG
cgcacctctctgtagctggg

SEQ ID NO: 120039 - DNA, 20 bp, Artificial Sequence
  Description of Artificial Sequence: Synthetic oligonucleotide
  Target: ATXN1; (+) strand; PAM type: NRG; PAM sequence: CAG
ctctgtagctgggcagcttt

SEQ ID NO: 120040 - DNA, 20 bp, Artificial Sequence
  Description of Artificial Sequence: Synthetic oligonucleotide
  Target: ATXN1; (+) strand; PAM type: NRG; PAM sequence: TAG
tgtagctgggcagctttcag

SEQ ID NO: 120041 - DNA, 20 bp, Artificial Sequence
  Description of Artificial Sequence: Synthetic oligonucleotide
  Target: ATXN1; (+) strand; PAM type: NRG; PAM sequence: GAG
tagctgggcagctttcagta

SEQ ID NO: 120042 - DNA, 20 bp, Artificial Sequence
  Description of Artificial Sequence: Synthetic oligonucleotide
  Target: ATXN1; (+) strand; PAM type: NRG; PAM sequence: CAG
cagctttcagtagagcatgt

SEQ ID NO: 120043 - DNA, 20 bp, Artificial Sequence
  Description of Artificial Sequence: Synthetic oligonucleotide
  Target: ATXN1; (+) strand; PAM type: NRG; PAM sequence: AGG
agctttcagtagagcatgtc

SEQ ID NO: 120044 - DNA, 20 bp, Artificial Sequence
  Description of Artificial Sequence: Synthetic oligonucleotide
  Target: ATXN1; (+) strand; PAM type: NRG; PAM sequence: GAG
ctttcagtagagcatgtcag

SEQ ID NO: 120045 - DNA, 20 bp, Artificial Sequence
  Description of Artificial Sequence: Synthetic oligonucleotide
  Target: ATXN1; (+) strand; PAM type: NRG; PAM sequence: GAG
gtgtgtgtgtgtgtgtgtgt

SEQ ID NO: 120046 - DNA, 20 bp, Artificial Sequence
  Description of Artificial Sequence: Synthetic oligonucleotide
  Target: ATXN1; (+) strand; PAM type: NRG; PAM sequence: CAG
gtgtgtgtgtgtgtgtgaga

SEQ ID NO: 120047 - DNA, 20 bp, Artificial Sequence
  Description of Artificial Sequence: Synthetic oligonucleotide
  Target: ATXN1; (+) strand; PAM type: NRG; PAM sequence: AAG
gtgtgtgtgtgtgagacaga

SEQ ID NO: 120048 - DNA, 20 bp, Artificial Sequence
  Description of Artificial Sequence: Synthetic oligonucleotide
  Target: ATXN1; (+) strand; PAM type: NRG; PAM sequence: GAG
gtgtgtgtgtgagacagaaa

SEQ ID NO: 120049 - DNA, 20 bp, Artificial Sequence
  Description of Artificial Sequence: Synthetic oligonucleotide
  Target: ATXN1; (+) strand; PAM type: NRG; PAM sequence: GAG
gtgtgtgtgagacagaaaga

SEQ ID NO: 120050 - DNA, 20 bp, Artificial Sequence
  Description of Artificial Sequence: Synthetic oligonucleotide
  Target: ATXN1; (+) strand; PAM type: NRG; PAM sequence: GAG
gtgtgtgagacagaaagaga

SEQ ID NO: 120051 - DNA, 20 bp, Artificial Sequence
  Description of Artificial Sequence: Synthetic oligonucleotide
  Target: ATXN1; (+) strand; PAM type: NRG; PAM sequence: GAG
gtgtgagacagaaagagaga

SEQ ID NO: 120052 - DNA, 20 bp, Artificial Sequence
  Description of Artificial Sequence: Synthetic oligonucleotide
  Target: ATXN1; (+) strand; PAM type: NRG; PAM sequence: CAG
gagtctgtcattgtaatata

SEQ ID NO: 120053 - DNA, 20 bp, Artificial Sequence
  Description of Artificial Sequence: Synthetic oligonucleotide
  Target: ATXN1; (+) strand; PAM type: NRG; PAM sequence: AGG
agtctgtcattgtaatatac

SEQ ID NO: 120054 - DNA, 20 bp, Artificial Sequence
  Description of Artificial Sequence: Synthetic oligonucleotide
  Target: ATXN1; (+) strand; PAM type: NRG; PAM sequence: GGG
gtctgtcattgtaatataca

SEQ ID NO: 120055 - DNA, 20 bp, Artificial Sequence
  Description of Artificial Sequence: Synthetic oligonucleotide
  Target: ATXN1; (+) strand; PAM type: NRG; PAM sequence: GAG
ctgtcattgtaatatacagg

SEQ ID NO: 120056 - DNA, 20 bp, Artificial Sequence
  Description of Artificial Sequence: Synthetic oligonucleotide
  Target: ATXN1; (+) strand; PAM type: NRG; PAM sequence: AAG
aatatacagggagtttacat

SEQ ID NO: 120057 - DNA, 20 bp, Artificial Sequence
  Description of Artificial Sequence: Synthetic oligonucleotide
  Target: ATXN1; (+) strand; PAM type: NRG; PAM sequence: GAG
tatacagggagtttacataa

SEQ ID NO: 120058 - DNA, 20 bp, Artificial Sequence
  Description of Artificial Sequence: Synthetic oligonucleotide
  Target: ATXN1; (+) strand; PAM type: NRG; PAM sequence: AAG
acagggagtttacataagag

SEQ ID NO: 120059 - DNA, 20 bp, Artificial Sequence
  Description of Artificial Sequence: Synthetic oligonucleotide
  Target: ATXN1; (+) strand; PAM type: NRG; PAM sequence: AGG
cagggagtttacataagaga

SEQ ID NO: 120060 - DNA, 20 bp, Artificial Sequence
  Description of Artificial Sequence: Synthetic oligonucleotide
  Target: ATXN1; (+) strand; PAM type: NRG; PAM sequence: TGG
gagtttacataagagaaggt

SEQ ID NO: 120061 - DNA, 20 bp, Artificial Sequence
  Description of Artificial Sequence: Synthetic oligonucleotide
  Target: ATXN1; (+) strand; PAM type: NRG; PAM sequence: AAG
tttacataagagaaggttgg

SEQ ID NO: 120062 - DNA, 20 bp, Artificial Sequence
  Description of Artificial Sequence: Synthetic oligonucleotide
  Target: ATXN1; (+) strand; PAM type: NRG; PAM sequence: GAG
tacataagagaaggttggaa

SEQ ID NO: 120063 - DNA, 20 bp, Artificial Sequence
  Description of Artificial Sequence: Synthetic oligonucleotide
  Target: ATXN1; (+) strand; PAM type: NRG; PAM sequence: AAG
gagcaacaacaatttgaatt

SEQ ID NO: 120064 - DNA, 20 bp, Artificial Sequence
  Description of Artificial Sequence: Synthetic oligonucleotide
  Target: ATXN1; (+) strand; PAM type: NRG; PAM sequence: AGG
agcaacaacaatttgaatta

SEQ ID NO: 120065 - DNA, 20 bp, Artificial Sequence
  Description of Artificial Sequence: Synthetic oligonucleotide
  Target: ATXN1; (+) strand; PAM type: NRG; PAM sequence: TAG
aacaacaatttgaattaagg

SEQ ID NO: 120066 - DNA, 20 bp, Artificial Sequence
  Description of Artificial Sequence: Synthetic oligonucleotide
  Target: ATXN1; (+) strand; PAM type: NRG; PAM sequence: AAG
ggtagcctatttttctttat

SEQ ID NO: 120067 - DNA, 20 bp, Artificial Sequence
  Description of Artificial Sequence: Synthetic oligonucleotide
  Target: ATXN1; (+) strand; PAM type: NRG; PAM sequence: CGG
atttttctttataagacact

SEQ ID NO: 120068 - DNA, 20 bp, Artificial Sequence
  Description of Artificial Sequence: Synthetic oligonucleotide
  Target: ATXN1; (+) strand; PAM type: NRG; PAM sequence: CAG
aagacactcggaatacctaa

SEQ ID NO: 120069 - DNA, 20 bp, Artificial Sequence
  Description of Artificial Sequence: Synthetic oligonucleotide
  Target: ATXN1; (+) strand; PAM type: NRG; PAM sequence: AGG
agacactcggaatacctaac

SEQ ID NO: 120070 - DNA, 20 bp, Artificial Sequence
  Description of Artificial Sequence: Synthetic oligonucleotide
  Target: ATXN1; (+) strand; PAM type: NRG; PAM sequence: CAG
tcaatctccgcaccatctgt

SEQ ID NO: 120071 - DNA, 20 bp, Artificial Sequence
  Description of Artificial Sequence: Synthetic oligonucleotide
  Target: ATXN1; (+) strand; PAM type: NRG; PAM sequence: TAG
ccgcaccatctgtcagacct

SEQ ID NO: 120072 - DNA, 20 bp, Artificial Sequence
  Description of Artificial Sequence: Synthetic oligonucleotide
  Target: ATXN1; (+) strand; PAM type: NRG; PAM sequence: AGG
cgcaccatctgtcagacctt

SEQ ID NO: 120073 - DNA, 20 bp, Artificial Sequence
  Description of Artificial Sequence: Synthetic oligonucleotide
  Target: ATXN1; (+) strand; PAM type: NRG; PAM sequence: CAG
atctgtcagaccttaggtta

SEQ ID NO: 120074 - DNA, 20 bp, Artificial Sequence
  Description of Artificial Sequence: Synthetic oligonucleotide
  Target: ATXN1; (+) strand; PAM type: NRG; PAM sequence: AAG
accacccccatgcattaatc

SEQ ID NO: 120075 - DNA, 20 bp, Artificial Sequence
  Description of Artificial Sequence: Synthetic oligonucleotide
  Target: ATXN1; (+) strand; PAM type: NRG; PAM sequence: AAG
acccccatgcattaatcaag

SEQ ID NO: 120076 - DNA, 20 bp, Artificial Sequence
  Description of Artificial Sequence: Synthetic oligonucleotide
  Target: ATXN1; (+) strand; PAM type: NRG; PAM sequence: GAG
ccccatgcattaatcaagaa

SEQ ID NO: 120077 - DNA, 20 bp, Artificial Sequence
  Description of Artificial Sequence: Synthetic oligonucleotide
  Target: ATXN1; (+) strand; PAM type: NRG; PAM sequence: AGG
cccatgcattaatcaagaag

SEQ ID NO: 120078 - DNA, 20 bp, Artificial Sequence
  Description of Artificial Sequence: Synthetic oligonucleotide
  Target: ATXN1; (+) strand; PAM type: NRG; PAM sequence: AAG
ttaatcaagaagaggcaacc

SEQ ID NO: 120079 - DNA, 20 bp, Artificial Sequence
  Description of Artificial Sequence: Synthetic oligonucleotide
  Target: ATXN1; (+) strand; PAM type: NRG; PAM sequence: TAG
agaagaggcaaccaagtgtg

SEQ ID NO: 120080 - DNA, 20 bp, Artificial Sequence
  Description of Artificial Sequence: Synthetic oligonucleotide
  Target: ATXN1; (+) strand; PAM type: NRG; PAM sequence: GAG
gcaaccaagtgtgtagcttt

SEQ ID NO: 120081 - DNA, 20 bp, Artificial Sequence
  Description of Artificial Sequence: Synthetic oligonucleotide
  Target: ATXN1; (+) strand; PAM type: NRG; PAM sequence: AAG
caagtgtgtagctttgagaa

SEQ ID NO: 120082 - DNA, 20 bp, Artificial Sequence
  Description of Artificial Sequence: Synthetic oligonucleotide
  Target: ATXN1; (+) strand; PAM type: NRG; PAM sequence: CAG
tgagaaaagttctgctcttt

SEQ ID NO: 120083 - DNA, 20 bp, Artificial Sequence
  Description of Artificial Sequence: Synthetic oligonucleotide
  Target: ATXN1; (+) strand; PAM type: NRG; PAM sequence: AAG
gtattattaaaatttctaaa

SEQ ID NO: 120084 - DNA, 20 bp, Artificial Sequence
  Description of Artificial Sequence: Synthetic oligonucleotide
  Target: ATXN1; (+) strand; PAM type: NRG; PAM sequence: AGG
tattattaaaatttctaaaa

SEQ ID NO: 120085 - DNA, 20 bp, Artificial Sequence
  Description of Artificial Sequence: Synthetic oligonucleotide
  Target: ATXN1; (+) strand; PAM type: NRG; PAM sequence: CAG
atttctaaaaaggtaaacaa

SEQ ID NO: 120086 - DNA, 20 bp, Artificial Sequence
  Description of Artificial Sequence: Synthetic oligonucleotide
  Target: ATXN1; (+) strand; PAM type: NRG; PAM sequence: AGG
tttctaaaaaggtaaacaac

SEQ ID NO: 120087 - DNA, 20 bp, Artificial Sequence
  Description of Artificial Sequence: Synthetic oligonucleotide
  Target: ATXN1; (+) strand; PAM type: NRG; PAM sequence: GAG
tctaaaaaggtaaacaacag

SEQ ID NO: 120088 - DNA, 20 bp, Artificial Sequence
  Description of Artificial Sequence: Synthetic oligonucleotide
  Target: ATXN1; (+) strand; PAM type: NRG; PAM sequence: AGG
ctaaaaaggtaaacaacagg

SEQ ID NO: 120089 - DNA, 20 bp, Artificial Sequence
  Description of Artificial Sequence: Synthetic oligonucleotide
  Target: ATXN1; (+) strand; PAM type: NRG; PAM sequence: TGG
aaaaggtaaacaacaggagg

SEQ ID NO: 120090 - DNA, 20 bp, Artificial Sequence
  Description of Artificial Sequence: Synthetic oligonucleotide
  Target: ATXN1; (+) strand; PAM type: NRG; PAM sequence: CAG
acaggaggtggttttaatca

SEQ ID NO: 120091 - DNA, 20 bp, Artificial Sequence
  Description of Artificial Sequence: Synthetic oligonucleotide
  Target: ATXN1; (+) strand; PAM type: NRG; PAM sequence: TGG
tgattgcatacccatgtccc

SEQ ID NO: 120092 - DNA, 20 bp, Artificial Sequence
  Description of Artificial Sequence: Synthetic oligonucleotide
  Target: ATXN1; (+) strand; PAM type: NRG; PAM sequence: CAG
ttgcatacccatgtccctgg

SEQ ID NO: 120093 - DNA, 20 bp, Artificial Sequence
  Description of Artificial Sequence: Synthetic oligonucleotide
  Target: ATXN1; (+) strand; PAM type: NRG; PAM sequence: TAG
tacccatgtccctggcagct

SEQ ID NO: 120094 - DNA, 20 bp, Artificial Sequence
  Description of Artificial Sequence: Synthetic oligonucleotide
  Target: ATXN1; (+) strand; PAM type: NRG; PAM sequence: TGG
atgtccctggcagcttagaa

SEQ ID NO: 120095 - DNA, 20 bp, Artificial Sequence
  Description of Artificial Sequence: Synthetic oligonucleotide
  Target: ATXN1; (+) strand; PAM type: NRG; PAM sequence: CAG
ctggcagcttagaatggtta

SEQ ID NO: 120096 - DNA, 20 bp, Artificial Sequence
  Description of Artificial Sequence: Synthetic oligonucleotide
  Target: ATXN1; (+) strand; PAM type: NRG; PAM sequence: AAG
ttagaatggttacagcgctt

SEQ ID NO: 120097 - DNA, 20 bp, Artificial Sequence
  Description of Artificial Sequence: Synthetic oligonucleotide
  Target: ATXN1; (+) strand; PAM type: NRG; PAM sequence: AGG
tagaatggttacagcgctta

SEQ ID NO: 120098 - DNA, 20 bp, Artificial Sequence
  Description of Artificial Sequence: Synthetic oligonucleotide
  Target: ATXN1; (+) strand; PAM type: NRG; PAM sequence: AAG
agcgcttaaggtaacataca

SEQ ID NO: 120099 - DNA, 20 bp, Artificial Sequence
  Description of Artificial Sequence: Synthetic oligonucleotide
  Target: ATXN1; (+) strand; PAM type: NRG; PAM sequence: CAG
ttaaggtaacatacaaagtg

SEQ ID NO: 120100 - DNA, 20 bp, Artificial Sequence
  Description of Artificial Sequence: Synthetic oligonucleotide
  Target: ATXN1; (+) strand; PAM type: NRG; PAM sequence: GAG
gtaacatacaaagtgcagat

SEQ ID NO: 120101 - DNA, 20 bp, Artificial Sequence
  Description of Artificial Sequence: Synthetic oligonucleotide
  Target: ATXN1; (+) strand; PAM type: NRG; PAM sequence: AAG
catacaaagtgcagatgagt

SEQ ID NO: 120102 - DNA, 20 bp, Artificial Sequence
  Description of Artificial Sequence: Synthetic oligonucleotide
  Target: ATXN1; (+) strand; PAM type: NRG; PAM sequence: AAG
aaagtgcagatgagtaagaa

SEQ ID NO: 120103 - DNA, 20 bp, Artificial Sequence
  Description of Artificial Sequence: Synthetic oligonucleotide
  Target: ATXN1; (+) strand; PAM type: NRG; PAM sequence: CAG
gaaaagaacctgacaaaact

SEQ ID NO: 120104 - DNA, 20 bp, Artificial Sequence
  Description of Artificial Sequence: Synthetic oligonucleotide
  Target: ATXN1; (+) strand; PAM type: NRG; PAM sequence: CAG
aaactcagtgaaataacacg

SEQ ID NO: 120105 - DNA, 20 bp, Artificial Sequence
  Description of Artificial Sequence: Synthetic oligonucleotide
  Target: ATXN1; (+) strand; PAM type: NRG; PAM sequence: AGG
aactcagtgaaataacacgc

SEQ ID NO: 120106 - DNA, 20 bp, Artificial Sequence
  Description of Artificial Sequence: Synthetic oligonucleotide
  Target: ATXN1; (+) strand; PAM type: NRG; PAM sequence: TGG
tcagtgaaataacacgcagg

SEQ ID NO: 120107 - DNA, 20 bp, Artificial Sequence
  Description of Artificial Sequence: Synthetic oligonucleotide
  Target: ATXN1; (+) strand; PAM type: NRG; PAM sequence: CAG
gtgaaataacacgcaggtgg

SEQ ID NO: 120108 - DNA, 20 bp, Artificial Sequence
  Description of Artificial Sequence: Synthetic oligonucleotide
  Target: ATXN1; (+) strand; PAM type: NRG; PAM sequence: AAG
ttcaccccacttccaaaaat

SEQ ID NO: 120109 - DNA, 20 bp, Artificial Sequence
  Description of Artificial Sequence: Synthetic oligonucleotide
  Target: ATXN1; (+) strand; PAM type: NRG; PAM sequence: AAG
accccacttccaaaaataag

SEQ ID NO: 120110 - DNA, 20 bp, Artificial Sequence
  Description of Artificial Sequence: Synthetic oligonucleotide
  Target: ATXN1; (+) strand; PAM type: NRG; PAM sequence: TAG
actgtctactccatacactc

SEQ ID NO: 120111 - DNA, 20 bp, Artificial Sequence
  Description of Artificial Sequence: Synthetic oligonucleotide
  Target: ATXN1; (+) strand; PAM type: NRG; PAM sequence: CAG
ctactccatacactctagaa

SEQ ID NO: 120112 - DNA, 20 bp, Artificial Sequence
  Description of Artificial Sequence: Synthetic oligonucleotide
  Target: ATXN1; (+) strand; PAM type: NRG; PAM sequence: AAG
agattacatacatatttata

SEQ ID NO: 120113 - DNA, 20 bp, Artificial Sequence
  Description of Artificial Sequence: Synthetic oligonucleotide
  Target: ATXN1; (+) strand; PAM type: NRG; PAM sequence: GAG
attacatacatatttataaa

SEQ ID NO: 120114 - DNA, 20 bp, Artificial Sequence
  Description of Artificial Sequence: Synthetic oligonucleotide
  Target: ATXN1; (+) strand; PAM type: NRG; PAM sequence: AAG
ttttatgcaaaacttcatgt

SEQ ID NO: 120115 - DNA, 20 bp, Artificial Sequence
  Description of Artificial Sequence: Synthetic oligonucleotide
  Target: ATXN1; (+) strand; PAM type: NRG; PAM sequence: AGG
tttatgcaaaacttcatgta

SEQ ID NO: 120116 - DNA, 20 bp, Artificial Sequence
  Description of Artificial Sequence: Synthetic oligonucleotide
  Target: ATXN1; (+) strand; PAM type: NRG; PAM sequence: CAG
tgtaaggtcatgtgtttgta

SEQ ID NO: 120117 - DNA, 20 bp, Artificial Sequence
  Description of Artificial Sequence: Synthetic oligonucleotide
  Target: ATXN1; (+) strand; PAM type: NRG; PAM sequence: TGG
tgtttgtacagcacaaaaca

SEQ ID NO: 120118 - DNA, 20 bp, Artificial Sequence
  Description of Artificial Sequence: Synthetic oligonucleotide
  Target: ATXN1; (+) strand; PAM type: NRG; PAM sequence: TGG
tacagcacaaaacatggaat

SEQ ID NO: 120119 - DNA, 20 bp, Artificial Sequence
  Description of Artificial Sequence: Synthetic oligonucleotide
  Target: ATXN1; (+) strand; PAM type: NRG; PAM sequence: GGG
acagcacaaaacatggaatt

SEQ ID NO: 120120 - DNA, 20 bp, Artificial Sequence
  Description of Artificial Sequence: Synthetic oligonucleotide
  Target: ATXN1; (+) strand; PAM type: NRG; PAM sequence: CAG
catggaattgggtatctctc

SEQ ID NO: 120121 - DNA, 20 bp, Artificial Sequence
  Description of Artificial Sequence: Synthetic oligonucleotide
  Target: ATXN1; (+) strand; PAM type: NRG; PAM sequence: AAG
tatctctccagtcacctata

SEQ ID NO: 120122 - DNA, 20 bp, Artificial Sequence
  Description of Artificial Sequence: Synthetic oligonucleotide
  Target: ATXN1; (+) strand; PAM type: NRG; PAM sequence: GAG
ctccagtcacctataaagct

SEQ ID NO: 120123 - DNA, 20 bp, Artificial Sequence
  Description of Artificial Sequence: Synthetic oligonucleotide
  Target: ATXN1; (+) strand; PAM type: NRG; PAM sequence: TGG
gctgagctcatcccttcttc

SEQ ID NO: 120124 - DNA, 20 bp, Artificial Sequence
  Description of Artificial Sequence: Synthetic oligonucleotide
  Target: ATXN1; (+) strand; PAM type: NRG; PAM sequence: TGG
acttgttctatactgtgttc

SEQ ID NO: 120125 - DNA, 20 bp, Artificial Sequence
  Description of Artificial Sequence: Synthetic oligonucleotide
  Target: ATXN1; (+) strand; PAM type: NRG; PAM sequence: AAG
tgttctatactgtgttctgg

SEQ ID NO: 120126 - DNA, 20 bp, Artificial Sequence
  Description of Artificial Sequence: Synthetic oligonucleotide
  Target: ATXN1; (+) strand; PAM type: NRG; PAM sequence: CAG
ctatactgtgttctggaagc

SEQ ID NO: 120127 - DNA, 20 bp, Artificial Sequence
  Description of Artificial Sequence: Synthetic oligonucleotide
  Target: ATXN1; (+) strand; PAM type: NRG; PAM sequence: CAG
ctgtgttctggaagccagac

SEQ ID NO: 120128 - DNA, 20 bp, Artificial Sequence
  Description of Artificial Sequence: Synthetic oligonucleotide
  Target: ATXN1; (+) strand; PAM type: NRG; PAM sequence: CAG
aagccagaccagattgaaca

SEQ ID NO: 120129 - DNA, 20 bp, Artificial Sequence
  Description of Artificial Sequence: Synthetic oligonucleotide
  Target: ATXN1; (+) strand; PAM type: NRG; PAM sequence: CAG
agcaaaccatatcttccttt

SEQ ID NO: 120130 - DNA, 20 bp, Artificial Sequence
  Description of Artificial Sequence: Synthetic oligonucleotide
  Target: ATXN1; (+) strand; PAM type: NRG; PAM sequence: TAG
accatatcttcctttcagta

SEQ ID NO: 120131 - DNA, 20 bp, Artificial Sequence
  Description of Artificial Sequence: Synthetic oligonucleotide
  Target: ATXN1; (+) strand; PAM type: NRG; PAM sequence: GAG
ctttcagtatagaatgcaat

SEQ ID NO: 120132 - DNA, 20 bp, Artificial Sequence
  Description of Artificial Sequence: Synthetic oligonucleotide
  Target: ATXN1; (+) strand; PAM type: NRG; PAM sequence: CAG
cagtatagaatgcaatgagt

SEQ ID NO: 120133 - DNA, 20 bp, Artificial Sequence
  Description of Artificial Sequence: Synthetic oligonucleotide
  Target: ATXN1; (+) strand; PAM type: NRG; PAM sequence: AAG
tatgcaatgatctgctatta

SEQ ID NO: 120134 - DNA, 20 bp, Artificial Sequence
  Description of Artificial Sequence: Synthetic oligonucleotide
  Target: ATXN1; (+) strand; PAM type: NRG; PAM sequence: AAG
gatctgctattaaagcaaat

SEQ ID NO: 120135 - DNA, 20 bp, Artificial Sequence
  Description of Artificial Sequence: Synthetic oligonucleotide
  Target: ATXN1; (+) strand; PAM type: NRG; PAM sequence: CAG
ctgctattaaagcaaataag

SEQ ID NO: 120136 - DNA, 20 bp, Artificial Sequence
  Description of Artificial Sequence: Synthetic oligonucleotide
  Target: ATXN1; (+) strand; PAM type: NRG; PAM sequence: CAG
ttaaagcaaataagcagaat

SEQ ID NO: 120137 - DNA, 20 bp, Artificial Sequence
  Description of Artificial Sequence: Synthetic oligonucleotide
  Target: ATXN1; (+) strand; PAM type: NRG; PAM sequence: AGG
taaagcaaataagcagaatc

SEQ ID NO: 120138 - DNA, 20 bp, Artificial Sequence
  Description of Artificial Sequence: Synthetic oligonucleotide
  Target: ATXN1; (+) strand; PAM type: NRG; PAM sequence: GAG
ttttcatttccatttcacat

SEQ ID NO: 120139 - DNA, 20 bp, Artificial Sequence
  Description of Artificial Sequence: Synthetic oligonucleotide
  Target: ATXN1; (+) strand; PAM type: NRG; PAM sequence: AAG
ttccatttcacatgagtata

SEQ ID NO: 120140 - DNA, 20 bp, Artificial Sequence
  Description of Artificial Sequence: Synthetic oligonucleotide
  Target: ATXN1; (+) strand; PAM type: NRG; PAM sequence: TGG
agtataaagctcaccaaatt

SEQ ID NO: 120141 - DNA, 20 bp, Artificial Sequence
  Description of Artificial Sequence: Synthetic oligonucleotide
  Target: ATXN1; (+) strand; PAM type: NRG; PAM sequence: GGG
gtataaagctcaccaaattt

SEQ ID NO: 120142 - DNA, 20 bp, Artificial Sequence
  Description of Artificial Sequence: Synthetic oligonucleotide
  Target: ATXN1; (+) strand; PAM type: NRG; PAM sequence: AAG
tttgggcactttaaattatg

SEQ ID NO: 120143 - DNA, 20 bp, Artificial Sequence
  Description of Artificial Sequence: Synthetic oligonucleotide
  Target: ATXN1; (+) strand; PAM type: NRG; PAM sequence: CAG
cctatcacacacttctttat

SEQ ID NO: 120144 - DNA, 20 bp, Artificial Sequence
  Description of Artificial Sequence: Synthetic oligonucleotide
  Target: ATXN1; (+) strand; PAM type: NRG; PAM sequence: AAG
ctccacataattgtttaact

SEQ ID NO: 120145 - DNA, 20 bp, Artificial Sequence
  Description of Artificial Sequence: Synthetic oligonucleotide
  Target: ATXN1; (+) strand; PAM type: NRG; PAM sequence: TGG
aatgtcaaaaatgcttgcca

SEQ ID NO: 120146 - DNA, 20 bp, Artificial Sequence
  Description of Artificial Sequence: Synthetic oligonucleotide
  Target: ATXN1; (+) strand; PAM type: NRG; PAM sequence: CAG
aaaatgcttgccatggttct

SEQ ID NO: 120147 - DNA, 20 bp, Artificial Sequence
  Description of Artificial Sequence: Synthetic oligonucleotide
  Target: ATXN1; (+) strand; PAM type: NRG; PAM sequence: CAG
atgcttgccatggttctcag

SEQ ID NO: 120148 - DNA, 20 bp, Artificial Sequence
  Description of Artificial Sequence: Synthetic oligonucleotide
  Target: ATXN1; (+) strand; PAM type: NRG; PAM sequence: CAG
cagcagcaaacaaatgcctg

SEQ ID NO: 120149 - DNA, 20 bp, Artificial Sequence
  Description of Artificial Sequence: Synthetic oligonucleotide
  Target: ATXN1; (+) strand; PAM type: NRG; PAM sequence: AGG
agcagcaaacaaatgcctgc

SEQ ID NO: 120150 - DNA, 20 bp, Artificial Sequence
  Description of Artificial Sequence: Synthetic oligonucleotide
  Target: ATXN1; (+) strand; PAM type: NRG; PAM sequence: GAG
aacaaatgcctgcaggctcc

SEQ ID NO: 120151 - DNA, 20 bp, Artificial Sequence
  Description of Artificial Sequence: Synthetic oligonucleotide
  Target: ATXN1; (+) strand; PAM type: NRG; PAM sequence: TGG
tgcaggctccgagcatgccc

SEQ ID NO: 120152 - DNA, 20 bp, Artificial Sequence
  Description of Artificial Sequence: Synthetic oligonucleotide
  Target: ATXN1; (+) strand; PAM type: NRG; PAM sequence: GGG
gcaggctccgagcatgccct

SEQ ID NO: 120153 - DNA, 20 bp, Artificial Sequence
  Description of Artificial Sequence: Synthetic oligonucleotide
  Target: ATXN1; (+) strand; PAM type: NRG; PAM sequence: GGG
caggctccgagcatgccctg

SEQ ID NO: 120154 - DNA, 20 bp, Artificial Sequence
  Description of Artificial Sequence: Synthetic oligonucleotide
  Target: ATXN1; (+) strand; PAM type: NRG; PAM sequence: CAG
ctttgaaaatgcatcccatt

SEQ ID NO: 120155 - DNA, 20 bp, Artificial Sequence
  Description of Artificial Sequence: Synthetic oligonucleotide
  Target: ATXN1; (+) strand; PAM type: NRG; PAM sequence: TAG
gaaaatgcatcccattcagt

SEQ ID NO: 120156 - DNA, 20 bp, Artificial Sequence
  Description of Artificial Sequence: Synthetic oligonucleotide
  Target: ATXN1; (+) strand; PAM type: NRG; PAM sequence: CAG
aatgcatcccattcagttag

SEQ ID NO: 120157 - DNA, 20 bp, Artificial Sequence
  Description of Artificial Sequence: Synthetic oligonucleotide
  Target: ATXN1; (+) strand; PAM type: NRG; PAM sequence: TGG
tcccattcagttagcagtgc

SEQ ID NO: 120158 - DNA, 20 bp, Artificial Sequence
  Description of Artificial Sequence: Synthetic oligonucleotide
  Target: ATXN1; (+) strand; PAM type: NRG; PAM sequence: AAG
cagttagcagtgctggtgat

SEQ ID NO: 120159 - DNA, 20 bp, Artificial Sequence
  Description of Artificial Sequence: Synthetic oligonucleotide
  Target: ATXN1; (+) strand; PAM type: NRG; PAM sequence: TGG
gcagtgctggtgataagaca

SEQ ID NO: 120160 - DNA, 20 bp, Artificial Sequence
  Description of Artificial Sequence: Synthetic oligonucleotide
  Target: ATXN1; (+) strand; PAM type: NRG; PAM sequence: CAG
tggtgataagacatggcacg

SEQ ID NO: 120161 - DNA, 20 bp, Artificial Sequence
  Description of Artificial Sequence: Synthetic oligonucleotide
  Target: ATXN1; (+) strand; PAM type: NRG; PAM sequence: GAG
gtgataagacatggcacgca

SEQ ID NO: 120162 - DNA, 20 bp, Artificial Sequence
  Description of Artificial Sequence: Synthetic oligonucleotide
  Target: ATXN1; (+) strand; PAM type: NRG; PAM sequence: AGG
tgataagacatggcacgcag

SEQ ID NO: 120163 - DNA, 20 bp, Artificial Sequence
  Description of Artificial Sequence: Synthetic oligonucleotide
  Target: ATXN1; (+) strand; PAM type: NRG; PAM sequence: GGG
gataagacatggcacgcaga

SEQ ID NO: 120164 - DNA, 20 bp, Artificial Sequence
  Description of Artificial Sequence: Synthetic oligonucleotide
  Target: ATXN1; (+) strand; PAM type: NRG; PAM sequence: AAG
ggtctaaaccaccaccccta

SEQ ID NO: 120165 - DNA, 20 bp, Artificial Sequence
  Description of Artificial Sequence: Synthetic oligonucleotide
  Target: ATXN1; (+) strand; PAM type: NRG; PAM sequence: AGG
gtctaaaccaccacccctaa

SEQ ID NO: 120166 - DNA, 20 bp, Artificial Sequence
  Description of Artificial Sequence: Synthetic oligonucleotide
  Target: ATXN1; (+) strand; PAM type: NRG; PAM sequence: CAG
accaccacccctaaaggtgc

SEQ ID NO: 120167 - DNA, 20 bp, Artificial Sequence
  Description of Artificial Sequence: Synthetic oligonucleotide
  Target: ATXN1; (+) strand; PAM type: NRG; PAM sequence: GAG
caccacccctaaaggtgcca

SEQ ID NO: 120168 - DNA, 20 bp, Artificial Sequence
  Description of Artificial Sequence: Synthetic oligonucleotide
  Target: ATXN1; (+) strand; PAM type: NRG; PAM sequence: CAG
cacccctaaaggtgccagag

SEQ ID NO: 120169 - DNA, 20 bp, Artificial Sequence
  Description of Artificial Sequence: Synthetic oligonucleotide
  Target: ATXN1; (+) strand; PAM type: NRG; PAM sequence: GAG
ccagagcagaaccctgcatt

SEQ ID NO: 120170 - DNA, 20 bp, Artificial Sequence
  Description of Artificial Sequence: Synthetic oligonucleotide
  Target: ATXN1; (+) strand; PAM type: NRG; PAM sequence: CAG
tgcattgagtttaatgctga

SEQ ID NO: 120171 - DNA, 20 bp, Artificial Sequence
  Description of Artificial Sequence: Synthetic oligonucleotide
  Target: ATXN1; (+) strand; PAM type: NRG; PAM sequence: GAG
cattgagtttaatgctgaca

SEQ ID NO: 120172 - DNA, 20 bp, Artificial Sequence
  Description of Artificial Sequence: Synthetic oligonucleotide
  Target: ATXN1; (+) strand; PAM type: NRG; PAM sequence: CAG
tgctgacagagcactccaat

SEQ ID NO: 120173 - DNA, 20 bp, Artificial Sequence
  Description of Artificial Sequence: Synthetic oligonucleotide
  Target: ATXN1; (+) strand; PAM type: NRG; PAM sequence: CAG
gacagagcactccaatcagt

SEQ ID NO: 120174 - DNA, 20 bp, Artificial Sequence
  Description of Artificial Sequence: Synthetic oligonucleotide
  Target: ATXN1; (+) strand; PAM type: NRG; PAM sequence: TGG
gtctgttcgaactctttgat

SEQ ID NO: 120175 - DNA, 20 bp, Artificial Sequence
  Description of Artificial Sequence: Synthetic oligonucleotide
  Target: ATXN1; (+) strand; PAM type: NRG; PAM sequence: GAG
ctgttcgaactctttgattg

SEQ ID NO: 120176 - DNA, 20 bp, Artificial Sequence
  Description of Artificial Sequence: Synthetic oligonucleotide
  Target: ATXN1; (+) strand; PAM type: NRG; PAM sequence: AAG
cgaactctttgattggagaa

SEQ ID NO: 120177 - DNA, 20 bp, Artificial Sequence
  Description of Artificial Sequence: Synthetic oligonucleotide
  Target: ATXN1; (+) strand; PAM type: NRG; PAM sequence: AGG
gaactctttgattggagaaa

SEQ ID NO: 120178 - DNA, 20 bp, Artificial Sequence
  Description of Artificial Sequence: Synthetic oligonucleotide
  Target: ATXN1; (+) strand; PAM type: NRG; PAM sequence: CAG
tctttgattggagaaaaggt

SEQ ID NO: 120179 - DNA, 20 bp, Artificial Sequence
  Description of Artificial Sequence: Synthetic oligonucleotide
  Target: ATXN1; (+) strand; PAM type: NRG; PAM sequence: GAG
tggagaaaaggtcagaatct

SEQ ID NO: 120180 - DNA, 20 bp, Artificial Sequence
  Description of Artificial Sequence: Synthetic oligonucleotide
  Target: ATXN1; (+) strand; PAM type: NRG; PAM sequence: AAG
ggtcagaatctgagctacaa

SEQ ID NO: 120181 - DNA, 20 bp, Artificial Sequence
  Description of Artificial Sequence: Synthetic oligonucleotide
  Target: ATXN1; (+) strand; PAM type: NRG; PAM sequence: TGG
cagaatctgagctacaaaag

SEQ ID NO: 120182 - DNA, 20 bp, Artificial Sequence
  Description of Artificial Sequence: Synthetic oligonucleotide
  Target: ATXN1; (+) strand; PAM type: NRG; PAM sequence: TGG
aaaagtggcctgcctgcccc

SEQ ID NO: 120183 - DNA, 20 bp, Artificial Sequence
  Description of Artificial Sequence: Synthetic oligonucleotide
  Target: ATXN1; (+) strand; PAM type: NRG; PAM sequence: AAG
agtggcctgcctgcccctgg

SEQ ID NO: 120184 - DNA, 20 bp, Artificial Sequence
  Description of Artificial Sequence: Synthetic oligonucleotide
  Target: ATXN1; (+) strand; PAM type: NRG; PAM sequence: TAG
cctgcctgcccctggaagat

SEQ ID NO: 120185 - DNA, 20 bp, Artificial Sequence
  Description of Artificial Sequence: Synthetic oligonucleotide
  Target: ATXN1; (+) strand; PAM type: NRG; PAM sequence: AGG
ctgcctgcccctggaagatt

SEQ ID NO: 120186 - DNA, 20 bp, Artificial Sequence
  Description of Artificial Sequence: Synthetic oligonucleotide
  Target: ATXN1; (+) strand; PAM type: NRG; PAM sequence: TGG
gcccctggaagattaggtcc

SEQ ID NO: 120187 - DNA, 20 bp, Artificial Sequence
  Description of Artificial Sequence: Synthetic oligonucleotide
  Target: ATXN1; (+) strand; PAM type: NRG; PAM sequence: GGG
cccctggaagattaggtcct

SEQ ID NO: 120188 - DNA, 20 bp, Artificial Sequence
  Description of Artificial Sequence: Synthetic oligonucleotide
  Target: ATXN1; (+) strand; PAM type: NRG; PAM sequence: TAG
aagattaggtcctgggtttt

SEQ ID NO: 120189 - DNA, 20 bp, Artificial Sequence
  Description of Artificial Sequence: Synthetic oligonucleotide
  Target: ATXN1; (+) strand; PAM type: NRG; PAM sequence: TGG
cccatttattttcaattatt

SEQ ID NO: 120190 - DNA, 20 bp, Artificial Sequence
  Description of Artificial Sequence: Synthetic oligonucleotide
  Target: ATXN1; (+) strand; PAM type: NRG; PAM sequence: TAG
tttattttcaattatttggt

SEQ ID NO: 120191 - DNA, 20 bp, Artificial Sequence
  Description of Artificial Sequence: Synthetic oligonucleotide
  Target: ATXN1; (+) strand; PAM type: NRG; PAM sequence: AGG
ttattttcaattatttggtt

SEQ ID NO: 120192 - DNA, 20 bp, Artificial Sequence
  Description of Artificial Sequence: Synthetic oligonucleotide
  Target: ATXN1; (+) strand; PAM type: NRG; PAM sequence: GGG
tattttcaattatttggtta

SEQ ID NO: 120193 - DNA, 20 bp, Artificial Sequence
  Description of Artificial Sequence: Synthetic oligonucleotide
  Target: ATXN1; (+) strand; PAM type: NRG; PAM sequence: AAG
tttcaattatttggttaggg

SEQ ID NO: 120194 - DNA, 20 bp, Artificial Sequence
  Description of Artificial Sequence: Synthetic oligonucleotide
  Target: ATXN1; (+) strand; PAM type: NRG; PAM sequence: AGG
ttcaattatttggttaggga

SEQ ID NO: 120195 - DNA, 20 bp, Artificial Sequence
  Description of Artificial Sequence: Synthetic oligonucleotide
  Target: ATXN1; (+) strand; PAM type: NRG; PAM sequence: AAG
ggttagggaaggtgtccctc

SEQ ID NO: 120196 - DNA, 20 bp, Artificial Sequence
  Description of Artificial Sequence: Synthetic oligonucleotide
  Target: ATXN1; (+) strand; PAM type: NRG; PAM sequence: AGG
gttagggaaggtgtccctca

SEQ ID NO: 120197 - DNA, 20 bp, Artificial Sequence
  Description of Artificial Sequence: Synthetic oligonucleotide
  Target: ATXN1; (+) strand; PAM type: NRG; PAM sequence: AAG
ggaaggtgtccctcaaggaa

SEQ ID NO: 120198 - DNA, 20 bp, Artificial Sequence
  Description of Artificial Sequence: Synthetic oligonucleotide
  Target: ATXN1; (+) strand; PAM type: NRG; PAM sequence: GAG
aaggtgtccctcaaggaaaa

SEQ ID NO: 120199 - DNA, 20 bp, Artificial Sequence
  Description of Artificial Sequence: Synthetic oligonucleotide
  Target: ATXN1; (+) strand; PAM type: NRG; PAM sequence: TAG
gtccctcaaggaaaagagca

SEQ ID NO: 120200 - DNA, 20 bp, Artificial Sequence
  Description of Artificial Sequence: Synthetic oligonucleotide
  Target: ATXN1; (+) strand; PAM type: NRG; PAM sequence: AGG
tccctcaaggaaaagagcat

SEQ ID NO: 120201 - DNA, 20 bp, Artificial Sequence
  Description of Artificial Sequence: Synthetic oligonucleotide
  Target: ATXN1; (+) strand; PAM type: NRG; PAM sequence: AAG
aggaaaagagcataggaatg

SEQ ID NO: 120202 - DNA, 20 bp, Artificial Sequence
  Description of Artificial Sequence: Synthetic oligonucleotide
  Target: ATXN1; (+) strand; PAM type: NRG; PAM sequence: AGG
ggaaaagagcataggaatga

SEQ ID NO: 120203 - DNA, 20 bp, Artificial Sequence
  Description of Artificial Sequence: Synthetic oligonucleotide
  Target: ATXN1; (+) strand; PAM type: NRG; PAM sequence: TAG
aaggctgcctgccctacttg

SEQ ID NO: 120204 - DNA, 20 bp, Artificial Sequence
  Description of Artificial Sequence: Synthetic oligonucleotide
  Target: ATXN1; (+) strand; PAM type: NRG; PAM sequence: TAG
tcttttttaatgaaaaaaat

SEQ ID NO: 120205 - DNA, 20 bp, Artificial Sequence
  Description of Artificial Sequence: Synthetic oligonucleotide
  Target: ATXN1; (+) strand; PAM type: NRG; PAM sequence: TGG
atgaaaaaaattagaaaact

SEQ ID NO: 120206 - DNA, 20 bp, Artificial Sequence
  Description of Artificial Sequence: Synthetic oligonucleotide
  Target: ATXN1; (+) strand; PAM type: NRG; PAM sequence: AAG
tccctcaattttacctataa

SEQ ID NO: 120207 - DNA, 20 bp, Artificial Sequence
  Description of Artificial Sequence: Synthetic oligonucleotide
  Target: ATXN1; (+) strand; PAM type: NRG; PAM sequence: GAG
agataccacttccaacattt

SEQ ID NO: 120208 - DNA, 20 bp, Artificial Sequence
  Description of Artificial Sequence: Synthetic oligonucleotide
  Target: ATXN1; (+) strand; PAM type: NRG; PAM sequence: AAG
aacatttgagttataacccc

SEQ ID NO: 120209 - DNA, 20 bp, Artificial Sequence
  Description of Artificial Sequence: Synthetic oligonucleotide
  Target: ATXN1; (+) strand; PAM type: NRG; PAM sequence: AGG
acatttgagttataacccca

SEQ ID NO: 120210 - DNA, 20 bp, Artificial Sequence
  Description of Artificial Sequence: Synthetic oligonucleotide
  Target: ATXN1; (+) strand; PAM type: NRG; PAM sequence: CAG
cccaaggactgaaaaatacc

SEQ ID NO: 120211 - DNA, 20 bp, Artificial Sequence
  Description of Artificial Sequence: Synthetic oligonucleotide
  Target: ATXN1; (+) strand; PAM type: NRG; PAM sequence: CAG
cagccactccgacccgatat

SEQ ID NO: 120212 - DNA, 20 bp, Artificial Sequence
  Description of Artificial Sequence: Synthetic oligonucleotide
  Target: ATXN1; (+) strand; PAM type: NRG; PAM sequence: AGG
agccactccgacccgatatc

SEQ ID NO: 120213 - DNA, 20 bp, Artificial Sequence
  Description of Artificial Sequence: Synthetic oligonucleotide
  Target: ATXN1; (+) strand; PAM type: NRG; PAM sequence: CAG
cactccgacccgatatcagg

SEQ ID NO: 120214 - DNA, 20 bp, Artificial Sequence
  Description of Artificial Sequence: Synthetic oligonucleotide
  Target: ATXN1; (+) strand; PAM type: NRG; PAM sequence: CAG
gacccgatatcaggcagttt

SEQ ID NO: 120215 - DNA, 20 bp, Artificial Sequence
  Description of Artificial Sequence: Synthetic oligonucleotide
  Target: ATXN1; (+) strand; PAM type: NRG; PAM sequence: TGG
cagtttcagtgacaacaaac

SEQ ID NO: 120216 - DNA, 20 bp, Artificial Sequence
  Description of Artificial Sequence: Synthetic oligonucleotide
  Target: ATXN1; (+) strand; PAM type: NRG; PAM sequence: CGG
aaactggtccccaaacgtac

SEQ ID NO: 120217 - DNA, 20 bp, Artificial Sequence
  Description of Artificial Sequence: Synthetic oligonucleotide
  Target: ATXN1; (+) strand; PAM type: NRG; PAM sequence: TGG
aaaccacacgttctcactct

SEQ ID NO: 120218 - DNA, 20 bp, Artificial Sequence
  Description of Artificial Sequence: Synthetic oligonucleotide
  Target: ATXN1; (+) strand; PAM type: NRG; PAM sequence: TGG
cactcttggcgacttgaatt

SEQ ID NO: 120219 - DNA, 20 bp, Artificial Sequence
  Description of Artificial Sequence: Synthetic oligonucleotide
  Target: ATXN1; (+) strand; PAM type: NRG; PAM sequence: CAG
ttgaatttggtgaaatgaaa

SEQ ID NO: 120220 - DNA, 20 bp, Artificial Sequence
  Description of Artificial Sequence: Synthetic oligonucleotide
  Target: ATXN1; (+) strand; PAM type: NRG; PAM sequence: AAG
tttctatttttgccttttga

SEQ ID NO: 120221 - DNA, 20 bp, Artificial Sequence
  Description of Artificial Sequence: Synthetic oligonucleotide
  Target: ATXN1; (+) strand; PAM type: NRG; PAM sequence: GAG
tctatttttgccttttgaaa

SEQ ID NO: 120222 - DNA, 20 bp, Artificial Sequence
  Description of Artificial Sequence: Synthetic oligonucleotide
  Target: ATXN1; (+) strand; PAM type: NRG; PAM sequence: AAG
ttttgaaagagttatgctta

SEQ ID NO: 120223 - DNA, 20 bp, Artificial Sequence
  Description of Artificial Sequence: Synthetic oligonucleotide
  Target: ATXN1; (+) strand; PAM type: NRG; PAM sequence: AGG
tttgaaagagttatgcttaa

SEQ ID NO: 120224 - DNA, 20 bp, Artificial Sequence
  Description of Artificial Sequence: Synthetic oligonucleotide
  Target: ATXN1; (+) strand; PAM type: NRG; PAM sequence: TAG
aagagttatgcttaaaggtg

SEQ ID NO: 120225 - DNA, 20 bp, Artificial Sequence
  Description of Artificial Sequence: Synthetic oligonucleotide
  Target: ATXN1; (+) strand; PAM type: NRG; PAM sequence: AAG
atgcttaaaggtgtagtgaa

SEQ ID NO: 120226 - DNA, 20 bp, Artificial Sequence
  Description of Artificial Sequence: Synthetic oligonucleotide
  Target: ATXN1; (+) strand; PAM type: NRG; PAM sequence: AGG
tgcttaaaggtgtagtgaaa

SEQ ID NO: 120227 - DNA, 20 bp, Artificial Sequence
  Description of Artificial Sequence: Synthetic oligonucleotide
  Target: ATXN1; (+) strand; PAM type: NRG; PAM sequence: CAG
taaaggtgtagtgaaaaggt

SEQ ID NO: 120228 - DNA, 20 bp, Artificial Sequence
  Description of Artificial Sequence: Synthetic oligonucleotide
  Target: ATXN1; (+) strand; PAM type: NRG; PAM sequence: TGG
tgtagtgaaaaggtcagatc

SEQ ID NO: 120229 - DNA, 20 bp, Artificial Sequence
  Description of Artificial Sequence: Synthetic oligonucleotide
  Target: ATXN1; (+) strand; PAM type: NRG; PAM sequence: TGG
aggtcagatctggaaattaa

SEQ ID NO: 120230 - DNA, 20 bp, Artificial Sequence
  Description of Artificial Sequence: Synthetic oligonucleotide
  Target: ATXN1; (+) strand; PAM type: NRG; PAM sequence: GGG
ggtcagatctggaaattaat

SEQ ID NO: 120231 - DNA, 20 bp, Artificial Sequence
  Description of Artificial Sequence: Synthetic oligonucleotide
  Target: ATXN1; (+) strand; PAM type: NRG; PAM sequence: AAG
agatctggaaattaatgggt

SEQ ID NO: 120232 - DNA, 20 bp, Artificial Sequence
  Description of Artificial Sequence: Synthetic oligonucleotide
  Target: ATXN1; (+) strand; PAM type: NRG; PAM sequence: TGG
tggaaattaatgggtaagca

SEQ ID NO: 120233 - DNA, 20 bp, Artificial Sequence
  Description of Artificial Sequence: Synthetic oligonucleotide
  Target: ATXN1; (+) strand; PAM type: NRG; PAM sequence: GAG
gggtaagcatggtcctatcc

SEQ ID NO: 120234 - DNA, 20 bp, Artificial Sequence
  Description of Artificial Sequence: Synthetic oligonucleotide
  Target: ATXN1; (+) strand; PAM type: NRG; PAM sequence: AGG
ggtaagcatggtcctatccg

SEQ ID NO: 120235 - DNA, 20 bp, Artificial Sequence
  Description of Artificial Sequence: Synthetic oligonucleotide
  Target: ATXN1; (+) strand; PAM type: NRG; PAM sequence: CAG
agcatggtcctatccgaggt

SEQ ID NO: 120236 - DNA, 20 bp, Artificial Sequence
  Description of Artificial Sequence: Synthetic oligonucleotide
  Target: ATXN1; (+) strand; PAM type: NRG; PAM sequence: GAG
catggtcctatccgaggtca

SEQ ID NO: 120237 - DNA, 20 bp, Artificial Sequence
  Description of Artificial Sequence: Synthetic oligonucleotide
  Target: ATXN1; (+) strand; PAM type: NRG; PAM sequence: AAG
ggtcctatccgaggtcagag

SEQ ID NO: 120238 - DNA, 20 bp, Artificial Sequence
  Description of Artificial Sequence: Synthetic oligonucleotide
  Target: ATXN1; (+) strand; PAM type: NRG; PAM sequence: GAG
cgaggtcagagaagcatttt

SEQ ID NO: 120239 - DNA, 20 bp, Artificial Sequence
  Description of Artificial Sequence: Synthetic oligonucleotide
  Target: ATXN1; (+) strand; PAM type: NRG; PAM sequence: GAG
aggtcagagaagcattttga

SEQ ID NO: 120240 - DNA, 20 bp, Artificial Sequence
  Description of Artificial Sequence: Synthetic oligonucleotide
  Target: ATXN1; (+) strand; PAM type: NRG; PAM sequence: CAG
gaagcattttgagagtgccc

SEQ ID NO: 120241 - DNA, 20 bp, Artificial Sequence
  Description of Artificial Sequence: Synthetic oligonucleotide
  Target: ATXN1; (+) strand; PAM type: NRG; PAM sequence: GAG
agcattttgagagtgcccca

SEQ ID NO: 120242 - DNA, 20 bp, Artificial Sequence
  Description of Artificial Sequence: Synthetic oligonucleotide
  Target: ATXN1; (+) strand; PAM type: NRG; PAM sequence: TAG
tgagagtgccccagagcctt

SEQ ID NO: 120243 - DNA, 20 bp, Artificial Sequence
  Description of Artificial Sequence: Synthetic oligonucleotide
  Target: ATXN1; (+) strand; PAM type: NRG; PAM sequence: GAG
tagaacacattgtttatttt

SEQ ID NO: 120244 - DNA, 20 bp, Artificial Sequence
  Description of Artificial Sequence: Synthetic oligonucleotide
  Target: ATXN1; (+) strand; PAM type: NRG; PAM sequence: AGG
agaacacattgtttattttg

SEQ ID NO: 120245 - DNA, 20 bp, Artificial Sequence
  Description of Artificial Sequence: Synthetic oligonucleotide
  Target: ATXN1; (+) strand; PAM type: NRG; PAM sequence: AAG
cattgtttattttgaggtca

SEQ ID NO: 120246 - DNA, 20 bp, Artificial Sequence
  Description of Artificial Sequence: Synthetic oligonucleotide
  Target: ATXN1; (+) strand; PAM type: NRG; PAM sequence: AGG
attgtttattttgaggtcaa

SEQ ID NO: 120247 - DNA, 20 bp, Artificial Sequence
  Description of Artificial Sequence: Synthetic oligonucleotide
  Target: ATXN1; (+) strand; PAM type: NRG; PAM sequence: GGG
ttgtttattttgaggtcaaa

SEQ ID NO: 120248 - DNA, 20 bp, Artificial Sequence
  Description of Artificial Sequence: Synthetic oligonucleotide
  Target: ATXN1; (+) strand; PAM type: NRG; PAM sequence: TGG
ggtcaaagggaaaaacatgt

SEQ ID NO: 120249 - DNA, 20 bp, Artificial Sequence
  Description of Artificial Sequence: Synthetic oligonucleotide
  Target: ATXN1; (+) strand; PAM type: NRG; PAM sequence: AAG
caaagggaaaaacatgttgg

SEQ ID NO: 120250 - DNA, 20 bp, Artificial Sequence
  Description of Artificial Sequence: Synthetic oligonucleotide
  Target: ATXN1; (+) strand; PAM type: NRG; PAM sequence: AGG
aaagggaaaaacatgttgga

SEQ ID NO: 120251 - DNA, 20 bp, Artificial Sequence
  Description of Artificial Sequence: Synthetic oligonucleotide
  Target: ATXN1; (+) strand; PAM type: NRG; PAM sequence: AAG
gaaaaacatgttggaaggaa

SEQ ID NO: 120252 - DNA, 20 bp, Artificial Sequence
  Description of Artificial Sequence: Synthetic oligonucleotide
  Target: ATXN1; (+) strand; PAM type: NRG; PAM sequence: GAG
aaaacatgttggaaggaaaa

SEQ ID NO: 120253 - DNA, 20 bp, Artificial Sequence
  Description of Artificial Sequence: Synthetic oligonucleotide
  Target: ATXN1; (+) strand; PAM type: NRG; PAM sequence: TGG
gttggaaggaaaagagtctt

SEQ ID NO: 120254 - DNA, 20 bp, Artificial Sequence
  Description of Artificial Sequence: Synthetic oligonucleotide
  Target: ATXN1; (+) strand; PAM type: NRG; PAM sequence: TGG
gaaggaaaagagtctttggc

SEQ ID NO: 120255 - DNA, 20 bp, Artificial Sequence
  Description of Artificial Sequence: Synthetic oligonucleotide
  Target: ATXN1; (+) strand; PAM type: NRG; PAM sequence: GGG
aaggaaaagagtctttggct

SEQ ID NO: 120256 - DNA, 20 bp, Artificial Sequence
  Description of Artificial Sequence: Synthetic oligonucleotide
  Target: ATXN1; (+) strand; PAM type: NRG; PAM sequence: AAG
ggctgggtgatgacaatgac

SEQ ID NO: 120257 - DNA, 20 bp, Artificial Sequence
  Description of Artificial Sequence: Synthetic oligonucleotide
  Target: ATXN1; (+) strand; PAM type: NRG; PAM sequence: AAG
tgggtgatgacaatgacaag

SEQ ID NO: 120258 - DNA, 20 bp, Artificial Sequence
  Description of Artificial Sequence: Synthetic oligonucleotide
  Target: ATXN1; (+) strand; PAM type: NRG; PAM sequence: CAG
caatgacaagaagacacttc

SEQ ID NO: 120259 - DNA, 20 bp, Artificial Sequence
  Description of Artificial Sequence: Synthetic oligonucleotide
  Target: ATXN1; (+) strand; PAM type: NRG; PAM sequence: GAG
atgacaagaagacacttcca

SEQ ID NO: 120260 - DNA, 20 bp, Artificial Sequence
  Description of Artificial Sequence: Synthetic oligonucleotide
  Target: ATXN1; (+) strand; PAM type: NRG; PAM sequence: TGG
aagaagacacttccagagac

SEQ ID NO: 120261 - DNA, 20 bp, Artificial Sequence
  Description of Artificial Sequence: Synthetic oligonucleotide
  Target: ATXN1; (+) strand; PAM type: NRG; PAM sequence: CAG
agactggaatctctttgact

SEQ ID NO: 120262 - DNA, 20 bp, Artificial Sequence
  Description of Artificial Sequence: Synthetic oligonucleotide
  Target: ATXN1; (+) strand; PAM type: NRG; PAM sequence: TGG
atctctttgactcagcccct

SEQ ID NO: 120263 - DNA, 20 bp, Artificial Sequence
  Description of Artificial Sequence: Synthetic oligonucleotide
  Target: ATXN1; (+) strand; PAM type: NRG; PAM sequence: TAG
tctttgactcagccccttgg

SEQ ID NO: 120264 - DNA, 20 bp, Artificial Sequence
  Description of Artificial Sequence: Synthetic oligonucleotide
  Target: ATXN1; (+) strand; PAM type: NRG; PAM sequence: AGG
ctttgactcagccccttggt

SEQ ID NO: 120265 - DNA, 20 bp, Artificial Sequence
  Description of Artificial Sequence: Synthetic oligonucleotide
  Target: ATXN1; (+) strand; PAM type: NRG; PAM sequence: TAG
ccccttggtaggtgtttatt

SEQ ID NO: 120266 - DNA, 20 bp, Artificial Sequence
  Description of Artificial Sequence: Synthetic oligonucleotide
  Target: ATXN1; (+) strand; PAM type: NRG; PAM sequence: AAG
taggtgtttatttagaaccc

SEQ ID NO: 120267 - DNA, 20 bp, Artificial Sequence
  Description of Artificial Sequence: Synthetic oligonucleotide
  Target: ATXN1; (+) strand; PAM type: NRG; PAM sequence: AGG
aggtgtttatttagaaccca

SEQ ID NO: 120268 - DNA, 20 bp, Artificial Sequence
  Description of Artificial Sequence: Synthetic oligonucleotide
  Target: ATXN1; (+) strand; PAM type: NRG; PAM sequence: TGG
tatttagaacccaaggacat

SEQ ID NO: 120269 - DNA, 20 bp, Artificial Sequence
  Description of Artificial Sequence: Synthetic oligonucleotide
  Target: ATXN1; (+) strand; PAM type: NRG; PAM sequence: GAG
tttagaacccaaggacattg

SEQ ID NO: 120270 - DNA, 20 bp, Artificial Sequence
  Description of Artificial Sequence: Synthetic oligonucleotide
  Target: ATXN1; (+) strand; PAM type: NRG; PAM sequence: TGG
aacccaaggacattggagtc

SEQ ID NO: 120271 - DNA, 20 bp, Artificial Sequence
  Description of Artificial Sequence: Synthetic oligonucleotide
  Target: ATXN1; (+) strand; PAM type: NRG; PAM sequence: CAG
ccaaggacattggagtctgg

SEQ ID NO: 120272 - DNA, 20 bp, Artificial Sequence
  Description of Artificial Sequence: Synthetic oligonucleotide
  Target: ATXN1; (+) strand; PAM type: NRG; PAM sequence: AGG
caaggacattggagtctggc

SEQ ID NO: 120273 - DNA, 20 bp, Artificial Sequence
  Description of Artificial Sequence: Synthetic oligonucleotide
  Target: ATXN1; (+) strand; PAM type: NRG; PAM sequence: AAG
gagtctggcaggatcccaca

SEQ ID NO: 120274 - DNA, 20 bp, Artificial Sequence
  Description of Artificial Sequence: Synthetic oligonucleotide
  Target: ATXN1; (+) strand; PAM type: NRG; PAM sequence: AGG
agtctggcaggatcccacaa

SEQ ID NO: 120275 - DNA, 20 bp, Artificial Sequence
  Description of Artificial Sequence: Synthetic oligonucleotide
  Target: ATXN1; (+) strand; PAM type: NRG; PAM sequence: GAG
tctggcaggatcccacaaag

SEQ ID NO: 120276 - DNA, 20 bp, Artificial Sequence
  Description of Artificial Sequence: Synthetic oligonucleotide
  Target: ATXN1; (+) strand; PAM type: NRG; PAM sequence: GAG
gcaggatcccacaaaggagc

SEQ ID NO: 120277 - DNA, 20 bp, Artificial Sequence
  Description of Artificial Sequence: Synthetic oligonucleotide
  Target: ATXN1; (+) strand; PAM type: NRG; PAM sequence: AGG
caggatcccacaaaggagcg

SEQ ID NO: 120278 - DNA, 20 bp, Artificial Sequence
  Description of Artificial Sequence: Synthetic oligonucleotide
  Target: ATXN1; (+) strand; PAM type: NRG; PAM sequence: GAG
atcccacaaaggagcgaggt

SEQ ID NO: 120279 - DNA, 20 bp, Artificial Sequence
  Description of Artificial Sequence: Synthetic oligonucleotide
  Target: ATXN1; (+) strand; PAM type: NRG; PAM sequence: AGG
tcccacaaaggagcgaggtg

SEQ ID NO: 120280 - DNA, 20 bp, Artificial Sequence
  Description of Artificial Sequence: Synthetic oligonucleotide
  Target: ATXN1; (+) strand; PAM type: NRG; PAM sequence: TGG
aggagcgaggtgaggaacac

SEQ ID NO: 120281 - DNA, 20 bp, Artificial Sequence
  Description of Artificial Sequence: Synthetic oligonucleotide
  Target: ATXN1; (+) strand; PAM type: NRG; PAM sequence: TGG
agcgaggtgaggaacactgg

SEQ ID NO: 120282 - DNA, 20 bp, Artificial Sequence
  Description of Artificial Sequence: Synthetic oligonucleotide
  Target: ATXN1; (+) strand; PAM type: NRG; PAM sequence: GAG
cgaggtgaggaacactggtg

SEQ ID NO: 120283 - DNA, 20 bp, Artificial Sequence
  Description of Artificial Sequence: Synthetic oligonucleotide
  Target: ATXN1; (+) strand; PAM type: NRG; PAM sequence: CAG
cactggtggagttctcccac

SEQ ID NO: 120284 - DNA, 20 bp, Artificial Sequence
  Description of Artificial Sequence: Synthetic oligonucleotide
  Target: ATXN1; (+) strand; PAM type: NRG; PAM sequence: CGG
gttctcccaccagattcata

SEQ ID NO: 120285 - DNA, 20 bp, Artificial Sequence
  Description of Artificial Sequence: Synthetic oligonucleotide
  Target: ATXN1; (+) strand; PAM type: NRG; PAM sequence: GAG
acggatattgctgatgacct

SEQ ID NO: 120286 - DNA, 20 bp, Artificial Sequence
  Description of Artificial Sequence: Synthetic oligonucleotide
  Target: ATXN1; (+) strand; PAM type: NRG; PAM sequence: AAG
gtcttttctgctctaccttg

SEQ ID NO: 120287 - DNA, 20 bp, Artificial Sequence
  Description of Artificial Sequence: Synthetic oligonucleotide
  Target: ATXN1; (+) strand; PAM type: NRG; PAM sequence: AGG
tcttttctgctctaccttga

SEQ ID NO: 120288 - DNA, 20 bp, Artificial Sequence
  Description of Artificial Sequence: Synthetic oligonucleotide
  Target: ATXN1; (+) strand; PAM type: NRG; PAM sequence: GGG
cttttctgctctaccttgaa

SEQ ID NO: 120289 - DNA, 20 bp, Artificial Sequence
  Description of Artificial Sequence: Synthetic oligonucleotide
  Target: ATXN1; (+) strand; PAM type: NRG; PAM sequence: TGG
agggcctccaacctcttttc

SEQ ID NO: 120290 - DNA, 20 bp, Artificial Sequence
  Description of Artificial Sequence: Synthetic oligonucleotide
  Target: ATXN1; (+) strand; PAM type: NRG; PAM sequence: AAG
ttctggtcacattgttctga

SEQ ID NO: 120291 - DNA, 20 bp, Artificial Sequence
  Description of Artificial Sequence: Synthetic oligonucleotide
  Target: ATXN1; (+) strand; PAM type: NRG; PAM sequence: CAG
attgttctgaaagtacacgt

SEQ ID NO: 120292 - DNA, 20 bp, Artificial Sequence
  Description of Artificial Sequence: Synthetic oligonucleotide
  Target: ATXN1; (+) strand; PAM type: NRG; PAM sequence: GAG
tgaaagtacacgtcagcttt

SEQ ID NO: 120293 - DNA, 20 bp, Artificial Sequence
  Description of Artificial Sequence: Synthetic oligonucleotide
  Target: ATXN1; (+) strand; PAM type: NRG; PAM sequence: CAG
gtcagctttgagccacctct

SEQ ID NO: 120294 - DNA, 20 bp, Artificial Sequence
  Description of Artificial Sequence: Synthetic oligonucleotide
  Target: ATXN1; (+) strand; PAM type: NRG; PAM sequence: AAG
ctttgagccacctctcagtc

SEQ ID NO: 120295 - DNA, 20 bp, Artificial Sequence
  Description of Artificial Sequence: Synthetic oligonucleotide
  Target: ATXN1; (+) strand; PAM type: NRG; PAM sequence: TGG
atcttctcctatgctatccc

SEQ ID NO: 120296 - DNA, 20 bp, Artificial Sequence
  Description of Artificial Sequence: Synthetic oligonucleotide
  Target: ATXN1; (+) strand; PAM type: NRG; PAM sequence: GGG
tcttctcctatgctatccct

SEQ ID NO: 120297 - DNA, 20 bp, Artificial Sequence
  Description of Artificial Sequence: Synthetic oligonucleotide
  Target: ATXN1; (+) strand; PAM type: NRG; PAM sequence: TGG
ctatccctgggtcatctctt

SEQ ID NO: 120298 - DNA, 20 bp, Artificial Sequence
  Description of Artificial Sequence: Synthetic oligonucleotide
  Target: ATXN1; (+) strand; PAM type: NRG; PAM sequence: TAG
tggaaacttcctgaattgtc

SEQ ID NO: 120299 - DNA, 20 bp, Artificial Sequence
  Description of Artificial Sequence: Synthetic oligonucleotide
  Target: ATXN1; (+) strand; PAM type: NRG; PAM sequence: AGG
ggaaacttcctgaattgtct

SEQ ID NO: 120300 - DNA, 20 bp, Artificial Sequence
  Description of Artificial Sequence: Synthetic oligonucleotide
  Target: ATXN1; (+) strand; PAM type: NRG; PAM sequence: GAG
cctgaattgtctaggctaac

SEQ ID NO: 120301 - DNA, 20 bp, Artificial Sequence
  Description of Artificial Sequence: Synthetic oligonucleotide
  Target: ATXN1; (+) strand; PAM type: NRG; PAM sequence: TAG
tctaggctaacgagtgtttt

SEQ ID NO: 120302 - DNA, 20 bp, Artificial Sequence
  Description of Artificial Sequence: Synthetic oligonucleotide
  Target: ATXN1; (+) strand; PAM type: NRG; PAM sequence: AGG
ctaggctaacgagtgttttt

SEQ ID NO: 120303 - DNA, 20 bp, Artificial Sequence
  Description of Artificial Sequence: Synthetic oligonucleotide
  Target: ATXN1; (+) strand; PAM type: NRG; PAM sequence: AAG
atgaccactcccctgtcttc

SEQ ID NO: 120304 - DNA, 20 bp, Artificial Sequence
  Description of Artificial Sequence: Synthetic oligonucleotide
  Target: ATXN1; (+) strand; PAM type: NRG; PAM sequence: CAG
aagataaactctaaactcct

SEQ ID NO: 120305 - DNA, 20 bp, Artificial Sequence
  Description of Artificial Sequence: Synthetic oligonucleotide
  Target: ATXN1; (+) strand; PAM type: NRG; PAM sequence: CAG
ataaactctaaactcctcag

SEQ ID NO: 120306 - DNA, 20 bp, Artificial Sequence
  Description of Artificial Sequence: Synthetic oligonucleotide
  Target: ATXN1; (+) strand; PAM type: NRG; PAM sequence: AAG
cctcagcagaacttactgaa

SEQ ID NO: 120307 - DNA, 20 bp, Artificial Sequence
  Description of Artificial Sequence: Synthetic oligonucleotide
  Target: ATXN1; (+) strand; PAM type: NRG; PAM sequence: TGG
tgaaaagacactttatgatc

SEQ ID NO: 120308 - DNA, 20 bp, Artificial Sequence
  Description of Artificial Sequence: Synthetic oligonucleotide
  Target: ATXN1; (+) strand; PAM type: NRG; PAM sequence: GAG
tgatctggctttttcttcat

SEQ ID NO: 120309 - DNA, 20 bp, Artificial Sequence
  Description of Artificial Sequence: Synthetic oligonucleotide
  Target: ATXN1; (+) strand; PAM type: NRG; PAM sequence: CAG
acttcacatatgcctgactc

SEQ ID NO: 120310 - DNA, 20 bp, Artificial Sequence
  Description of Artificial Sequence: Synthetic oligonucleotide
  Target: ATXN1; (+) strand; PAM type: NRG; PAM sequence: GAG
ccatgttctctcttaccttt

SEQ ID NO: 120311 - DNA, 20 bp, Artificial Sequence
  Description of Artificial Sequence: Synthetic oligonucleotide
  Target: ATXN1; (+) strand; PAM type: NRG; PAM sequence: TAG
tcatgttgtcctcatgtgac

SEQ ID NO: 120312 - DNA, 20 bp, Artificial Sequence
  Description of Artificial Sequence: Synthetic oligonucleotide
  Target: ATXN1; (+) strand; PAM type: NRG; PAM sequence: GAG
atgttgtcctcatgtgacta

SEQ ID NO: 120313 - DNA, 20 bp, Artificial Sequence
  Description of Artificial Sequence: Synthetic oligonucleotide
  Target: ATXN1; (+) strand; PAM type: NRG; PAM sequence: TGG
tgtcctcatgtgactagagc

SEQ ID NO: 120314 - DNA, 20 bp, Artificial Sequence
  Description of Artificial Sequence: Synthetic oligonucleotide
  Target: ATXN1; (+) strand; PAM type: NRG; PAM sequence: GAG
tcctcatgtgactagagctg

SEQ ID NO: 120315 - DNA, 20 bp, Artificial Sequence
  Description of Artificial Sequence: Synthetic oligonucleotide
  Target: ATXN1; (+) strand; PAM type: NRG; PAM sequence: AAG
tcctttgaactgaacaaatt

SEQ ID NO: 120316 - DNA, 20 bp, Artificial Sequence
  Description of Artificial Sequence: Synthetic oligonucleotide
  Target: ATXN1; (+) strand; PAM type: NRG; PAM sequence: TGG
acaaattaagtaatttgctt

SEQ ID NO: 120317 - DNA, 20 bp, Artificial Sequence
  Description of Artificial Sequence: Synthetic oligonucleotide
  Target: ATXN1; (+) strand; PAM type: NRG; PAM sequence: AAG
taagtaatttgctttggtta

SEQ ID NO: 120318 - DNA, 20 bp, Artificial Sequence
  Description of Artificial Sequence: Synthetic oligonucleotide
  Target: ATXN1; (+) strand; PAM type: NRG; PAM sequence: AGG
aagtaatttgctttggttaa

SEQ ID NO: 120319 - DNA, 20 bp, Artificial Sequence
  Description of Artificial Sequence: Synthetic oligonucleotide
  Target: ATXN1; (+) strand; PAM type: NRG; PAM sequence: GGG
agtaatttgctttggttaaa

SEQ ID NO: 120320 - DNA, 20 bp, Artificial Sequence
  Description of Artificial Sequence: Synthetic oligonucleotide
  Target: ATXN1; (+) strand; PAM type: NRG; PAM sequence: TAG
tgctttggttaaagggaaat

SEQ ID NO: 120321 - DNA, 20 bp, Artificial Sequence
  Description of Artificial Sequence: Synthetic oligonucleotide
  Target: ATXN1; (+) strand; PAM type: NRG; PAM sequence: AAG
ttggttaaagggaaattagc

SEQ ID NO: 120322 - DNA, 20 bp, Artificial Sequence
  Description of Artificial Sequence: Synthetic oligonucleotide
  Target: ATXN1; (+) strand; PAM type: NRG; PAM sequence: AAG
ggaaattagcaagcatcttg

SEQ ID NO: 120323 - DNA, 20 bp, Artificial Sequence
  Description of Artificial Sequence: Synthetic oligonucleotide
  Target: ATXN1; (+) strand; PAM type: NRG; PAM sequence: CAG
aattagcaagcatcttgaag

SEQ ID NO: 120324 - DNA, 20 bp, Artificial Sequence
  Description of Artificial Sequence: Synthetic oligonucleotide
  Target: ATXN1; (+) strand; PAM type: NRG; PAM sequence: GAG
ttagcaagcatcttgaagca

SEQ ID NO: 120325 - DNA, 20 bp, Artificial Sequence
  Description of Artificial Sequence: Synthetic oligonucleotide
  Target: ATXN1; (+) strand; PAM type: NRG; PAM sequence: AAG
atcttgaagcagagcttgaa

SEQ ID NO: 120326 - DNA, 20 bp, Artificial Sequence
  Description of Artificial Sequence: Synthetic oligonucleotide
  Target: ATXN1; (+) strand; PAM type: NRG; PAM sequence: TGG
cttgaaaagcactcatgcac

SEQ ID NO: 120327 - DNA, 20 bp, Artificial Sequence
  Description of Artificial Sequence: Synthetic oligonucleotide
  Target: ATXN1; (+) strand; PAM type: NRG; PAM sequence: GGG
ttgaaaagcactcatgcact

SEQ ID NO: 120328 - DNA, 20 bp, Artificial Sequence
  Description of Artificial Sequence: Synthetic oligonucleotide
  Target: ATXN1; (+) strand; PAM type: NRG; PAM sequence: GGG
tgaaaagcactcatgcactg

SEQ ID NO: 120329 - DNA, 20 bp, Artificial Sequence
  Description of Artificial Sequence: Synthetic oligonucleotide
  Target: ATXN1; (+) strand; PAM type: NRG; PAM sequence: TGG
ttgccctttcttgctgcttt

SEQ ID NO: 120330 - DNA, 20 bp, Artificial Sequence
  Description of Artificial Sequence: Synthetic oligonucleotide
  Target: ATXN1; (+) strand; PAM type: NRG; PAM sequence: GGG
tgccctttcttgctgctttt

SEQ ID NO: 120331 - DNA, 20 bp, Artificial Sequence
  Description of Artificial Sequence: Synthetic oligonucleotide
  Target: ATXN1; (+) strand; PAM type: NRG; PAM sequence: TAG
ttgctgcttttgggaaccct

SEQ ID NO: 120332 - DNA, 20 bp, Artificial Sequence
  Description of Artificial Sequence: Synthetic oligonucleotide
  Target: ATXN1; (+) strand; PAM type: NRG; PAM sequence: AAG
ttgggaacccttagcctgca

SEQ ID NO: 120333 - DNA, 20 bp, Artificial Sequence
  Description of Artificial Sequence: Synthetic oligonucleotide
  Target: ATXN1; (+) strand; PAM type: NRG; PAM sequence: AAG
aacccttagcctgcaaagtg

SEQ ID NO: 120334 - DNA, 20 bp, Artificial Sequence
  Description of Artificial Sequence: Synthetic oligonucleotide
  Target: ATXN1; (+) strand; PAM type: NRG; PAM sequence: AAG
ccttagcctgcaaagtgaag

SEQ ID NO: 120335 - DNA, 20 bp, Artificial Sequence
  Description of Artificial Sequence: Synthetic oligonucleotide
  Target: ATXN1; (+) strand; PAM type: NRG; PAM sequence: CAG
gcctgcaaagtgaagaagct

SEQ ID NO: 120336 - DNA, 20 bp, Artificial Sequence
  Description of Artificial Sequence: Synthetic oligonucleotide
  Target: ATXN1; (+) strand; PAM type: NRG; PAM sequence: TAG
caaagtgaagaagctcagac

SEQ ID NO: 120337 - DNA, 20 bp, Artificial Sequence
  Description of Artificial Sequence: Synthetic oligonucleotide
  Target: ATXN1; (+) strand; PAM type: NRG; PAM sequence: TGG
agaagctcagactagtctac

SEQ ID NO: 120338 - DNA, 20 bp, Artificial Sequence
  Description of Artificial Sequence: Synthetic oligonucleotide
  Target: ATXN1; (+) strand; PAM type: NRG; PAM sequence: GAG
aagctcagactagtctactg

SEQ ID NO: 120339 - DNA, 20 bp, Artificial Sequence
  Description of Artificial Sequence: Synthetic oligonucleotide
  Target: ATXN1; (+) strand; PAM type: NRG; PAM sequence: AGG
agctcagactagtctactgg

SEQ ID NO: 120340 - DNA, 20 bp, Artificial Sequence
  Description of Artificial Sequence: Synthetic oligonucleotide
  Target: ATXN1; (+) strand; PAM type: NRG; PAM sequence: GAG
agactagtctactggaggat

SEQ ID NO: 120341 - DNA, 20 bp, Artificial Sequence
  Description of Artificial Sequence: Synthetic oligonucleotide
  Target: ATXN1; (+) strand; PAM type: NRG; PAM sequence: GAG
actagtctactggaggatga

SEQ ID NO: 120342 - DNA, 20 bp, Artificial Sequence
  Description of Artificial Sequence: Synthetic oligonucleotide
  Target: ATXN1; (+) strand; PAM type: NRG; PAM sequence: AGG
ctagtctactggaggatgag

SEQ ID NO: 120343 - DNA, 20 bp, Artificial Sequence
  Description of Artificial Sequence: Synthetic oligonucleotide
  Target: ATXN1; (+) strand; PAM type: NRG; PAM sequence: AAG
ggaggatgagaggccacctg

SEQ ID NO: 120344 - DNA, 20 bp, Artificial Sequence
  Description of Artificial Sequence: Synthetic oligonucleotide
  Target: ATXN1; (+) strand; PAM type: NRG; PAM sequence: CAG
ggatgagaggccacctgaag

SEQ ID NO: 120345 - DNA, 20 bp, Artificial Sequence
  Description of Artificial Sequence: Synthetic oligonucleotide
  Target: ATXN1; (+) strand; PAM type: NRG; PAM sequence: GAG
atgagaggccacctgaagca

SEQ ID NO: 120346 - DNA, 20 bp, Artificial Sequence
  Description of Artificial Sequence: Synthetic oligonucleotide
  Target: ATXN1; (+) strand; PAM type: NRG; PAM sequence: AAG
aggccacctgaagcagagac

SEQ ID NO: 120347 - DNA, 20 bp, Artificial Sequence
  Description of Artificial Sequence: Synthetic oligonucleotide
  Target: ATXN1; (+) strand; PAM type: NRG; PAM sequence: CAG
gaagcagagacaagctgtcc

SEQ ID NO: 120348 - DNA, 20 bp, Artificial Sequence
  Description of Artificial Sequence: Synthetic oligonucleotide
  Target: ATXN1; (+) strand; PAM type: NRG; PAM sequence: AAG
gagacaagctgtcccagctg

SEQ ID NO: 120349 - DNA, 20 bp, Artificial Sequence
  Description of Artificial Sequence: Synthetic oligonucleotide
  Target: ATXN1; (+) strand; PAM type: NRG; PAM sequence: CAG
gctgaagatcacccatctct

SEQ ID NO: 120350 - DNA, 20 bp, Artificial Sequence
  Description of Artificial Sequence: Synthetic oligonucleotide
  Target: ATXN1; (+) strand; PAM type: NRG; PAM sequence: AGG
ctgaagatcacccatctctc

SEQ ID NO: 120351 - DNA, 20 bp, Artificial Sequence
  Description of Artificial Sequence: Synthetic oligonucleotide
  Target: ATXN1; (+) strand; PAM type: NRG; PAM sequence: CAG
cacccatctctcaggcaaac

SEQ ID NO: 120352 - DNA, 20 bp, Artificial Sequence
  Description of Artificial Sequence: Synthetic oligonucleotide
  Target: ATXN1; (+) strand; PAM type: NRG; PAM sequence: TAG
tctcaggcaaaccagccttc

SEQ ID NO: 120353 - DNA, 20 bp, Artificial Sequence
  Description of Artificial Sequence: Synthetic oligonucleotide
  Target: ATXN1; (+) strand; PAM type: NRG; PAM sequence: TAG
caggcaaaccagccttctag

SEQ ID NO: 120354 - DNA, 20 bp, Artificial Sequence
  Description of Artificial Sequence: Synthetic oligonucleotide
  Target: ATXN1; (+) strand; PAM type: NRG; PAM sequence: GAG
cagccttctagtagctatgt

SEQ ID NO: 120355 - DNA, 20 bp, Artificial Sequence
  Description of Artificial Sequence: Synthetic oligonucleotide
  Target: ATXN1; (+) strand; PAM type: NRG; PAM sequence: GAG
cttctagtagctatgtgagt

SEQ ID NO: 120356 - DNA, 20 bp, Artificial Sequence
  Description of Artificial Sequence: Synthetic oligonucleotide
  Target: ATXN1; (+) strand; PAM type: NRG; PAM sequence: TGG
ctatgtgagtgagaccatgc

SEQ ID NO: 120357 - DNA, 20 bp, Artificial Sequence
  Description of Artificial Sequence: Synthetic oligonucleotide
  Target: ATXN1; (+) strand; PAM type: NRG; PAM sequence: CAG
tgagaccatgctggattaac

SEQ ID NO: 120358 - DNA, 20 bp, Artificial Sequence
  Description of Artificial Sequence: Synthetic oligonucleotide
  Target: ATXN1; (+) strand; PAM type: NRG; PAM sequence: CAG
catgctggattaaccagtcc

SEQ ID NO: 120359 - DNA, 20 bp, Artificial Sequence
  Description of Artificial Sequence: Synthetic oligonucleotide
  Target: ATXN1; (+) strand; PAM type: NRG; PAM sequence: AAG
tggattaaccagtcccagcc

SEQ ID NO: 120360 - DNA, 20 bp, Artificial Sequence
  Description of Artificial Sequence: Synthetic oligonucleotide
  Target: ATXN1; (+) strand; PAM type: NRG; PAM sequence: TGG
ttaaccagtcccagccaagc

SEQ ID NO: 120361 - DNA, 20 bp, Artificial Sequence
  Description of Artificial Sequence: Synthetic oligonucleotide
  Target: ATXN1; (+) strand; PAM type: NRG; PAM sequence: CAG
cagtcccagccaagctggcc

SEQ ID NO: 120362 - DNA, 20 bp, Artificial Sequence
  Description of Artificial Sequence: Synthetic oligonucleotide
  Target: ATXN1; (+) strand; PAM type: NRG; PAM sequence: TAG
caagctggcccagactaaaa

SEQ ID NO: 120363 - DNA, 20 bp, Artificial Sequence
  Description of Artificial Sequence: Synthetic oligonucleotide
  Target: ATXN1; (+) strand; PAM type: NRG; PAM sequence: CAG
tggcccagactaaaatagtc

SEQ ID NO: 120364 - DNA, 20 bp, Artificial Sequence
  Description of Artificial Sequence: Synthetic oligonucleotide
  Target: ATXN1; (+) strand; PAM type: NRG; PAM sequence: AGG
ggcccagactaaaatagtcc

SEQ ID NO: 120365 - DNA, 20 bp, Artificial Sequence
  Description of Artificial Sequence: Synthetic oligonucleotide
  Target: ATXN1; (+) strand; PAM type: NRG; PAM sequence: AAG
tccaggtgacccacaatcat

SEQ ID NO: 120366 - DNA, 20 bp, Artificial Sequence
  Description of Artificial Sequence: Synthetic oligonucleotide
  Target: ATXN1; (+) strand; PAM type: NRG; PAM sequence: TGG
gacccacaatcataagattg

SEQ ID NO: 120367 - DNA, 20 bp, Artificial Sequence
  Description of Artificial Sequence: Synthetic oligonucleotide
  Target: ATXN1; (+) strand; PAM type: NRG; PAM sequence: TGG
caatcataagattgtggtct

SEQ ID NO: 120368 - DNA, 20 bp, Artificial Sequence
  Description of Artificial Sequence: Synthetic oligonucleotide
  Target: ATXN1; (+) strand; PAM type: NRG; PAM sequence: TGG
tggtcttggcccttaactgt

SEQ ID NO: 120369 - DNA, 20 bp, Artificial Sequence
  Description of Artificial Sequence: Synthetic oligonucleotide
  Target: ATXN1; (+) strand; PAM type: NRG; PAM sequence: GGG
ggtcttggcccttaactgtt

SEQ ID NO: 120370 - DNA, 20 bp, Artificial Sequence
  Description of Artificial Sequence: Synthetic oligonucleotide
  Target: ATXN1; (+) strand; PAM type: NRG; PAM sequence: TGG
ttggcccttaactgttggga

SEQ ID NO: 120371 - DNA, 20 bp, Artificial Sequence
  Description of Artificial Sequence: Synthetic oligonucleotide
  Target: ATXN1; (+) strand; PAM type: NRG; PAM sequence: CAG
tgttgggatggcttgttaca

SEQ ID NO: 120372 - DNA, 20 bp, Artificial Sequence
  Description of Artificial Sequence: Synthetic oligonucleotide
  Target: ATXN1; (+) strand; PAM type: NRG; PAM sequence: TGG
gatacatccactttgttttc

SEQ ID NO: 120373 - DNA, 20 bp, Artificial Sequence
  Description of Artificial Sequence: Synthetic oligonucleotide
  Target: ATXN1; (+) strand; PAM type: NRG; PAM sequence: AAG
ttaacatctactcctcattc

SEQ ID NO: 120374 - DNA, 20 bp, Artificial Sequence
  Description of Artificial Sequence: Synthetic oligonucleotide
  Target: ATXN1; (+) strand; PAM type: NRG; PAM sequence: GAG
tctactcctcattcaagtct

SEQ ID NO: 120375 - DNA, 20 bp, Artificial Sequence
  Description of Artificial Sequence: Synthetic oligonucleotide
  Target: ATXN1; (+) strand; PAM type: NRG; PAM sequence: AGG
ctactcctcattcaagtctg

SEQ ID NO: 120376 - DNA, 20 bp, Artificial Sequence
  Description of Artificial Sequence: Synthetic oligonucleotide
  Target: ATXN1; (+) strand; PAM type: NRG; PAM sequence: AAG
tcattcaagtctgaggatga

SEQ ID NO: 120377 - DNA, 20 bp, Artificial Sequence
  Description of Artificial Sequence: Synthetic oligonucleotide
  Target: ATXN1; (+) strand; PAM type: NRG; PAM sequence: CAG
gatgaaagcttccctgatcc

SEQ ID NO: 120378 - DNA, 20 bp, Artificial Sequence
  Description of Artificial Sequence: Synthetic oligonucleotide
  Target: ATXN1; (+) strand; PAM type: NRG; PAM sequence: AAG
gaaagcttccctgatcccag

SEQ ID NO: 120379 - DNA, 20 bp, Artificial Sequence
  Description of Artificial Sequence: Synthetic oligonucleotide
  Target: ATXN1; (+) strand; PAM type: NRG; PAM sequence: TGG
gatcccagaagatgccatgc

SEQ ID NO: 120380 - DNA, 20 bp, Artificial Sequence
  Description of Artificial Sequence: Synthetic oligonucleotide
  Target: ATXN1; (+) strand; PAM type: NRG; PAM sequence: TGG
gccatgctggtctgcatcca

SEQ ID NO: 120381 - DNA, 20 bp, Artificial Sequence
  Description of Artificial Sequence: Synthetic oligonucleotide
  Target: ATXN1; (+) strand; PAM type: NRG; PAM sequence: TGG
tctgcatccatggcaacctg

SEQ ID NO: 120382 - DNA, 20 bp, Artificial Sequence
  Description of Artificial Sequence: Synthetic oligonucleotide
  Target: ATXN1; (+) strand; PAM type: NRG; PAM sequence: GGG
ctgcatccatggcaacctgt

SEQ ID NO: 120383 - DNA, 20 bp, Artificial Sequence
  Description of Artificial Sequence: Synthetic oligonucleotide
  Target: ATXN1; (+) strand; PAM type: NRG; PAM sequence: TAG
tggcaacctgtgggtaccat

SEQ ID NO: 120384 - DNA, 20 bp, Artificial Sequence
  Description of Artificial Sequence: Synthetic oligonucleotide
  Target: ATXN1; (+) strand; PAM type: NRG; PAM sequence: AGG
ggcaacctgtgggtaccatt

SEQ ID NO: 120385 - DNA, 20 bp, Artificial Sequence
  Description of Artificial Sequence: Synthetic oligonucleotide
  Target: ATXN1; (+) strand; PAM type: NRG; PAM sequence: GAG
caacctgtgggtaccattag

SEQ ID NO: 120386 - DNA, 20 bp, Artificial Sequence
  Description of Artificial Sequence: Synthetic oligonucleotide
  Target: ATXN1; (+) strand; PAM type: NRG; PAM sequence: GAG
acctgtgggtaccattagga

SEQ ID NO: 120387 - DNA, 20 bp, Artificial Sequence
  Description of Artificial Sequence: Synthetic oligonucleotide
  Target: ATXN1; (+) strand; PAM type: NRG; PAM sequence: GAG
ctgtgggtaccattaggaga

SEQ ID NO: 120388 - DNA, 20 bp, Artificial Sequence
  Description of Artificial Sequence: Synthetic oligonucleotide
  Target: ATXN1; (+) strand; PAM type: NRG; PAM sequence: TGG
gggtaccattaggagagagc

SEQ ID NO: 120389 - DNA, 20 bp, Artificial Sequence
  Description of Artificial Sequence: Synthetic oligonucleotide
  Target: ATXN1; (+) strand; PAM type: NRG; PAM sequence: TGG
cattaggagagagctggtca

SEQ ID NO: 120390 - DNA, 20 bp, Artificial Sequence
  Description of Artificial Sequence: Synthetic oligonucleotide
  Target: ATXN1; (+) strand; PAM type: NRG; PAM sequence: AAG
agagagctggtcatggtgta

SEQ ID NO: 120391 - DNA, 20 bp, Artificial Sequence
  Description of Artificial Sequence: Synthetic oligonucleotide
  Target: ATXN1; (+) strand; PAM type: NRG; PAM sequence: AGG
gagagctggtcatggtgtaa

SEQ ID NO: 120392 - DNA, 20 bp, Artificial Sequence
  Description of Artificial Sequence: Synthetic oligonucleotide
  Target: ATXN1; (+) strand; PAM type: NRG; PAM sequence: CAG
tgttttctcatttctttccc

SEQ ID NO: 120393 - DNA, 20 bp, Artificial Sequence
  Description of Artificial Sequence: Synthetic oligonucleotide
  Target: ATXN1; (+) strand; PAM type: NRG; PAM sequence: AAG
tttctttccccagtgactga

SEQ ID NO: 120394 - DNA, 20 bp, Artificial Sequence
  Description of Artificial Sequence: Synthetic oligonucleotide
  Target: ATXN1; (+) strand; PAM type: NRG; PAM sequence: TAG
gaaagctcctttaactactg

SEQ ID NO: 120395 - DNA, 20 bp, Artificial Sequence
  Description of Artificial Sequence: Synthetic oligonucleotide
  Target: ATXN1; (+) strand; PAM type: NRG; PAM sequence: AGG
aaagctcctttaactactgt

SEQ ID NO: 120396 - DNA, 20 bp, Artificial Sequence
  Description of Artificial Sequence: Synthetic oligonucleotide
  Target: ATXN1; (+) strand; PAM type: NRG; PAM sequence: TAG
ctttaactactgtaggtgcc

SEQ ID NO: 120397 - DNA, 20 bp, Artificial Sequence
  Description of Artificial Sequence: Synthetic oligonucleotide
  Target: ATXN1; (+) strand; PAM type: NRG; PAM sequence: TAG
tactgtaggtgcctagcctg

SEQ ID NO: 120398 - DNA, 20 bp, Artificial Sequence
  Description of Artificial Sequence: Synthetic oligonucleotide
  Target: ATXN1; (+) strand; PAM type: NRG; PAM sequence: AAG
tttctgtaaatatttgctga

SEQ ID NO: 120399 - DNA, 20 bp, Artificial Sequence
  Description of Artificial Sequence: Synthetic oligonucleotide
  Target: ATXN1; (+) strand; PAM type: NRG; PAM sequence: AAG
ctgtaaatatttgctgaaag

SEQ ID NO: 120400 - DNA, 20 bp, Artificial Sequence
  Description of Artificial Sequence: Synthetic oligonucleotide
  Target: ATXN1; (+) strand; PAM type: NRG; PAM sequence: AAG
tatttgctgaaagaagatac

SEQ ID NO: 120401 - DNA, 20 bp, Artificial Sequence
  Description of Artificial Sequence: Synthetic oligonucleotide
  Target: ATXN1; (+) strand; PAM type: NRG; PAM sequence: TAG
tgaaagaagatacaagaatg

SEQ ID NO: 120402 - DNA, 20 bp, Artificial Sequence
  Description of Artificial Sequence: Synthetic oligonucleotide
  Target: ATXN1; (+) strand; PAM type: NRG; PAM sequence: CAG
agaatgtagatatccatctt

SEQ ID NO: 120403 - DNA, 20 bp, Artificial Sequence
  Description of Artificial Sequence: Synthetic oligonucleotide
  Target: ATXN1; (+) strand; PAM type: NRG; PAM sequence: AGG
gaatgtagatatccatcttc

SEQ ID NO: 120404 - DNA, 20 bp, Artificial Sequence
  Description of Artificial Sequence: Synthetic oligonucleotide
  Target: ATXN1; (+) strand; PAM type: NRG; PAM sequence: AAG
ttcttctatcctaaatttca

SEQ ID NO: 120405 - DNA, 20 bp, Artificial Sequence
  Description of Artificial Sequence: Synthetic oligonucleotide
  Target: ATXN1; (+) strand; PAM type: NRG; PAM sequence: TAG
tatcctaaatttcaaagaat

SEQ ID NO: 120406 - DNA, 20 bp, Artificial Sequence
  Description of Artificial Sequence: Synthetic oligonucleotide
  Target: ATXN1; (+) strand; PAM type: NRG; PAM sequence: TAG
taaatttcaaagaattagac

SEQ ID NO: 120407 - DNA, 20 bp, Artificial Sequence
  Description of Artificial Sequence: Synthetic oligonucleotide
  Target: ATXN1; (+) strand; PAM type: NRG; PAM sequence: TAG
tgtttttacctatcaccacc

SEQ ID NO: 120408 - DNA, 20 bp, Artificial Sequence
  Description of Artificial Sequence: Synthetic oligonucleotide
  Target: ATXN1; (+) strand; PAM type: NRG; PAM sequence: CGG
tacctatcaccacctagaca

SEQ ID NO: 120409 - DNA, 20 bp, Artificial Sequence
  Description of Artificial Sequence: Synthetic oligonucleotide
  Target: ATXN1; (+) strand; PAM type: NRG; PAM sequence: CAG
attttaatgttttacttttt

SEQ ID NO: 120410 - DNA, 20 bp, Artificial Sequence
  Description of Artificial Sequence: Synthetic oligonucleotide
  Target: ATXN1; (+) strand; PAM type: NRG; PAM sequence: GAG
tttaatgttttactttttca

SEQ ID NO: 120411 - DNA, 20 bp, Artificial Sequence
  Description of Artificial Sequence: Synthetic oligonucleotide
  Target: ATXN1; (+) strand; PAM type: NRG; PAM sequence: CAG
cagagttctactcatatcaa

SEQ ID NO: 120412 - DNA, 20 bp, Artificial Sequence
  Description of Artificial Sequence: Synthetic oligonucleotide
  Target: ATXN1; (+) strand; PAM type: NRG; PAM sequence: TGG
ctactcatatcaacagcctt

SEQ ID NO: 120413 - DNA, 20 bp, Artificial Sequence
  Description of Artificial Sequence: Synthetic oligonucleotide
  Target: ATXN1; (+) strand; PAM type: NRG; PAM sequence: GGG
tactcatatcaacagccttt

SEQ ID NO: 120414 - DNA, 20 bp, Artificial Sequence
  Description of Artificial Sequence: Synthetic oligonucleotide
  Target: ATXN1; (+) strand; PAM type: NRG; PAM sequence: TAG
gaatctccctactcctttta

SEQ ID NO: 120415 - DNA, 20 bp, Artificial Sequence
  Description of Artificial Sequence: Synthetic oligonucleotide
  Target: ATXN1; (+) strand; PAM type: NRG; PAM sequence: GAG
tccctactccttttatagat

SEQ ID NO: 120416 - DNA, 20 bp, Artificial Sequence
  Description of Artificial Sequence: Synthetic oligonucleotide
  Target: ATXN1; (+) strand; PAM type: NRG; PAM sequence: TAG
ttttatagatgagactatta

SEQ ID NO: 120417 - DNA, 20 bp, Artificial Sequence
  Description of Artificial Sequence: Synthetic oligonucleotide
  Target: ATXN1; (+) strand; PAM type: NRG; PAM sequence: CAG
tccaaactcactgtgccttt

SEQ ID NO: 120418 - DNA, 20 bp, Artificial Sequence
  Description of Artificial Sequence: Synthetic oligonucleotide
  Target: ATXN1; (+) strand; PAM type: NRG; PAM sequence: AAG
taaaattcacctaaaattcc

SEQ ID NO: 120419 - DNA, 20 bp, Artificial Sequence
  Description of Artificial Sequence: Synthetic oligonucleotide
  Target: ATXN1; (+) strand; PAM type: NRG; PAM sequence: AGG
aaaattcacctaaaattcca

SEQ ID NO: 120420 - DNA, 20 bp, Artificial Sequence
  Description of Artificial Sequence: Synthetic oligonucleotide
  Target: ATXN1; (+) strand; PAM type: NRG; PAM sequence: GGG
aaattcacctaaaattccaa

SEQ ID NO: 120421 - DNA, 20 bp, Artificial Sequence
  Description of Artificial Sequence: Synthetic oligonucleotide
  Target: ATXN1; (+) strand; PAM type: NRG; PAM sequence: CAG
cctaaaattccaagggccct

SEQ ID NO: 120422 - DNA, 20 bp, Artificial Sequence
  Description of Artificial Sequence: Synthetic oligonucleotide
  Target: ATXN1; (+) strand; PAM type: NRG; PAM sequence: TGG
gggccctcagcatatgcaca

SEQ ID NO: 120423 - DNA, 20 bp, Artificial Sequence
  Description of Artificial Sequence: Synthetic oligonucleotide
  Target: ATXN1; (+) strand; PAM type: NRG; PAM sequence: AAG
tattctactatatacatgtc

SEQ ID NO: 120424 - DNA, 20 bp, Artificial Sequence
  Description of Artificial Sequence: Synthetic oligonucleotide
  Target: ATXN1; (+) strand; PAM type: NRG; PAM sequence: AGG
attctactatatacatgtca

SEQ ID NO: 120425 - DNA, 20 bp, Artificial Sequence
  Description of Artificial Sequence: Synthetic oligonucleotide
  Target: ATXN1; (+) strand; PAM type: NRG; PAM sequence: AAG
ctactatatacatgtcaagg

SEQ ID NO: 120426 - DNA, 20 bp, Artificial Sequence
  Description of Artificial Sequence: Synthetic oligonucleotide
  Target: ATXN1; (+) strand; PAM type: NRG; PAM sequence: CAG
ctatatacatgtcaaggaag

SEQ ID NO: 120427 - DNA, 20 bp, Artificial Sequence
  Description of Artificial Sequence: Synthetic oligonucleotide
  Target: ATXN1; (+) strand; PAM type: NRG; PAM sequence: AAG
tatacatgtcaaggaagcag

SEQ ID NO: 120428 - DNA, 20 bp, Artificial Sequence
  Description of Artificial Sequence: Synthetic oligonucleotide
  Target: ATXN1; (+) strand; PAM type: NRG; PAM sequence: AGG
atacatgtcaaggaagcaga

SEQ ID NO: 120429 - DNA, 20 bp, Artificial Sequence
  Description of Artificial Sequence: Synthetic oligonucleotide
  Target: ATXN1; (+) strand; PAM type: NRG; PAM sequence: CAG
tacataaccgaattcactgt

SEQ ID NO: 120430 - DNA, 20 bp, Artificial Sequence
  Description of Artificial Sequence: Synthetic oligonucleotide
  Target: ATXN1; (+) strand; PAM type: NRG; PAM sequence: CAG
tgtcagtgtaatgacaatga

SEQ ID NO: 120431 - DNA, 20 bp, Artificial Sequence
  Description of Artificial Sequence: Synthetic oligonucleotide
  Target: ATXN1; (+) strand; PAM type: NRG; PAM sequence: TAG
gttaatgacaactcctatta

SEQ ID NO: 120432 - DNA, 20 bp, Artificial Sequence
  Description of Artificial Sequence: Synthetic oligonucleotide
  Target: ATXN1; (+) strand; PAM type: NRG; PAM sequence: CAG
aatgacaactcctattatag

SEQ ID NO: 120433 - DNA, 20 bp, Artificial Sequence
  Description of Artificial Sequence: Synthetic oligonucleotide
  Target: ATXN1; (+) strand; PAM type: NRG; PAM sequence: AAG
gcagaaatgtctctacaaca

SEQ ID NO: 120434 - DNA, 20 bp, Artificial Sequence
  Description of Artificial Sequence: Synthetic oligonucleotide
  Target: ATXN1; (+) strand; PAM type: NRG; PAM sequence: GAG
agaaatgtctctacaacaaa

SEQ ID NO: 120435 - DNA, 20 bp, Artificial Sequence
  Description of Artificial Sequence: Synthetic oligonucleotide
  Target: ATXN1; (+) strand; PAM type: NRG; PAM sequence: GAG
tgtctctacaacaaagagat

SEQ ID NO: 120436 - DNA, 20 bp, Artificial Sequence
  Description of Artificial Sequence: Synthetic oligonucleotide
  Target: ATXN1; (+) strand; PAM type: NRG; PAM sequence: AAG
tctacaacaaagagatgagc

SEQ ID NO: 120437 - DNA, 20 bp, Artificial Sequence
  Description of Artificial Sequence: Synthetic oligonucleotide
  Target: ATXN1; (+) strand; PAM type: NRG; PAM sequence: CAG
aactgctcacctgttcactt

SEQ ID NO: 120438 - DNA, 20 bp, Artificial Sequence
  Description of Artificial Sequence: Synthetic oligonucleotide
  Target: ATXN1; (+) strand; PAM type: NRG; PAM sequence: TAG
acttcagcaacgcatcatga

SEQ ID NO: 120439 - DNA, 20 bp, Artificial Sequence
  Description of Artificial Sequence: Synthetic oligonucleotide
  Target: ATXN1; (+) strand; PAM type: NRG; PAM sequence: CAG
ttgtgtgaaatttatcataa

SEQ ID NO: 120440 - DNA, 20 bp, Artificial Sequence
  Description of Artificial Sequence: Synthetic oligonucleotide
  Target: ATXN1; (+) strand; PAM type: NRG; PAM sequence: TGG
aatttatcataacagcatca

SEQ ID NO: 120441 - DNA, 20 bp, Artificial Sequence
  Description of Artificial Sequence: Synthetic oligonucleotide
  Target: ATXN1; (+) strand; PAM type: NRG; PAM sequence: CAG
taacagcatcatggctgcca

SEQ ID NO: 120442 - DNA, 20 bp, Artificial Sequence
  Description of Artificial Sequence: Synthetic oligonucleotide
  Target: ATXN1; (+) strand; PAM type: NRG; PAM sequence: TAG
atcatggctgccacagttat

SEQ ID NO: 120443 - DNA, 20 bp, Artificial Sequence
  Description of Artificial Sequence: Synthetic oligonucleotide
  Target: ATXN1; (+) strand; PAM type: NRG; PAM sequence: AGG
tcatggctgccacagttatt

SEQ ID NO: 120444 - DNA, 20 bp, Artificial Sequence
  Description of Artificial Sequence: Synthetic oligonucleotide
  Target: ATXN1; (+) strand; PAM type: NRG; PAM sequence: GGG
catggctgccacagttatta

SEQ ID NO: 120445 - DNA, 20 bp, Artificial Sequence
  Description of Artificial Sequence: Synthetic oligonucleotide
  Target: ATXN1; (+) strand; PAM type: NRG; PAM sequence: GAG
tggctgccacagttattagg

SEQ ID NO: 120446 - DNA, 20 bp, Artificial Sequence
  Description of Artificial Sequence: Synthetic oligonucleotide
  Target: ATXN1; (+) strand; PAM type: NRG; PAM sequence: TGG
agttattagggagcaatcac

SEQ ID NO: 120447 - DNA, 20 bp, Artificial Sequence
  Description of Artificial Sequence: Synthetic oligonucleotide
  Target: ATXN1; (+) strand; PAM type: NRG; PAM sequence: GGG
gttattagggagcaatcact

SEQ ID NO: 120448 - DNA, 20 bp, Artificial Sequence
  Description of Artificial Sequence: Synthetic oligonucleotide
  Target: ATXN1; (+) strand; PAM type: NRG; PAM sequence: CAG
tcactgggctaaaaacttaa

SEQ ID NO: 120449 - DNA, 20 bp, Artificial Sequence
  Description of Artificial Sequence: Synthetic oligonucleotide
  Target: ATXN1; (+) strand; PAM type: NRG; PAM sequence: CAG
atcgcatttaactctcttaa

SEQ ID NO: 120450 - DNA, 20 bp, Artificial Sequence
  Description of Artificial Sequence: Synthetic oligonucleotide
  Target: ATXN1; (+) strand; PAM type: NRG; PAM sequence: AGG
tcgcatttaactctcttaac

SEQ ID NO: 120451 - DNA, 20 bp, Artificial Sequence
  Description of Artificial Sequence: Synthetic oligonucleotide
  Target: ATXN1; (+) strand; PAM type: NRG; PAM sequence: CAG
taactctcttaacaggtcat

SEQ ID NO: 120452 - DNA, 20 bp, Artificial Sequence
  Description of Artificial Sequence: Synthetic oligonucleotide
  Target: ATXN1; (+) strand; PAM type: NRG; PAM sequence: AGG
aactctcttaacaggtcatc

SEQ ID NO: 120453 - DNA, 20 bp, Artificial Sequence
  Description of Artificial Sequence: Synthetic oligonucleotide
  Target: ATXN1; (+) strand; PAM type: NRG; PAM sequence: GGG
actctcttaacaggtcatca

SEQ ID NO: 120454 - DNA, 20 bp, Artificial Sequence
  Description of Artificial Sequence: Synthetic oligonucleotide
  Target: ATXN1; (+) strand; PAM type: NRG; PAM sequence: TAG
ctcttaacaggtcatcaggg

SEQ ID NO: 120455 - DNA, 20 bp, Artificial Sequence
  Description of Artificial Sequence: Synthetic oligonucleotide
  Target: ATXN1; (+) strand; PAM type: NRG; PAM sequence: AGG
tcttaacaggtcatcagggt

SEQ ID NO: 120456 - DNA, 20 bp, Artificial Sequence
  Description of Artificial Sequence: Synthetic oligonucleotide
  Target: ATXN1; (+) strand; PAM type: NRG; PAM sequence: TGG
acaggtcatcagggtaggtg

SEQ ID NO: 120457 - DNA, 20 bp, Artificial Sequence
  Description of Artificial Sequence: Synthetic oligonucleotide
  Target: ATXN1; (+) strand; PAM type: NRG; PAM sequence: CAG
gtcatcagggtaggtgtggt

SEQ ID NO: 120458 - DNA, 20 bp, Artificial Sequence
  Description of Artificial Sequence: Synthetic oligonucleotide
  Target: ATXN1; (+) strand; PAM type: NRG; PAM sequence: TAG
gtgtggtcagaccttcttta

SEQ ID NO: 120459 - DNA, 20 bp, Artificial Sequence
  Description of Artificial Sequence: Synthetic oligonucleotide
  Target: ATXN1; (+) strand; PAM type: NRG; PAM sequence: AAG
tcagaccttctttatagatg

SEQ ID NO: 120460 - DNA, 20 bp, Artificial Sequence
  Description of Artificial Sequence: Synthetic oligonucleotide
  Target: ATXN1; (+) strand; PAM type: NRG; PAM sequence: AAG
tctttatagatgaagtaaat

SEQ ID NO: 120461 - DNA, 20 bp, Artificial Sequence
  Description of Artificial Sequence: Synthetic oligonucleotide
  Target: ATXN1; (+) strand; PAM type: NRG; PAM sequence: AGG
ctttatagatgaagtaaata

SEQ ID NO: 120462 - DNA, 20 bp, Artificial Sequence
  Description of Artificial Sequence: Synthetic oligonucleotide
  Target: ATXN1; (+) strand; PAM type: NRG; PAM sequence: CAG
tagatgaagtaaataaggct

SEQ ID NO: 120463 - DNA, 20 bp, Artificial Sequence
  Description of Artificial Sequence: Synthetic oligonucleotide
  Target: ATXN1; (+) strand; PAM type: NRG; PAM sequence: GAG
gatgaagtaaataaggctca

SEQ ID NO: 120464 - DNA, 20 bp, Artificial Sequence
  Description of Artificial Sequence: Synthetic oligonucleotide
  Target: ATXN1; (+) strand; PAM type: NRG; PAM sequence: AAG
gaagtaaataaggctcagag

SEQ ID NO: 120465 - DNA, 20 bp, Artificial Sequence
  Description of Artificial Sequence: Synthetic oligonucleotide
  Target: ATXN1; (+) strand; PAM type: NRG; PAM sequence: TGG
taaataaggctcagagaagt

SEQ ID NO: 120466 - DNA, 20 bp, Artificial Sequence
  Description of Artificial Sequence: Synthetic oligonucleotide
  Target: ATXN1; (+) strand; PAM type: NRG; PAM sequence: GGG
aaataaggctcagagaagtt

SEQ ID NO: 120467 - DNA, 20 bp, Artificial Sequence
  Description of Artificial Sequence: Synthetic oligonucleotide
  Target: ATXN1; (+) strand; PAM type: NRG; PAM sequence: AAG
agaagttgggcaatttccca

SEQ ID NO: 120468 - DNA, 20 bp, Artificial Sequence
  Description of Artificial Sequence: Synthetic oligonucleotide
  Target: ATXN1; (+) strand; PAM type: NRG; PAM sequence: AGG
gaagttgggcaatttcccaa

SEQ ID NO: 120469 - DNA, 20 bp, Artificial Sequence
  Description of Artificial Sequence: Synthetic oligonucleotide
  Target: ATXN1; (+) strand; PAM type: NRG; PAM sequence: CAG
gcaatttcccaaaggacaca

SEQ ID NO: 120470 - DNA, 20 bp, Artificial Sequence
  Description of Artificial Sequence: Synthetic oligonucleotide
  Target: ATXN1; (+) strand; PAM type: NRG; PAM sequence: TGG
cccaaaggacacacagctac

SEQ ID NO: 120471 - DNA, 20 bp, Artificial Sequence
  Description of Artificial Sequence: Synthetic oligonucleotide
  Target: ATXN1; (+) strand; PAM type: NRG; PAM sequence: GGG
ccaaaggacacacagctact

SEQ ID NO: 120472 - DNA, 20 bp, Artificial Sequence
  Description of Artificial Sequence: Synthetic oligonucleotide
  Target: ATXN1; (+) strand; PAM type: NRG; PAM sequence: TGG
aaggacacacagctactggg

SEQ ID NO: 120473 - DNA, 20 bp, Artificial Sequence
  Description of Artificial Sequence: Synthetic oligonucleotide
  Target: ATXN1; (+) strand; PAM type: NRG; PAM sequence: CAG
gacacacagctactgggtgg

SEQ ID NO: 120474 - DNA, 20 bp, Artificial Sequence
  Description of Artificial Sequence: Synthetic oligonucleotide
  Target: ATXN1; (+) strand; PAM type: NRG; PAM sequence: AGG
acacacagctactgggtggc

SEQ ID NO: 120475 - DNA, 20 bp, Artificial Sequence
  Description of Artificial Sequence: Synthetic oligonucleotide
  Target: ATXN1; (+) strand; PAM type: NRG; PAM sequence: AAG
ctgaacccaaatgtgattca

SEQ ID NO: 120476 - DNA, 20 bp, Artificial Sequence
  Description of Artificial Sequence: Synthetic oligonucleotide
  Target: ATXN1; (+) strand; PAM type: NRG; PAM sequence: GAG
gaacccaaatgtgattcaaa

SEQ ID NO: 120477 - DNA, 20 bp, Artificial Sequence
  Description of Artificial Sequence: Synthetic oligonucleotide
  Target: ATXN1; (+) strand; PAM type: NRG; PAM sequence: AAG
actttaaatctgatgctgtt

SEQ ID NO: 120478 - DNA, 20 bp, Artificial Sequence
  Description of Artificial Sequence: Synthetic oligonucleotide
  Target: ATXN1; (+) strand; PAM type: NRG; PAM sequence: TGG
ttaaatctgatgctgttaag

SEQ ID NO: 120479 - DNA, 20 bp, Artificial Sequence
  Description of Artificial Sequence: Synthetic oligonucleotide
  Target: ATXN1; (+) strand; PAM type: NRG; PAM sequence: CAG
aatctgatgctgttaagtgg

SEQ ID NO: 120480 - DNA, 20 bp, Artificial Sequence
  Description of Artificial Sequence: Synthetic oligonucleotide
  Target: ATXN1; (+) strand; PAM type: NRG; PAM sequence: TGG
cagtgataatgatcttcctt

SEQ ID NO: 120481 - DNA, 20 bp, Artificial Sequence
  Description of Artificial Sequence: Synthetic oligonucleotide
  Target: ATXN1; (+) strand; PAM type: NRG; PAM sequence: AAG
tgataatgatcttcctttgg

SEQ ID NO: 120482 - DNA, 20 bp, Artificial Sequence
  Description of Artificial Sequence: Synthetic oligonucleotide
  Target: ATXN1; (+) strand; PAM type: NRG; PAM sequence: AAG
atgatcttcctttggaagat

SEQ ID NO: 120483 - DNA, 20 bp, Artificial Sequence
  Description of Artificial Sequence: Synthetic oligonucleotide
  Target: ATXN1; (+) strand; PAM type: NRG; PAM sequence: AGG
tgatcttcctttggaagata

SEQ ID NO: 120484 - DNA, 20 bp, Artificial Sequence
  Description of Artificial Sequence: Synthetic oligonucleotide
  Target: ATXN1; (+) strand; PAM type: NRG; PAM sequence: TAG
tcctttggaagataaggaaa

SEQ ID NO: 120485 - DNA, 20 bp, Artificial Sequence
  Description of Artificial Sequence: Synthetic oligonucleotide
  Target: ATXN1; (+) strand; PAM type: NRG; PAM sequence: GAG
ctttggaagataaggaaata

SEQ ID NO: 120486 - DNA, 20 bp, Artificial Sequence
  Description of Artificial Sequence: Synthetic oligonucleotide
  Target: ATXN1; (+) strand; PAM type: NRG; PAM sequence: AGG
tttggaagataaggaaatag

SEQ ID NO: 120487 - DNA, 20 bp, Artificial Sequence
  Description of Artificial Sequence: Synthetic oligonucleotide
  Target: ATXN1; (+) strand; PAM type: NRG; PAM sequence: CAG
gataaggaaatagaggcacc

SEQ ID NO: 120488 - DNA, 20 bp, Artificial Sequence
  Description of Artificial Sequence: Synthetic oligonucleotide
  Target: ATXN1; (+) strand; PAM type: NRG; PAM sequence: TAG
aggaaatagaggcacccaga

SEQ ID NO: 120489 - DNA, 20 bp, Artificial Sequence
  Description of Artificial Sequence: Synthetic oligonucleotide
  Target: ATXN1; (+) strand; PAM type: NRG; PAM sequence: GAG
gaaatagaggcacccagata

SEQ ID NO: 120490 - DNA, 20 bp, Artificial Sequence
  Description of Artificial Sequence: Synthetic oligonucleotide
  Target: ATXN1; (+) strand; PAM type: NRG; PAM sequence: GAG
aatagaggcacccagataga

SEQ ID NO: 120491 - DNA, 20 bp, Artificial Sequence
  Description of Artificial Sequence: Synthetic oligonucleotide
  Target: ATXN1; (+) strand; PAM type: NRG; PAM sequence: TAG
agaggcacccagatagagag

SEQ ID NO: 120492 - DNA, 20 bp, Artificial Sequence
  Description of Artificial Sequence: Synthetic oligonucleotide
  Target: ATXN1; (+) strand; PAM type: NRG; PAM sequence: TGG
gatagagagtagcttgccac

SEQ ID NO: 120493 - DNA, 20 bp, Artificial Sequence
  Description of Artificial Sequence: Synthetic oligonucleotide
  Target: ATXN1; (+) strand; PAM type: NRG; PAM sequence: AAG
gtagcttgccactggtctaa

SEQ ID NO: 120494 - DNA, 20 bp, Artificial Sequence
  Description of Artificial Sequence: Synthetic oligonucleotide
  Target: ATXN1; (+) strand; PAM type: NRG; PAM sequence: AGG
tagcttgccactggtctaaa

SEQ ID NO: 120495 - DNA, 20 bp, Artificial Sequence
  Description of Artificial Sequence: Synthetic oligonucleotide
  Target: ATXN1; (+) strand; PAM type: NRG; PAM sequence: GGG
agcttgccactggtctaaaa

SEQ ID NO: 120496 - DNA, 20 bp, Artificial Sequence
  Description of Artificial Sequence: Synthetic oligonucleotide
  Target: ATXN1; (+) strand; PAM type: NRG; PAM sequence: CAG
ttgccactggtctaaaaggg

SEQ ID NO: 120497 - DNA, 20 bp, Artificial Sequence
  Description of Artificial Sequence: Synthetic oligonucleotide
  Target: ATXN1; (+) strand; PAM type: NRG; PAM sequence: AGG
tgccactggtctaaaagggc

SEQ ID NO: 120498 - DNA, 20 bp, Artificial Sequence
  Description of Artificial Sequence: Synthetic oligonucleotide
  Target: ATXN1; (+) strand; PAM type: NRG; PAM sequence: GGG
gccactggtctaaaagggca

SEQ ID NO: 120499 - DNA, 20 bp, Artificial Sequence
  Description of Artificial Sequence: Synthetic oligonucleotide
  Target: ATXN1; (+) strand; PAM type: NRG; PAM sequence: TGG
ctggtctaaaagggcaggga

SEQ ID NO: 120500 - DNA, 20 bp, Artificial Sequence
  Description of Artificial Sequence: Synthetic oligonucleotide
  Target: ATXN1; (+) strand; PAM type: NRG; PAM sequence: GGG
tggtctaaaagggcagggat

SEQ ID NO: 120501 - DNA, 20 bp, Artificial Sequence
  Description of Artificial Sequence: Synthetic oligonucleotide
  Target: ATXN1; (+) strand; PAM type: NRG; PAM sequence: AAG
tctaaaagggcagggatggg

SEQ ID NO: 120502 - DNA, 20 bp, Artificial Sequence
  Description of Artificial Sequence: Synthetic oligonucleotide
  Target: ATXN1; (+) strand; PAM type: NRG; PAM sequence: GAG
taaaagggcagggatgggaa

SEQ ID NO: 120503 - DNA, 20 bp, Artificial Sequence
  Description of Artificial Sequence: Synthetic oligonucleotide
  Target: ATXN1; (+) strand; PAM type: NRG; PAM sequence: CAG
gcagggatgggaagagaacc

SEQ ID NO: 120504 - DNA, 20 bp, Artificial Sequence
  Description of Artificial Sequence: Synthetic oligonucleotide
  Target: ATXN1; (+) strand; PAM type: NRG; PAM sequence: AGG
cagggatgggaagagaaccc

SEQ ID NO: 120505 - DNA, 20 bp, Artificial Sequence
  Description of Artificial Sequence: Synthetic oligonucleotide
  Target: ATXN1; (+) strand; PAM type: NRG; PAM sequence: TAG
agaacccaggtgtcccttct

SEQ ID NO: 120506 - DNA, 20 bp, Artificial Sequence
  Description of Artificial Sequence: Synthetic oligonucleotide
  Target: ATXN1; (+) strand; PAM type: NRG; PAM sequence: GAG
caggtgtcccttcttagcct

SEQ ID NO: 120507 - DNA, 20 bp, Artificial Sequence
  Description of Artificial Sequence: Synthetic oligonucleotide
  Target: ATXN1; (+) strand; PAM type: NRG; PAM sequence: AGG
aggtgtcccttcttagcctg

SEQ ID NO: 120508 - DNA, 20 bp, Artificial Sequence
  Description of Artificial Sequence: Synthetic oligonucleotide
  Target: ATXN1; (+) strand; PAM type: NRG; PAM sequence: TGG
tagcctgaggttcctgctac

SEQ ID NO: 120509 - DNA, 20 bp, Artificial Sequence
  Description of Artificial Sequence: Synthetic oligonucleotide
  Target: ATXN1; (+) strand; PAM type: NRG; PAM sequence: CAG
ctgaggttcctgctactgga

SEQ ID NO: 120510 - DNA, 20 bp, Artificial Sequence
  Description of Artificial Sequence: Synthetic oligonucleotide
  Target: ATXN1; (+) strand; PAM type: NRG; PAM sequence: GAG
gaggttcctgctactggaca

SEQ ID NO: 120511 - DNA, 20 bp, Artificial Sequence
  Description of Artificial Sequence: Synthetic oligonucleotide
  Target: ATXN1; (+) strand; PAM type: NRG; PAM sequence: AAG
cctgctactggacagagccc

SEQ ID NO: 120512 - DNA, 20 bp, Artificial Sequence
  Description of Artificial Sequence: Synthetic oligonucleotide
  Target: ATXN1; (+) strand; PAM type: NRG; PAM sequence: AGG
ctgctactggacagagccca

SEQ ID NO: 120513 - DNA, 20 bp, Artificial Sequence
  Description of Artificial Sequence: Synthetic oligonucleotide
  Target: ATXN1; (+) strand; PAM type: NRG; PAM sequence: TAG
aggtgtccctatcttctcct

SEQ ID NO: 120514 - DNA, 20 bp, Artificial Sequence
  Description of Artificial Sequence: Synthetic oligonucleotide
  Target: ATXN1; (+) strand; PAM type: NRG; PAM sequence: GAG
ttactttttttttttttttt

SEQ ID NO: 120515 - DNA, 20 bp, Artificial Sequence
  Description of Artificial Sequence: Synthetic oligonucleotide
  Target: ATXN1; (+) strand; PAM type: NRG; PAM sequence: TGG
ttttttttttttttttgaga

SEQ ID NO: 120516 - DNA, 20 bp, Artificial Sequence
  Description of Artificial Sequence: Synthetic oligonucleotide
  Target: ATXN1; (+) strand; PAM type: NRG; PAM sequence: GAG
ttttttttttttttgagatg

SEQ ID NO: 120517 - DNA, 20 bp, Artificial Sequence
  Description of Artificial Sequence: Synthetic oligonucleotide
  Target: ATXN1; (+) strand; PAM type: NRG; PAM sequence: CAG
tggagtctcactctgttacc

SEQ ID NO: 120518 - DNA, 20 bp, Artificial Sequence
  Description of Artificial Sequence: Synthetic oligonucleotide
  Target: ATXN1; (+) strand; PAM type: NRG; PAM sequence: TGG
tctcactctgttacccagac

SEQ ID NO: 120519 - DNA, 20 bp, Artificial Sequence
  Description of Artificial Sequence: Synthetic oligonucleotide
  Target: ATXN1; (+) strand; PAM type: NRG; PAM sequence: GAG
tcactctgttacccagactg

SEQ ID NO: 120520 - DNA, 20 bp, Artificial Sequence
  Description of Artificial Sequence: Synthetic oligonucleotide
  Target: ATXN1; (+) strand; PAM type: NRG; PAM sequence: CAG
ctgttacccagactggagtg

SEQ ID NO: 120521 - DNA, 20 bp, Artificial Sequence
  Description of Artificial Sequence: Synthetic oligonucleotide
  Target: ATXN1; (+) strand; PAM type: NRG; PAM sequence: TGG
ttacccagactggagtgcag

SEQ ID NO: 120522 - DNA, 20 bp, Artificial Sequence
  Description of Artificial Sequence: Synthetic oligonucleotide
  Target: ATXN1; (+) strand; PAM type: NRG; PAM sequence: TGG
ggagtgcagtggcatgatct

SEQ ID NO: 120523 - DNA, 20 bp, Artificial Sequence
  Description of Artificial Sequence: Synthetic oligonucleotide
  Target: ATXN1; (+) strand; PAM type: NRG; PAM sequence: CGG
tcactgcaacctccacctcc

SEQ ID NO: 120524 - DNA, 20 bp, Artificial Sequence
  Description of Artificial Sequence: Synthetic oligonucleotide
  Target: ATXN1; (+) strand; PAM type: NRG; PAM sequence: GGG
cactgcaacctccacctccc

SEQ ID NO: 120525 - DNA, 20 bp, Artificial Sequence
  Description of Artificial Sequence: Synthetic oligonucleotide
  Target: ATXN1; (+) strand; PAM type: NRG; PAM sequence: AAG
aacctccacctcccgggtcc

SEQ ID NO: 120526 - DNA, 20 bp, Artificial Sequence
  Description of Artificial Sequence: Synthetic oligonucleotide
  Target: ATXN1; (+) strand; PAM type: NRG; PAM sequence: CAG
tccaagtgattctcctgcct

SEQ ID NO: 120527 - DNA, 20 bp, Artificial Sequence
  Description of Artificial Sequence: Synthetic oligonucleotide
  Target: ATXN1; (+) strand; PAM type: NRG; PAM sequence: GAG
ttctcctgcctcagcctccc

SEQ ID NO: 120528 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcccgag

SEQ ID NO: 120529 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccgagtagc

SEQ ID NO: 120530 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccgagtagct

SEQ ID NO: 120531 - DNA, 20 bp, Artificial Sequence
  Description of Artificial Sequence: Synthetic oligonucleotide
  Target: ATXN1; (+) strand; PAM type: NRG; PAM sequence: CAG
ctcccgagtagctgggacta

SEQ ID NO: 120532 - DNA, 20 bp, Artificial Sequence
  Description of Artificial Sequence: Synthetic oligonucleotide
  Target: ATXN1; (+) strand; PAM type: NRG; PAM sequence: AGG
tcccgagtagctgggactac

SEQ ID NO: 120533 - DNA, 20 bp, Artificial Sequence
  Description of Artificial Sequence: Synthetic oligonucleotide
  Target: ATXN1; (+) strand; PAM type: NRG; PAM sequence: CAG
caggcatgcaccaccatgcc

SEQ ID NO: 120534 - DNA, 20 bp, Artificial Sequence
  Description of Artificial Sequence: Synthetic oligonucleotide
  Target: ATXN1; (+) strand; PAM type: NRG; PAM sequence: TAG
gctaattttatatatatttt

SEQ ID NO: 120535 - DNA, 20 bp, Artificial Sequence
  Description of Artificial Sequence: Synthetic oligonucleotide
  Target: ATXN1; (+) strand; PAM type: NRG; PAM sequence: TAG
aattttatatatatttttag

SEQ ID NO: 120536 - DNA, 20 bp, Artificial Sequence
  Description of Artificial Sequence: Synthetic oligonucleotide
  Target: ATXN1; (+) strand; PAM type: NRG; PAM sequence: GAG
ttttatatatatttttagta

SEQ ID NO: 120537 - DNA, 20 bp, Artificial Sequence
  Description of Artificial Sequence: Synthetic oligonucleotide
  Target: ATXN1; (+) strand; PAM type: NRG; PAM sequence: AAG
tatatatttttagtagagat

SEQ ID NO: 120538 - DNA, 20 bp, Artificial Sequence
  Description of Artificial Sequence: Synthetic oligonucleotide
  Target: ATXN1; (+) strand; PAM type: NRG; PAM sequence: AGG
atatatttttagtagagata

SEQ ID NO: 120539 - DNA, 20 bp, Artificial Sequence
  Description of Artificial Sequence: Synthetic oligonucleotide
  Target: ATXN1; (+) strand; PAM type: NRG; PAM sequence: TGG
gagataaggtttcaccatgt

SEQ ID NO: 120540 - DNA, 20 bp, Artificial Sequence
  Description of Artificial Sequence: Synthetic oligonucleotide
  Target: ATXN1; (+) strand; PAM type: NRG; PAM sequence: CAG
taaggtttcaccatgttggc

SEQ ID NO: 120541 - DNA, 20 bp, Artificial Sequence
  Description of Artificial Sequence: Synthetic oligonucleotide
  Target: ATXN1; (+) strand; PAM type: NRG; PAM sequence: AGG
aaggtttcaccatgttggcc

SEQ ID NO: 120542 - DNA, 20 bp, Artificial Sequence
  Description of Artificial Sequence: Synthetic oligonucleotide
  Target: ATXN1; (+) strand; PAM type: NRG; PAM sequence: TGG
tttcaccatgttggccaggc

SEQ ID NO: 120543 - DNA, 20 bp, Artificial Sequence
  Description of Artificial Sequence: Synthetic oligonucleotide
  Target: ATXN1; (+) strand; PAM type: NRG; PAM sequence: CAG
tggtcttgaactcctgacct

SEQ ID NO: 120544 - DNA, 20 bp, Artificial Sequence
  Description of Artificial Sequence: Synthetic oligonucleotide
  Target: ATXN1; (+) strand; PAM type: NRG; PAM sequence: AGG
ggtcttgaactcctgacctc

SEQ ID NO: 120545 - DNA, 20 bp, Artificial Sequence
  Description of Artificial Sequence: Synthetic oligonucleotide
  Target: ATXN1; (+) strand; PAM type: NRG; PAM sequence: TGG
ctcaggtgatccacccgcct

SEQ ID NO: 120546 - DNA, 20 bp, Artificial Sequence
  Description of Artificial Sequence: Synthetic oligonucleotide
  Target: ATXN1; (+) strand; PAM type: NRG; PAM sequence: AAG
ccacccgccttggcttccca

SEQ ID NO: 120547 - DNA, 20 bp, Artificial Sequence
  Description of Artificial Sequence: Synthetic oligonucleotide
  Target: ATXN1; (+) strand; PAM type: NRG; PAM sequence: TGG
gccttggcttcccaaagtgc

SEQ ID NO: 120548 - DNA, 20 bp, Artificial Sequence
  Description of Artificial Sequence: Synthetic oligonucleotide
  Target: ATXN1; (+) strand; PAM type: NRG; PAM sequence: TGG
agtgctggaattactgtgcc

SEQ ID NO: 120549 - DNA, 20 bp, Artificial Sequence
  Description of Artificial Sequence: Synthetic oligonucleotide
  Target: ATXN1; (+) strand; PAM type: NRG; PAM sequence: TAG
tggaattactgtgcctggcc

SEQ ID NO: 120550 - DNA, 20 bp, Artificial Sequence
  Description of Artificial Sequence: Synthetic oligonucleotide
  Target: ATXN1; (+) strand; PAM type: NRG; PAM sequence: CAG
gtgatcaacgacaacttatt

SEQ ID NO: 120551 - DNA, 20 bp, Artificial Sequence
  Description of Artificial Sequence: Synthetic oligonucleotide
  Target: ATXN1; (+) strand; PAM type: NRG; PAM sequence: AGG
tgatcaacgacaacttattc

SEQ ID NO: 120552 - DNA, 20 bp, Artificial Sequence
  Description of Artificial Sequence: Synthetic oligonucleotide
  Target: ATXN1; (+) strand; PAM type: NRG; PAM sequence: AAG
tcaacgacaacttattcagg

SEQ ID NO: 120553 - DNA, 20 bp, Artificial Sequence
  Description of Artificial Sequence: Synthetic oligonucleotide
  Target: ATXN1; (+) strand; PAM type: NRG; PAM sequence: AAG
acgacaacttattcaggaag

SEQ ID NO: 120554 - DNA, 20 bp, Artificial Sequence
  Description of Artificial Sequence: Synthetic oligonucleotide
  Target: ATXN1; (+) strand; PAM type: NRG; PAM sequence: AGG
cgacaacttattcaggaaga

SEQ ID NO: 120555 - DNA, 20 bp, Artificial Sequence
  Description of Artificial Sequence: Synthetic oligonucleotide
  Target: ATXN1; (+) strand; PAM type: NRG; PAM sequence: GGG
gacaacttattcaggaagaa

SEQ ID NO: 120556 - DNA, 20 bp, Artificial Sequence
  Description of Artificial Sequence: Synthetic oligonucleotide
  Target: ATXN1; (+) strand; PAM type: NRG; PAM sequence: TAG
aagaagggttctttctactc

SEQ ID NO: 120557 - DNA, 20 bp, Artificial Sequence
  Description of Artificial Sequence: Synthetic oligonucleotide
  Target: ATXN1; (+) strand; PAM type: NRG; PAM sequence: CAG
tttctactctagtatgcttc

SEQ ID NO: 120558 - DNA, 20 bp, Artificial Sequence
  Description of Artificial Sequence: Synthetic oligonucleotide
  Target: ATXN1; (+) strand; PAM type: NRG; PAM sequence: TAG
ccagttatttactgtgtatc

SEQ ID NO: 120559 - DNA, 20 bp, Artificial Sequence
  Description of Artificial Sequence: Synthetic oligonucleotide
  Target: ATXN1; (+) strand; PAM type: NRG; PAM sequence: TAG
ttatttactgtgtatctagc

SEQ ID NO: 120560 - DNA, 20 bp, Artificial Sequence
  Description of Artificial Sequence: Synthetic oligonucleotide
  Target: ATXN1; (+) strand; PAM type: NRG; PAM sequence: AGG
tatttactgtgtatctagct

SEQ ID NO: 120561 - DNA, 20 bp, Artificial Sequence
  Description of Artificial Sequence: Synthetic oligonucleotide
  Target: ATXN1; (+) strand; PAM type: NRG; PAM sequence: AAG
gtatctagctaggttgtgaa

SEQ ID NO: 120562 - DNA, 20 bp, Artificial Sequence
  Description of Artificial Sequence: Synthetic oligonucleotide
  Target: ATXN1; (+) strand; PAM type: NRG; PAM sequence: AAG
tagctaggttgtgaaaagaa

SEQ ID NO: 120563 - DNA, 20 bp, Artificial Sequence
  Description of Artificial Sequence: Synthetic oligonucleotide
  Target: ATXN1; (+) strand; PAM type: NRG; PAM sequence: AAG
tgtgaaaagaaaagaatatg

SEQ ID NO: 120564 - DNA, 20 bp, Artificial Sequence
  Description of Artificial Sequence: Synthetic oligonucleotide
  Target: ATXN1; (+) strand; PAM type: NRG; PAM sequence: AAG
agaaaagaatatgaagcacg

SEQ ID NO: 120565 - DNA, 20 bp, Artificial Sequence
  Description of Artificial Sequence: Synthetic oligonucleotide
  Target: ATXN1; (+) strand; PAM type: NRG; PAM sequence: TGG
cgaagttcatgaaacctaac

SEQ ID NO: 120566 - DNA, 20 bp, Artificial Sequence
  Description of Artificial Sequence: Synthetic oligonucleotide
  Target: ATXN1; (+) strand; PAM type: NRG; PAM sequence: AAG
ttaccaaatttcttctaaaa

SEQ ID NO: 120567 - DNA, 20 bp, Artificial Sequence
  Description of Artificial Sequence: Synthetic oligonucleotide
  Target: ATXN1; (+) strand; PAM type: NRG; PAM sequence: CAG
aaaaaagcaaccatcaaacc

SEQ ID NO: 120568 - DNA, 20 bp, Artificial Sequence
  Description of Artificial Sequence: Synthetic oligonucleotide
  Target: ATXN1; (+) strand; PAM type: NRG; PAM sequence: GAG
aaaagcaaccatcaaaccca

SEQ ID NO: 120569 - DNA, 20 bp, Artificial Sequence
  Description of Artificial Sequence: Synthetic oligonucleotide
  Target: ATXN1; (+) strand; PAM type: NRG; PAM sequence: AAG
agcaaccatcaaacccagag

SEQ ID NO: 120570 - DNA, 20 bp, Artificial Sequence
  Description of Artificial Sequence: Synthetic oligonucleotide
  Target: ATXN1; (+) strand; PAM type: NRG; PAM sequence: AAG
caaacccagagaagaatttg

SEQ ID NO: 120571 - DNA, 20 bp, Artificial Sequence
  Description of Artificial Sequence: Synthetic oligonucleotide
  Target: ATXN1; (+) strand; PAM type: NRG; PAM sequence: TAG
aactttaatgccattcacat

SEQ ID NO: 120572 - DNA, 20 bp, Artificial Sequence
  Description of Artificial Sequence: Synthetic oligonucleotide
  Target: ATXN1; (+) strand; PAM type: NRG; PAM sequence: GAG
gttgtatttcttattcatat

SEQ ID NO: 120573 - DNA, 20 bp, Artificial Sequence
  Description of Artificial Sequence: Synthetic oligonucleotide
  Target: ATXN1; (+) strand; PAM type: NRG; PAM sequence: GAG
tgtatttcttattcatatga

SEQ ID NO: 120574 - DNA, 20 bp, Artificial Sequence
  Description of Artificial Sequence: Synthetic oligonucleotide
  Target: ATXN1; (+) strand; PAM type: NRG; PAM sequence: AAG
tttatgacctgtgcactata

SEQ ID NO: 120575 - DNA, 20 bp, Artificial Sequence
  Description of Artificial Sequence: Synthetic oligonucleotide
  Target: ATXN1; (+) strand; PAM type: NRG; PAM sequence: GAG
tgtgcactataaagaatgat

SEQ ID NO: 120576 - DNA, 20 bp, Artificial Sequence
  Description of Artificial Sequence: Synthetic oligonucleotide
  Target: ATXN1; (+) strand; PAM type: NRG; PAM sequence: AAG
atgatgagtatttaaacact

SEQ ID NO: 120577 - DNA, 20 bp, Artificial Sequence
  Description of Artificial Sequence: Synthetic oligonucleotide
  Target: ATXN1; (+) strand; PAM type: NRG; PAM sequence: CAG
aacactaagtgttgaattaa

SEQ ID NO: 120578 - DNA, 20 bp, Artificial Sequence
  Description of Artificial Sequence: Synthetic oligonucleotide
  Target: ATXN1; (+) strand; PAM type: NRG; PAM sequence: TAG
ctgtatcaaaatgtacttaa

SEQ ID NO: 120579 - DNA, 20 bp, Artificial Sequence
  Description of Artificial Sequence: Synthetic oligonucleotide
  Target: ATXN1; (+) strand; PAM type: NRG; PAM sequence: AGG
tgtatcaaaatgtacttaat

SEQ ID NO: 120580 - DNA, 20 bp, Artificial Sequence
  Description of Artificial Sequence: Synthetic oligonucleotide
  Target: ATXN1; (+) strand; PAM type: NRG; PAM sequence: CAG
ttaataggtatttattgttt

SEQ ID NO: 120581 - DNA, 20 bp, Artificial Sequence
  Description of Artificial Sequence: Synthetic oligonucleotide
  Target: ATXN1; (+) strand; PAM type: NRG; PAM sequence: AGG
taataggtatttattgtttc

SEQ ID NO: 120582 - DNA, 20 bp, Artificial Sequence
  Description of Artificial Sequence: Synthetic oligonucleotide
  Target: ATXN1; (+) strand; PAM type: NRG; PAM sequence: TGG
gtcaatttaaaataatgacc

SEQ ID NO: 120583 - DNA, 20 bp, Artificial Sequence
  Description of Artificial Sequence: Synthetic oligonucleotide
  Target: ATXN1; (+) strand; PAM type: NRG; PAM sequence: TGG
atttaaaataatgacctggc

SEQ ID NO: 120584 - DNA, 20 bp, Artificial Sequence
  Description of Artificial Sequence: Synthetic oligonucleotide
  Target: ATXN1; (+) strand; PAM type: NRG; PAM sequence: GGG
tttaaaataatgacctggct

SEQ ID NO: 120585 - DNA, 20 bp, Artificial Sequence
  Description of Artificial Sequence: Synthetic oligonucleotide
  Target: ATXN1; (+) strand; PAM type: NRG; PAM sequence: TGG
tacaaaacatcctgaaaata

SEQ ID NO: 120586 - DNA, 20 bp, Artificial Sequence
  Description of Artificial Sequence: Synthetic oligonucleotide
  Target: ATXN1; (+) strand; PAM type: NRG; PAM sequence: GGG
acaaaacatcctgaaaatat

SEQ ID NO: 120587 - DNA, 20 bp, Artificial Sequence
  Description of Artificial Sequence: Synthetic oligonucleotide
  Target: ATXN1; (+) strand; PAM type: NRG; PAM sequence: AAG
gaaaatatgggatgctctga

SEQ ID NO: 120588 - DNA, 20 bp, Artificial Sequence
  Description of Artificial Sequence: Synthetic oligonucleotide
  Target: ATXN1; (+) strand; PAM type: NRG; PAM sequence: CAG
ggatgctctgaaagtgccaa

SEQ ID NO: 120589 - DNA, 20 bp, Artificial Sequence
  Description of Artificial Sequence: Synthetic oligonucleotide
  Target: ATXN1; (+) strand; PAM type: NRG; PAM sequence: TGG
aaagtgccaacagctaccct

SEQ ID NO: 120590 - DNA, 20 bp, Artificial Sequence
  Description of Artificial Sequence: Synthetic oligonucleotide
  Target: ATXN1; (+) strand; PAM type: NRG; PAM sequence: GAG
agtgccaacagctacccttg

SEQ ID NO: 120591 - DNA, 20 bp, Artificial Sequence
  Description of Artificial Sequence: Synthetic oligonucleotide
  Target: ATXN1; (+) strand; PAM type: NRG; PAM sequence: CAG
aaaattatttctttcaattc

SEQ ID NO: 120592 - DNA, 20 bp, Artificial Sequence
  Description of Artificial Sequence: Synthetic oligonucleotide
  Target: ATXN1; (+) strand; PAM type: NRG; PAM sequence: CAG
atttctttcaattccagtcc

SEQ ID NO: 120593 - DNA, 20 bp, Artificial Sequence
  Description of Artificial Sequence: Synthetic oligonucleotide
  Target: ATXN1; (+) strand; PAM type: NRG; PAM sequence: CAG
cagtcccagatcttcactac

SEQ ID NO: 120594 - DNA, 20 bp, Artificial Sequence
  Description of Artificial Sequence: Synthetic oligonucleotide
  Target: ATXN1; (+) strand; PAM type: NRG; PAM sequence: CAG
ttcactaccagcccttattt

SEQ ID NO: 120595 - DNA, 20 bp, Artificial Sequence
  Description of Artificial Sequence: Synthetic oligonucleotide
  Target: ATXN1; (+) strand; PAM type: NRG; PAM sequence: TGG
accagcccttatttcagcta

SEQ ID NO: 120596 - DNA, 20 bp, Artificial Sequence
  Description of Artificial Sequence: Synthetic oligonucleotide
  Target: ATXN1; (+) strand; PAM type: NRG; PAM sequence: TAG
agcccttatttcagctatgg

SEQ ID NO: 120597 - DNA, 20 bp, Artificial Sequence
  Description of Artificial Sequence: Synthetic oligonucleotide
  Target: ATXN1; (+) strand; PAM type: NRG; PAM sequence: AAG
ccttatttcagctatggtag

SEQ ID NO: 120598 - DNA, 20 bp, Artificial Sequence
  Description of Artificial Sequence: Synthetic oligonucleotide
  Target: ATXN1; (+) strand; PAM type: NRG; PAM sequence: AGG
cttatttcagctatggtaga

SEQ ID NO: 120599 - DNA, 20 bp, Artificial Sequence
  Description of Artificial Sequence: Synthetic oligonucleotide
  Target: ATXN1; (+) strand; PAM type: NRG; PAM sequence: GAG
tatttcagctatggtagaag

SEQ ID NO: 120600 - DNA, 20 bp, Artificial Sequence
  Description of Artificial Sequence: Synthetic oligonucleotide
  Target: ATXN1; (+) strand; PAM type: NRG; PAM sequence: GAG
gagtgaatataccttctgtt

SEQ ID NO: 120601 - DNA, 20 bp, Artificial Sequence
  Description of Artificial Sequence: Synthetic oligonucleotide
  Target: ATXN1; (+) strand; PAM type: NRG; PAM sequence: TAG
gttgagtatacaaaacgtgc

SEQ ID NO: 120602 - DNA, 20 bp, Artificial Sequence
  Description of Artificial Sequence: Synthetic oligonucleotide
  Target: ATXN1; (+) strand; PAM type: NRG; PAM sequence: TGG
tatacaaaacgtgctagaaa

SEQ ID NO: 120603 - DNA, 20 bp, Artificial Sequence
  Description of Artificial Sequence: Synthetic oligonucleotide
  Target: ATXN1; (+) strand; PAM type: NRG; PAM sequence: CAG
caaaacgtgctagaaatggt

SEQ ID NO: 120604 - DNA, 20 bp, Artificial Sequence
  Description of Artificial Sequence: Synthetic oligonucleotide
  Target: ATXN1; (+) strand; PAM type: NRG; PAM sequence: AAG
ctaaatgtctttcccatcat

SEQ ID NO: 120605 - DNA, 20 bp, Artificial Sequence
  Description of Artificial Sequence: Synthetic oligonucleotide
  Target: ATXN1; (+) strand; PAM type: NRG; PAM sequence: CAG
tctttcccatcataagcaca

SEQ ID NO: 120606 - DNA, 20 bp, Artificial Sequence
  Description of Artificial Sequence: Synthetic oligonucleotide
  Target: ATXN1; (+) strand; PAM type: NRG; PAM sequence: GAG
tcatgcaattatctcgactt

SEQ ID NO: 120607 - DNA, 20 bp, Artificial Sequence
  Description of Artificial Sequence: Synthetic oligonucleotide
  Target: ATXN1; (+) strand; PAM type: NRG; PAM sequence: TGG
caattatctcgacttgagtg

SEQ ID NO: 120608 - DNA, 20 bp, Artificial Sequence
  Description of Artificial Sequence: Synthetic oligonucleotide
  Target: ATXN1; (+) strand; PAM type: NRG; PAM sequence: CAG
tcgacttgagtgtggtcatt

SEQ ID NO: 120609 - DNA, 20 bp, Artificial Sequence
  Description of Artificial Sequence: Synthetic oligonucleotide
  Target: ATXN1; (+) strand; PAM type: NRG; PAM sequence: TGG
acttgagtgtggtcattcag

SEQ ID NO: 120610 - DNA, 20 bp, Artificial Sequence
  Description of Artificial Sequence: Synthetic oligonucleotide
  Target: ATXN1; (+) strand; PAM type: NRG; PAM sequence: CGG
ttcagtggaacaaatgacaa

SEQ ID NO: 120611 - DNA, 20 bp, Artificial Sequence
  Description of Artificial Sequence: Synthetic oligonucleotide
  Target: ATXN1; (+) strand; PAM type: NRG; PAM sequence: GAG
aacaaatgacaacggtcatt

SEQ ID NO: 120612 - DNA, 20 bp, Artificial Sequence
  Description of Artificial Sequence: Synthetic oligonucleotide
  Target: ATXN1; (+) strand; PAM type: NRG; PAM sequence: TAG
tgagactacaaaaactcttt

SEQ ID NO: 120613 - DNA, 20 bp, Artificial Sequence
  Description of Artificial Sequence: Synthetic oligonucleotide
  Target: ATXN1; (+) strand; PAM type: NRG; PAM sequence: AAG
caaaaactcttttagtcgtg

SEQ ID NO: 120614 - DNA, 20 bp, Artificial Sequence
  Description of Artificial Sequence: Synthetic oligonucleotide
  Target: ATXN1; (+) strand; PAM type: NRG; PAM sequence: AGG
aaaaactcttttagtcgtga

SEQ ID NO: 120615 - DNA, 20 bp, Artificial Sequence
  Description of Artificial Sequence: Synthetic oligonucleotide
  Target: ATXN1; (+) strand; PAM type: NRG; PAM sequence: GGG
aaaactcttttagtcgtgaa

SEQ ID NO: 120616 - DNA, 20 bp, Artificial Sequence
  Description of Artificial Sequence: Synthetic oligonucleotide
  Target: ATXN1; (+) strand; PAM type: NRG; PAM sequence: AAG
ctcttttagtcgtgaaggga

SEQ ID NO: 120617 - DNA, 20 bp, Artificial Sequence
  Description of Artificial Sequence: Synthetic oligonucleotide
  Target: ATXN1; (+) strand; PAM type: NRG; PAM sequence: AGG
tcttttagtcgtgaagggaa

SEQ ID NO: 120618 - DNA, 20 bp, Artificial Sequence
  Description of Artificial Sequence: Synthetic oligonucleotide
  Target: ATXN1; (+) strand; PAM type: NRG; PAM sequence: TGG
gtcatacttcctgtcatctg

SEQ ID NO: 120619 - DNA, 20 bp, Artificial Sequence
  Description of Artificial Sequence: Synthetic oligonucleotide
  Target: ATXN1; (+) strand; PAM type: NRG; PAM sequence: GGG
tcatacttcctgtcatctgt

SEQ ID NO: 120620 - DNA, 20 bp, Artificial Sequence
  Description of Artificial Sequence: Synthetic oligonucleotide
  Target: ATXN1; (+) strand; PAM type: NRG; PAM sequence: TGG
tctgtgggtcttcaatgctc

SEQ ID NO: 120621 - DNA, 20 bp, Artificial Sequence
  Description of Artificial Sequence: Synthetic oligonucleotide
  Target: ATXN1; (+) strand; PAM type: NRG; PAM sequence: GGG
ctgtgggtcttcaatgctct

SEQ ID NO: 120622 - DNA, 20 bp, Artificial Sequence
  Description of Artificial Sequence: Synthetic oligonucleotide
  Target: ATXN1; (+) strand; PAM type: NRG; PAM sequence: GGG
tgtgggtcttcaatgctctg

SEQ ID NO: 120623 - DNA, 20 bp, Artificial Sequence
  Description of Artificial Sequence: Synthetic oligonucleotide
  Target: ATXN1; (+) strand; PAM type: NRG; PAM sequence: CAG
ctctggggacaccctttcat

SEQ ID NO: 120624 - DNA, 20 bp, Artificial Sequence
  Description of Artificial Sequence: Synthetic oligonucleotide
  Target: ATXN1; (+) strand; PAM type: NRG; PAM sequence: AAG
ttgttccccatttccttgca

SEQ ID NO: 120625 - DNA, 20 bp, Artificial Sequence
  Description of Artificial Sequence: Synthetic oligonucleotide
  Target: ATXN1; (+) strand; PAM type: NRG; PAM sequence: GAG
tccttgcaaagacccacctt

SEQ ID NO: 120626 - DNA, 20 bp, Artificial Sequence
  Description of Artificial Sequence: Synthetic oligonucleotide
  Target: ATXN1; (+) strand; PAM type: NRG; PAM sequence: TGG
tttcttcgtgaaaaatgtct

SEQ ID NO: 120627 - DNA, 20 bp, Artificial Sequence
  Description of Artificial Sequence: Synthetic oligonucleotide
  Target: ATXN1; (+) strand; PAM type: NRG; PAM sequence: CAG
gaaaaatgtcttggcatctc

SEQ ID NO: 120628 - DNA, 20 bp, Artificial Sequence
  Description of Artificial Sequence: Synthetic oligonucleotide
  Target: ATXN1; (+) strand; PAM type: NRG; PAM sequence: AGG
aaaaatgtcttggcatctcc

SEQ ID NO: 120629 - DNA, 20 bp, Artificial Sequence
  Description of Artificial Sequence: Synthetic oligonucleotide
  Target: ATXN1; (+) strand; PAM type: NRG; PAM sequence: GGG
aaaatgtcttggcatctcca

SEQ ID NO: 120630 - DNA, 20 bp, Artificial Sequence
  Description of Artificial Sequence: Synthetic oligonucleotide
  Target: ATXN1; (+) strand; PAM type: NRG; PAM sequence: CAG
ttggcatctccagggccaca

SEQ ID NO: 120631 - DNA, 20 bp, Artificial Sequence
  Description of Artificial Sequence: Synthetic oligonucleotide
  Target: ATXN1; (+) strand; PAM type: NRG; PAM sequence: AAG
tctccagggccacacagacg

SEQ ID NO: 120632 - DNA, 20 bp, Artificial Sequence
  Description of Artificial Sequence: Synthetic oligonucleotide
  Target: ATXN1; (+) strand; PAM type: NRG; PAM sequence: CAG
ccacacagacgaagcactct

SEQ ID NO: 120633 - DNA, 20 bp, Artificial Sequence
  Description of Artificial Sequence: Synthetic oligonucleotide
  Target: ATXN1; (+) strand; PAM type: NRG; PAM sequence: AGG
cacacagacgaagcactctc

SEQ ID NO: 120634 - DNA, 20 bp, Artificial Sequence
  Description of Artificial Sequence: Synthetic oligonucleotide
  Target: ATXN1; (+) strand; PAM type: NRG; PAM sequence: GAG
cacagacgaagcactctcag

SEQ ID NO: 120635 - DNA, 20 bp, Artificial Sequence
  Description of Artificial Sequence: Synthetic oligonucleotide
  Target: ATXN1; (+) strand; PAM type: NRG; PAM sequence: TAG
tgtcacccaaacccattgcc

SEQ ID NO: 120636 - DNA, 20 bp, Artificial Sequence
  Description of Artificial Sequence: Synthetic oligonucleotide
  Target: ATXN1; (+) strand; PAM type: NRG; PAM sequence: AGG
gtcacccaaacccattgcct

SEQ ID NO: 120637 - DNA, 20 bp, Artificial Sequence
  Description of Artificial Sequence: Synthetic oligonucleotide
  Target: ATXN1; (+) strand; PAM type: NRG; PAM sequence: GGG
tcacccaaacccattgccta

SEQ ID NO: 120638 - DNA, 20 bp, Artificial Sequence
  Description of Artificial Sequence: Synthetic oligonucleotide
  Target: ATXN1; (+) strand; PAM type: NRG; PAM sequence: GGG
cacccaaacccattgcctag

SEQ ID NO: 120639 - DNA, 20 bp, Artificial Sequence
  Description of Artificial Sequence: Synthetic oligonucleotide
  Target: ATXN1; (+) strand; PAM type: NRG; PAM sequence: CAG
ccattgcctaggggcttcca

SEQ ID NO: 120640 - DNA, 20 bp, Artificial Sequence
  Description of Artificial Sequence: Synthetic oligonucleotide
  Target: ATXN1; (+) strand; PAM type: NRG; PAM sequence: GAG
attgcctaggggcttccaca

SEQ ID NO: 120641 - DNA, 20 bp, Artificial Sequence
  Description of Artificial Sequence: Synthetic oligonucleotide
  Target: ATXN1; (+) strand; PAM type: NRG; PAM sequence: AAG
gcctaggggcttccacagag

SEQ ID NO: 120642 - DNA, 20 bp, Artificial Sequence
  Description of Artificial Sequence: Synthetic oligonucleotide
  Target: ATXN1; (+) strand; PAM type: NRG; PAM sequence: TGG
taggggcttccacagagaag

SEQ ID NO: 120643 - DNA, 20 bp, Artificial Sequence
  Description of Artificial Sequence: Synthetic oligonucleotide
  Target: ATXN1; (+) strand; PAM type: NRG; PAM sequence: TGG
cttccacagagaagtggcca

SEQ ID NO: 120644 - DNA, 20 bp, Artificial Sequence
  Description of Artificial Sequence: Synthetic oligonucleotide
  Target: ATXN1; (+) strand; PAM type: NRG; PAM sequence: GAG
tccacagagaagtggccatg

SEQ ID NO: 120645 - DNA, 20 bp, Artificial Sequence
  Description of Artificial Sequence: Synthetic oligonucleotide
  Target: ATXN1; (+) strand; PAM type: NRG; PAM sequence: AGG
ccacagagaagtggccatgg

SEQ ID NO: 120646 - DNA, 20 bp, Artificial Sequence
  Description of Artificial Sequence: Synthetic oligonucleotide
  Target: ATXN1; (+) strand; PAM type: NRG; PAM sequence: GGG
cacagagaagtggccatgga

SEQ ID NO: 120647 - DNA, 20 bp, Artificial Sequence
  Description of Artificial Sequence: Synthetic oligonucleotide
  Target: ATXN1; (+) strand; PAM type: NRG; PAM sequence: AAG
agagaagtggccatggaggg

SEQ ID NO: 120648 - DNA, 20 bp, Artificial Sequence
  Description of Artificial Sequence: Synthetic oligonucleotide
  Target: ATXN1; (+) strand; PAM type: NRG; PAM sequence: CAG
tggccatggagggaagcccc

SEQ ID NO: 120649 - DNA, 20 bp, Artificial Sequence
  Description of Artificial Sequence: Synthetic oligonucleotide
  Target: ATXN1; (+) strand; PAM type: NRG; PAM sequence: TAG
tgtcacttgactgtccattt

SEQ ID NO: 120650 - DNA, 20 bp, Artificial Sequence
  Description of Artificial Sequence: Synthetic oligonucleotide
  Target: ATXN1; (+) strand; PAM type: NRG; PAM sequence: TAG
tgtccattttagatttcatc

SEQ ID NO: 120651 - DNA, 20 bp, Artificial Sequence
  Description of Artificial Sequence: Synthetic oligonucleotide
  Target: ATXN1; (+) strand; PAM type: NRG; PAM sequence: AGG
gtccattttagatttcatct

SEQ ID NO: 120652 - DNA, 20 bp, Artificial Sequence
  Description of Artificial Sequence: Synthetic oligonucleotide
  Target: ATXN1; (+) strand; PAM type: NRG; PAM sequence: AAG
attttagatttcatctaggc

SEQ ID NO: 120653 - DNA, 20 bp, Artificial Sequence
  Description of Artificial Sequence: Synthetic oligonucleotide
  Target: ATXN1; (+) strand; PAM type: NRG; PAM sequence: AGG
ttttagatttcatctaggca

SEQ ID NO: 120654 - DNA, 20 bp, Artificial Sequence
  Description of Artificial Sequence: Synthetic oligonucleotide
  Target: ATXN1; (+) strand; PAM type: NRG; PAM sequence: TGG
tcatctaggcaaggccactt

SEQ ID NO: 120655 - DNA, 20 bp, Artificial Sequence
  Description of Artificial Sequence: Synthetic oligonucleotide
  Target: ATXN1; (+) strand; PAM type: NRG; PAM sequence: CAG
ctaggcaaggccactttgga

SEQ ID NO: 120656 - DNA, 20 bp, Artificial Sequence
  Description of Artificial Sequence: Synthetic oligonucleotide
  Target: ATXN1; (+) strand; PAM type: NRG; PAM sequence: AGG
taggcaaggccactttggac

SEQ ID NO: 120657 - DNA, 20 bp, Artificial Sequence
  Description of Artificial Sequence: Synthetic oligonucleotide
  Target: ATXN1; (+) strand; PAM type: NRG; PAM sequence: GGG
aggcaaggccactttggaca

SEQ ID NO: 120658 - DNA, 20 bp, Artificial Sequence
  Description of Artificial Sequence: Synthetic oligonucleotide
  Target: ATXN1; (+) strand; PAM type: NRG; PAM sequence: AAG
ccactttggacagggacttt

SEQ ID NO: 120659 - DNA, 20 bp, Artificial Sequence
  Description of Artificial Sequence: Synthetic oligonucleotide
  Target: ATXN1; (+) strand; PAM type: NRG; PAM sequence: CAG
ggactttaagatacaatcca

SEQ ID NO: 120660 - DNA, 20 bp, Artificial Sequence
  Description of Artificial Sequence: Synthetic oligonucleotide
  Target: ATXN1; (+) strand; PAM type: NRG; PAM sequence: TGG
cacagtatttctatgttctt

SEQ ID NO: 120661 - DNA, 20 bp, Artificial Sequence
  Description of Artificial Sequence: Synthetic oligonucleotide
  Target: ATXN1; (+) strand; PAM type: NRG; PAM sequence: CGG
tatgttctttggatccaaat

SEQ ID NO: 120662 - DNA, 20 bp, Artificial Sequence
  Description of Artificial Sequence: Synthetic oligonucleotide
  Target: ATXN1; (+) strand; PAM type: NRG; PAM sequence: TGG
tttggatccaaatcggaaaa

SEQ ID NO: 120663 - DNA, 20 bp, Artificial Sequence
  Description of Artificial Sequence: Synthetic oligonucleotide
  Target: ATXN1; (+) strand; PAM type: NRG; PAM sequence: CAG
ggatccaaatcggaaaatgg

SEQ ID NO: 120664 - DNA, 20 bp, Artificial Sequence
  Description of Artificial Sequence: Synthetic oligonucleotide
  Target: ATXN1; (+) strand; PAM type: NRG; PAM sequence: AAG
aaatcggaaaatggcagaaa

SEQ ID NO: 120665 - DNA, 20 bp, Artificial Sequence
  Description of Artificial Sequence: Synthetic oligonucleotide
  Target: ATXN1; (+) strand; PAM type: NRG; PAM sequence: TAG
aaatggcagaaaaagtcatt

SEQ ID NO: 120666 - DNA, 20 bp, Artificial Sequence
  Description of Artificial Sequence: Synthetic oligonucleotide
  Target: ATXN1; (+) strand; PAM type: NRG; PAM sequence: TGG
catttagtgccaattcaatg

SEQ ID NO: 120667 - DNA, 20 bp, Artificial Sequence
  Description of Artificial Sequence: Synthetic oligonucleotide
  Target: ATXN1; (+) strand; PAM type: NRG; PAM sequence: GAG
ccaattcaatgtggcataat

SEQ ID NO: 120668 - DNA, 20 bp, Artificial Sequence
  Description of Artificial Sequence: Synthetic oligonucleotide
  Target: ATXN1; (+) strand; PAM type: NRG; PAM sequence: GAG
aattcaatgtggcataatga

SEQ ID NO: 120669 - DNA, 20 bp, Artificial Sequence
  Description of Artificial Sequence: Synthetic oligonucleotide
  Target: ATXN1; (+) strand; PAM type: NRG; PAM sequence: AGG
attcaatgtggcataatgag

SEQ ID NO: 120670 - DNA, 20 bp, Artificial Sequence
  Description of Artificial Sequence: Synthetic oligonucleotide
  Target: ATXN1; (+) strand; PAM type: NRG; PAM sequence: GAG
tcaatgtggcataatgagag

SEQ ID NO: 120671 - DNA, 20 bp, Artificial Sequence
  Description of Artificial Sequence: Synthetic oligonucleotide
  Target: ATXN1; (+) strand; PAM type: NRG; PAM sequence: GAG
aatgtggcataatgagagga

SEQ ID NO: 120672 - DNA, 20 bp, Artificial Sequence
  Description of Artificial Sequence: Synthetic oligonucleotide
  Target: ATXN1; (+) strand; PAM type: NRG; PAM sequence: AAG
ataatgagaggagagcaatt

SEQ ID NO: 120673 - DNA, 20 bp, Artificial Sequence
  Description of Artificial Sequence: Synthetic oligonucleotide
  Target: ATXN1; (+) strand; PAM type: NRG; PAM sequence: AAG
atgagaggagagcaattaag

SEQ ID NO: 120674 - DNA, 20 bp, Artificial Sequence
  Description of Artificial Sequence: Synthetic oligonucleotide
  Target: ATXN1; (+) strand; PAM type: NRG; PAM sequence: AAG
gagcaattaagaagattaca

SEQ ID NO: 120675 - DNA, 20 bp, Artificial Sequence
  Description of Artificial Sequence: Synthetic oligonucleotide
  Target: ATXN1; (+) strand; PAM type: NRG; PAM sequence: GAG
aattaagaagattacaaagt

SEQ ID NO: 120676 - DNA, 20 bp, Artificial Sequence
  Description of Artificial Sequence: Synthetic oligonucleotide
  Target: ATXN1; (+) strand; PAM type: NRG; PAM sequence: AAG
agtgagccatattcctcttc

SEQ ID NO: 120677 - DNA, 20 bp, Artificial Sequence
  Description of Artificial Sequence: Synthetic oligonucleotide
  Target: ATXN1; (+) strand; PAM type: NRG; PAM sequence: AGG
gtgagccatattcctcttca

SEQ ID NO: 120678 - DNA, 20 bp, Artificial Sequence
  Description of Artificial Sequence: Synthetic oligonucleotide
  Target: ATXN1; (+) strand; PAM type: NRG; PAM sequence: TGG
gccatattcctcttcaaggc

SEQ ID NO: 120679 - DNA, 20 bp, Artificial Sequence
  Description of Artificial Sequence: Synthetic oligonucleotide
  Target: ATXN1; (+) strand; PAM type: NRG; PAM sequence: GGG
ccatattcctcttcaaggct

SEQ ID NO: 120680 - DNA, 20 bp, Artificial Sequence
  Description of Artificial Sequence: Synthetic oligonucleotide
  Target: ATXN1; (+) strand; PAM type: NRG; PAM sequence: TGG
cctcttcaaggctgggtgca

SEQ ID NO: 120681 - DNA, 20 bp, Artificial Sequence
  Description of Artificial Sequence: Synthetic oligonucleotide
  Target: ATXN1; (+) strand; PAM type: NRG; PAM sequence: CAG
tgggtgcatggataaattac

SEQ ID NO: 120682 - DNA, 20 bp, Artificial Sequence
  Description of Artificial Sequence: Synthetic oligonucleotide
  Target: ATXN1; (+) strand; PAM type: NRG; PAM sequence: GAG
ggtgcatggataaattacca

SEQ ID NO: 120683 - DNA, 20 bp, Artificial Sequence
  Description of Artificial Sequence: Synthetic oligonucleotide
  Target: ATXN1; (+) strand; PAM type: NRG; PAM sequence: CAG
atggataaattaccagagct

SEQ ID NO: 120684 - DNA, 20 bp, Artificial Sequence
  Description of Artificial Sequence: Synthetic oligonucleotide
  Target: ATXN1; (+) strand; PAM type: NRG; PAM sequence: AAG
ataaattaccagagctcagt

SEQ ID NO: 120685 - DNA, 20 bp, Artificial Sequence
  Description of Artificial Sequence: Synthetic oligonucleotide
  Target: ATXN1; (+) strand; PAM type: NRG; PAM sequence: AAG
aattaccagagctcagtaag

SEQ ID NO: 120686 - DNA, 20 bp, Artificial Sequence
  Description of Artificial Sequence: Synthetic oligonucleotide
  Target: ATXN1; (+) strand; PAM type: NRG; PAM sequence: AGG
attaccagagctcagtaaga

SEQ ID NO: 120687 - DNA, 20 bp, Artificial Sequence
  Description of Artificial Sequence: Synthetic oligonucleotide
  Target: ATXN1; (+) strand; PAM type: NRG; PAM sequence: TGG
taagaaggctctcgttacac

SEQ ID NO: 120688 - DNA, 20 bp, Artificial Sequence
  Description of Artificial Sequence: Synthetic oligonucleotide
  Target: ATXN1; (+) strand; PAM type: NRG; PAM sequence: TGG
aaggctctcgttacactgga

SEQ ID NO: 120689 - DNA, 20 bp, Artificial Sequence
  Description of Artificial Sequence: Synthetic oligonucleotide
  Target: ATXN1; (+) strand; PAM type: NRG; PAM sequence: CAG
tcgttacactggatggcttt

SEQ ID NO: 120690 - DNA, 20 bp, Artificial Sequence
  Description of Artificial Sequence: Synthetic oligonucleotide
  Target: ATXN1; (+) strand; PAM type: NRG; PAM sequence: AGG
cgttacactggatggctttc

SEQ ID NO: 120691 - DNA, 20 bp, Artificial Sequence
  Description of Artificial Sequence: Synthetic oligonucleotide
  Target: ATXN1; (+) strand; PAM type: NRG; PAM sequence: CAG
acactggatggctttcaggc

SEQ ID NO: 120692 - DNA, 20 bp, Artificial Sequence
  Description of Artificial Sequence: Synthetic oligonucleotide
  Target: ATXN1; (+) strand; PAM type: NRG; PAM sequence: CAG
tttcaggccagacctgtcaa

SEQ ID NO: 120693 - DNA, 20 bp, Artificial Sequence
  Description of Artificial Sequence: Synthetic oligonucleotide
  Target: ATXN1; (+) strand; PAM type: NRG; PAM sequence: AGG
ttcaggccagacctgtcaac

SEQ ID NO: 120694 - DNA, 20 bp, Artificial Sequence
  Description of Artificial Sequence: Synthetic oligonucleotide
  Target: ATXN1; (+) strand; PAM type: NRG; PAM sequence: AAG
gccagacctgtcaacaggaa

SEQ ID NO: 120695 - DNA, 20 bp, Artificial Sequence
  Description of Artificial Sequence: Synthetic oligonucleotide
  Target: ATXN1; (+) strand; PAM type: NRG; PAM sequence: AGG
ccagacctgtcaacaggaaa

SEQ ID NO: 120696 - DNA, 20 bp, Artificial Sequence
  Description of Artificial Sequence: Synthetic oligonucleotide
  Target: ATXN1; (+) strand; PAM type: NRG; PAM sequence: GGG
cagacctgtcaacaggaaaa

SEQ ID NO: 120697 - DNA, 20 bp, Artificial Sequence
  Description of Artificial Sequence: Synthetic oligonucleotide
  Target: ATXN1; (+) strand; PAM type: NRG; PAM sequence: GGG
agacctgtcaacaggaaaag

SEQ ID NO: 120698 - DNA, 20 bp, Artificial Sequence
  Description of Artificial Sequence: Synthetic oligonucleotide
  Target: ATXN1; (+) strand; PAM type: NRG; PAM sequence: AAG
tgtcaacaggaaaaggggcc

SEQ ID NO: 120699 - DNA, 20 bp, Artificial Sequence
  Description of Artificial Sequence: Synthetic oligonucleotide
  Target: ATXN1; (+) strand; PAM type: NRG; PAM sequence: GAG
tcaacaggaaaaggggccaa

SEQ ID NO: 120700 - DNA, 20 bp, Artificial Sequence
  Description of Artificial Sequence: Synthetic oligonucleotide
  Target: ATXN1; (+) strand; PAM type: NRG; PAM sequence: AGG
caacaggaaaaggggccaag

SEQ ID NO: 120701 - DNA, 20 bp, Artificial Sequence
  Description of Artificial Sequence: Synthetic oligonucleotide
  Target: ATXN1; (+) strand; PAM type: NRG; PAM sequence: GGG
aacaggaaaaggggccaaga

SEQ ID NO: 120702 - DNA, 20 bp, Artificial Sequence
  Description of Artificial Sequence: Synthetic oligonucleotide
  Target: ATXN1; (+) strand; PAM type: NRG; PAM sequence: TGG
ggggccaagagggactgtca

SEQ ID NO: 120703 - DNA, 20 bp, Artificial Sequence
  Description of Artificial Sequence: Synthetic oligonucleotide
  Target: ATXN1; (+) strand; PAM type: NRG; PAM sequence: CAG
atgtctccaactctgcatgc

SEQ ID NO: 120704 - DNA, 20 bp, Artificial Sequence
  Description of Artificial Sequence: Synthetic oligonucleotide
  Target: ATXN1; (+) strand; PAM type: NRG; PAM sequence: AAG
gcatgccagtgctgataaac

SEQ ID NO: 120705 - DNA, 20 bp, Artificial Sequence
  Description of Artificial Sequence: Synthetic oligonucleotide
  Target: ATXN1; (+) strand; PAM type: NRG; PAM sequence: AAG
aaaacattaacctaattcac

SEQ ID NO: 120706 - DNA, 20 bp, Artificial Sequence
  Description of Artificial Sequence: Synthetic oligonucleotide
  Target: ATXN1; (+) strand; PAM type: NRG; PAM sequence: CAG
acaagaaaaactgataccat

SEQ ID NO: 120707 - DNA, 20 bp, Artificial Sequence
  Description of Artificial Sequence: Synthetic oligonucleotide
  Target: ATXN1; (+) strand; PAM type: NRG; PAM sequence: GAG
ctgataccatcagatgcttt

SEQ ID NO: 120708 - DNA, 20 bp, Artificial Sequence
  Description of Artificial Sequence: Synthetic oligonucleotide
  Target: ATXN1; (+) strand; PAM type: NRG; PAM sequence: TGG
tttgagatcgcctaacatct

SEQ ID NO: 120709 - DNA, 20 bp, Artificial Sequence
  Description of Artificial Sequence: Synthetic oligonucleotide
  Target: ATXN1; (+) strand; PAM type: NRG; PAM sequence: CGG
gatcgcctaacatcttggcc

SEQ ID NO: 120710 - DNA, 20 bp, Artificial Sequence
  Description of Artificial Sequence: Synthetic oligonucleotide
  Target: ATXN1; (+) strand; PAM type: NRG; PAM sequence: CAG
cgcctaacatcttggcccgg

SEQ ID NO: 120711 - DNA, 20 bp, Artificial Sequence
  Description of Artificial Sequence: Synthetic oligonucleotide
  Target: ATXN1; (+) strand; PAM type: NRG; PAM sequence: TGG
ggcagtccccacattctgcc

SEQ ID NO: 120712 - DNA, 20 bp, Artificial Sequence
  Description of Artificial Sequence: Synthetic oligonucleotide
  Target: ATXN1; (+) strand; PAM type: NRG; PAM sequence: TGG
aattcatttgttattctccg

SEQ ID NO: 120713 - DNA, 20 bp, Artificial Sequence
  Description of Artificial Sequence: Synthetic oligonucleotide
  Target: ATXN1; (+) strand; PAM type: NRG; PAM sequence: GGG
attcatttgttattctccgt

SEQ ID NO: 120714 - DNA, 20 bp, Artificial Sequence
  Description of Artificial Sequence: Synthetic oligonucleotide
  Target: ATXN1; (+) strand; PAM type: NRG; PAM sequence: CAG
ccgtgggattctatctgtac

SEQ ID NO: 120715 - DNA, 20 bp, Artificial Sequence
  Description of Artificial Sequence: Synthetic oligonucleotide
  Target: ATXN1; (+) strand; PAM type: NRG; PAM sequence: AAG
gggattctatctgtaccaga

SEQ ID NO: 120716 - DNA, 20 bp, Artificial Sequence
  Description of Artificial Sequence: Synthetic oligonucleotide
  Target: ATXN1; (+) strand; PAM type: NRG; PAM sequence: TGG
tctgtaccagaaagaccatg

SEQ ID NO: 120717 - DNA, 20 bp, Artificial Sequence
  Description of Artificial Sequence: Synthetic oligonucleotide
  Target: ATXN1; (+) strand; PAM type: NRG; PAM sequence: TAG
accatgtggtccatgatcct

SEQ ID NO: 120718 - DNA, 20 bp, Artificial Sequence
  Description of Artificial Sequence: Synthetic oligonucleotide
  Target: ATXN1; (+) strand; PAM type: NRG; PAM sequence: AAG
tgtggtccatgatccttagt

SEQ ID NO: 120719 - DNA, 20 bp, Artificial Sequence
  Description of Artificial Sequence: Synthetic oligonucleotide
  Target: ATXN1; (+) strand; PAM type: NRG; PAM sequence: TAG
tgacactcccatgatacact

SEQ ID NO: 120720 - DNA, 20 bp, Artificial Sequence
  Description of Artificial Sequence: Synthetic oligonucleotide
  Target: ATXN1; (+) strand; PAM type: NRG; PAM sequence: AAG
actcccatgatacacttagt

SEQ ID NO: 120721 - DNA, 20 bp, Artificial Sequence
  Description of Artificial Sequence: Synthetic oligonucleotide
  Target: ATXN1; (+) strand; PAM type: NRG; PAM sequence: TGG
agtaagtgacgttttcctcc

SEQ ID NO: 120722 - DNA, 20 bp, Artificial Sequence
  Description of Artificial Sequence: Synthetic oligonucleotide
  Target: ATXN1; (+) strand; PAM type: NRG; PAM sequence: GAG
taagtgacgttttcctcctg

SEQ ID NO: 120723 - DNA, 20 bp, Artificial Sequence
  Description of Artificial Sequence: Synthetic oligonucleotide
  Target: ATXN1; (+) strand; PAM type: NRG; PAM sequence: AGG
aagtgacgttttcctcctgg

SEQ ID NO: 120724 - DNA, 20 bp, Artificial Sequence
  Description of Artificial Sequence: Synthetic oligonucleotide
  Target: ATXN1; (+) strand; PAM type: NRG; PAM sequence: CAG
tttcctcctggaggcctgcc

SEQ ID NO: 120725 - DNA, 20 bp, Artificial Sequence
  Description of Artificial Sequence: Synthetic oligonucleotide
  Target: ATXN1; (+) strand; PAM type: NRG; PAM sequence: GAG
tcctggaggcctgcccagat

SEQ ID NO: 120726 - DNA, 20 bp, Artificial Sequence
  Description of Artificial Sequence: Synthetic oligonucleotide
  Target: ATXN1; (+) strand; PAM type: NRG; PAM sequence: AGG
cctggaggcctgcccagatg

SEQ ID NO: 120727 - DNA, 20 bp, Artificial Sequence
  Description of Artificial Sequence: Synthetic oligonucleotide
  Target: ATXN1; (+) strand; PAM type: NRG; PAM sequence: GGG
ctggaggcctgcccagatga

SEQ ID NO: 120728 - DNA, 20 bp, Artificial Sequence
  Description of Artificial Sequence: Synthetic oligonucleotide
  Target: ATXN1; (+) strand; PAM type: NRG; PAM sequence: TGG
gcctgcccagatgagggaaa

SEQ ID NO: 120729 - DNA, 20 bp, Artificial Sequence
  Description of Artificial Sequence: Synthetic oligonucleotide
  Target: ATXN1; (+) strand; PAM type: NRG; PAM sequence: GAG
ggaaatggaaaatcctcttt

SEQ ID NO: 120730 - DNA, 20 bp, Artificial Sequence
  Description of Artificial Sequence: Synthetic oligonucleotide
  Target: ATXN1; (+) strand; PAM type: NRG; PAM sequence: AAG
atggaaaatcctctttgagc

SEQ ID NO: 120731 - DNA, 20 bp, Artificial Sequence
  Description of Artificial Sequence: Synthetic oligonucleotide
  Target: ATXN1; (+) strand; PAM type: NRG; PAM sequence: AGG
tggaaaatcctctttgagca

SEQ ID NO: 120732 - DNA, 20 bp, Artificial Sequence
  Description of Artificial Sequence: Synthetic oligonucleotide
  Target: ATXN1; (+) strand; PAM type: NRG; PAM sequence: GAG
aactcccttctgaccctctc

SEQ ID NO: 120733 - DNA, 20 bp, Artificial Sequence
  Description of Artificial Sequence: Synthetic oligonucleotide
  Target: ATXN1; (+) strand; PAM type: NRG; PAM sequence: AGG
actcccttctgaccctctcg

SEQ ID NO: 120734 - DNA, 20 bp, Artificial Sequence
  Description of Artificial Sequence: Synthetic oligonucleotide
  Target: ATXN1; (+) strand; PAM type: NRG; PAM sequence: AAG
tcccttacttgcctttaacg

SEQ ID NO: 120735 - DNA, 20 bp, Artificial Sequence
  Description of Artificial Sequence: Synthetic oligonucleotide
  Target: ATXN1; (+) strand; PAM type: NRG; PAM sequence: CAG
acttgcctttaacgaagtgc

SEQ ID NO: 120736 - DNA, 20 bp, Artificial Sequence
  Description of Artificial Sequence: Synthetic oligonucleotide
  Target: ATXN1; (+) strand; PAM type: NRG; PAM sequence: CAG
gcctttaacgaagtgccagc

SEQ ID NO: 120737 - DNA, 20 bp, Artificial Sequence
  Description of Artificial Sequence: Synthetic oligonucleotide
  Target: ATXN1; (+) strand; PAM type: NRG; PAM sequence: TAG
agtgccagccagcacgttgc

SEQ ID NO: 120738 - DNA, 20 bp, Artificial Sequence
  Description of Artificial Sequence: Synthetic oligonucleotide
  Target: ATXN1; (+) strand; PAM type: NRG; PAM sequence: AGG
gtgccagccagcacgttgct

SEQ ID NO: 120739 - DNA, 20 bp, Artificial Sequence
  Description of Artificial Sequence: Synthetic oligonucleotide
  Target: ATXN1; (+) strand; PAM type: NRG; PAM sequence: TGG
cagcacgttgctaggacaac

SEQ ID NO: 120740 - DNA, 20 bp, Artificial Sequence
  Description of Artificial Sequence: Synthetic oligonucleotide
  Target: ATXN1; (+) strand; PAM type: NRG; PAM sequence: CGG
taggacaactggcgtcactg

SEQ ID NO: 120741 - DNA, 20 bp, Artificial Sequence
  Description of Artificial Sequence: Synthetic oligonucleotide
  Target: ATXN1; (+) strand; PAM type: NRG; PAM sequence: GAG
ggacaactggcgtcactgcg

SEQ ID NO: 120742 - DNA, 20 bp, Artificial Sequence
  Description of Artificial Sequence: Synthetic oligonucleotide
  Target: ATXN1; (+) strand; PAM type: NRG; PAM sequence: AGG
gacaactggcgtcactgcgg

SEQ ID NO: 120743 - DNA, 20 bp, Artificial Sequence
  Description of Artificial Sequence: Synthetic oligonucleotide
  Target: ATXN1; (+) strand; PAM type: NRG; PAM sequence: CAG
ctggcgtcactgcggaggca

SEQ ID NO: 120744 - DNA, 20 bp, Artificial Sequence
  Description of Artificial Sequence: Synthetic oligonucleotide
  Target: ATXN1; (+) strand; PAM type: NRG; PAM sequence: TAG
tcactgcggaggcacagaaa

SEQ ID NO: 120745 - DNA, 20 bp, Artificial Sequence
  Description of Artificial Sequence: Synthetic oligonucleotide
  Target: ATXN1; (+) strand; PAM type: NRG; PAM sequence: CAG
gaggcacagaaatagatcac

SEQ ID NO: 120746 - DNA, 20 bp, Artificial Sequence
  Description of Artificial Sequence: Synthetic oligonucleotide
  Target: ATXN1; (+) strand; PAM type: NRG; PAM sequence: TGG
gcacagaaatagatcaccag

SEQ ID NO: 120747 - DNA, 20 bp, Artificial Sequence
  Description of Artificial Sequence: Synthetic oligonucleotide
  Target: ATXN1; (+) strand; PAM type: NRG; PAM sequence: GGG
cacagaaatagatcaccagt

SEQ ID NO: 120748 - DNA, 20 bp, Artificial Sequence
  Description of Artificial Sequence: Synthetic oligonucleotide
  Target: ATXN1; (+) strand; PAM type: NRG; PAM sequence: GGG
acagaaatagatcaccagtg

SEQ ID NO: 120749 - DNA, 20 bp, Artificial Sequence
  Description of Artificial Sequence: Synthetic oligonucleotide
  Target: ATXN1; (+) strand; PAM type: NRG; PAM sequence: TAG
aaatagatcaccagtggggc

SEQ ID NO: 120750 - DNA, 20 bp, Artificial Sequence
  Description of Artificial Sequence: Synthetic oligonucleotide
  Target: ATXN1; (+) strand; PAM type: NRG; PAM sequence: AGG
aatagatcaccagtggggct

SEQ ID NO: 120751 - DNA, 20 bp, Artificial Sequence
  Description of Artificial Sequence: Synthetic oligonucleotide
  Target: ATXN1; (+) strand; PAM type: NRG; PAM sequence: TGG
caccagtggggctaggaacc

SEQ ID NO: 120752 - DNA, 20 bp, Artificial Sequence
  Description of Artificial Sequence: Synthetic oligonucleotide
  Target: ATXN1; (+) strand; PAM type: NRG; PAM sequence: CAG
tggattataaacgccaatga

SEQ ID NO: 120753 - DNA, 20 bp, Artificial Sequence
  Description of Artificial Sequence: Synthetic oligonucleotide
  Target: ATXN1; (+) strand; PAM type: NRG; PAM sequence: GAG
taaacgccaatgacagtgat

SEQ ID NO: 120754 - DNA, 20 bp, Artificial Sequence
  Description of Artificial Sequence: Synthetic oligonucleotide
  Target: ATXN1; (+) strand; PAM type: NRG; PAM sequence: TGG
gacagtgatgagatactgat

SEQ ID NO: 120755 - DNA, 20 bp, Artificial Sequence
  Description of Artificial Sequence: Synthetic oligonucleotide
  Target: ATXN1; (+) strand; PAM type: NRG; PAM sequence: CAG
agtgatgagatactgattgg

SEQ ID NO: 120756 - DNA, 20 bp, Artificial Sequence
  Description of Artificial Sequence: Synthetic oligonucleotide
  Target: ATXN1; (+) strand; PAM type: NRG; PAM sequence: TAG
ggcagctaatctgtccccta

SEQ ID NO: 120757 - DNA, 20 bp, Artificial Sequence
  Description of Artificial Sequence: Synthetic oligonucleotide
  Target: ATXN1; (+) strand; PAM type: NRG; PAM sequence: AAG
gctaatctgtcccctatagc

SEQ ID NO: 120758 - DNA, 20 bp, Artificial Sequence
  Description of Artificial Sequence: Synthetic oligonucleotide
  Target: ATXN1; (+) strand; PAM type: NRG; PAM sequence: GAG
gtcccctatagcaagtgacc

SEQ ID NO: 120759 - DNA, 20 bp, Artificial Sequence
  Description of Artificial Sequence: Synthetic oligonucleotide
  Target: ATXN1; (+) strand; PAM type: NRG; PAM sequence: CAG
agtgaccgagtaacactacc

SEQ ID NO: 120760 - DNA, 20 bp, Artificial Sequence
  Description of Artificial Sequence: Synthetic oligonucleotide
  Target: ATXN1; (+) strand; PAM type: NRG; PAM sequence: TGG
gaccgagtaacactacccag

SEQ ID NO: 120761 - DNA, 20 bp, Artificial Sequence
  Description of Artificial Sequence: Synthetic oligonucleotide
  Target: ATXN1; (+) strand; PAM type: NRG; PAM sequence: GGG
accgagtaacactacccagt

SEQ ID NO: 120762 - DNA, 20 bp, Artificial Sequence
  Description of Artificial Sequence: Synthetic oligonucleotide
  Target: ATXN1; (+) strand; PAM type: NRG; PAM sequence: CAG
gagtaacactacccagtggg

SEQ ID NO: 120763 - DNA, 20 bp, Artificial Sequence
  Description of Artificial Sequence: Synthetic oligonucleotide
  Target: ATXN1; (+) strand; PAM type: NRG; PAM sequence: TGG
atctacatttgtgcttgatg

SEQ ID NO: 120764 - DNA, 20 bp, Artificial Sequence
  Description of Artificial Sequence: Synthetic oligonucleotide
  Target: ATXN1; (+) strand; PAM type: NRG; PAM sequence: TAG
tacatttgtgcttgatgtgg

SEQ ID NO: 120765 - DNA, 20 bp, Artificial Sequence
  Description of Artificial Sequence: Synthetic oligonucleotide
  Target: ATXN1; (+) strand; PAM type: NRG; PAM sequence: GAG
tgcttgatgtggtagtgact

SEQ ID NO: 120766 - DNA, 20 bp, Artificial Sequence
  Description of Artificial Sequence: Synthetic oligonucleotide
  Target: ATXN1; (+) strand; PAM type: NRG; PAM sequence: AAG
ttgatgtggtagtgactgag

SEQ ID NO: 120767 - DNA, 20 bp, Artificial Sequence
  Description of Artificial Sequence: Synthetic oligonucleotide
  Target: ATXN1; (+) strand; PAM type: NRG; PAM sequence: AGG
tgatgtggtagtgactgaga

SEQ ID NO: 120768 - DNA, 20 bp, Artificial Sequence
  Description of Artificial Sequence: Synthetic oligonucleotide
  Target: ATXN1; (+) strand; PAM type: NRG; PAM sequence: GGG
gatgtggtagtgactgagaa

SEQ ID NO: 120769 - DNA, 20 bp, Artificial Sequence
  Description of Artificial Sequence: Synthetic oligonucleotide
  Target: ATXN1; (+) strand; PAM type: NRG; PAM sequence: GGG
atgtggtagtgactgagaag

SEQ ID NO: 120770 - DNA, 20 bp, Artificial Sequence
  Description of Artificial Sequence: Synthetic oligonucleotide
  Target: ATXN1; (+) strand; PAM type: NRG; PAM sequence: AAG
ggtagtgactgagaaggggc

SEQ ID NO: 120771 - DNA, 20 bp, Artificial Sequence
  Description of Artificial Sequence: Synthetic oligonucleotide
  Target: ATXN1; (+) strand; PAM type: NRG; PAM sequence: AGG
gtagtgactgagaaggggca

SEQ ID NO: 120772 - DNA, 20 bp, Artificial Sequence
  Description of Artificial Sequence: Synthetic oligonucleotide
  Target: ATXN1; (+) strand; PAM type: NRG; PAM sequence: TAG
actgagaaggggcaaggaac

SEQ ID NO: 120773 - DNA, 20 bp, Artificial Sequence
  Description of Artificial Sequence: Synthetic oligonucleotide
  Target: ATXN1; (+) strand; PAM type: NRG; PAM sequence: TAG
aaggggcaaggaactagctt

SEQ ID NO: 120774 - DNA, 20 bp, Artificial Sequence
  Description of Artificial Sequence: Synthetic oligonucleotide
  Target: ATXN1; (+) strand; PAM type: NRG; PAM sequence: TAG
ggcaaggaactagctttaga

SEQ ID NO: 120775 - DNA, 20 bp, Artificial Sequence
  Description of Artificial Sequence: Synthetic oligonucleotide
  Target: ATXN1; (+) strand; PAM type: NRG; PAM sequence: AGG
gcaaggaactagctttagat

SEQ ID NO: 120776 - DNA, 20 bp, Artificial Sequence
  Description of Artificial Sequence: Synthetic oligonucleotide
  Target: ATXN1; (+) strand; PAM type: NRG; PAM sequence: GAG
aaggaactagctttagatag

SEQ ID NO: 120777 - DNA, 20 bp, Artificial Sequence
  Description of Artificial Sequence: Synthetic oligonucleotide
  Target: ATXN1; (+) strand; PAM type: NRG; PAM sequence: GAG
gactctgttttgaattatgt

SEQ ID NO: 120778 - DNA, 20 bp, Artificial Sequence
  Description of Artificial Sequence: Synthetic oligonucleotide
  Target: ATXN1; (+) strand; PAM type: NRG; PAM sequence: CAG
ctgttttgaattatgtgagc

SEQ ID NO: 120779 - DNA, 20 bp, Artificial Sequence
  Description of Artificial Sequence: Synthetic oligonucleotide
  Target: ATXN1; (+) strand; PAM type: NRG; PAM sequence: TAG
ttttgaattatgtgagccag

SEQ ID NO: 120780 - DNA, 20 bp, Artificial Sequence
  Description of Artificial Sequence: Synthetic oligonucleotide
  Target: ATXN1; (+) strand; PAM type: NRG; PAM sequence: TAG
tatgtgagccagtagatatg

SEQ ID NO: 120781 - DNA, 20 bp, Artificial Sequence
  Description of Artificial Sequence: Synthetic oligonucleotide
  Target: ATXN1; (+) strand; PAM type: NRG; PAM sequence: TAG
catttgcacctttaatttgt

SEQ ID NO: 120782 - DNA, 20 bp, Artificial Sequence
  Description of Artificial Sequence: Synthetic oligonucleotide
  Target: ATXN1; (+) strand; PAM type: NRG; PAM sequence: TAG
tttgttagtttcctgaaaat

SEQ ID NO: 120783 - DNA, 20 bp, Artificial Sequence
  Description of Artificial Sequence: Synthetic oligonucleotide
  Target: ATXN1; (+) strand; PAM type: NRG; PAM sequence: AGG
ttgttagtttcctgaaaatt

SEQ ID NO: 120784 - DNA, 20 bp, Artificial Sequence
  Description of Artificial Sequence: Synthetic oligonucleotide
  Target: ATXN1; (+) strand; PAM type: NRG; PAM sequence: GGG
tgttagtttcctgaaaatta

SEQ ID NO: 120785 - DNA, 20 bp, Artificial Sequence
  Description of Artificial Sequence: Synthetic oligonucleotide
  Target: ATXN1; (+) strand; PAM type: NRG; PAM sequence: GAG
ttagtttcctgaaaattagg

SEQ ID NO: 120786 - DNA, 20 bp, Artificial Sequence
  Description of Artificial Sequence: Synthetic oligonucleotide
  Target: ATXN1; (+) strand; PAM type: NRG; PAM sequence: AGG
tagtttcctgaaaattaggg

SEQ ID NO: 120787 - DNA, 20 bp, Artificial Sequence
  Description of Artificial Sequence: Synthetic oligonucleotide
  Target: ATXN1; (+) strand; PAM type: NRG; PAM sequence: AAG
tttcctgaaaattagggagg

SEQ ID NO: 120788 - DNA, 20 bp, Artificial Sequence
  Description of Artificial Sequence: Synthetic oligonucleotide
  Target: ATXN1; (+) strand; PAM type: NRG; PAM sequence: AGG
ttcctgaaaattagggagga

SEQ ID NO: 120789 - DNA, 20 bp, Artificial Sequence
  Description of Artificial Sequence: Synthetic oligonucleotide
  Target: ATXN1; (+) strand; PAM type: NRG; PAM sequence: AAG
tagggaggaaggctgttcac

SEQ ID NO: 120790 - DNA, 20 bp, Artificial Sequence
  Description of Artificial Sequence: Synthetic oligonucleotide
  Target: ATXN1; (+) strand; PAM type: NRG; PAM sequence: AAG
ggaaggctgttcacaagccg

SEQ ID NO: 120791 - DNA, 20 bp, Artificial Sequence
  Description of Artificial Sequence: Synthetic oligonucleotide
  Target: ATXN1; (+) strand; PAM type: NRG; PAM sequence: CAG
gttcacaagccgaagtatga

SEQ ID NO: 120792 - DNA, 20 bp, Artificial Sequence
  Description of Artificial Sequence: Synthetic oligonucleotide
  Target: ATXN1; (+) strand; PAM type: NRG; PAM sequence: CAG
acaagccgaagtatgacagc

SEQ ID NO: 120793 - DNA, 20 bp, Artificial Sequence
  Description of Artificial Sequence: Synthetic oligonucleotide
  Target: ATXN1; (+) strand; PAM type: NRG; PAM sequence: CAG
cgaagtatgacagccagaaa

SEQ ID NO: 120794 - DNA, 20 bp, Artificial Sequence
  Description of Artificial Sequence: Synthetic oligonucleotide
  Target: ATXN1; (+) strand; PAM type: NRG; PAM sequence: AGG
gaagtatgacagccagaaac

SEQ ID NO: 120795 - DNA, 20 bp, Artificial Sequence
  Description of Artificial Sequence: Synthetic oligonucleotide
  Target: ATXN1; (+) strand; PAM type: NRG; PAM sequence: TAG
gtatgacagccagaaacagg

SEQ ID NO: 120796 - DNA, 20 bp, Artificial Sequence
  Description of Artificial Sequence: Synthetic oligonucleotide
  Target: ATXN1; (+) strand; PAM type: NRG; PAM sequence: GAG
atgacagccagaaacaggta

SEQ ID NO: 120797 - DNA, 20 bp, Artificial Sequence
  Description of Artificial Sequence: Synthetic oligonucleotide
  Target: ATXN1; (+) strand; PAM type: NRG; PAM sequence: GAG
cagaaacaggtagagccatt

SEQ ID NO: 120798 - DNA, 20 bp, Artificial Sequence
  Description of Artificial Sequence: Synthetic oligonucleotide
  Target: ATXN1; (+) strand; PAM type: NRG; PAM sequence: AGG
agaaacaggtagagccattg

SEQ ID NO: 120799 - DNA, 20 bp, Artificial Sequence
  Description of Artificial Sequence: Synthetic oligonucleotide
  Target: ATXN1; (+) strand; PAM type: NRG; PAM sequence: CAG
gagccattgaggttgccaaa

SEQ ID NO: 120800 - DNA, 20 bp, Artificial Sequence
  Description of Artificial Sequence: Synthetic oligonucleotide
  Target: ATXN1; (+) strand; PAM type: NRG; PAM sequence: AAG
ccattgaggttgccaaacag

SEQ ID NO: 120801 - DNA, 20 bp, Artificial Sequence
  Description of Artificial Sequence: Synthetic oligonucleotide
  Target: ATXN1; (+) strand; PAM type: NRG; PAM sequence: AGG
cattgaggttgccaaacaga

SEQ ID NO: 120802 - DNA, 20 bp, Artificial Sequence
  Description of Artificial Sequence: Synthetic oligonucleotide
  Target: ATXN1; (+) strand; PAM type: NRG; PAM sequence: TGG
gaaggaaaaaacaatctgtt

SEQ ID NO: 120803 - DNA, 20 bp, Artificial Sequence
  Description of Artificial Sequence: Synthetic oligonucleotide
  Target: ATXN1; (+) strand; PAM type: NRG; PAM sequence: AAG
aaaaaacaatctgtttggac

SEQ ID NO: 120804 - DNA, 20 bp, Artificial Sequence
  Description of Artificial Sequence: Synthetic oligonucleotide
  Target: ATXN1; (+) strand; PAM type: NRG; PAM sequence: TAG
caatctgtttggacaagcaa

SEQ ID NO: 120805 - DNA, 20 bp, Artificial Sequence
  Description of Artificial Sequence: Synthetic oligonucleotide
  Target: ATXN1; (+) strand; PAM type: NRG; PAM sequence: TAG
gctttctcctttctgaacaa

SEQ ID NO: 120806 - DNA, 20 bp, Artificial Sequence
  Description of Artificial Sequence: Synthetic oligonucleotide
  Target: ATXN1; (+) strand; PAM type: NRG; PAM sequence: TAG
tctactcttctaccttcttt

SEQ ID NO: 120807 - DNA, 20 bp, Artificial Sequence
  Description of Artificial Sequence: Synthetic oligonucleotide
  Target: ATXN1; (+) strand; PAM type: NRG; PAM sequence: GAG
tactcttctaccttctttta

SEQ ID NO: 120808 - DNA, 20 bp, Artificial Sequence
  Description of Artificial Sequence: Synthetic oligonucleotide
  Target: ATXN1; (+) strand; PAM type: NRG; PAM sequence: AAG
ctaccttcttttagagatca

SEQ ID NO: 120809 - DNA, 20 bp, Artificial Sequence
  Description of Artificial Sequence: Synthetic oligonucleotide
  Target: ATXN1; (+) strand; PAM type: NRG; PAM sequence: AAG
ccttcttttagagatcaaag

SEQ ID NO: 120810 - DNA, 20 bp, Artificial Sequence
  Description of Artificial Sequence: Synthetic oligonucleotide
  Target: ATXN1; (+) strand; PAM type: NRG; PAM sequence: AGG
cttcttttagagatcaaaga

SEQ ID NO: 120811 - DNA, 20 bp, Artificial Sequence
  Description of Artificial Sequence: Synthetic oligonucleotide
  Target: ATXN1; (+) strand; PAM type: NRG; PAM sequence: AAG
tttagagatcaaagaaggaa

SEQ ID NO: 120812 - DNA, 20 bp, Artificial Sequence
  Description of Artificial Sequence: Synthetic oligonucleotide
  Target: ATXN1; (+) strand; PAM type: NRG; PAM sequence: AGG
ttagagatcaaagaaggaaa

SEQ ID NO: 120813 - DNA, 20 bp, Artificial Sequence
  Description of Artificial Sequence: Synthetic oligonucleotide
  Target: ATXN1; (+) strand; PAM type: NRG; PAM sequence: AAG
gatcaaagaaggaaaaggca

SEQ ID NO: 120814 - DNA, 20 bp, Artificial Sequence
  Description of Artificial Sequence: Synthetic oligonucleotide
  Target: ATXN1; (+) strand; PAM type: NRG; PAM sequence: AGG
atcaaagaaggaaaaggcaa

SEQ ID NO: 120815 - DNA, 20 bp, Artificial Sequence
  Description of Artificial Sequence: Synthetic oligonucleotide
  Target: ATXN1; (+) strand; PAM type: NRG; PAM sequence: CGG
aaggaaaaggcaaaggaaac

SEQ ID NO: 120816 - DNA, 20 bp, Artificial Sequence
  Description of Artificial Sequence: Synthetic oligonucleotide
  Target: ATXN1; (+) strand; PAM type: NRG; PAM sequence: TAG
ggcaaaggaaaccggaaaac

SEQ ID NO: 120817 - DNA, 20 bp, Artificial Sequence
  Description of Artificial Sequence: Synthetic oligonucleotide
  Target: ATXN1; (+) strand; PAM type: NRG; PAM sequence: AGG
gcaaaggaaaccggaaaact

SEQ ID NO: 120818 - DNA, 20 bp, Artificial Sequence
  Description of Artificial Sequence: Synthetic oligonucleotide
  Target: ATXN1; (+) strand; PAM type: NRG; PAM sequence: GGG
caaaggaaaccggaaaacta

SEQ ID NO: 120819 - DNA, 20 bp, Artificial Sequence
  Description of Artificial Sequence: Synthetic oligonucleotide
  Target: ATXN1; (+) strand; PAM type: NRG; PAM sequence: TGG
cggaaaactagggcttgcca

SEQ ID NO: 120820 - DNA, 20 bp, Artificial Sequence
  Description of Artificial Sequence: Synthetic oligonucleotide
  Target: ATXN1; (+) strand; PAM type: NRG; PAM sequence: AAG
actagggcttgccatggttg

SEQ ID NO: 120821 - DNA, 20 bp, Artificial Sequence
  Description of Artificial Sequence: Synthetic oligonucleotide
  Target: ATXN1; (+) strand; PAM type: NRG; PAM sequence: AAG
agggcttgccatggttgaag

SEQ ID NO: 120822 - DNA, 20 bp, Artificial Sequence
  Description of Artificial Sequence: Synthetic oligonucleotide
  Target: ATXN1; (+) strand; PAM type: NRG; PAM sequence: GAG
ggcttgccatggttgaagaa

SEQ ID NO: 120823 - DNA, 20 bp, Artificial Sequence
  Description of Artificial Sequence: Synthetic oligonucleotide
  Target: ATXN1; (+) strand; PAM type: NRG; PAM sequence: CAG
aagagaataatctttgtgcc

SEQ ID NO: 120824 - DNA, 20 bp, Artificial Sequence
  Description of Artificial Sequence: Synthetic oligonucleotide
  Target: ATXN1; (+) strand; PAM type: NRG; PAM sequence: CAG
gcccagttctctttgttctg

SEQ ID NO: 120825 - DNA, 20 bp, Artificial Sequence
  Description of Artificial Sequence: Synthetic oligonucleotide
  Target: ATXN1; (+) strand; PAM type: NRG; PAM sequence: AGG
cccagttctctttgttctgc

SEQ ID NO: 120826 - DNA, 20 bp, Artificial Sequence
  Description of Artificial Sequence: Synthetic oligonucleotide
  Target: ATXN1; (+) strand; PAM type: NRG; PAM sequence: GGG
ccagttctctttgttctgca

SEQ ID NO: 120827 - DNA, 20 bp, Artificial Sequence
  Description of Artificial Sequence: Synthetic oligonucleotide
  Target: ATXN1; (+) strand; PAM type: NRG; PAM sequence: GAG
ttctctttgttctgcagggt

SEQ ID NO: 120828 - DNA, 20 bp, Artificial Sequence
  Description of Artificial Sequence: Synthetic oligonucleotide
  Target: ATXN1; (+) strand; PAM type: NRG; PAM sequence: CGG
gagttttacaatgcttataa

SEQ ID NO: 120829 - DNA, 20 bp, Artificial Sequence
  Description of Artificial Sequence: Synthetic oligonucleotide
  Target: ATXN1; (+) strand; PAM type: NRG; PAM sequence: GGG
agttttacaatgcttataac

SEQ ID NO: 120830 - DNA, 20 bp, Artificial Sequence
  Description of Artificial Sequence: Synthetic oligonucleotide
  Target: ATXN1; (+) strand; PAM type: NRG; PAM sequence: TAG
tttacaatgcttataacggg

SEQ ID NO: 120831 - DNA, 20 bp, Artificial Sequence
  Description of Artificial Sequence: Synthetic oligonucleotide
  Target: ATXN1; (+) strand; PAM type: NRG; PAM sequence: TAG
ttataacgggtagcaactcg

SEQ ID NO: 120832 - DNA, 20 bp, Artificial Sequence
  Description of Artificial Sequence: Synthetic oligonucleotide
  Target: ATXN1; (+) strand; PAM type: NRG; PAM sequence: AGG
tataacgggtagcaactcgt

SEQ ID NO: 120833 - DNA, 20 bp, Artificial Sequence
  Description of Artificial Sequence: Synthetic oligonucleotide
  Target: ATXN1; (+) strand; PAM type: NRG; PAM sequence: GAG
taacgggtagcaactcgtag

SEQ ID NO: 120834 - DNA, 20 bp, Artificial Sequence
  Description of Artificial Sequence: Synthetic oligonucleotide
  Target: ATXN1; (+) strand; PAM type: NRG; PAM sequence: AAG
tcgtaggagccccatgcatt

SEQ ID NO: 120835 - DNA, 20 bp, Artificial Sequence
  Description of Artificial Sequence: Synthetic oligonucleotide
  Target: ATXN1; (+) strand; PAM type: NRG; PAM sequence: AAG
tgcattaagactgcctatca

SEQ ID NO: 120836 - DNA, 20 bp, Artificial Sequence
  Description of Artificial Sequence: Synthetic oligonucleotide
  Target: ATXN1; (+) strand; PAM type: NRG; PAM sequence: TGG
aagactgcctatcaaagtct

SEQ ID NO: 120837 - DNA, 20 bp, Artificial Sequence
  Description of Artificial Sequence: Synthetic oligonucleotide
  Target: ATXN1; (+) strand; PAM type: NRG; PAM sequence: TAG
cctatcaaagtcttggattt

SEQ ID NO: 120838 - DNA, 20 bp, Artificial Sequence
  Description of Artificial Sequence: Synthetic oligonucleotide
  Target: ATXN1; (+) strand; PAM type: NRG; PAM sequence: TGG
aaagtcttggattttagccc

SEQ ID NO: 120839 - DNA, 20 bp, Artificial Sequence
  Description of Artificial Sequence: Synthetic oligonucleotide
  Target: ATXN1; (+) strand; PAM type: NRG; PAM sequence: GAG
agtcttggattttagccctg

SEQ ID NO: 120840 - DNA, 20 bp, Artificial Sequence
  Description of Artificial Sequence: Synthetic oligonucleotide
  Target: ATXN1; (+) strand; PAM type: NRG; PAM sequence: AAG
tttttttttcaattctatgc

SEQ ID NO: 120841 - DNA, 20 bp, Artificial Sequence
  Description of Artificial Sequence: Synthetic oligonucleotide
  Target: ATXN1; (+) strand; PAM type: NRG; PAM sequence: AAG
tcaattctatgcaagccaca

SEQ ID NO: 120842 - DNA, 20 bp, Artificial Sequence
  Description of Artificial Sequence: Synthetic oligonucleotide
  Target: ATXN1; (+) strand; PAM type: NRG; PAM sequence: AGG
caattctatgcaagccacaa

SEQ ID NO: 120843 - DNA, 20 bp, Artificial Sequence
  Description of Artificial Sequence: Synthetic oligonucleotide
  Target: ATXN1; (+) strand; PAM type: NRG; PAM sequence: TGG
ctatgcaagccacaaaggct

SEQ ID NO: 120844 - DNA, 20 bp, Artificial Sequence
  Description of Artificial Sequence: Synthetic oligonucleotide
  Target: ATXN1; (+) strand; PAM type: NRG; PAM sequence: GGG
tatgcaagccacaaaggctt

SEQ ID NO: 120845 - DNA, 20 bp, Artificial Sequence
  Description of Artificial Sequence: Synthetic oligonucleotide
  Target: ATXN1; (+) strand; PAM type: NRG; PAM sequence: AAG
gcaagccacaaaggcttggg

SEQ ID NO: 120846 - DNA, 20 bp, Artificial Sequence
  Description of Artificial Sequence: Synthetic oligonucleotide
  Target: ATXN1; (+) strand; PAM type: NRG; PAM sequence: AAG
agccacaaaggcttgggaag

SEQ ID NO: 120847 - DNA, 20 bp, Artificial Sequence
  Description of Artificial Sequence: Synthetic oligonucleotide
  Target: ATXN1; (+) strand; PAM type: NRG; PAM sequence: AAG
acaaaggcttgggaagaaga

SEQ ID NO: 120848 - DNA, 20 bp, Artificial Sequence
  Description of Artificial Sequence: Synthetic oligonucleotide
  Target: ATXN1; (+) strand; PAM type: NRG; PAM sequence: AGG
caaaggcttgggaagaagaa

SEQ ID NO: 120849 - DNA, 20 bp, Artificial Sequence
  Description of Artificial Sequence: Synthetic oligonucleotide
  Target: ATXN1; (+) strand; PAM type: NRG; PAM sequence: AAG
aagaaaggaaaaatgaaatg

SEQ ID NO: 120850 - DNA, 20 bp, Artificial Sequence
  Description of Artificial Sequence: Synthetic oligonucleotide
  Target: ATXN1; (+) strand; PAM type: NRG; PAM sequence: GAG
gaaaggaaaaatgaaatgaa

SEQ ID NO: 120851 - DNA, 20 bp, Artificial Sequence
  Description of Artificial Sequence: Synthetic oligonucleotide
  Target: ATXN1; (+) strand; PAM type: NRG; PAM sequence: TGG
tgaaatgaagagcaacctaa

SEQ ID NO: 120852 - DNA, 20 bp, Artificial Sequence
  Description of Artificial Sequence: Synthetic oligonucleotide
  Target: ATXN1; (+) strand; PAM type: NRG; PAM sequence: TAG
gagcaacctaatggaaactt

SEQ ID NO: 120853 - DNA, 20 bp, Artificial Sequence
  Description of Artificial Sequence: Synthetic oligonucleotide
  Target: ATXN1; (+) strand; PAM type: NRG; PAM sequence: AAG
ctttagaaaaccattttatc

SEQ ID NO: 120854 - DNA, 20 bp, Artificial Sequence
  Description of Artificial Sequence: Synthetic oligonucleotide
  Target: ATXN1; (+) strand; PAM type: NRG; PAM sequence: GAG
ttagaaaaccattttatcaa

SEQ ID NO: 120855 - DNA, 20 bp, Artificial Sequence
  Description of Artificial Sequence: Synthetic oligonucleotide
  Target: ATXN1; (+) strand; PAM type: NRG; PAM sequence: CAG
atcaagagcatttttatttc

SEQ ID NO: 120856 - DNA, 20 bp, Artificial Sequence
  Description of Artificial Sequence: Synthetic oligonucleotide
  Target: ATXN1; (+) strand; PAM type: NRG; PAM sequence: AAG
tttttatttccagatgcaca

SEQ ID NO: 120857 - DNA, 20 bp, Artificial Sequence
  Description of Artificial Sequence: Synthetic oligonucleotide
  Target: ATXN1; (+) strand; PAM type: NRG; PAM sequence: AGG
ttttatttccagatgcacaa

SEQ ID NO: 120858 - DNA, 20 bp, Artificial Sequence
  Description of Artificial Sequence: Synthetic oligonucleotide
  Target: ATXN1; (+) strand; PAM type: NRG; PAM sequence: AAG
tatttccagatgcacaaagg

SEQ ID NO: 120859 - DNA, 20 bp, Artificial Sequence
  Description of Artificial Sequence: Synthetic oligonucleotide
  Target: ATXN1; (+) strand; PAM type: NRG; PAM sequence: AGG
atttccagatgcacaaagga

SEQ ID NO: 120860 - DNA, 20 bp, Artificial Sequence
  Description of Artificial Sequence: Synthetic oligonucleotide
  Target: ATXN1; (+) strand; PAM type: NRG; PAM sequence: TGG
ccagatgcacaaaggaaggc

SEQ ID NO: 120861 - DNA, 20 bp, Artificial Sequence
  Description of Artificial Sequence: Synthetic oligonucleotide
  Target: ATXN1; (+) strand; PAM type: NRG; PAM sequence: GAG
atgcacaaaggaaggctggt

SEQ ID NO: 120862 - DNA, 20 bp, Artificial Sequence
  Description of Artificial Sequence: Synthetic oligonucleotide
  Target: ATXN1; (+) strand; PAM type: NRG; PAM sequence: AGG
tgcacaaaggaaggctggtg

SEQ ID NO: 120863 - DNA, 20 bp, Artificial Sequence
  Description of Artificial Sequence: Synthetic oligonucleotide
  Target: ATXN1; (+) strand; PAM type: NRG; PAM sequence: TGG
caaaggaaggctggtgagga

SEQ ID NO: 120864 - DNA, 20 bp, Artificial Sequence
  Description of Artificial Sequence: Synthetic oligonucleotide
  Target: ATXN1; (+) strand; PAM type: NRG; PAM sequence: CAG
tggtgaggatggctgatgtg

SEQ ID NO: 120865 - DNA, 20 bp, Artificial Sequence
  Description of Artificial Sequence: Synthetic oligonucleotide
  Target: ATXN1; (+) strand; PAM type: NRG; PAM sequence: CAG
agattgaaacacgtaaccaa

SEQ ID NO: 120866 - DNA, 20 bp, Artificial Sequence
  Description of Artificial Sequence: Synthetic oligonucleotide
  Target: ATXN1; (+) strand; PAM type: NRG; PAM sequence: TGG
gaaacacgtaaccaacagcc

SEQ ID NO: 120867 - DNA, 20 bp, Artificial Sequence
  Description of Artificial Sequence: Synthetic oligonucleotide
  Target: ATXN1; (+) strand; PAM type: NRG; PAM sequence: GGG
aaacacgtaaccaacagcct

SEQ ID NO: 120868 - DNA, 20 bp, Artificial Sequence
  Description of Artificial Sequence: Synthetic oligonucleotide
  Target: ATXN1; (+) strand; PAM type: NRG; PAM sequence: CAG
ccaacagcctgggacctgtg

SEQ ID NO: 120869 - DNA, 20 bp, Artificial Sequence
  Description of Artificial Sequence: Synthetic oligonucleotide
  Target: ATXN1; (+) strand; PAM type: NRG; PAM sequence: AGG
caacagcctgggacctgtgc

SEQ ID NO: 120870 - DNA, 20 bp, Artificial Sequence
  Description of Artificial Sequence: Synthetic oligonucleotide
  Target: ATXN1; (+) strand; PAM type: NRG; PAM sequence: GGG
aacagcctgggacctgtgca

SEQ ID NO: 120871 - DNA, 20 bp, Artificial Sequence
  Description of Artificial Sequence: Synthetic oligonucleotide
  Target: ATXN1; (+) strand; PAM type: NRG; PAM sequence: GGG
acagcctgggacctgtgcag

SEQ ID NO: 120872 - DNA, 20 bp, Artificial Sequence
  Description of Artificial Sequence: Synthetic oligonucleotide
  Target: ATXN1; (+) strand; PAM type: NRG; PAM sequence: CAG
ctgggacctgtgcaggggtc

SEQ ID NO: 120873 - DNA, 20 bp, Artificial Sequence
  Description of Artificial Sequence: Synthetic oligonucleotide
  Target: ATXN1; (+) strand; PAM type: NRG; PAM sequence: CAG
ggacctgtgcaggggtccag

SEQ ID NO: 120874 - DNA, 20 bp, Artificial Sequence
  Description of Artificial Sequence: Synthetic oligonucleotide
  Target: ATXN1; (+) strand; PAM type: NRG; PAM sequence: CAG
ggtccagcagcgaattctga

SEQ ID NO: 120875 - DNA, 20 bp, Artificial Sequence
  Description of Artificial Sequence: Synthetic oligonucleotide
  Target: ATXN1; (+) strand; PAM type: NRG; PAM sequence: TGG
agcgaattctgacagcaatg

SEQ ID NO: 120876 - DNA, 20 bp, Artificial Sequence
  Description of Artificial Sequence: Synthetic oligonucleotide
  Target: ATXN1; (+) strand; PAM type: NRG; PAM sequence: GGG
gcgaattctgacagcaatgt

SEQ ID NO: 120877 - DNA, 20 bp, Artificial Sequence
  Description of Artificial Sequence: Synthetic oligonucleotide
  Target: ATXN1; (+) strand; PAM type: NRG; PAM sequence: CAG
aattctgacagcaatgtggg

SEQ ID NO: 120878 - DNA, 20 bp, Artificial Sequence
  Description of Artificial Sequence: Synthetic oligonucleotide
  Target: ATXN1; (+) strand; PAM type: NRG; PAM sequence: AGG
attctgacagcaatgtgggc

SEQ ID NO: 120879 - DNA, 20 bp, Artificial Sequence
  Description of Artificial Sequence: Synthetic oligonucleotide
  Target: ATXN1; (+) strand; PAM type: NRG; PAM sequence: CAG
aatgtgggcaggtcacctcc

SEQ ID NO: 120880 - DNA, 20 bp, Artificial Sequence
  Description of Artificial Sequence: Synthetic oligonucleotide
  Target: ATXN1; (+) strand; PAM type: NRG; PAM sequence: CAG
ggcaggtcacctcccagtgc

SEQ ID NO: 120881 - DNA, 20 bp, Artificial Sequence
  Description of Artificial Sequence: Synthetic oligonucleotide
  Target: ATXN1; (+) strand; PAM type: NRG; PAM sequence: AGG
gcaggtcacctcccagtgcc

SEQ ID NO: 120882 - DNA, 20 bp, Artificial Sequence
  Description of Artificial Sequence: Synthetic oligonucleotide
  Target: ATXN1; (+) strand; PAM type: NRG; PAM sequence: AAG
cctcccagtgccaggcactc

SEQ ID NO: 120883 - DNA, 20 bp, Artificial Sequence
  Description of Artificial Sequence: Synthetic oligonucleotide
  Target: ATXN1; (+) strand; PAM type: NRG; PAM sequence: TGG
cagtgccaggcactcaagac

SEQ ID NO: 120884 - DNA, 20 bp, Artificial Sequence
  Description of Artificial Sequence: Synthetic oligonucleotide
  Target: ATXN1; (+) strand; PAM type: NRG; PAM sequence: GGG
agtgccaggcactcaagact

SEQ ID NO: 120885 - DNA, 20 bp, Artificial Sequence
  Description of Artificial Sequence: Synthetic oligonucleotide
  Target: ATXN1; (+) strand; PAM type: NRG; PAM sequence: AAG
caagactgggaaatgatcac

SEQ ID NO: 120886 - DNA, 20 bp, Artificial Sequence
  Description of Artificial Sequence: Synthetic oligonucleotide
  Target: ATXN1; (+) strand; PAM type: NRG; PAM sequence: GAG
atgctgtttaaaaatgtatt

SEQ ID NO: 120887 - DNA, 20 bp, Artificial Sequence
  Description of Artificial Sequence: Synthetic oligonucleotide
  Target: ATXN1; (+) strand; PAM type: NRG; PAM sequence: AAG
tgtttaaaaatgtattgaga

SEQ ID NO: 120888 - DNA, 20 bp, Artificial Sequence
  Description of Artificial Sequence: Synthetic oligonucleotide
  Target: ATXN1; (+) strand; PAM type: NRG; PAM sequence: AAG
ttaaaaatgtattgagaaag

SEQ ID NO: 120889 - DNA, 20 bp, Artificial Sequence
  Description of Artificial Sequence: Synthetic oligonucleotide
  Target: ATXN1; (+) strand; PAM type: NRG; PAM sequence: TAG
aaaatgtattgagaaagaag

SEQ ID NO: 120890 - DNA, 20 bp, Artificial Sequence
  Description of Artificial Sequence: Synthetic oligonucleotide
  Target: ATXN1; (+) strand; PAM type: NRG; PAM sequence: AAG
gagaaagaagtagaatttaa

SEQ ID NO: 120891 - DNA, 20 bp, Artificial Sequence
  Description of Artificial Sequence: Synthetic oligonucleotide
  Target: ATXN1; (+) strand; PAM type: NRG; PAM sequence: TAG
aaagaagtagaatttaaaag

SEQ ID NO: 120892 - DNA, 20 bp, Artificial Sequence
  Description of Artificial Sequence: Synthetic oligonucleotide
  Target: ATXN1; (+) strand; PAM type: NRG; PAM sequence: AAG
gaagtagaatttaaaagtag

SEQ ID NO: 120893 - DNA, 20 bp, Artificial Sequence
  Description of Artificial Sequence: Synthetic oligonucleotide
  Target: ATXN1; (+) strand; PAM type: NRG; PAM sequence: AAG
gtagaatttaaaagtagaag

SEQ ID NO: 120894 - DNA, 20 bp, Artificial Sequence
  Description of Artificial Sequence: Synthetic oligonucleotide
  Target: ATXN1; (+) strand; PAM type: NRG; PAM sequence: TGG
aatttaaaagtagaagaaga

SEQ ID NO: 120895 - DNA, 20 bp, Artificial Sequence
  Description of Artificial Sequence: Synthetic oligonucleotide
  Target: ATXN1; (+) strand; PAM type: NRG; PAM sequence: AAG
aaaagtagaagaagatggtt

SEQ ID NO: 120896 - DNA, 20 bp, Artificial Sequence
  Description of Artificial Sequence: Synthetic oligonucleotide
  Target: ATXN1; (+) strand; PAM type: NRG; PAM sequence: GAG
aagtagaagaagatggttaa

SEQ ID NO: 120897 - DNA, 20 bp, Artificial Sequence
  Description of Artificial Sequence: Synthetic oligonucleotide
  Target: ATXN1; (+) strand; PAM type: NRG; PAM sequence: AAG
agaagatggttaagagtcca

SEQ ID NO: 120898 - DNA, 20 bp, Artificial Sequence
  Description of Artificial Sequence: Synthetic oligonucleotide
  Target: ATXN1; (+) strand; PAM type: NRG; PAM sequence: GAG
aagatggttaagagtccaaa

SEQ ID NO: 120899 - DNA, 20 bp, Artificial Sequence
  Description of Artificial Sequence: Synthetic oligonucleotide
  Target: ATXN1; (+) strand; PAM type: NRG; PAM sequence: GAG
atgatgataaaaacctgtct

SEQ ID NO: 120900 - DNA, 20 bp, Artificial Sequence
  Description of Artificial Sequence: Synthetic oligonucleotide
  Target: ATXN1; (+) strand; PAM type: NRG; PAM sequence: TGG
ataaaaacctgtctgagttt

SEQ ID NO: 120901 - DNA, 20 bp, Artificial Sequence
  Description of Artificial Sequence: Synthetic oligonucleotide
  Target: ATXN1; (+) strand; PAM type: NRG; PAM sequence: AAG
tgtctgagttttggaaataa

SEQ ID NO: 120902 - DNA, 20 bp, Artificial Sequence
  Description of Artificial Sequence: Synthetic oligonucleotide
  Target: ATXN1; (+) strand; PAM type: NRG; PAM sequence: TAG
ttggaaataaaagattatga

SEQ ID NO: 120903 - DNA, 20 bp, Artificial Sequence
  Description of Artificial Sequence: Synthetic oligonucleotide
  Target: ATXN1; (+) strand; PAM type: NRG; PAM sequence: GAG
ggaaataaaagattatgata

SEQ ID NO: 120904 - DNA, 20 bp, Artificial Sequence
  Description of Artificial Sequence: Synthetic oligonucleotide
  Target: ATXN1; (+) strand; PAM type: NRG; PAM sequence: AGG
gaaataaaagattatgatag

SEQ ID NO: 120905 - DNA, 20 bp, Artificial Sequence
  Description of Artificial Sequence: Synthetic oligonucleotide
  Target: ATXN1; (+) strand; PAM type: NRG; PAM sequence: TAG
taaaagattatgatagagga

SEQ ID NO: 120906 - DNA, 20 bp, Artificial Sequence
  Description of Artificial Sequence: Synthetic oligonucleotide
  Target: ATXN1; (+) strand; PAM type: NRG; PAM sequence: AAG
taccatttatgtttccattt

SEQ ID NO: 120907 - DNA, 20 bp, Artificial Sequence
  Description of Artificial Sequence: Synthetic oligonucleotide
  Target: ATXN1; (+) strand; PAM type: NRG; PAM sequence: AGG
accatttatgtttccattta

SEQ ID NO: 120908 - DNA, 20 bp, Artificial Sequence
  Description of Artificial Sequence: Synthetic oligonucleotide
  Target: ATXN1; (+) strand; PAM type: NRG; PAM sequence: GAG
catttatgtttccatttaag

SEQ ID NO: 120909 - DNA, 20 bp, Artificial Sequence
  Description of Artificial Sequence: Synthetic oligonucleotide
  Target: ATXN1; (+) strand; PAM type: NRG; PAM sequence: AAG
catttaaggagactctcctt

SEQ ID NO: 120910 - DNA, 20 bp, Artificial Sequence
  Description of Artificial Sequence: Synthetic oligonucleotide
  Target: ATXN1; (+) strand; PAM type: NRG; PAM sequence: AAG
taaggagactctccttaagc

SEQ ID NO: 120911 - DNA, 20 bp, Artificial Sequence
  Description of Artificial Sequence: Synthetic oligonucleotide
  Target: ATXN1; (+) strand; PAM type: NRG; PAM sequence: CAG
tctccttaagcaagttgttt

SEQ ID NO: 120912 - DNA, 20 bp, Artificial Sequence
  Description of Artificial Sequence: Synthetic oligonucleotide
  Target: ATXN1; (+) strand; PAM type: NRG; PAM sequence: AGG
ctccttaagcaagttgtttc

SEQ ID NO: 120913 - DNA, 20 bp, Artificial Sequence
  Description of Artificial Sequence: Synthetic oligonucleotide
  Target: ATXN1; (+) strand; PAM type: NRG; PAM sequence: AAG
gcaagttgtttcaggaatat

SEQ ID NO: 120914 - DNA, 20 bp, Artificial Sequence
  Description of Artificial Sequence: Synthetic oligonucleotide
  Target: ATXN1; (+) strand; PAM type: NRG; PAM sequence: TAG
aaaacttaatttctctaaca

SEQ ID NO: 120915 - DNA, 20 bp, Artificial Sequence
  Description of Artificial Sequence: Synthetic oligonucleotide
  Target: ATXN1; (+) strand; PAM type: NRG; PAM sequence: AGG
aaacttaatttctctaacat

SEQ ID NO: 120916 - DNA, 20 bp, Artificial Sequence
  Description of Artificial Sequence: Synthetic oligonucleotide
  Target: ATXN1; (+) strand; PAM type: NRG; PAM sequence: CAG
tctctaacataggtttgaaa

SEQ ID NO: 120917 - DNA, 20 bp, Artificial Sequence
  Description of Artificial Sequence: Synthetic oligonucleotide
  Target: ATXN1; (+) strand; PAM type: NRG; PAM sequence: TAG
aatcatgtaacatacttgtt

SEQ ID NO: 120918 - DNA, 20 bp, Artificial Sequence
  Description of Artificial Sequence: Synthetic oligonucleotide
  Target: ATXN1; (+) strand; PAM type: NRG; PAM sequence: AGG
atcatgtaacatacttgttt

SEQ ID NO: 120919 - DNA, 20 bp, Artificial Sequence
  Description of Artificial Sequence: Synthetic oligonucleotide
  Target: ATXN1; (+) strand; PAM type: NRG; PAM sequence: TGG
aacatacttgtttaggtgtc

SEQ ID NO: 120920 - DNA, 20 bp, Artificial Sequence
  Description of Artificial Sequence: Synthetic oligonucleotide
  Target: ATXN1; (+) strand; PAM type: NRG; PAM sequence: AAG
acttgtttaggtgtctggaa

SEQ ID NO: 120921 - DNA, 20 bp, Artificial Sequence
  Description of Artificial Sequence: Synthetic oligonucleotide
  Target: ATXN1; (+) strand; PAM type: NRG; PAM sequence: AGG
cttgtttaggtgtctggaaa

SEQ ID NO: 120922 - DNA, 20 bp, Artificial Sequence
  Description of Artificial Sequence: Synthetic oligonucleotide
  Target: ATXN1; (+) strand; PAM type: NRG; PAM sequence: CAG
gaaaaggttaacataatctt

SEQ ID NO: 120923 - DNA, 20 bp, Artificial Sequence
  Description of Artificial Sequence: Synthetic oligonucleotide
  Target: ATXN1; (+) strand; PAM type: NRG; PAM sequence: AGG
aaaaggttaacataatcttc

SEQ ID NO: 120924 - DNA, 20 bp, Artificial Sequence
  Description of Artificial Sequence: Synthetic oligonucleotide
  Target: ATXN1; (+) strand; PAM type: NRG; PAM sequence: TAG
aacataatcttcaggattta

SEQ ID NO: 120925 - DNA, 20 bp, Artificial Sequence
  Description of Artificial Sequence: Synthetic oligonucleotide
  Target: ATXN1; (+) strand; PAM type: NRG; PAM sequence: AAG
ataatcttcaggatttatag

SEQ ID NO: 120926 - DNA, 20 bp, Artificial Sequence
  Description of Artificial Sequence: Synthetic oligonucleotide
  Target: ATXN1; (+) strand; PAM type: NRG; PAM sequence: TGG
tcttcaggatttatagaaga

SEQ ID NO: 120927 - DNA, 20 bp, Artificial Sequence
  Description of Artificial Sequence: Synthetic oligonucleotide
  Target: ATXN1; (+) strand; PAM type: NRG; PAM sequence: CAG
agaagatggattaattcttt

SEQ ID NO: 120928 - DNA, 20 bp, Artificial Sequence
  Description of Artificial Sequence: Synthetic oligonucleotide
  Target: ATXN1; (+) strand; PAM type: NRG; PAM sequence: TAG
tttcagtctacaattctact

SEQ ID NO: 120929 - DNA, 20 bp, Artificial Sequence
  Description of Artificial Sequence: Synthetic oligonucleotide
  Target: ATXN1; (+) strand; PAM type: NRG; PAM sequence: TAG
cttagcaataatttattaca

SEQ ID NO: 120930 - DNA, 20 bp, Artificial Sequence
  Description of Artificial Sequence: Synthetic oligonucleotide
  Target: ATXN1; (+) strand; PAM type: NRG; PAM sequence: TGG
atttattacatagctaccac

SEQ ID NO: 120931 - DNA, 20 bp, Artificial Sequence
  Description of Artificial Sequence: Synthetic oligonucleotide
  Target: ATXN1; (+) strand; PAM type: NRG; PAM sequence: AAG
tggaaatttaacatgaattt

SEQ ID NO: 120932 - DNA, 20 bp, Artificial Sequence
  Description of Artificial Sequence: Synthetic oligonucleotide
  Target: ATXN1; (+) strand; PAM type: NRG; PAM sequence: TGG
aatttaacatgaatttaagt

SEQ ID NO: 120933 - DNA, 20 bp, Artificial Sequence
  Description of Artificial Sequence: Synthetic oligonucleotide
  Target: ATXN1; (+) strand; PAM type: NRG; PAM sequence: GAG
tttaacatgaatttaagttg

SEQ ID NO: 120934 - DNA, 20 bp, Artificial Sequence
  Description of Artificial Sequence: Synthetic oligonucleotide
  Target: ATXN1; (+) strand; PAM type: NRG; PAM sequence: TGG
atgaatttaagttggagaca

SEQ ID NO: 120935 - DNA, 20 bp, Artificial Sequence
  Description of Artificial Sequence: Synthetic oligonucleotide
  Target: ATXN1; (+) strand; PAM type: NRG; PAM sequence: TGG
agacatggttaatattttta

SEQ ID NO: 120936 - DNA, 20 bp, Artificial Sequence
  Description of Artificial Sequence: Synthetic oligonucleotide
  Target: ATXN1; (+) strand; PAM type: NRG; PAM sequence: AAG
ataatatgattcttttacaa

SEQ ID NO: 120937 - DNA, 20 bp, Artificial Sequence
  Description of Artificial Sequence: Synthetic oligonucleotide
  Target: ATXN1; (+) strand; PAM type: NRG; PAM sequence: TAG
ttttacaaaagtgaaaaatt

SEQ ID NO: 120938 - DNA, 20 bp, Artificial Sequence
  Description of Artificial Sequence: Synthetic oligonucleotide
  Target: ATXN1; (+) strand; PAM type: NRG; PAM sequence: AAG
atttagataattaaaaaatg

SEQ ID NO: 120939 - DNA, 20 bp, Artificial Sequence
  Description of Artificial Sequence: Synthetic oligonucleotide
  Target: ATXN1; (+) strand; PAM type: NRG; PAM sequence: TAG
ttctatttgtctgtttacat

SEQ ID NO: 120940 - DNA, 20 bp, Artificial Sequence
  Description of Artificial Sequence: Synthetic oligonucleotide
  Target: ATXN1; (+) strand; PAM type: NRG; PAM sequence: AAG
tgtctgtttacattagtcct

SEQ ID NO: 120941 - DNA, 20 bp, Artificial Sequence
  Description of Artificial Sequence: Synthetic oligonucleotide
  Target: ATXN1; (+) strand; PAM type: NRG; PAM sequence: AGG
gtctgtttacattagtccta

SEQ ID NO: 120942 - DNA, 20 bp, Artificial Sequence
  Description of Artificial Sequence: Synthetic oligonucleotide
  Target: ATXN1; (+) strand; PAM type: NRG; PAM sequence: GAG
ctgtttacattagtcctaag

SEQ ID NO: 120943 - DNA, 20 bp, Artificial Sequence
  Description of Artificial Sequence: Synthetic oligonucleotide
  Target: ATXN1; (+) strand; PAM type: NRG; PAM sequence: AAG
ggagtaatttatgtgttgtt

SEQ ID NO: 120944 - DNA, 20 bp, Artificial Sequence
  Description of Artificial Sequence: Synthetic oligonucleotide
  Target: ATXN1; (+) strand; PAM type: NRG; PAM sequence: TAG
tatgtgttgttaagaaccaa

SEQ ID NO: 120945 - DNA, 20 bp, Artificial Sequence
  Description of Artificial Sequence: Synthetic oligonucleotide
  Target: ATXN1; (+) strand; PAM type: NRG; PAM sequence: TGG
aagaaccaatagattttgtt

SEQ ID NO: 120946 - DNA, 20 bp, Artificial Sequence
  Description of Artificial Sequence: Synthetic oligonucleotide
  Target: ATXN1; (+) strand; PAM type: NRG; PAM sequence: GGG
agaaccaatagattttgttt

SEQ ID NO: 120947 - DNA, 20 bp, Artificial Sequence
  Description of Artificial Sequence: Synthetic oligonucleotide
  Target: ATXN1; (+) strand; PAM type: NRG; PAM sequence: TAG
tatgactaaacaatgtcaac

SEQ ID NO: 120948 - DNA, 20 bp, Artificial Sequence
  Description of Artificial Sequence: Synthetic oligonucleotide
  Target: ATXN1; (+) strand; PAM type: NRG; PAM sequence: CAG
aactagttcttatcactatt

SEQ ID NO: 120949 - DNA, 20 bp, Artificial Sequence
  Description of Artificial Sequence: Synthetic oligonucleotide
  Target: ATXN1; (+) strand; PAM type: NRG; PAM sequence: TGG
atccctgcccttctttattg

SEQ ID NO: 120950 - DNA, 20 bp, Artificial Sequence
  Description of Artificial Sequence: Synthetic oligonucleotide
  Target: ATXN1; (+) strand; PAM type: NRG; PAM sequence: GAG
attgtggattcttgaacatt

SEQ ID NO: 120951 - DNA, 20 bp, Artificial Sequence
  Description of Artificial Sequence: Synthetic oligonucleotide
  Target: ATXN1; (+) strand; PAM type: NRG; PAM sequence: TAG
ccacctaaaaaatacatctt

SEQ ID NO: 120952 - DNA, 20 bp, Artificial Sequence
  Description of Artificial Sequence: Synthetic oligonucleotide
  Target: ATXN1; (+) strand; PAM type: NRG; PAM sequence: TGG
aatacatctttagttttgtt

SEQ ID NO: 120953 - DNA, 20 bp, Artificial Sequence
  Description of Artificial Sequence: Synthetic oligonucleotide
  Target: ATXN1; (+) strand; PAM type: NRG; PAM sequence: GGG
atacatctttagttttgttt

SEQ ID NO: 120954 - DNA, 20 bp, Artificial Sequence
  Description of Artificial Sequence: Synthetic oligonucleotide
  Target: ATXN1; (+) strand; PAM type: NRG; PAM sequence: AAG
tgtttgggtttttctgtaca

SEQ ID NO: 120955 - DNA, 20 bp, Artificial Sequence
  Description of Artificial Sequence: Synthetic oligonucleotide
  Target: ATXN1; (+) strand; PAM type: NRG; PAM sequence: CAG
gggtttttctgtacaaagtt

SEQ ID NO: 120956 - DNA, 20 bp, Artificial Sequence
  Description of Artificial Sequence: Synthetic oligonucleotide
  Target: ATXN1; (+) strand; PAM type: NRG; PAM sequence: TGG
ttttctgtacaaagttcagt

SEQ ID NO: 120957 - DNA, 20 bp, Artificial Sequence
  Description of Artificial Sequence: Synthetic oligonucleotide
  Target: ATXN1; (+) strand; PAM type: NRG; PAM sequence: TGG
aacactgcccttactaatgc

SEQ ID NO: 120958 - DNA, 20 bp, Artificial Sequence
  Description of Artificial Sequence: Synthetic oligonucleotide
  Target: ATXN1; (+) strand; PAM type: NRG; PAM sequence: GGG
acactgcccttactaatgct

SEQ ID NO: 120959 - DNA, 20 bp, Artificial Sequence
  Description of Artificial Sequence: Synthetic oligonucleotide
  Target: ATXN1; (+) strand; PAM type: NRG; PAM sequence: GAG
actgcccttactaatgctgg

SEQ ID NO: 120960 - DNA, 20 bp, Artificial Sequence
  Description of Artificial Sequence: Synthetic oligonucleotide
  Target: ATXN1; (+) strand; PAM type: NRG; PAM sequence: AGG
ctgcccttactaatgctggg

SEQ ID NO: 120961 - DNA, 20 bp, Artificial Sequence
  Description of Artificial Sequence: Synthetic oligonucleotide
  Target: ATXN1; (+) strand; PAM type: NRG; PAM sequence: TAG
tgctgggaggcatcattctt

SEQ ID NO: 120962 - DNA, 20 bp, Artificial Sequence
  Description of Artificial Sequence: Synthetic oligonucleotide
  Target: ATXN1; (+) strand; PAM type: NRG; PAM sequence: AGG
gctgggaggcatcattcttt

SEQ ID NO: 120963 - DNA, 20 bp, Artificial Sequence
  Description of Artificial Sequence: Synthetic oligonucleotide
  Target: ATXN1; (+) strand; PAM type: NRG; PAM sequence: AAG
catcattctttaggcatccc

SEQ ID NO: 120964 - DNA, 20 bp, Artificial Sequence
  Description of Artificial Sequence: Synthetic oligonucleotide
  Target: ATXN1; (+) strand; PAM type: NRG; PAM sequence: AAG
tgcttcaacttttacatata

SEQ ID NO: 120965 - DNA, 20 bp, Artificial Sequence
  Description of Artificial Sequence: Synthetic oligonucleotide
  Target: ATXN1; (+) strand; PAM type: NRG; PAM sequence: CAG
tataaagatccaaaatgtgc

SEQ ID NO: 120966 - DNA, 20 bp, Artificial Sequence
  Description of Artificial Sequence: Synthetic oligonucleotide
  Target: ATXN1; (+) strand; PAM type: NRG; PAM sequence: AGG
ataaagatccaaaatgtgcc

SEQ ID NO: 120967 - DNA, 20 bp, Artificial Sequence
  Description of Artificial Sequence: Synthetic oligonucleotide
  Target: ATXN1; (+) strand; PAM type: NRG; PAM sequence: TAG
gatccaaaatgtgccaggcg

SEQ ID NO: 120968 - DNA, 20 bp, Artificial Sequence
  Description of Artificial Sequence: Synthetic oligonucleotide
  Target: ATXN1; (+) strand; PAM type: NRG; PAM sequence: TGG
ccaaaatgtgccaggcgtag

SEQ ID NO: 120969 - DNA, 20 bp, Artificial Sequence
  Description of Artificial Sequence: Synthetic oligonucleotide
  Target: ATXN1; (+) strand; PAM type: NRG; PAM sequence: CAG
gtggctgatgcctataatcc

SEQ ID NO: 120970 - DNA, 20 bp, Artificial Sequence
  Description of Artificial Sequence: Synthetic oligonucleotide
  Target: ATXN1; (+) strand; PAM type: NRG; PAM sequence: TGG
tgcctataatcccagcattt

SEQ ID NO: 120971 - DNA, 20 bp, Artificial Sequence
  Description of Artificial Sequence: Synthetic oligonucleotide
  Target: ATXN1; (+) strand; PAM type: NRG; PAM sequence: GGG
gcctataatcccagcatttt

SEQ ID NO: 120972 - DNA, 20 bp, Artificial Sequence
  Description of Artificial Sequence: Synthetic oligonucleotide
  Target: ATXN1; (+) strand; PAM type: NRG; PAM sequence: AAG
tataatcccagcattttggg

SEQ ID NO: 120973 - DNA, 20 bp, Artificial Sequence
  Description of Artificial Sequence: Synthetic oligonucleotide
  Target: ATXN1; (+) strand; PAM type: NRG; PAM sequence: GAG
tcccagcattttgggaagcc

SEQ ID NO: 120974 - DNA, 20 bp, Artificial Sequence
  Description of Artificial Sequence: Synthetic oligonucleotide
  Target: ATXN1; (+) strand; PAM type: NRG; PAM sequence: AGG
cccagcattttgggaagccg

SEQ ID NO: 120975 - DNA, 20 bp, Artificial Sequence
  Description of Artificial Sequence: Synthetic oligonucleotide
  Target: ATXN1; (+) strand; PAM type: NRG; PAM sequence: TGG
agcattttgggaagccgagg

SEQ ID NO: 120976 - DNA, 20 bp, Artificial Sequence
  Description of Artificial Sequence: Synthetic oligonucleotide
  Target: ATXN1; (+) strand; PAM type: NRG; PAM sequence: GGG
gcattttgggaagccgaggt

SEQ ID NO: 120977 - DNA, 20 bp, Artificial Sequence
  Description of Artificial Sequence: Synthetic oligonucleotide
  Target: ATXN1; (+) strand; PAM type: NRG; PAM sequence: CAG
ttttgggaagccgaggtggg

SEQ ID NO: 120978 - DNA, 20 bp, Artificial Sequence
  Description of Artificial Sequence: Synthetic oligonucleotide
  Target: ATXN1; (+) strand; PAM type: NRG; PAM sequence: GAG
ccgaggtgggcagatcactt

SEQ ID NO: 120979 - DNA, 20 bp, Artificial Sequence
  Description of Artificial Sequence: Synthetic oligonucleotide
  Target: ATXN1; (+) strand; PAM type: NRG; PAM sequence: AAG
tgggcagatcacttgagctc

SEQ ID NO: 120980 - DNA, 20 bp, Artificial Sequence
  Description of Artificial Sequence: Synthetic oligonucleotide
  Target: ATXN1; (+) strand; PAM type: NRG; PAM sequence: GAG
ggcagatcacttgagctcaa

SEQ ID NO: 120981 - DNA, 20 bp, Artificial Sequence
  Description of Artificial Sequence: Synthetic oligonucleotide
  Target: ATXN1; (+) strand; PAM type: NRG; PAM sequence: GAG
tcacttgagctcaagagttt

SEQ ID NO: 120982 - DNA, 20 bp, Artificial Sequence
  Description of Artificial Sequence: Synthetic oligonucleotide
  Target: ATXN1; (+) strand; PAM type: NRG; PAM sequence: CAG
tgagctcaagagtttgagat

SEQ ID NO: 120983 - DNA, 20 bp, Artificial Sequence
  Description of Artificial Sequence: Synthetic oligonucleotide
  Target: ATXN1; (+) strand; PAM type: NRG; PAM sequence: TGG
tcaagagtttgagatcagcc

SEQ ID NO: 120984 - DNA, 20 bp, Artificial Sequence
  Description of Artificial Sequence: Synthetic oligonucleotide
  Target: ATXN1; (+) strand; PAM type: NRG; PAM sequence: TGG
tgagatcagcctggccaaca

SEQ ID NO: 120985 - DNA, 20 bp, Artificial Sequence
  Description of Artificial Sequence: Synthetic oligonucleotide
  Target: ATXN1; (+) strand; PAM type: NRG; PAM sequence: TAG
tctacaaaaaatacaaaaat

SEQ ID NO: 120986 - DNA, 20 bp, Artificial Sequence
  Description of Artificial Sequence: Synthetic oligonucleotide
  Target: ATXN1; (+) strand; PAM type: NRG; PAM sequence: CGG
caaaaaatacaaaaattagc

SEQ ID NO: 120987 - DNA, 20 bp, Artificial Sequence
  Description of Artificial Sequence: Synthetic oligonucleotide
  Target: ATXN1; (+) strand; PAM type: NRG; PAM sequence: GGG
aaaaaatacaaaaattagcc

SEQ ID NO: 120988 - DNA, 20 bp, Artificial Sequence
  Description of Artificial Sequence: Synthetic oligonucleotide
  Target: ATXN1; (+) strand; PAM type: NRG; PAM sequence: GAG
aaaaattagccgggcattgt

SEQ ID NO: 120989 - DNA, 20 bp, Artificial Sequence
  Description of Artificial Sequence: Synthetic oligonucleotide
  Target: ATXN1; (+) strand; PAM type: NRG; PAM sequence: AGG
aaaattagccgggcattgtg

SEQ ID NO: 120990 - DNA, 20 bp, Artificial Sequence
  Description of Artificial Sequence: Synthetic oligonucleotide
  Target: ATXN1; (+) strand; PAM type: NRG; PAM sequence: CAG
gtgaggcacacctgtaatcc

SEQ ID NO: 120991 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatcccagctact

SEQ ID NO: 120992 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccagctactt

SEQ ID NO: 120993 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctacttgg

SEQ ID NO: 120994 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctacttggg

SEQ ID NO: 120995 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttgggaggct

SEQ ID NO: 120996 - DNA, 20 bp, Artificial Sequence
  Description of Artificial Sequence: Synthetic oligonucleotide
  Target: ATXN1; (+) strand; PAM type: NRG; PAM sequence: AGG
cccagctacttgggaggctg

SEQ ID NO: 120997 - DNA, 20 bp, Artificial Sequence
  Description of Artificial Sequence: Synthetic oligonucleotide
  Target: ATXN1; (+) strand; PAM type: NRG; PAM sequence: CAG
agctacttgggaggctgagg

SEQ ID NO: 120998 - DNA, 20 bp, Artificial Sequence
  Description of Artificial Sequence: Synthetic oligonucleotide
  Target: ATXN1; (+) strand; PAM type: NRG; PAM sequence: AGG
gctacttgggaggctgaggc

SEQ ID NO: 120999 - DNA, 20 bp, Artificial Sequence
  Description of Artificial Sequence: Synthetic oligonucleotide
  Target: ATXN1; (+) strand; PAM type: NRG; PAM sequence: GAG
tacttgggaggctgaggcag

SEQ ID NO: 121000 - DNA, 20 bp, Artificial Sequence
  Description of Artificial Sequence: Synthetic oligonucleotide
  Target: ATXN1; (+) strand; PAM type: NRG; PAM sequence: CAG
gcaggagaatcgcttgaacc

SEQ ID NO: 121001 - DNA, 20 bp, Artificial Sequence
  Description of Artificial Sequence: Synthetic oligonucleotide
  Target: ATXN1; (+) strand; PAM type: NRG; PAM sequence: AAG
ggagaatcgcttgaacccag

SEQ ID NO: 121002 - DNA, 20 bp, Artificial Sequence
  Description of Artificial Sequence: Synthetic oligonucleotide
  Target: ATXN1; (+) strand; PAM type: NRG; PAM sequence: AGG
gagaatcgcttgaacccaga

SEQ ID NO: 121003 - DNA, 20 bp, Artificial Sequence
  Description of Artificial Sequence: Synthetic oligonucleotide
  Target: ATXN1; (+) strand; PAM type: NRG; PAM sequence: TGG
aatcgcttgaacccagaagg

SEQ ID NO: 121004 - DNA, 20 bp, Artificial Sequence
  Description of Artificial Sequence: Synthetic oligonucleotide
  Target: ATXN1; (+) strand; PAM type: NRG; PAM sequence: GAG
tcgcttgaacccagaaggtg

SEQ ID NO: 121005 - DNA, 20 bp, Artificial Sequence
  Description of Artificial Sequence: Synthetic oligonucleotide
  Target: ATXN1; (+) strand; PAM type: NRG; PAM sequence: AGG
cgcttgaacccagaaggtgg

SEQ ID NO: 121006 - DNA, 20 bp, Artificial Sequence
  Description of Artificial Sequence: Synthetic oligonucleotide
  Target: ATXN1; (+) strand; PAM type: NRG; PAM sequence: CAG
aacccagaaggtggaggttg

SEQ ID NO: 121007 - DNA, 20 bp, Artificial Sequence
  Description of Artificial Sequence: Synthetic oligonucleotide
  Target: ATXN1; (+) strand; PAM type: NRG; PAM sequence: GAG
cagaaggtggaggttgcagt

SEQ ID NO: 121008 - DNA, 20 bp, Artificial Sequence
  Description of Artificial Sequence: Synthetic oligonucleotide
  Target: ATXN1; (+) strand; PAM type: NRG; PAM sequence: AAG
ggtggaggttgcagtgagtt

SEQ ID NO: 121009 - DNA, 20 bp, Artificial Sequence
  Description of Artificial Sequence: Synthetic oligonucleotide
  Target: ATXN1; (+) strand; PAM type: NRG; PAM sequence: CAG
aagatcgtgccactgccctc

SEQ ID NO: 121010 - DNA, 20 bp, Artificial Sequence
  Description of Artificial Sequence: Synthetic oligonucleotide
  Target: ATXN1; (+) strand; PAM type: NRG; PAM sequence: TGG
cgtgccactgccctccagcc

SEQ ID NO: 121011 - DNA, 20 bp, Artificial Sequence
  Description of Artificial Sequence: Synthetic oligonucleotide
  Target: ATXN1; (+) strand; PAM type: NRG; PAM sequence: GGG
gtgccactgccctccagcct

SEQ ID NO: 121012 - DNA, 20 bp, Artificial Sequence
  Description of Artificial Sequence: Synthetic oligonucleotide
  Target: ATXN1; (+) strand; PAM type: NRG; PAM sequence: CAG
gccctccagcctgggcaaca

SEQ ID NO: 121013 - DNA, 20 bp, Artificial Sequence
  Description of Artificial Sequence: Synthetic oligonucleotide
  Target: ATXN1; (+) strand; PAM type: NRG; PAM sequence: AAG
tccagcctgggcaacacagc

SEQ ID NO: 121014 - DNA, 20 bp, Artificial Sequence
  Description of Artificial Sequence: Synthetic oligonucleotide
  Target: ATXN1; (+) strand; PAM type: NRG; PAM sequence: GAG
cagcctgggcaacacagcaa

SEQ ID NO: 121015 - DNA, 20 bp, Artificial Sequence
  Description of Artificial Sequence: Synthetic oligonucleotide
  Target: ATXN1; (+) strand; PAM type: NRG; PAM sequence: AAG
aaatatctaaaatgatcctg

SEQ ID NO: 121016 - DNA, 20 bp, Artificial Sequence
  Description of Artificial Sequence: Synthetic oligonucleotide
  Target: ATXN1; (+) strand; PAM type: NRG; PAM sequence: TGG
taaaatgatcctgaagaaaa

SEQ ID NO: 121017 - DNA, 20 bp, Artificial Sequence
  Description of Artificial Sequence: Synthetic oligonucleotide
  Target: ATXN1; (+) strand; PAM type: NRG; PAM sequence: TGG
aatgatcctgaagaaaatgg

SEQ ID NO: 121018 - DNA, 20 bp, Artificial Sequence
  Description of Artificial Sequence: Synthetic oligonucleotide
  Target: ATXN1; (+) strand; PAM type: NRG; PAM sequence: TGG
tcctgaagaaaatggtggcc

SEQ ID NO: 121019 - DNA, 20 bp, Artificial Sequence
  Description of Artificial Sequence: Synthetic oligonucleotide
  Target: ATXN1; (+) strand; PAM type: NRG; PAM sequence: TGG
tgaagaaaatggtggcctgg

SEQ ID NO: 121020 - DNA, 20 bp, Artificial Sequence
  Description of Artificial Sequence: Synthetic oligonucleotide
  Target: ATXN1; (+) strand; PAM type: NRG; PAM sequence: CAG
tcctcatgctatgtttttgt

SEQ ID NO: 121021 - DNA, 20 bp, Artificial Sequence
  Description of Artificial Sequence: Synthetic oligonucleotide
  Target: ATXN1; (+) strand; PAM type: NRG; PAM sequence: TGG
tcaaaccaaacaatttctga

SEQ ID NO: 121022 - DNA, 20 bp, Artificial Sequence
  Description of Artificial Sequence: Synthetic oligonucleotide
  Target: ATXN1; (+) strand; PAM type: NRG; PAM sequence: AAG
aaccaaacaatttctgatgg

SEQ ID NO: 121023 - DNA, 20 bp, Artificial Sequence
  Description of Artificial Sequence: Synthetic oligonucleotide
  Target: ATXN1; (+) strand; PAM type: NRG; PAM sequence: AGG
accaaacaatttctgatgga

SEQ ID NO: 121024 - DNA, 20 bp, Artificial Sequence
  Description of Artificial Sequence: Synthetic oligonucleotide
  Target: ATXN1; (+) strand; PAM type: NRG; PAM sequence: AAG
aacaatttctgatggaagga

SEQ ID NO: 121025 - DNA, 20 bp, Artificial Sequence
  Description of Artificial Sequence: Synthetic oligonucleotide
  Target: ATXN1; (+) strand; PAM type: NRG; PAM sequence: TGG
ttctgatggaaggaaagctc

SEQ ID NO: 121026 - DNA, 20 bp, Artificial Sequence
  Description of Artificial Sequence: Synthetic oligonucleotide
  Target: ATXN1; (+) strand; PAM type: NRG; PAM sequence: GAG
ggaaggaaagctctggctct

SEQ ID NO: 121027 - DNA, 20 bp, Artificial Sequence
  Description of Artificial Sequence: Synthetic oligonucleotide
  Target: ATXN1; (+) strand; PAM type: NRG; PAM sequence: CAG
gctctgagctctcacatgcc

SEQ ID NO: 121028 - DNA, 20 bp, Artificial Sequence
  Description of Artificial Sequence: Synthetic oligonucleotide
  Target: ATXN1; (+) strand; PAM type: NRG; PAM sequence: CAG
agctctcacatgcccagaca

SEQ ID NO: 121029 - DNA, 20 bp, Artificial Sequence
  Description of Artificial Sequence: Synthetic oligonucleotide
  Target: ATXN1; (+) strand; PAM type: NRG; PAM sequence: AAG
tctcacatgcccagacacag

SEQ ID NO: 121030 - DNA, 20 bp, Artificial Sequence
  Description of Artificial Sequence: Synthetic oligonucleotide
  Target: ATXN1; (+) strand; PAM type: NRG; PAM sequence: TAG
cacatgcccagacacagaag

SEQ ID NO: 121031 - DNA, 20 bp, Artificial Sequence
  Description of Artificial Sequence: Synthetic oligonucleotide
  Target: ATXN1; (+) strand; PAM type: NRG; PAM sequence: TAG
agtacataaaatactattcc

SEQ ID NO: 121032 - DNA, 20 bp, Artificial Sequence
  Description of Artificial Sequence: Synthetic oligonucleotide
  Target: ATXN1; (+) strand; PAM type: NRG; PAM sequence: AAG
ctattcctagtctcttctca

SEQ ID NO: 121033 - DNA, 20 bp, Artificial Sequence
  Description of Artificial Sequence: Synthetic oligonucleotide
  Target: ATXN1; (+) strand; PAM type: NRG; PAM sequence: TGG
ctctaaatacacatatatat

SEQ ID NO: 121034 - DNA, 20 bp, Artificial Sequence
  Description of Artificial Sequence: Synthetic oligonucleotide
  Target: ATXN1; (+) strand; PAM type: NRG; PAM sequence: GGG
tctaaatacacatatatatt

SEQ ID NO: 121035 - DNA, 20 bp, Artificial Sequence
  Description of Artificial Sequence: Synthetic oligonucleotide
  Target: ATXN1; (+) strand; PAM type: NRG; PAM sequence: AAG
tgaaattccacctctgcttg

SEQ ID NO: 121036 - DNA, 20 bp, Artificial Sequence
  Description of Artificial Sequence: Synthetic oligonucleotide
  Target: ATXN1; (+) strand; PAM type: NRG; PAM sequence: AGG
gaaattccacctctgcttga

SEQ ID NO: 121037 - DNA, 20 bp, Artificial Sequence
  Description of Artificial Sequence: Synthetic oligonucleotide
  Target: ATXN1; (+) strand; PAM type: NRG; PAM sequence: TAG
ctctgcttgaaggctcaatt

SEQ ID NO: 121038 - DNA, 20 bp, Artificial Sequence
  Description of Artificial Sequence: Synthetic oligonucleotide
  Target: ATXN1; (+) strand; PAM type: NRG; PAM sequence: CAG
agatgtcttccctgaaattc

SEQ ID NO: 121039 - DNA, 20 bp, Artificial Sequence
  Description of Artificial Sequence: Synthetic oligonucleotide
  Target: ATXN1; (+) strand; PAM type: NRG; PAM sequence: CGG
ctcttacccatcgtcccttt

SEQ ID NO: 121040 - DNA, 20 bp, Artificial Sequence
  Description of Artificial Sequence: Synthetic oligonucleotide
  Target: ATXN1; (+) strand; PAM type: NRG; PAM sequence: AAG
gtacacctgactccgccacc

SEQ ID NO: 121041 - DNA, 20 bp, Artificial Sequence
  Description of Artificial Sequence: Synthetic oligonucleotide
  Target: ATXN1; (+) strand; PAM type: NRG; PAM sequence: TAG
caccaagtacatccttccca

SEQ ID NO: 121042 - DNA, 20 bp, Artificial Sequence
  Description of Artificial Sequence: Synthetic oligonucleotide
  Target: ATXN1; (+) strand; PAM type: NRG; PAM sequence: TAG
tccttcccatagcaccttcc

SEQ ID NO: 121043 - DNA, 20 bp, Artificial Sequence
  Description of Artificial Sequence: Synthetic oligonucleotide
  Target: ATXN1; (+) strand; PAM type: NRG; PAM sequence: GAG
cttcccatagcaccttccta

SEQ ID NO: 121044 - DNA, 20 bp, Artificial Sequence
  Description of Artificial Sequence: Synthetic oligonucleotide
  Target: ATXN1; (+) strand; PAM type: NRG; PAM sequence: AAG
agcaccttcctagagtctca

SEQ ID NO: 121045 - DNA, 20 bp, Artificial Sequence
  Description of Artificial Sequence: Synthetic oligonucleotide
  Target: ATXN1; (+) strand; PAM type: NRG; PAM sequence: AGG
gcaccttcctagagtctcaa

SEQ ID NO: 121046 - DNA, 20 bp, Artificial Sequence
  Description of Artificial Sequence: Synthetic oligonucleotide
  Target: ATXN1; (+) strand; PAM type: NRG; PAM sequence: GGG
caccttcctagagtctcaaa

SEQ ID NO: 121047 - DNA, 20 bp, Artificial Sequence
  Description of Artificial Sequence: Synthetic oligonucleotide
  Target: ATXN1; (+) strand; PAM type: NRG; PAM sequence: CAG
cttcctagagtctcaaaggg

SEQ ID NO: 121048 - DNA, 20 bp, Artificial Sequence
  Description of Artificial Sequence: Synthetic oligonucleotide
  Target: ATXN1; (+) strand; PAM type: NRG; PAM sequence: AAG
ctagagtctcaaagggcagt

SEQ ID NO: 121049 - DNA, 20 bp, Artificial Sequence
  Description of Artificial Sequence: Synthetic oligonucleotide
  Target: ATXN1; (+) strand; PAM type: NRG; PAM sequence: CAG
gtctcaaagggcagtaagta

SEQ ID NO: 121050 - DNA, 20 bp, Artificial Sequence
  Description of Artificial Sequence: Synthetic oligonucleotide
  Target: ATXN1; (+) strand; PAM type: NRG; PAM sequence: CAG
ggcagtaagtacagattact

SEQ ID NO: 121051 - DNA, 20 bp, Artificial Sequence
  Description of Artificial Sequence: Synthetic oligonucleotide
  Target: ATXN1; (+) strand; PAM type: NRG; PAM sequence: TGG
aagtacagattactcagccc

SEQ ID NO: 121052 - DNA, 20 bp, Artificial Sequence
  Description of Artificial Sequence: Synthetic oligonucleotide
  Target: ATXN1; (+) strand; PAM type: NRG; PAM sequence: TAG
actcagccctggatccctga

SEQ ID NO: 121053 - DNA, 20 bp, Artificial Sequence
  Description of Artificial Sequence: Synthetic oligonucleotide
  Target: ATXN1; (+) strand; PAM type: NRG; PAM sequence: AAG
cctggatccctgatagactc

SEQ ID NO: 121054 - DNA, 20 bp, Artificial Sequence
  Description of Artificial Sequence: Synthetic oligonucleotide
  Target: ATXN1; (+) strand; PAM type: NRG; PAM sequence: TGG
tgatagactcaagaacatcc

SEQ ID NO: 121055 - DNA, 20 bp, Artificial Sequence
  Description of Artificial Sequence: Synthetic oligonucleotide
  Target: ATXN1; (+) strand; PAM type: NRG; PAM sequence: GAG
ttaataaatatcatgtaatt

SEQ ID NO: 121056 - DNA, 20 bp, Artificial Sequence
  Description of Artificial Sequence: Synthetic oligonucleotide
  Target: ATXN1; (+) strand; PAM type: NRG; PAM sequence: AAG
ttgagtgaactctaaactta

SEQ ID NO: 121057 - DNA, 20 bp, Artificial Sequence
  Description of Artificial Sequence: Synthetic oligonucleotide
  Target: ATXN1; (+) strand; PAM type: NRG; PAM sequence: GAG
gagtgaactctaaacttaaa

SEQ ID NO: 121058 - DNA, 20 bp, Artificial Sequence
  Description of Artificial Sequence: Synthetic oligonucleotide
  Target: ATXN1; (+) strand; PAM type: NRG; PAM sequence: AGG
agtgaactctaaacttaaag

SEQ ID NO: 121059 - DNA, 20 bp, Artificial Sequence
  Description of Artificial Sequence: Synthetic oligonucleotide
  Target: ATXN1; (+) strand; PAM type: NRG; PAM sequence: AAG
taaacttaaagaggacacaa

SEQ ID NO: 121060 - DNA, 20 bp, Artificial Sequence
  Description of Artificial Sequence: Synthetic oligonucleotide
  Target: ATXN1; (+) strand; PAM type: NRG; PAM sequence: TGG
gacacaaaagcattttacct

SEQ ID NO: 121061 - DNA, 20 bp, Artificial Sequence
  Description of Artificial Sequence: Synthetic oligonucleotide
  Target: ATXN1; (+) strand; PAM type: NRG; PAM sequence: CAG
cattttaccttggcactatt

SEQ ID NO: 121062 - DNA, 20 bp, Artificial Sequence
  Description of Artificial Sequence: Synthetic oligonucleotide
  Target: ATXN1; (+) strand; PAM type: NRG; PAM sequence: AAG
cttggcactattcagttaca

SEQ ID NO: 121063 - DNA, 20 bp, Artificial Sequence
  Description of Artificial Sequence: Synthetic oligonucleotide
  Target: ATXN1; (+) strand; PAM type: NRG; PAM sequence: CAG
ggcactattcagttacaaag

SEQ ID NO: 121064 - DNA, 20 bp, Artificial Sequence
  Description of Artificial Sequence: Synthetic oligonucleotide
  Target: ATXN1; (+) strand; PAM type: NRG; PAM sequence: CAG
cagttacaaagcagcctgac

SEQ ID NO: 121065 - DNA, 20 bp, Artificial Sequence
  Description of Artificial Sequence: Synthetic oligonucleotide
  Target: ATXN1; (+) strand; PAM type: NRG; PAM sequence: AGG
agttacaaagcagcctgacc

SEQ ID NO: 121066 - DNA, 20 bp, Artificial Sequence
  Description of Artificial Sequence: Synthetic oligonucleotide
  Target: ATXN1; (+) strand; PAM type: NRG; PAM sequence: TAG
gttgatgttgtttcacccca

SEQ ID NO: 121067 - DNA, 20 bp, Artificial Sequence
  Description of Artificial Sequence: Synthetic oligonucleotide
  Target: ATXN1; (+) strand; PAM type: NRG; PAM sequence: AAG
atagaacacaaatgttgtaa

SEQ ID NO: 121068 - DNA, 20 bp, Artificial Sequence
  Description of Artificial Sequence: Synthetic oligonucleotide
  Target: ATXN1; (+) strand; PAM type: NRG; PAM sequence: TGG
ttttttccttccacaacgtc

SEQ ID NO: 121069 - DNA, 20 bp, Artificial Sequence
  Description of Artificial Sequence: Synthetic oligonucleotide
  Target: ATXN1; (+) strand; PAM type: NRG; PAM sequence: GGG
tttttccttccacaacgtct

SEQ ID NO: 121070 - DNA, 20 bp, Artificial Sequence
  Description of Artificial Sequence: Synthetic oligonucleotide
  Target: ATXN1; (+) strand; PAM type: NRG; PAM sequence: AAG
gcattttcctcctcctctcc

SEQ ID NO: 121071 - DNA, 20 bp, Artificial Sequence
  Description of Artificial Sequence: Synthetic oligonucleotide
  Target: ATXN1; (+) strand; PAM type: NRG; PAM sequence: GAG
ctcctcctctccaagatgct

SEQ ID NO: 121072 - DNA, 20 bp, Artificial Sequence
  Description of Artificial Sequence: Synthetic oligonucleotide
  Target: ATXN1; (+) strand; PAM type: NRG; PAM sequence: GAG
cctcctctccaagatgctga

SEQ ID NO: 121073 - DNA, 20 bp, Artificial Sequence
  Description of Artificial Sequence: Synthetic oligonucleotide
  Target: ATXN1; (+) strand; PAM type: NRG; PAM sequence: AGG
ctcctctccaagatgctgag

SEQ ID NO: 121074 - DNA, 20 bp, Artificial Sequence
  Description of Artificial Sequence: Synthetic oligonucleotide
  Target: ATXN1; (+) strand; PAM type: NRG; PAM sequence: GAG
cctctccaagatgctgagag

SEQ ID NO: 121075 - DNA, 20 bp, Artificial Sequence
  Description of Artificial Sequence: Synthetic oligonucleotide
  Target: ATXN1; (+) strand; PAM type: NRG; PAM sequence: AGG
ctctccaagatgctgagagg

SEQ ID NO: 121076 - DNA, 20 bp, Artificial Sequence
  Description of Artificial Sequence: Synthetic oligonucleotide
  Target: ATXN1; (+) strand; PAM type: NRG; PAM sequence: GAG
ctccaagatgctgagaggag

SEQ ID NO: 121077 - DNA, 20 bp, Artificial Sequence
  Description of Artificial Sequence: Synthetic oligonucleotide
  Target: ATXN1; (+) strand; PAM type: NRG; PAM sequence: GAG
agatgctgagaggaggagct

SEQ ID NO: 121078 - DNA, 20 bp, Artificial Sequence
  Description of Artificial Sequence: Synthetic oligonucleotide
  Target: ATXN1; (+) strand; PAM type: NRG; PAM sequence: GAG
agaggaggagctgagtactt

SEQ ID NO: 121079 - DNA, 20 bp, Artificial Sequence
  Description of Artificial Sequence: Synthetic oligonucleotide
  Target: ATXN1; (+) strand; PAM type: NRG; PAM sequence: AGG
gaggaggagctgagtacttg

SEQ ID NO: 121080 - DNA, 20 bp, Artificial Sequence
  Description of Artificial Sequence: Synthetic oligonucleotide
  Target: ATXN1; (+) strand; PAM type: NRG; PAM sequence: AAG
gaggagctgagtacttgagg

SEQ ID NO: 121081 - DNA, 20 bp, Artificial Sequence
  Description of Artificial Sequence: Synthetic oligonucleotide
  Target: ATXN1; (+) strand; PAM type: NRG; PAM sequence: AAG
gagctgagtacttgaggaag

SEQ ID NO: 121082 - DNA, 20 bp, Artificial Sequence
  Description of Artificial Sequence: Synthetic oligonucleotide
  Target: ATXN1; (+) strand; PAM type: NRG; PAM sequence: AGG
agctgagtacttgaggaaga

SEQ ID NO: 121083 - DNA, 20 bp, Artificial Sequence
  Description of Artificial Sequence: Synthetic oligonucleotide
  Target: ATXN1; (+) strand; PAM type: NRG; PAM sequence: GAG
tacttgaggaagaaggtgct

SEQ ID NO: 121084 - DNA, 20 bp, Artificial Sequence
  Description of Artificial Sequence: Synthetic oligonucleotide
  Target: ATXN1; (+) strand; PAM type: NRG; PAM sequence: AGG
acttgaggaagaaggtgctg

SEQ ID NO: 121085 - DNA, 20 bp, Artificial Sequence
  Description of Artificial Sequence: Synthetic oligonucleotide
  Target: ATXN1; (+) strand; PAM type: NRG; PAM sequence: GGG
cttgaggaagaaggtgctga

SEQ ID NO: 121086 - DNA, 20 bp, Artificial Sequence
  Description of Artificial Sequence: Synthetic oligonucleotide
  Target: ATXN1; (+) strand; PAM type: NRG; PAM sequence: GGG
ttgaggaagaaggtgctgag

SEQ ID NO: 121087 - DNA, 20 bp, Artificial Sequence
  Description of Artificial Sequence: Synthetic oligonucleotide
  Target: ATXN1; (+) strand; PAM type: NRG; PAM sequence: AAG
ggaagaaggtgctgagggga

SEQ ID NO: 121088 - DNA, 20 bp, Artificial Sequence
  Description of Artificial Sequence: Synthetic oligonucleotide
  Target: ATXN1; (+) strand; PAM type: NRG; PAM sequence: AGG
gaagaaggtgctgaggggaa

SEQ ID NO: 121089 - DNA, 20 bp, Artificial Sequence
  Description of Artificial Sequence: Synthetic oligonucleotide
  Target: ATXN1; (+) strand; PAM type: NRG; PAM sequence: GGG
aagaaggtgctgaggggaaa

SEQ ID NO: 121090 - DNA, 20 bp, Artificial Sequence
  Description of Artificial Sequence: Synthetic oligonucleotide
  Target: ATXN1; (+) strand; PAM type: NRG; PAM sequence: TGG
ctgaggggaaagggtgtgcc

SEQ ID NO: 121091 - DNA, 20 bp, Artificial Sequence
  Description of Artificial Sequence: Synthetic oligonucleotide
  Target: ATXN1; (+) strand; PAM type: NRG; PAM sequence: GGG
tgaggggaaagggtgtgcct

SEQ ID NO: 121092 - DNA, 20 bp, Artificial Sequence
  Description of Artificial Sequence: Synthetic oligonucleotide
  Target: ATXN1; (+) strand; PAM type: NRG; PAM sequence: TGG
gggaaagggtgtgcctggga

SEQ ID NO: 121093 - DNA, 20 bp, Artificial Sequence
  Description of Artificial Sequence: Synthetic oligonucleotide
  Target: ATXN1; (+) strand; PAM type: NRG; PAM sequence: GGG
ggaaagggtgtgcctgggat

SEQ ID NO: 121094 - DNA, 20 bp, Artificial Sequence
  Description of Artificial Sequence: Synthetic oligonucleotide
  Target: ATXN1; (+) strand; PAM type: NRG; PAM sequence: CAG
tgggatgggctacgctttgt

SEQ ID NO: 121095 - DNA, 20 bp, Artificial Sequence
  Description of Artificial Sequence: Synthetic oligonucleotide
  Target: ATXN1; (+) strand; PAM type: NRG; PAM sequence: CAG
ctacgctttgtcagttgcct

SEQ ID NO: 121096 - DNA, 20 bp, Artificial Sequence
  Description of Artificial Sequence: Synthetic oligonucleotide
  Target: ATXN1; (+) strand; PAM type: NRG; PAM sequence: AGG
tacgctttgtcagttgcctc

SEQ ID NO: 121097 - DNA, 20 bp, Artificial Sequence
  Description of Artificial Sequence: Synthetic oligonucleotide
  Target: ATXN1; (+) strand; PAM type: NRG; PAM sequence: GAG
cgctttgtcagttgcctcag

SEQ ID NO: 121098 - DNA, 20 bp, Artificial Sequence
  Description of Artificial Sequence: Synthetic oligonucleotide
  Target: ATXN1; (+) strand; PAM type: NRG; PAM sequence: AGG
gctttgtcagttgcctcagg

SEQ ID NO: 121099 - DNA, 20 bp, Artificial Sequence
  Description of Artificial Sequence: Synthetic oligonucleotide
  Target: ATXN1; (+) strand; PAM type: NRG; PAM sequence: TAG
ttgtcagttgcctcaggagg

SEQ ID NO: 121100 - DNA, 20 bp, Artificial Sequence
  Description of Artificial Sequence: Synthetic oligonucleotide
  Target: ATXN1; (+) strand; PAM type: NRG; PAM sequence: TAG
gtagctctgacaccacttct

SEQ ID NO: 121101 - DNA, 20 bp, Artificial Sequence
  Description of Artificial Sequence: Synthetic oligonucleotide
  Target: ATXN1; (+) strand; PAM type: NRG; PAM sequence: AAG
gctctgacaccacttcttag

SEQ ID NO: 121102 - DNA, 20 bp, Artificial Sequence
  Description of Artificial Sequence: Synthetic oligonucleotide
  Target: ATXN1; (+) strand; PAM type: NRG; PAM sequence: CAG
ctgacaccacttcttagaag

SEQ ID NO: 121103 - DNA, 20 bp, Artificial Sequence
  Description of Artificial Sequence: Synthetic oligonucleotide
  Target: ATXN1; (+) strand; PAM type: NRG; PAM sequence: AAG
tagaagcagtgactcctgca

SEQ ID NO: 121104 - DNA, 20 bp, Artificial Sequence
  Description of Artificial Sequence: Synthetic oligonucleotide
  Target: ATXN1; (+) strand; PAM type: NRG; PAM sequence: AAG
ctcctgcaaagaccctgcca

SEQ ID NO: 121105 - DNA, 20 bp, Artificial Sequence
  Description of Artificial Sequence: Synthetic oligonucleotide
  Target: ATXN1; (+) strand; PAM type: NRG; PAM sequence: AGG
tcctgcaaagaccctgccaa

SEQ ID NO: 121106 - DNA, 20 bp, Artificial Sequence
  Description of Artificial Sequence: Synthetic oligonucleotide
  Target: ATXN1; (+) strand; PAM type: NRG; PAM sequence: CAG
gcccatcccaaataacacac

SEQ ID NO: 121107 - DNA, 20 bp, Artificial Sequence
  Description of Artificial Sequence: Synthetic oligonucleotide
  Target: ATXN1; (+) strand; PAM type: NRG; PAM sequence: AGG
cccatcccaaataacacacc

SEQ ID NO: 121108 - DNA, 20 bp, Artificial Sequence
  Description of Artificial Sequence: Synthetic oligonucleotide
  Target: ATXN1; (+) strand; PAM type: NRG; PAM sequence: GGG
ccatcccaaataacacacca

SEQ ID NO: 121109 - DNA, 20 bp, Artificial Sequence
  Description of Artificial Sequence: Synthetic oligonucleotide
  Target: ATXN1; (+) strand; PAM type: NRG; PAM sequence: GGG
catcccaaataacacaccag

SEQ ID NO: 121110 - DNA, 20 bp, Artificial Sequence
  Description of Artificial Sequence: Synthetic oligonucleotide
  Target: ATXN1; (+) strand; PAM type: NRG; PAM sequence: TGG
aaataacacaccaggggcaa

SEQ ID NO: 121111 - DNA, 20 bp, Artificial Sequence
  Description of Artificial Sequence: Synthetic oligonucleotide
  Target: ATXN1; (+) strand; PAM type: NRG; PAM sequence: CAG
aacacaccaggggcaatggc

SEQ ID NO: 121112 - DNA, 20 bp, Artificial Sequence
  Description of Artificial Sequence: Synthetic oligonucleotide
  Target: ATXN1; (+) strand; PAM type: NRG; PAM sequence: AGG
acacaccaggggcaatggcc

SEQ ID NO: 121113 - DNA, 20 bp, Artificial Sequence
  Description of Artificial Sequence: Synthetic oligonucleotide
  Target: ATXN1; (+) strand; PAM type: NRG; PAM sequence: TAG
caggggcaatggccaggaac

SEQ ID NO: 121114 - DNA, 20 bp, Artificial Sequence
  Description of Artificial Sequence: Synthetic oligonucleotide
  Target: ATXN1; (+) strand; PAM type: NRG; PAM sequence: AAG
gcaatggccaggaactagtg

SEQ ID NO: 121115 - DNA, 20 bp, Artificial Sequence
  Description of Artificial Sequence: Synthetic oligonucleotide
  Target: ATXN1; (+) strand; PAM type: NRG; PAM sequence: CAG
gaactagtgaagctgtcaat

SEQ ID NO: 121116 - DNA, 20 bp, Artificial Sequence
  Description of Artificial Sequence: Synthetic oligonucleotide
  Target: ATXN1; (+) strand; PAM type: NRG; PAM sequence: AAG
ctagtgaagctgtcaatcag

SEQ ID NO: 121117 - DNA, 20 bp, Artificial Sequence
  Description of Artificial Sequence: Synthetic oligonucleotide
  Target: ATXN1; (+) strand; PAM type: NRG; PAM sequence: AAG
ctgtcaatcagaagccattc

SEQ ID NO: 121118 - DNA, 20 bp, Artificial Sequence
  Description of Artificial Sequence: Synthetic oligonucleotide
  Target: ATXN1; (+) strand; PAM type: NRG; PAM sequence: AGG
tgtcaatcagaagccattca

SEQ ID NO: 121119 - DNA, 20 bp, Artificial Sequence
  Description of Artificial Sequence: Synthetic oligonucleotide
  Target: ATXN1; (+) strand; PAM type: NRG; PAM sequence: AAG
caatcagaagccattcaagg

SEQ ID NO: 121120 - DNA, 20 bp, Artificial Sequence
  Description of Artificial Sequence: Synthetic oligonucleotide
  Target: ATXN1; (+) strand; PAM type: NRG; PAM sequence: GAG
gaagccattcaaggaagtct

SEQ ID NO: 121121 - DNA, 20 bp, Artificial Sequence
  Description of Artificial Sequence: Synthetic oligonucleotide
  Target: ATXN1; (+) strand; PAM type: NRG; PAM sequence: AGG
aagccattcaaggaagtctg

SEQ ID NO: 121122 - DNA, 20 bp, Artificial Sequence
  Description of Artificial Sequence: Synthetic oligonucleotide
  Target: ATXN1; (+) strand; PAM type: NRG; PAM sequence: AAG
ccattcaaggaagtctgagg

SEQ ID NO: 121123 - DNA, 20 bp, Artificial Sequence
  Description of Artificial Sequence: Synthetic oligonucleotide
  Target: ATXN1; (+) strand; PAM type: NRG; PAM sequence: GAG
attcaaggaagtctgaggaa

SEQ ID NO: 121124 - DNA, 20 bp, Artificial Sequence
  Description of Artificial Sequence: Synthetic oligonucleotide
  Target: ATXN1; (+) strand; PAM type: NRG; PAM sequence: GAG
tcaaggaagtctgaggaaga

SEQ ID NO: 121125 - DNA, 20 bp, Artificial Sequence
  Description of Artificial Sequence: Synthetic oligonucleotide
  Target: ATXN1; (+) strand; PAM type: NRG; PAM sequence: GAG
aaggaagtctgaggaagaga

SEQ ID NO: 121126 - DNA, 20 bp, Artificial Sequence
  Description of Artificial Sequence: Synthetic oligonucleotide
  Target: ATXN1; (+) strand; PAM type: NRG; PAM sequence: TGG
gtctgaggaagagagagaaa

SEQ ID NO: 121127 - DNA, 20 bp, Artificial Sequence
  Description of Artificial Sequence: Synthetic oligonucleotide
  Target: ATXN1; (+) strand; PAM type: NRG; PAM sequence: GGG
tctgaggaagagagagaaat

SEQ ID NO: 121128 - DNA, 20 bp, Artificial Sequence
  Description of Artificial Sequence: Synthetic oligonucleotide
  Target: ATXN1; (+) strand; PAM type: NRG; PAM sequence: AAG
gaagagagagaaatgggtga

SEQ ID NO: 121129 - DNA, 20 bp, Artificial Sequence
  Description of Artificial Sequence: Synthetic oligonucleotide
  Target: ATXN1; (+) strand; PAM type: NRG; PAM sequence: GAG
agagagagaaatgggtgaaa

SEQ ID NO: 121130 - DNA, 20 bp, Artificial Sequence
  Description of Artificial Sequence: Synthetic oligonucleotide
  Target: ATXN1; (+) strand; PAM type: NRG; PAM sequence: TAG
atgggtgaaagagaaaactc

SEQ ID NO: 121131 - DNA, 20 bp, Artificial Sequence
  Description of Artificial Sequence: Synthetic oligonucleotide
  Target: ATXN1; (+) strand; PAM type: NRG; PAM sequence: AAG
ggtgaaagagaaaactctag

SEQ ID NO: 121132 - DNA, 20 bp, Artificial Sequence
  Description of Artificial Sequence: Synthetic oligonucleotide
  Target: ATXN1; (+) strand; PAM type: NRG; PAM sequence: AAG
agaaaactctagaagacttg

SEQ ID NO: 121133 - DNA, 20 bp, Artificial Sequence
  Description of Artificial Sequence: Synthetic oligonucleotide
  Target: ATXN1; (+) strand; PAM type: NRG; PAM sequence: CAG
agaagacttgaagctatccc

SEQ ID NO: 121134 - DNA, 20 bp, Artificial Sequence
  Description of Artificial Sequence: Synthetic oligonucleotide
  Target: ATXN1; (+) strand; PAM type: NRG; PAM sequence: TGG
gaagctatccccagtgcact

SEQ ID NO: 121135 - DNA, 20 bp, Artificial Sequence
  Description of Artificial Sequence: Synthetic oligonucleotide
  Target: ATXN1; (+) strand; PAM type: NRG; PAM sequence: TGG
ctatccccagtgcacttgga

SEQ ID NO: 121136 - DNA, 20 bp, Artificial Sequence
  Description of Artificial Sequence: Synthetic oligonucleotide
  Target: ATXN1; (+) strand; PAM type: NRG; PAM sequence: GAG
ccagtgcacttggatggaat

SEQ ID NO: 121137 - DNA, 20 bp, Artificial Sequence
  Description of Artificial Sequence: Synthetic oligonucleotide
  Target: ATXN1; (+) strand; PAM type: NRG; PAM sequence: CAG
gcacttggatggaatgagct

SEQ ID NO: 121138 - DNA, 20 bp, Artificial Sequence
  Description of Artificial Sequence: Synthetic oligonucleotide
  Target: ATXN1; (+) strand; PAM type: NRG; PAM sequence: TAG
ctctctgcctttacaatctg

SEQ ID NO: 121139 - DNA, 20 bp, Artificial Sequence
  Description of Artificial Sequence: Synthetic oligonucleotide
  Target: ATXN1; (+) strand; PAM type: NRG; PAM sequence: AGG
tctctgcctttacaatctgt

SEQ ID NO: 121140 - DNA, 20 bp, Artificial Sequence
  Description of Artificial Sequence: Synthetic oligonucleotide
  Target: ATXN1; (+) strand; PAM type: NRG; PAM sequence: CAG
acaatctgtaggtcaatctg

SEQ ID NO: 121141 - DNA, 20 bp, Artificial Sequence
  Description of Artificial Sequence: Synthetic oligonucleotide
  Target: ATXN1; (+) strand; PAM type: NRG; PAM sequence: AGG
caatctgtaggtcaatctgc

SEQ ID NO: 121142 - DNA, 20 bp, Artificial Sequence
  Description of Artificial Sequence: Synthetic oligonucleotide
  Target: ATXN1; (+) strand; PAM type: NRG; PAM sequence: GAG
atctgtaggtcaatctgcag

SEQ ID NO: 121143 - DNA, 20 bp, Artificial Sequence
  Description of Artificial Sequence: Synthetic oligonucleotide
  Target: ATXN1; (+) strand; PAM type: NRG; PAM sequence: AAG
tcaatctgcaggagcattac

SEQ ID NO: 121144 - DNA, 20 bp, Artificial Sequence
  Description of Artificial Sequence: Synthetic oligonucleotide
  Target: ATXN1; (+) strand; PAM type: NRG; PAM sequence: AAG
tctgcaggagcattacaagc

SEQ ID NO: 121145 - DNA, 20 bp, Artificial Sequence
  Description of Artificial Sequence: Synthetic oligonucleotide
  Target: ATXN1; (+) strand; PAM type: NRG; PAM sequence: AGG
ctgcaggagcattacaagca

SEQ ID NO: 121146 - DNA, 20 bp, Artificial Sequence
  Description of Artificial Sequence: Synthetic oligonucleotide
  Target: ATXN1; (+) strand; PAM type: NRG; PAM sequence: AAG
agcattacaagcaaggattt

SEQ ID NO: 121147 - DNA, 20 bp, Artificial Sequence
  Description of Artificial Sequence: Synthetic oligonucleotide
  Target: ATXN1; (+) strand; PAM type: NRG; PAM sequence: AAG
acaagcaaggatttaagaaa

SEQ ID NO: 121148 - DNA, 20 bp, Artificial Sequence
  Description of Artificial Sequence: Synthetic oligonucleotide
  Target: ATXN1; (+) strand; PAM type: NRG; PAM sequence: AGG
caagcaaggatttaagaaaa

SEQ ID NO: 121149 - DNA, 20 bp, Artificial Sequence
  Description of Artificial Sequence: Synthetic oligonucleotide
  Target: ATXN1; (+) strand; PAM type: NRG; PAM sequence: GAG
agcaaggatttaagaaaaag

SEQ ID NO: 121150 - DNA, 20 bp, Artificial Sequence
  Description of Artificial Sequence: Synthetic oligonucleotide
  Target: ATXN1; (+) strand; PAM type: NRG; PAM sequence: AAG
gttctccctcacttgtccaa

SEQ ID NO: 121151 - DNA, 20 bp, Artificial Sequence
  Description of Artificial Sequence: Synthetic oligonucleotide
  Target: ATXN1; (+) strand; PAM type: NRG; PAM sequence: TGG
ctccctcacttgtccaaaag

SEQ ID NO: 121152 - DNA, 20 bp, Artificial Sequence
  Description of Artificial Sequence: Synthetic oligonucleotide
  Target: ATXN1; (+) strand; PAM type: NRG; PAM sequence: TGG
cctcacttgtccaaaagtgg

SEQ ID NO: 121153 - DNA, 20 bp, Artificial Sequence
  Description of Artificial Sequence: Synthetic oligonucleotide
  Target: ATXN1; (+) strand; PAM type: NRG; PAM sequence: CAG
cctgaccctcttatctactt

SEQ ID NO: 121154 - DNA, 20 bp, Artificial Sequence
  Description of Artificial Sequence: Synthetic oligonucleotide
  Target: ATXN1; (+) strand; PAM type: NRG; PAM sequence: TGG
agattttttttttgtaacgc

SEQ ID NO: 121155 - DNA, 20 bp, Artificial Sequence
  Description of Artificial Sequence: Synthetic oligonucleotide
  Target: ATXN1; (+) strand; PAM type: NRG; PAM sequence: GAG
attttttttttgtaacgctg

SEQ ID NO: 121156 - DNA, 20 bp, Artificial Sequence
  Description of Artificial Sequence: Synthetic oligonucleotide
  Target: ATXN1; (+) strand; PAM type: NRG; PAM sequence: TGG
ttttgtaacgctggagaatt

SEQ ID NO: 121157 - DNA, 20 bp, Artificial Sequence
  Description of Artificial Sequence: Synthetic oligonucleotide
  Target: ATXN1; (+) strand; PAM type: NRG; PAM sequence: CAG
cgctggagaatttggtatca

SEQ ID NO: 121158 - DNA, 20 bp, Artificial Sequence
  Description of Artificial Sequence: Synthetic oligonucleotide
  Target: ATXN1; (+) strand; PAM type: NRG; PAM sequence: TGG
ggagaatttggtatcacaga

SEQ ID NO: 121159 - DNA, 20 bp, Artificial Sequence
  Description of Artificial Sequence: Synthetic oligonucleotide
  Target: ATXN1; (+) strand; PAM type: NRG; PAM sequence: AAG
atcacagatggcaaatctaa

SEQ ID NO: 121160 - DNA, 20 bp, Artificial Sequence
  Description of Artificial Sequence: Synthetic oligonucleotide
  Target: ATXN1; (+) strand; PAM type: NRG; PAM sequence: AGG
tcacagatggcaaatctaaa

SEQ ID NO: 121161 - DNA, 20 bp, Artificial Sequence
  Description of Artificial Sequence: Synthetic oligonucleotide
  Target: ATXN1; (+) strand; PAM type: NRG; PAM sequence: CAG
atctaaaaggtacaaactga

SEQ ID NO: 121162 - DNA, 20 bp, Artificial Sequence
  Description of Artificial Sequence: Synthetic oligonucleotide
  Target: ATXN1; (+) strand; PAM type: NRG; PAM sequence: CAG
aaggtacaaactgacagaca

SEQ ID NO: 121163 - DNA, 20 bp, Artificial Sequence
  Description of Artificial Sequence: Synthetic oligonucleotide
  Target: ATXN1; (+) strand; PAM type: NRG; PAM sequence: GAG
ggtacaaactgacagacaca

SEQ ID NO: 121164 - DNA, 20 bp, Artificial Sequence
  Description of Artificial Sequence: Synthetic oligonucleotide
  Target: ATXN1; (+) strand; PAM type: NRG; PAM sequence: AGG
gtacaaactgacagacacag

SEQ ID NO: 121165 - DNA, 20 bp, Artificial Sequence
  Description of Artificial Sequence: Synthetic oligonucleotide
  Target: ATXN1; (+) strand; PAM type: NRG; PAM sequence: GGG
tacaaactgacagacacaga

SEQ ID NO: 121166 - DNA, 20 bp, Artificial Sequence
  Description of Artificial Sequence: Synthetic oligonucleotide
  Target: ATXN1; (+) strand; PAM type: NRG; PAM sequence: CAG
cagacacagagggaaattcc

SEQ ID NO: 121167 - DNA, 20 bp, Artificial Sequence
  Description of Artificial Sequence: Synthetic oligonucleotide
  Target: ATXN1; (+) strand; PAM type: NRG; PAM sequence: TAG
aattcccagattgctcttat

SEQ ID NO: 121168 - DNA, 20 bp, Artificial Sequence
  Description of Artificial Sequence: Synthetic oligonucleotide
  Target: ATXN1; (+) strand; PAM type: NRG; PAM sequence: GAG
ttcccagattgctcttatta

SEQ ID NO: 121169 - DNA, 20 bp, Artificial Sequence
  Description of Artificial Sequence: Synthetic oligonucleotide
  Target: ATXN1; (+) strand; PAM type: NRG; PAM sequence: TAG
gcgtgtgtgtgcaattctct

SEQ ID NO: 121170 - DNA, 20 bp, Artificial Sequence
  Description of Artificial Sequence: Synthetic oligonucleotide
  Target: ATXN1; (+) strand; PAM type: NRG; PAM sequence: TGG
tgtgtgcaattctcttagtc

SEQ ID NO: 121171 - DNA, 20 bp, Artificial Sequence
  Description of Artificial Sequence: Synthetic oligonucleotide
  Target: ATXN1; (+) strand; PAM type: NRG; PAM sequence: GAG
tgtgcaattctcttagtctg

SEQ ID NO: 121172 - DNA, 20 bp, Artificial Sequence
  Description of Artificial Sequence: Synthetic oligonucleotide
  Target: ATXN1; (+) strand; PAM type: NRG; PAM sequence: CAG
attctcttagtctggagatt

SEQ ID NO: 121173 - DNA, 20 bp, Artificial Sequence
  Description of Artificial Sequence: Synthetic oligonucleotide
  Target: ATXN1; (+) strand; PAM type: NRG; PAM sequence: GAG
tctcttagtctggagattca

SEQ ID NO: 121174 - DNA, 20 bp, Artificial Sequence
  Description of Artificial Sequence: Synthetic oligonucleotide
  Target: ATXN1; (+) strand; PAM type: NRG; PAM sequence: AAG
ttagtctggagattcagagt

SEQ ID NO: 121175 - DNA, 20 bp, Artificial Sequence
  Description of Artificial Sequence: Synthetic oligonucleotide
  Target: ATXN1; (+) strand; PAM type: NRG; PAM sequence: GAG
agtctggagattcagagtaa

SEQ ID NO: 121176 - DNA, 20 bp, Artificial Sequence
  Description of Artificial Sequence: Synthetic oligonucleotide
  Target: ATXN1; (+) strand; PAM type: NRG; PAM sequence: CAG
gattcagagtaagagaaatt

SEQ ID NO: 121177 - DNA, 20 bp, Artificial Sequence
  Description of Artificial Sequence: Synthetic oligonucleotide
  Target: ATXN1; (+) strand; PAM type: NRG; PAM sequence: AAG
aaattcagctcccatttttt

SEQ ID NO: 121178 - DNA, 20 bp, Artificial Sequence
  Description of Artificial Sequence: Synthetic oligonucleotide
  Target: ATXN1; (+) strand; PAM type: NRG; PAM sequence: CAG
cccattttttaagacttaca

SEQ ID NO: 121179 - DNA, 20 bp, Artificial Sequence
  Description of Artificial Sequence: Synthetic oligonucleotide
  Target: ATXN1; (+) strand; PAM type: NRG; PAM sequence: CAG
ttttttaagacttacacaga

SEQ ID NO: 121180 - DNA, 20 bp, Artificial Sequence
  Description of Artificial Sequence: Synthetic oligonucleotide
  Target: ATXN1; (+) strand; PAM type: NRG; PAM sequence: CAG
acagcataatgctgtttaca

SEQ ID NO: 121181 - DNA, 20 bp, Artificial Sequence
  Description of Artificial Sequence: Synthetic oligonucleotide
  Target: ATXN1; (+) strand; PAM type: NRG; PAM sequence: AGG
cagcataatgctgtttacac

SEQ ID NO: 121182 - DNA, 20 bp, Artificial Sequence
  Description of Artificial Sequence: Synthetic oligonucleotide
  Target: ATXN1; (+) strand; PAM type: NRG; PAM sequence: CAG
taatgctgtttacacaggta

SEQ ID NO: 121183 - DNA, 20 bp, Artificial Sequence
  Description of Artificial Sequence: Synthetic oligonucleotide
  Target: ATXN1; (+) strand; PAM type: NRG; PAM sequence: GAG
atgctgtttacacaggtaca

SEQ ID NO: 121184 - DNA, 20 bp, Artificial Sequence
  Description of Artificial Sequence: Synthetic oligonucleotide
  Target: ATXN1; (+) strand; PAM type: NRG; PAM sequence: AGG
tgctgtttacacaggtacag

SEQ ID NO: 121185 - DNA, 20 bp, Artificial Sequence
  Description of Artificial Sequence: Synthetic oligonucleotide
  Target: ATXN1; (+) strand; PAM type: NRG; PAM sequence: TAG
aggtacagaggtatttattt

SEQ ID NO: 121186 - DNA, 20 bp, Artificial Sequence
  Description of Artificial Sequence: Synthetic oligonucleotide
  Target: ATXN1; (+) strand; PAM type: NRG; PAM sequence: TAG
ttagtctctccatttcttcc

SEQ ID NO: 121187 - DNA, 20 bp, Artificial Sequence
  Description of Artificial Sequence: Synthetic oligonucleotide
  Target: ATXN1; (+) strand; PAM type: NRG; PAM sequence: AGG
tagtctctccatttcttcct

SEQ ID NO: 121188 - DNA, 20 bp, Artificial Sequence
  Description of Artificial Sequence: Synthetic oligonucleotide
  Target: ATXN1; (+) strand; PAM type: NRG; PAM sequence: AAG
tccatttcttcctaggaata

SEQ ID NO: 121189 - DNA, 20 bp, Artificial Sequence
  Description of Artificial Sequence: Synthetic oligonucleotide
  Target: ATXN1; (+) strand; PAM type: NRG; PAM sequence: CAG
aataaagtaatgcctgcact

SEQ ID NO: 121190 - DNA, 20 bp, Artificial Sequence
  Description of Artificial Sequence: Synthetic oligonucleotide
  Target: ATXN1; (+) strand; PAM type: NRG; PAM sequence: GAG
taaagtaatgcctgcactca

SEQ ID NO: 121191 - DNA, 20 bp, Artificial Sequence
  Description of Artificial Sequence: Synthetic oligonucleotide
  Target: ATXN1; (+) strand; PAM type: NRG; PAM sequence: CAG
agtaatgcctgcactcagag

SEQ ID NO: 121192 - DNA, 20 bp, Artificial Sequence
  Description of Artificial Sequence: Synthetic oligonucleotide
  Target: ATXN1; (+) strand; PAM type: NRG; PAM sequence: AAG
ctcagagcagttattctgaa

SEQ ID NO: 121193 - DNA, 20 bp, Artificial Sequence
  Description of Artificial Sequence: Synthetic oligonucleotide
  Target: ATXN1; (+) strand; PAM type: NRG; PAM sequence: AGG
tcagagcagttattctgaaa

SEQ ID NO: 121194 - DNA, 20 bp, Artificial Sequence
  Description of Artificial Sequence: Synthetic oligonucleotide
  Target: ATXN1; (+) strand; PAM type: NRG; PAM sequence: GGG
cagagcagttattctgaaaa

SEQ ID NO: 121195 - DNA, 20 bp, Artificial Sequence
  Description of Artificial Sequence: Synthetic oligonucleotide
  Target: ATXN1; (+) strand; PAM type: NRG; PAM sequence: GAG
gagcagttattctgaaaagg

SEQ ID NO: 121196 - DNA, 20 bp, Artificial Sequence
  Description of Artificial Sequence: Synthetic oligonucleotide
  Target: ATXN1; (+) strand; PAM type: NRG; PAM sequence: TAG
tattctgaaaagggagtcca

SEQ ID NO: 121197 - DNA, 20 bp, Artificial Sequence
  Description of Artificial Sequence: Synthetic oligonucleotide
  Target: ATXN1; (+) strand; PAM type: NRG; PAM sequence: CAG
tccatagacacacaaaattc

SEQ ID NO: 121198 - DNA, 20 bp, Artificial Sequence
  Description of Artificial Sequence: Synthetic oligonucleotide
  Target: ATXN1; (+) strand; PAM type: NRG; PAM sequence: AAG
tttattattgctgtcctcaa

SEQ ID NO: 121199 - DNA, 20 bp, Artificial Sequence
  Description of Artificial Sequence: Synthetic oligonucleotide
  Target: ATXN1; (+) strand; PAM type: NRG; PAM sequence: TAG
tgctgtcctcaaaagctaac

SEQ ID NO: 121200 - DNA, 20 bp, Artificial Sequence
  Description of Artificial Sequence: Synthetic oligonucleotide
  Target: ATXN1; (+) strand; PAM type: NRG; PAM sequence: AAG
aactagcacaatgcctccct

SEQ ID NO: 121201 - DNA, 20 bp, Artificial Sequence
  Description of Artificial Sequence: Synthetic oligonucleotide
  Target: ATXN1; (+) strand; PAM type: NRG; PAM sequence: AAG
agcacaatgcctccctaaga

SEQ ID NO: 121202 - DNA, 20 bp, Artificial Sequence
  Description of Artificial Sequence: Synthetic oligonucleotide
  Target: ATXN1; (+) strand; PAM type: NRG; PAM sequence: CAG
gaacttcccatcacacacca

SEQ ID NO: 121203 - DNA, 20 bp, Artificial Sequence
  Description of Artificial Sequence: Synthetic oligonucleotide
  Target: ATXN1; (+) strand; PAM type: NRG; PAM sequence: GAG
acttcccatcacacaccaca

SEQ ID NO: 121204 - DNA, 20 bp, Artificial Sequence
  Description of Artificial Sequence: Synthetic oligonucleotide
  Target: ATXN1; (+) strand; PAM type: NRG; PAM sequence: TGG
cacaccacagagacattaaa

SEQ ID NO: 121205 - DNA, 20 bp, Artificial Sequence
  Description of Artificial Sequence: Synthetic oligonucleotide
  Target: ATXN1; (+) strand; PAM type: NRG; PAM sequence: GGG
acaccacagagacattaaat

SEQ ID NO: 121206 - DNA, 20 bp, Artificial Sequence
  Description of Artificial Sequence: Synthetic oligonucleotide
  Target: ATXN1; (+) strand; PAM type: NRG; PAM sequence: CAG
taaatgggtttcatttgtac

SEQ ID NO: 121207 - DNA, 20 bp, Artificial Sequence
  Description of Artificial Sequence: Synthetic oligonucleotide
  Target: ATXN1; (+) strand; PAM type: NRG; PAM sequence: AAG
gcacaccattttttcattct

SEQ ID NO: 121208 - DNA, 20 bp, Artificial Sequence
  Description of Artificial Sequence: Synthetic oligonucleotide
  Target: ATXN1; (+) strand; PAM type: NRG; PAM sequence: AGG
cacaccattttttcattcta

SEQ ID NO: 121209 - DNA, 20 bp, Artificial Sequence
  Description of Artificial Sequence: Synthetic oligonucleotide
  Target: ATXN1; (+) strand; PAM type: NRG; PAM sequence: TAG
tttcattctaaggtgtgcac

SEQ ID NO: 121210 - DNA, 20 bp, Artificial Sequence
  Description of Artificial Sequence: Synthetic oligonucleotide
  Target: ATXN1; (+) strand; PAM type: NRG; PAM sequence: AAG
ctaaggtgtgcactagaatg

SEQ ID NO: 121211 - DNA, 20 bp, Artificial Sequence
  Description of Artificial Sequence: Synthetic oligonucleotide
  Target: ATXN1; (+) strand; PAM type: NRG; PAM sequence: CAG
cactagaatgaagtgttatt

SEQ ID NO: 121212 - DNA, 20 bp, Artificial Sequence
  Description of Artificial Sequence: Synthetic oligonucleotide
  Target: ATXN1; (+) strand; PAM type: NRG; PAM sequence: CAG
agaatgaagtgttattcagt

SEQ ID NO: 121213 - DNA, 20 bp, Artificial Sequence
  Description of Artificial Sequence: Synthetic oligonucleotide
  Target: ATXN1; (+) strand; PAM type: NRG; PAM sequence: TAG
ttattcagtcagcccctttc

SEQ ID NO: 121214 - DNA, 20 bp, Artificial Sequence
  Description of Artificial Sequence: Synthetic oligonucleotide
  Target: ATXN1; (+) strand; PAM type: NRG; PAM sequence: AGG
tattcagtcagcccctttct

SEQ ID NO: 121215 - DNA, 20 bp, Artificial Sequence
  Description of Artificial Sequence: Synthetic oligonucleotide
  Target: ATXN1; (+) strand; PAM type: NRG; PAM sequence: GGG
attcagtcagcccctttcta

SEQ ID NO: 121216 - DNA, 20 bp, Artificial Sequence
  Description of Artificial Sequence: Synthetic oligonucleotide
  Target: ATXN1; (+) strand; PAM type: NRG; PAM sequence: GAG
tcagtcagcccctttctagg

SEQ ID NO: 121217 - DNA, 20 bp, Artificial Sequence
  Description of Artificial Sequence: Synthetic oligonucleotide
  Target: ATXN1; (+) strand; PAM type: NRG; PAM sequence: CAG
agcccctttctagggagata

SEQ ID NO: 121218 - DNA, 20 bp, Artificial Sequence
  Description of Artificial Sequence: Synthetic oligonucleotide
  Target: ATXN1; (+) strand; PAM type: NRG; PAM sequence: CAG
tctagggagatacagcactt

SEQ ID NO: 121219 - DNA, 20 bp, Artificial Sequence
  Description of Artificial Sequence: Synthetic oligonucleotide
  Target: ATXN1; (+) strand; PAM type: NRG; PAM sequence: AGG
ctagggagatacagcacttc

SEQ ID NO: 121220 - DNA, 20 bp, Artificial Sequence
  Description of Artificial Sequence: Synthetic oligonucleotide
  Target: ATXN1; (+) strand; PAM type: NRG; PAM sequence: AAG
aggcccatccctactttgaa

SEQ ID NO: 121221 - DNA, 20 bp, Artificial Sequence
  Description of Artificial Sequence: Synthetic oligonucleotide
  Target: ATXN1; (+) strand; PAM type: NRG; PAM sequence: AAG
ttgaaaagaaatatgaacgt

SEQ ID NO: 121222 - DNA, 20 bp, Artificial Sequence
  Description of Artificial Sequence: Synthetic oligonucleotide
  Target: ATXN1; (+) strand; PAM type: NRG; PAM sequence: CAG
aaaagaaatatgaacgtaag

SEQ ID NO: 121223 - DNA, 20 bp, Artificial Sequence
  Description of Artificial Sequence: Synthetic oligonucleotide
  Target: ATXN1; (+) strand; PAM type: NRG; PAM sequence: AAG
tgatgaaatgatgtgatgat

SEQ ID NO: 121224 - DNA, 20 bp, Artificial Sequence
  Description of Artificial Sequence: Synthetic oligonucleotide
  Target: ATXN1; (+) strand; PAM type: NRG; PAM sequence: GAG
atgaaatgatgtgatgataa

SEQ ID NO: 121225 - DNA, 20 bp, Artificial Sequence
  Description of Artificial Sequence: Synthetic oligonucleotide
  Target: ATXN1; (+) strand; PAM type: NRG; PAM sequence: CAG
gacaaaaccaccgccgttca

SEQ ID NO: 121226 - DNA, 20 bp, Artificial Sequence
  Description of Artificial Sequence: Synthetic oligonucleotide
  Target: ATXN1; (+) strand; PAM type: NRG; PAM sequence: AAG
aaaccaccgccgttcacaga

SEQ ID NO: 121227 - DNA, 20 bp, Artificial Sequence
  Description of Artificial Sequence: Synthetic oligonucleotide
  Target: ATXN1; (+) strand; PAM type: NRG; PAM sequence: CAG
caccgccgttcacagaaagc

SEQ ID NO: 121228 - DNA, 20 bp, Artificial Sequence
  Description of Artificial Sequence: Synthetic oligonucleotide
  Target: ATXN1; (+) strand; PAM type: NRG; PAM sequence: AGG
accgccgttcacagaaagcc

SEQ ID NO: 121229 - DNA, 20 bp, Artificial Sequence
  Description of Artificial Sequence: Synthetic oligonucleotide
  Target: ATXN1; (+) strand; PAM type: NRG; PAM sequence: GGG
ccgccgttcacagaaagcca

SEQ ID NO: 121230 - DNA, 20 bp, Artificial Sequence
  Description of Artificial Sequence: Synthetic oligonucleotide
  Target: ATXN1; (+) strand; PAM type: NRG; PAM sequence: CAG
ccgttcacagaaagccaggg

SEQ ID NO: 121231 - DNA, 20 bp, Artificial Sequence
  Description of Artificial Sequence: Synthetic oligonucleotide
  Target: ATXN1; (+) strand; PAM type: NRG; PAM sequence: AGG
cgttcacagaaagccagggc

SEQ ID NO: 121232 - DNA, 20 bp, Artificial Sequence
  Description of Artificial Sequence: Synthetic oligonucleotide
  Target: ATXN1; (+) strand; PAM type: NRG; PAM sequence: AAG
agggcaggatgctcacaaac

SEQ ID NO: 121233 - DNA, 20 bp, Artificial Sequence
  Description of Artificial Sequence: Synthetic oligonucleotide
  Target: ATXN1; (+) strand; PAM type: NRG; PAM sequence: AAG
atgctcacaaacaagtgaca

SEQ ID NO: 121234 - DNA, 20 bp, Artificial Sequence
  Description of Artificial Sequence: Synthetic oligonucleotide
  Target: ATXN1; (+) strand; PAM type: NRG; PAM sequence: TGG
gacaaagcaaaccactcaaa

SEQ ID NO: 121235 - DNA, 20 bp, Artificial Sequence
  Description of Artificial Sequence: Synthetic oligonucleotide
  Target: ATXN1; (+) strand; PAM type: NRG; PAM sequence: AAG
agcaaaccactcaaatggaa

SEQ ID NO: 121236 - DNA, 20 bp, Artificial Sequence
  Description of Artificial Sequence: Synthetic oligonucleotide
  Target: ATXN1; (+) strand; PAM type: NRG; PAM sequence: AGG
gcaaaccactcaaatggaaa

SEQ ID NO: 121237 - DNA, 20 bp, Artificial Sequence
  Description of Artificial Sequence: Synthetic oligonucleotide
  Target: ATXN1; (+) strand; PAM type: NRG; PAM sequence: GAG
aaaccactcaaatggaaaag

SEQ ID NO: 121238 - DNA, 20 bp, Artificial Sequence
  Description of Artificial Sequence: Synthetic oligonucleotide
  Target: ATXN1; (+) strand; PAM type: NRG; PAM sequence: GAG
accactcaaatggaaaagga

SEQ ID NO: 121239 - DNA, 20 bp, Artificial Sequence
  Description of Artificial Sequence: Synthetic oligonucleotide
  Target: ATXN1; (+) strand; PAM type: NRG; PAM sequence: AGG
ccactcaaatggaaaaggag

SEQ ID NO: 121240 - DNA, 20 bp, Artificial Sequence
  Description of Artificial Sequence: Synthetic oligonucleotide
  Target: ATXN1; (+) strand; PAM type: NRG; PAM sequence: CAG
atggaaaaggagaggaaata

SEQ ID NO: 121241 - DNA, 20 bp, Artificial Sequence
  Description of Artificial Sequence: Synthetic oligonucleotide
  Target: ATXN1; (+) strand; PAM type: NRG; PAM sequence: CAG
aaaaggagaggaaatacaga

SEQ ID NO: 121242 - DNA, 20 bp, Artificial Sequence
  Description of Artificial Sequence: Synthetic oligonucleotide
  Target: ATXN1; (+) strand; PAM type: NRG; PAM sequence: CAG
gagaggaaatacagacagtg

SEQ ID NO: 121243 - DNA, 20 bp, Artificial Sequence
  Description of Artificial Sequence: Synthetic oligonucleotide
  Target: ATXN1; (+) strand; PAM type: NRG; PAM sequence: AAG
acagtgcagacttttaaaaa

SEQ ID NO: 121244 - DNA, 20 bp, Artificial Sequence
  Description of Artificial Sequence: Synthetic oligonucleotide
  Target: ATXN1; (+) strand; PAM type: NRG; PAM sequence: TAG
cagacttttaaaaaaagtat

SEQ ID NO: 121245 - DNA, 20 bp, Artificial Sequence
  Description of Artificial Sequence: Synthetic oligonucleotide
  Target: ATXN1; (+) strand; PAM type: NRG; PAM sequence: TAG
aaatccccaaactctactga

SEQ ID NO: 121246 - DNA, 20 bp, Artificial Sequence
  Description of Artificial Sequence: Synthetic oligonucleotide
  Target: ATXN1; (+) strand; PAM type: NRG; PAM sequence: AGG
aatccccaaactctactgat

SEQ ID NO: 121247 - DNA, 20 bp, Artificial Sequence
  Description of Artificial Sequence: Synthetic oligonucleotide
  Target: ATXN1; (+) strand; PAM type: NRG; PAM sequence: TAG
ccaaactctactgataggtc

SEQ ID NO: 121248 - DNA, 20 bp, Artificial Sequence
  Description of Artificial Sequence: Synthetic oligonucleotide
  Target: ATXN1; (+) strand; PAM type: NRG; PAM sequence: AAG
cacatttctttatacacatc

SEQ ID NO: 121249 - DNA, 20 bp, Artificial Sequence
  Description of Artificial Sequence: Synthetic oligonucleotide
  Target: ATXN1; (+) strand; PAM type: NRG; PAM sequence: AAG
cacatcaagtatccacttct

SEQ ID NO: 121250 - DNA, 20 bp, Artificial Sequence
  Description of Artificial Sequence: Synthetic oligonucleotide
  Target: ATXN1; (+) strand; PAM type: NRG; PAM sequence: AGG
acatcaagtatccacttcta

SEQ ID NO: 121251 - DNA, 20 bp, Artificial Sequence
  Description of Artificial Sequence: Synthetic oligonucleotide
  Target: ATXN1; (+) strand; PAM type: NRG; PAM sequence: TAG
gtatccacttctaaggaaaa

SEQ ID NO: 121252 - DNA, 20 bp, Artificial Sequence
  Description of Artificial Sequence: Synthetic oligonucleotide
  Target: ATXN1; (+) strand; PAM type: NRG; PAM sequence: TAG
cacttctaaggaaaatagtc

SEQ ID NO: 121253 - DNA, 20 bp, Artificial Sequence
  Description of Artificial Sequence: Synthetic oligonucleotide
  Target: ATXN1; (+) strand; PAM type: NRG; PAM sequence: CAG
ccacacccttaaactgctat

SEQ ID NO: 121254 - DNA, 20 bp, Artificial Sequence
  Description of Artificial Sequence: Synthetic oligonucleotide
  Target: ATXN1; (+) strand; PAM type: NRG; PAM sequence: AAG
cttaaactgctatcagattc

SEQ ID NO: 121255 - DNA, 20 bp, Artificial Sequence
  Description of Artificial Sequence: Synthetic oligonucleotide
  Target: ATXN1; (+) strand; PAM type: NRG; PAM sequence: CAG
tcagattcaagcattctcat

SEQ ID NO: 121256 - DNA, 20 bp, Artificial Sequence
  Description of Artificial Sequence: Synthetic oligonucleotide
  Target: ATXN1; (+) strand; PAM type: NRG; PAM sequence: CAG
ttcaagcattctcatcagaa

SEQ ID NO: 121257 - DNA, 20 bp, Artificial Sequence
  Description of Artificial Sequence: Synthetic oligonucleotide
  Target: ATXN1; (+) strand; PAM type: NRG; PAM sequence: TGG
atgtatgttccttttcctaa

SEQ ID NO: 121258 - DNA, 20 bp, Artificial Sequence
  Description of Artificial Sequence: Synthetic oligonucleotide
  Target: ATXN1; (+) strand; PAM type: NRG; PAM sequence: CAG
tgttccttttcctaatggct

SEQ ID NO: 121259 - DNA, 20 bp, Artificial Sequence
  Description of Artificial Sequence: Synthetic oligonucleotide
  Target: ATXN1; (+) strand; PAM type: NRG; PAM sequence: AGG
gttccttttcctaatggctc

SEQ ID NO: 121260 - DNA, 20 bp, Artificial Sequence
  Description of Artificial Sequence: Synthetic oligonucleotide
  Target: ATXN1; (+) strand; PAM type: NRG; PAM sequence: GAG
aatggctcaggcccacacat

SEQ ID NO: 121261 - DNA, 20 bp, Artificial Sequence
  Description of Artificial Sequence: Synthetic oligonucleotide
  Target: ATXN1; (+) strand; PAM type: NRG; PAM sequence: GAG
tggctcaggcccacacatga

SEQ ID NO: 121262 - DNA, 20 bp, Artificial Sequence
  Description of Artificial Sequence: Synthetic oligonucleotide
  Target: ATXN1; (+) strand; PAM type: NRG; PAM sequence: AGG
ggctcaggcccacacatgag

SEQ ID NO: 121263 - DNA, 20 bp, Artificial Sequence
  Description of Artificial Sequence: Synthetic oligonucleotide
  Target: ATXN1; (+) strand; PAM type: NRG; PAM sequence: TAG
acacatgagaggcattcact

SEQ ID NO: 121264 - DNA, 20 bp, Artificial Sequence
  Description of Artificial Sequence: Synthetic oligonucleotide
  Target: ATXN1; (+) strand; PAM type: NRG; PAM sequence: TAG
ttcacttagtgaatgtcatt

SEQ ID NO: 121265 - DNA, 20 bp, Artificial Sequence
  Description of Artificial Sequence: Synthetic oligonucleotide
  Target: ATXN1; (+) strand; PAM type: NRG; PAM sequence: AGG
tcacttagtgaatgtcattt

SEQ ID NO: 121266 - DNA, 20 bp, Artificial Sequence
  Description of Artificial Sequence: Synthetic oligonucleotide
  Target: ATXN1; (+) strand; PAM type: NRG; PAM sequence: TGG
tatttactgactgcccatta

SEQ ID NO: 121267 - DNA, 20 bp, Artificial Sequence
  Description of Artificial Sequence: Synthetic oligonucleotide
  Target: ATXN1; (+) strand; PAM type: NRG; PAM sequence: GGG
atttactgactgcccattat

SEQ ID NO: 121268 - DNA, 20 bp, Artificial Sequence
  Description of Artificial Sequence: Synthetic oligonucleotide
  Target: ATXN1; (+) strand; PAM type: NRG; PAM sequence: AAG
tgactgcccattatgggaac

SEQ ID NO: 121269 - DNA, 20 bp, Artificial Sequence
  Description of Artificial Sequence: Synthetic oligonucleotide
  Target: ATXN1; (+) strand; PAM type: NRG; PAM sequence: CAG
ctgcccattatgggaacaag

SEQ ID NO: 121270 - DNA, 20 bp, Artificial Sequence
  Description of Artificial Sequence: Synthetic oligonucleotide
  Target: ATXN1; (+) strand; PAM type: NRG; PAM sequence: TAG
tatgggaacaagcagtattt

SEQ ID NO: 121271 - DNA, 20 bp, Artificial Sequence
  Description of Artificial Sequence: Synthetic oligonucleotide
  Target: ATXN1; (+) strand; PAM type: NRG; PAM sequence: AGG
atgggaacaagcagtatttt

SEQ ID NO: 121272 - DNA, 20 bp, Artificial Sequence
  Description of Artificial Sequence: Synthetic oligonucleotide
  Target: ATXN1; (+) strand; PAM type: NRG; PAM sequence: CAG
tttaggtactattcattcac

SEQ ID NO: 121273 - DNA, 20 bp, Artificial Sequence
  Description of Artificial Sequence: Synthetic oligonucleotide
  Target: ATXN1; (+) strand; PAM type: NRG; PAM sequence: AGG
ttaggtactattcattcacc

SEQ ID NO: 121274 - DNA, 20 bp, Artificial Sequence
  Description of Artificial Sequence: Synthetic oligonucleotide
  Target: ATXN1; (+) strand; PAM type: NRG; PAM sequence: GGG
taggtactattcattcacca

SEQ ID NO: 121275 - DNA, 20 bp, Artificial Sequence
  Description of Artificial Sequence: Synthetic oligonucleotide
  Target: ATXN1; (+) strand; PAM type: NRG; PAM sequence: AAG
gtactattcattcaccaggg

SEQ ID NO: 121276 - DNA, 20 bp, Artificial Sequence
  Description of Artificial Sequence: Synthetic oligonucleotide
  Target: ATXN1; (+) strand; PAM type: NRG; PAM sequence: AAG
ttcattcaccagggaagaat

SEQ ID NO: 121277 - DNA, 20 bp, Artificial Sequence
  Description of Artificial Sequence: Synthetic oligonucleotide
  Target: ATXN1; (+) strand; PAM type: NRG; PAM sequence: GAG
caccagggaagaataagaat

SEQ ID NO: 121278 - DNA, 20 bp, Artificial Sequence
  Description of Artificial Sequence: Synthetic oligonucleotide
  Target: ATXN1; (+) strand; PAM type: NRG; PAM sequence: AAG
ggaagaataagaatgagaat

SEQ ID NO: 121279 - DNA, 20 bp, Artificial Sequence
  Description of Artificial Sequence: Synthetic oligonucleotide
  Target: ATXN1; (+) strand; PAM type: NRG; PAM sequence: AGG
gaagaataagaatgagaata

SEQ ID NO: 121280 - DNA, 20 bp, Artificial Sequence
  Description of Artificial Sequence: Synthetic oligonucleotide
  Target: ATXN1; (+) strand; PAM type: NRG; PAM sequence: AAG
ataagaatgagaataaggat

SEQ ID NO: 121281 - DNA, 20 bp, Artificial Sequence
  Description of Artificial Sequence: Synthetic oligonucleotide
  Target: ATXN1; (+) strand; PAM type: NRG; PAM sequence: CAG
gaataccatccctccttttg

SEQ ID NO: 121282 - DNA, 20 bp, Artificial Sequence
  Description of Artificial Sequence: Synthetic oligonucleotide
  Target: ATXN1; (+) strand; PAM type: NRG; PAM sequence: GAG
ataccatccctccttttgca

SEQ ID NO: 121283 - DNA, 20 bp, Artificial Sequence
  Description of Artificial Sequence: Synthetic oligonucleotide
  Target: ATXN1; (+) strand; PAM type: NRG; PAM sequence: CAG
ccctccttttgcagagcttg

SEQ ID NO: 121284 - DNA, 20 bp, Artificial Sequence
  Description of Artificial Sequence: Synthetic oligonucleotide
  Target: ATXN1; (+) strand; PAM type: NRG; PAM sequence: TAG
cttttgcagagcttgcagac

SEQ ID NO: 121285 - DNA, 20 bp, Artificial Sequence
  Description of Artificial Sequence: Synthetic oligonucleotide
  Target: ATXN1; (+) strand; PAM type: NRG; PAM sequence: GAG
gcagagcttgcagactagtt

SEQ ID NO: 121286 - DNA, 20 bp, Artificial Sequence
  Description of Artificial Sequence: Synthetic oligonucleotide
  Target: ATXN1; (+) strand; PAM type: NRG; PAM sequence: AGG
cagagcttgcagactagttg

SEQ ID NO: 121287 - DNA, 20 bp, Artificial Sequence
  Description of Artificial Sequence: Synthetic oligonucleotide
  Target: ATXN1; (+) strand; PAM type: NRG; PAM sequence: GAG
gagcttgcagactagttgag

SEQ ID NO: 121288 - DNA, 20 bp, Artificial Sequence
  Description of Artificial Sequence: Synthetic oligonucleotide
  Target: ATXN1; (+) strand; PAM type: NRG; PAM sequence: AAG
caaataaatatataatatgt

SEQ ID NO: 121289 - DNA, 20 bp, Artificial Sequence
  Description of Artificial Sequence: Synthetic oligonucleotide
  Target: ATXN1; (+) strand; PAM type: NRG; PAM sequence: AGG
aaataaatatataatatgta

SEQ ID NO: 121290 - DNA, 20 bp, Artificial Sequence
  Description of Artificial Sequence: Synthetic oligonucleotide
  Target: ATXN1; (+) strand; PAM type: NRG; PAM sequence: AAG
ataatatgtaaggtgcttaa

SEQ ID NO: 121291 - DNA, 20 bp, Artificial Sequence
  Description of Artificial Sequence: Synthetic oligonucleotide
  Target: ATXN1; (+) strand; PAM type: NRG; PAM sequence: CAG
aggtgcttaaaagaaaaaca

SEQ ID NO: 121292 - DNA, 20 bp, Artificial Sequence
  Description of Artificial Sequence: Synthetic oligonucleotide
  Target: ATXN1; (+) strand; PAM type: NRG; PAM sequence: AAG
tgcttaaaagaaaaacacag

SEQ ID NO: 121293 - DNA, 20 bp, Artificial Sequence
  Description of Artificial Sequence: Synthetic oligonucleotide
  Target: ATXN1; (+) strand; PAM type: NRG; PAM sequence: AGG
gcttaaaagaaaaacacaga

SEQ ID NO: 121294 - DNA, 20 bp, Artificial Sequence
  Description of Artificial Sequence: Synthetic oligonucleotide
  Target: ATXN1; (+) strand; PAM type: NRG; PAM sequence: TAG
aaaagaaaaacacagaaggc

SEQ ID NO: 121295 - DNA, 20 bp, Artificial Sequence
  Description of Artificial Sequence: Synthetic oligonucleotide
  Target: ATXN1; (+) strand; PAM type: NRG; PAM sequence: GAG
aagaaaaacacagaaggcta

SEQ ID NO: 121296 - DNA, 20 bp, Artificial Sequence
  Description of Artificial Sequence: Synthetic oligonucleotide
  Target: ATXN1; (+) strand; PAM type: NRG; PAM sequence: AGG
agaaaaacacagaaggctag

SEQ ID NO: 121297 - DNA, 20 bp, Artificial Sequence
  Description of Artificial Sequence: Synthetic oligonucleotide
  Target: ATXN1; (+) strand; PAM type: NRG; PAM sequence: GAG
acacagaaggctagaggact

SEQ ID NO: 121298 - DNA, 20 bp, Artificial Sequence
  Description of Artificial Sequence: Synthetic oligonucleotide
  Target: ATXN1; (+) strand; PAM type: NRG; PAM sequence: GAG
acagaaggctagaggactga

SEQ ID NO: 121299 - DNA, 20 bp, Artificial Sequence
  Description of Artificial Sequence: Synthetic oligonucleotide
  Target: ATXN1; (+) strand; PAM type: NRG; PAM sequence: AGG
cagaaggctagaggactgag

SEQ ID NO: 121300 - DNA, 20 bp, Artificial Sequence
  Description of Artificial Sequence: Synthetic oligonucleotide
  Target: ATXN1; (+) strand; PAM type: NRG; PAM sequence: GGG
agaaggctagaggactgaga

SEQ ID NO: 121301 - DNA, 20 bp, Artificial Sequence
  Description of Artificial Sequence: Synthetic oligonucleotide
  Target: ATXN1; (+) strand; PAM type: NRG; PAM sequence: TGG
ggctagaggactgagaggga

SEQ ID NO: 121302 - DNA, 20 bp, Artificial Sequence
  Description of Artificial Sequence: Synthetic oligonucleotide
  Target: ATXN1; (+) strand; PAM type: NRG; PAM sequence: GGG
gctagaggactgagagggat

SEQ ID NO: 121303 - DNA, 20 bp, Artificial Sequence
  Description of Artificial Sequence: Synthetic oligonucleotide
  Target: ATXN1; (+) strand; PAM type: NRG; PAM sequence: GGG
ctagaggactgagagggatg

SEQ ID NO: 121304 - DNA, 20 bp, Artificial Sequence
  Description of Artificial Sequence: Synthetic oligonucleotide
  Target: ATXN1; (+) strand; PAM type: NRG; PAM sequence: TGG
gaggactgagagggatgggg

SEQ ID NO: 121305 - DNA, 20 bp, Artificial Sequence
  Description of Artificial Sequence: Synthetic oligonucleotide
  Target: ATXN1; (+) strand; PAM type: NRG; PAM sequence: TAG
ggggtggatgctattttatg

SEQ ID NO: 121306 - DNA, 20 bp, Artificial Sequence
  Description of Artificial Sequence: Synthetic oligonucleotide
  Target: ATXN1; (+) strand; PAM type: NRG; PAM sequence: CAG
ggatgctattttatgtagat

SEQ ID NO: 121307 - DNA, 20 bp, Artificial Sequence
  Description of Artificial Sequence: Synthetic oligonucleotide
  Target: ATXN1; (+) strand; PAM type: NRG; PAM sequence: AGG
gatgctattttatgtagatc

SEQ ID NO: 121308 - DNA, 20 bp, Artificial Sequence
  Description of Artificial Sequence: Synthetic oligonucleotide
  Target: ATXN1; (+) strand; PAM type: NRG; PAM sequence: GGG
atgctattttatgtagatca

SEQ ID NO: 121309 - DNA, 20 bp, Artificial Sequence
  Description of Artificial Sequence: Synthetic oligonucleotide
  Target: ATXN1; (+) strand; PAM type: NRG; PAM sequence: AAG
ctattttatgtagatcaggg

SEQ ID NO: 121310 - DNA, 20 bp, Artificial Sequence
  Description of Artificial Sequence: Synthetic oligonucleotide
  Target: ATXN1; (+) strand; PAM type: NRG; PAM sequence: AGG
tattttatgtagatcaggga

SEQ ID NO: 121311 - DNA, 20 bp, Artificial Sequence
  Description of Artificial Sequence: Synthetic oligonucleotide
  Target: ATXN1; (+) strand; PAM type: NRG; PAM sequence: AAG
tcagggaaggctgctttgat

SEQ ID NO: 121312 - DNA, 20 bp, Artificial Sequence
  Description of Artificial Sequence: Synthetic oligonucleotide
  Target: ATXN1; (+) strand; PAM type: NRG; PAM sequence: AGG
cagggaaggctgctttgata

SEQ ID NO: 121313 - DNA, 20 bp, Artificial Sequence
  Description of Artificial Sequence: Synthetic oligonucleotide
  Target: ATXN1; (+) strand; PAM type: NRG; PAM sequence: AAG
ctgctttgataaggtaactc

SEQ ID NO: 121314 - DNA, 20 bp, Artificial Sequence
  Description of Artificial Sequence: Synthetic oligonucleotide
  Target: ATXN1; (+) strand; PAM type: NRG; PAM sequence: AAG
taactcaagaattcctactt

SEQ ID NO: 121315 - DNA, 20 bp, Artificial Sequence
  Description of Artificial Sequence: Synthetic oligonucleotide
  Target: ATXN1; (+) strand; PAM type: NRG; PAM sequence: AGG
aactcaagaattcctactta

SEQ ID NO: 121316 - DNA, 20 bp, Artificial Sequence
  Description of Artificial Sequence: Synthetic oligonucleotide
  Target: ATXN1; (+) strand; PAM type: NRG; PAM sequence: AAG
tcaagaattcctacttaagg

SEQ ID NO: 121317 - DNA, 20 bp, Artificial Sequence
  Description of Artificial Sequence: Synthetic oligonucleotide
  Target: ATXN1; (+) strand; PAM type: NRG; PAM sequence: CAG
agaattcctacttaaggaag

SEQ ID NO: 121318 - DNA, 20 bp, Artificial Sequence
  Description of Artificial Sequence: Synthetic oligonucleotide
  Target: ATXN1; (+) strand; PAM type: NRG; PAM sequence: GAG
aattcctacttaaggaagca

SEQ ID NO: 121319 - DNA, 20 bp, Artificial Sequence
  Description of Artificial Sequence: Synthetic oligonucleotide
  Target: ATXN1; (+) strand; PAM type: NRG; PAM sequence: AAG
tcctacttaaggaagcagag

SEQ ID NO: 121320 - DNA, 20 bp, Artificial Sequence
  Description of Artificial Sequence: Synthetic oligonucleotide
  Target: ATXN1; (+) strand; PAM type: NRG; PAM sequence: TAG
cttaaggaagcagagaagct

SEQ ID NO: 121321 - DNA, 20 bp, Artificial Sequence
  Description of Artificial Sequence: Synthetic oligonucleotide
  Target: ATXN1; (+) strand; PAM type: NRG; PAM sequence: AGG
ttaaggaagcagagaagctt

SEQ ID NO: 121322 - DNA, 20 bp, Artificial Sequence
  Description of Artificial Sequence: Synthetic oligonucleotide
  Target: ATXN1; (+) strand; PAM type: NRG; PAM sequence: TGG
agaagcttaggaatgaaata

SEQ ID NO: 121323 - DNA, 20 bp, Artificial Sequence
  Description of Artificial Sequence: Synthetic oligonucleotide
  Target: ATXN1; (+) strand; PAM type: NRG; PAM sequence: TAG
tggatcactttctccttgct

SEQ ID NO: 121324 - DNA, 20 bp, Artificial Sequence
  Description of Artificial Sequence: Synthetic oligonucleotide
  Target: ATXN1; (+) strand; PAM type: NRG; PAM sequence: GAG
ttagactctaaccaatattt

SEQ ID NO: 121325 - DNA, 20 bp, Artificial Sequence
  Description of Artificial Sequence: Synthetic oligonucleotide
  Target: ATXN1; (+) strand; PAM type: NRG; PAM sequence: CAG
ctctaaccaatatttgagca

SEQ ID NO: 121326 - DNA, 20 bp, Artificial Sequence
  Description of Artificial Sequence: Synthetic oligonucleotide
  Target: ATXN1; (+) strand; PAM type: NRG; PAM sequence: GAG
ctaaccaatatttgagcaca

SEQ ID NO: 121327 - DNA, 20 bp, Artificial Sequence
  Description of Artificial Sequence: Synthetic oligonucleotide
  Target: ATXN1; (+) strand; PAM type: NRG; PAM sequence: AGG
taaccaatatttgagcacag

SEQ ID NO: 121328 - DNA, 20 bp, Artificial Sequence
  Description of Artificial Sequence: Synthetic oligonucleotide
  Target: ATXN1; (+) strand; PAM type: NRG; PAM sequence: TGG
ccaatatttgagcacagagg

SEQ ID NO: 121329 - DNA, 20 bp, Artificial Sequence
  Description of Artificial Sequence: Synthetic oligonucleotide
  Target: ATXN1; (+) strand; PAM type: NRG; PAM sequence: TAG
tttgagcacagaggtggttt

SEQ ID NO: 121330 - DNA, 20 bp, Artificial Sequence
  Description of Artificial Sequence: Synthetic oligonucleotide
  Target: ATXN1; (+) strand; PAM type: NRG; PAM sequence: AAG
gaggtggttttagaaaactc

SEQ ID NO: 121331 - DNA, 20 bp, Artificial Sequence
  Description of Artificial Sequence: Synthetic oligonucleotide
  Target: ATXN1; (+) strand; PAM type: NRG; PAM sequence: AAG
tcgttcctgtttattttcaa

SEQ ID NO: 121332 - DNA, 20 bp, Artificial Sequence
  Description of Artificial Sequence: Synthetic oligonucleotide
  Target: ATXN1; (+) strand; PAM type: NRG; PAM sequence: AGG
cgttcctgtttattttcaaa

SEQ ID NO: 121333 - DNA, 20 bp, Artificial Sequence
  Description of Artificial Sequence: Synthetic oligonucleotide
  Target: ATXN1; (+) strand; PAM type: NRG; PAM sequence: GAG
ttattttcaaaaggaccaat

SEQ ID NO: 121334 - DNA, 20 bp, Artificial Sequence
  Description of Artificial Sequence: Synthetic oligonucleotide
  Target: ATXN1; (+) strand; PAM type: NRG; PAM sequence: TGG
ttcaaaaggaccaatgagtg

SEQ ID NO: 121335 - DNA, 20 bp, Artificial Sequence
  Description of Artificial Sequence: Synthetic oligonucleotide
  Target: ATXN1; (+) strand; PAM type: NRG; PAM sequence: CAG
gtgtggaccctaaatttaaa

SEQ ID NO: 121336 - DNA, 20 bp, Artificial Sequence
  Description of Artificial Sequence: Synthetic oligonucleotide
  Target: ATXN1; (+) strand; PAM type: NRG; PAM sequence: AAG
accctaaatttaaacagcta

SEQ ID NO: 121337 - DNA, 20 bp, Artificial Sequence
  Description of Artificial Sequence: Synthetic oligonucleotide
  Target: ATXN1; (+) strand; PAM type: NRG; PAM sequence: TAG
aatttaaacagctaaagcta

SEQ ID NO: 121338 - DNA, 20 bp, Artificial Sequence
  Description of Artificial Sequence: Synthetic oligonucleotide
  Target: ATXN1; (+) strand; PAM type: NRG; PAM sequence: AAG
aacagctaaagctatagtct

SEQ ID NO: 121339 - DNA, 20 bp, Artificial Sequence
  Description of Artificial Sequence: Synthetic oligonucleotide
  Target: ATXN1; (+) strand; PAM type: NRG; PAM sequence: AGG
acagctaaagctatagtcta

SEQ ID NO: 121340 - DNA, 20 bp, Artificial Sequence
  Description of Artificial Sequence: Synthetic oligonucleotide
  Target: ATXN1; (+) strand; PAM type: NRG; PAM sequence: CAG
ctaaagctatagtctaagga

SEQ ID NO: 121341 - DNA, 20 bp, Artificial Sequence
  Description of Artificial Sequence: Synthetic oligonucleotide
  Target: ATXN1; (+) strand; PAM type: NRG; PAM sequence: TGG
aatacctttgaattgtcata

SEQ ID NO: 121342 - DNA, 20 bp, Artificial Sequence
  Description of Artificial Sequence: Synthetic oligonucleotide
  Target: ATXN1; (+) strand; PAM type: NRG; PAM sequence: CAG
ttgaattgtcatatggtgcc

SEQ ID NO: 121343 - DNA, 20 bp, Artificial Sequence
  Description of Artificial Sequence: Synthetic oligonucleotide
  Target: ATXN1; (+) strand; PAM type: NRG; PAM sequence: AGG
tgaattgtcatatggtgccc

SEQ ID NO: 121344 - DNA, 20 bp, Artificial Sequence
  Description of Artificial Sequence: Synthetic oligonucleotide
  Target: ATXN1; (+) strand; PAM type: NRG; PAM sequence: GAG
aattgtcatatggtgcccag

SEQ ID NO: 121345 - DNA, 20 bp, Artificial Sequence
  Description of Artificial Sequence: Synthetic oligonucleotide
  Target: ATXN1; (+) strand; PAM type: NRG; PAM sequence: AGG
attgtcatatggtgcccagg

SEQ ID NO: 121346 - DNA, 20 bp, Artificial Sequence
  Description of Artificial Sequence: Synthetic oligonucleotide
  Target: ATXN1; (+) strand; PAM type: NRG; PAM sequence: GGG
ttgtcatatggtgcccagga

SEQ ID NO: 121347 - DNA, 20 bp, Artificial Sequence
  Description of Artificial Sequence: Synthetic oligonucleotide
  Target: ATXN1; (+) strand; PAM type: NRG; PAM sequence: TGG
tggtgcccaggagggtcttg

SEQ ID NO: 121348 - DNA, 20 bp, Artificial Sequence
  Description of Artificial Sequence: Synthetic oligonucleotide
  Target: ATXN1; (+) strand; PAM type: NRG; PAM sequence: AAG
gcccaggagggtcttgtgga

SEQ ID NO: 121349 - DNA, 20 bp, Artificial Sequence
  Description of Artificial Sequence: Synthetic oligonucleotide
  Target: ATXN1; (+) strand; PAM type: NRG; PAM sequence: AGG
cccaggagggtcttgtggaa

SEQ ID NO: 121350 - DNA, 20 bp, Artificial Sequence
  Description of Artificial Sequence: Synthetic oligonucleotide
  Target: ATXN1; (+) strand; PAM type: NRG; PAM sequence: GGG
ccaggagggtcttgtggaaa

SEQ ID NO: 121351 - DNA, 20 bp, Artificial Sequence
  Description of Artificial Sequence: Synthetic oligonucleotide
  Target: ATXN1; (+) strand; PAM type: NRG; PAM sequence: TGG
gtcttgtggaaagggtttca

SEQ ID NO: 121352 - DNA, 20 bp, Artificial Sequence
  Description of Artificial Sequence: Synthetic oligonucleotide
  Target: ATXN1; (+) strand; PAM type: NRG; PAM sequence: TAG
ttgtggaaagggtttcatgg

SEQ ID NO: 121353 - DNA, 20 bp, Artificial Sequence
  Description of Artificial Sequence: Synthetic oligonucleotide
  Target: ATXN1; (+) strand; PAM type: NRG; PAM sequence: AAG
aaagggtttcatggtagtga

SEQ ID NO: 121354 - DNA, 20 bp, Artificial Sequence
  Description of Artificial Sequence: Synthetic oligonucleotide
  Target: ATXN1; (+) strand; PAM type: NRG; PAM sequence: AAG
tctttttttcttttaaccct

SEQ ID NO: 121355 - DNA, 20 bp, Artificial Sequence
  Description of Artificial Sequence: Synthetic oligonucleotide
  Target: ATXN1; (+) strand; PAM type: NRG; PAM sequence: CAG
tgtgctcaatgttttaaaaa

SEQ ID NO: 121356 - DNA, 20 bp, Artificial Sequence
  Description of Artificial Sequence: Synthetic oligonucleotide
  Target: ATXN1; (+) strand; PAM type: NRG; PAM sequence: GAG
ttttaaaaacagttgtaaat

SEQ ID NO: 121357 - DNA, 20 bp, Artificial Sequence
  Description of Artificial Sequence: Synthetic oligonucleotide
  Target: ATXN1; (+) strand; PAM type: NRG; PAM sequence: AGG
tttaaaaacagttgtaaatg

SEQ ID NO: 121358 - DNA, 20 bp, Artificial Sequence
  Description of Artificial Sequence: Synthetic oligonucleotide
  Target: ATXN1; (+) strand; PAM type: NRG; PAM sequence: TAG
aaaaacagttgtaaatgagg

SEQ ID NO: 121359 - DNA, 20 bp, Artificial Sequence
  Description of Artificial Sequence: Synthetic oligonucleotide
  Target: ATXN1; (+) strand; PAM type: NRG; PAM sequence: TAG
agtgccaaatcattgatttt

SEQ ID NO: 121360 - DNA, 20 bp, Artificial Sequence
  Description of Artificial Sequence: Synthetic oligonucleotide
  Target: ATXN1; (+) strand; PAM type: NRG; PAM sequence: AGG
gtgccaaatcattgattttt

SEQ ID NO: 121361 - DNA, 20 bp, Artificial Sequence
  Description of Artificial Sequence: Synthetic oligonucleotide
  Target: ATXN1; (+) strand; PAM type: NRG; PAM sequence: AAG
tcattgatttttaggaaccc

SEQ ID NO: 121362 - DNA, 20 bp, Artificial Sequence
  Description of Artificial Sequence: Synthetic oligonucleotide
  Target: ATXN1; (+) strand; PAM type: NRG; PAM sequence: AAG
ttgatttttaggaacccaag

SEQ ID NO: 121363 - DNA, 20 bp, Artificial Sequence
  Description of Artificial Sequence: Synthetic oligonucleotide
  Target: ATXN1; (+) strand; PAM type: NRG; PAM sequence: AGG
tgatttttaggaacccaaga

SEQ ID NO: 121364 - DNA, 20 bp, Artificial Sequence
  Description of Artificial Sequence: Synthetic oligonucleotide
  Target: ATXN1; (+) strand; PAM type: NRG; PAM sequence: TGG
aggtaaaataaacgttcaat

SEQ ID NO: 121365 - DNA, 20 bp, Artificial Sequence
  Description of Artificial Sequence: Synthetic oligonucleotide
  Target: ATXN1; (+) strand; PAM type: NRG; PAM sequence: AAG
acgttcaattggcctcatct

SEQ ID NO: 121366 - DNA, 20 bp, Artificial Sequence
  Description of Artificial Sequence: Synthetic oligonucleotide
  Target: ATXN1; (+) strand; PAM type: NRG; PAM sequence: AGG
cgttcaattggcctcatcta

SEQ ID NO: 121367 - DNA, 20 bp, Artificial Sequence
  Description of Artificial Sequence: Synthetic oligonucleotide
  Target: ATXN1; (+) strand; PAM type: NRG; PAM sequence: GAG
gctgatactttatgcaactt

SEQ ID NO: 121368 - DNA, 20 bp, Artificial Sequence
  Description of Artificial Sequence: Synthetic oligonucleotide
  Target: ATXN1; (+) strand; PAM type: NRG; PAM sequence: TAG
tttatgcaacttgagacact

SEQ ID NO: 121369 - DNA, 20 bp, Artificial Sequence
  Description of Artificial Sequence: Synthetic oligonucleotide
  Target: ATXN1; (+) strand; PAM type: NRG; PAM sequence: AGG
ttatgcaacttgagacactt

SEQ ID NO: 121370 - DNA, 20 bp, Artificial Sequence
  Description of Artificial Sequence: Synthetic oligonucleotide
  Target: ATXN1; (+) strand; PAM type: NRG; PAM sequence: GGG
tatgcaacttgagacactta

SEQ ID NO: 121371 - DNA, 20 bp, Artificial Sequence
  Description of Artificial Sequence: Synthetic oligonucleotide
  Target: ATXN1; (+) strand; PAM type: NRG; PAM sequence: TGG
cttagggtaaaaaccaccac

SEQ ID NO: 121372 - DNA, 20 bp, Artificial Sequence
  Description of Artificial Sequence: Synthetic oligonucleotide
  Target: ATXN1; (+) strand; PAM type: NRG; PAM sequence: GAG
tagggtaaaaaccaccactg

SEQ ID NO: 121373 - DNA, 20 bp, Artificial Sequence
  Description of Artificial Sequence: Synthetic oligonucleotide
  Target: ATXN1; (+) strand; PAM type: NRG; PAM sequence: AGG
agggtaaaaaccaccactgg

SEQ ID NO: 121374 - DNA, 20 bp, Artificial Sequence
  Description of Artificial Sequence: Synthetic oligonucleotide
  Target: ATXN1; (+) strand; PAM type: NRG; PAM sequence: AAG
tgatttaactcaattttctc

SEQ ID NO: 121375 - DNA, 20 bp, Artificial Sequence
  Description of Artificial Sequence: Synthetic oligonucleotide
  Target: ATXN1; (+) strand; PAM type: NRG; PAM sequence: GAG
caagttgtccatcataaaat

SEQ ID NO: 121376 - DNA, 20 bp, Artificial Sequence
  Description of Artificial Sequence: Synthetic oligonucleotide
  Target: ATXN1; (+) strand; PAM type: NRG; PAM sequence: TGG
catcataaaatgagtcccca

SEQ ID NO: 121377 - DNA, 20 bp, Artificial Sequence
  Description of Artificial Sequence: Synthetic oligonucleotide
  Target: ATXN1; (+) strand; PAM type: NRG; PAM sequence: TAG
cataaaatgagtccccatgg

SEQ ID NO: 121378 - DNA, 20 bp, Artificial Sequence
  Description of Artificial Sequence: Synthetic oligonucleotide
  Target: ATXN1; (+) strand; PAM type: NRG; PAM sequence: GAG
taaaatgagtccccatggta

SEQ ID NO: 121379 - DNA, 20 bp, Artificial Sequence
  Description of Artificial Sequence: Synthetic oligonucleotide
  Target: ATXN1; (+) strand; PAM type: NRG; PAM sequence: GAG
aaatgagtccccatggtaga

SEQ ID NO: 121380 - DNA, 20 bp, Artificial Sequence
  Description of Artificial Sequence: Synthetic oligonucleotide
  Target: ATXN1; (+) strand; PAM type: NRG; PAM sequence: AGG
aatgagtccccatggtagag

SEQ ID NO: 121381 - DNA, 20 bp, Artificial Sequence
  Description of Artificial Sequence: Synthetic oligonucleotide
  Target: ATXN1; (+) strand; PAM type: NRG; PAM sequence: AAG
ccccatggtagagaggaccc

SEQ ID NO: 121382 - DNA, 20 bp, Artificial Sequence
  Description of Artificial Sequence: Synthetic oligonucleotide
  Target: ATXN1; (+) strand; PAM type: NRG; PAM sequence: AGG
cccatggtagagaggaccca

SEQ ID NO: 121383 - DNA, 20 bp, Artificial Sequence
  Description of Artificial Sequence: Synthetic oligonucleotide
  Target: ATXN1; (+) strand; PAM type: NRG; PAM sequence: TGG
agagaggacccaaggttata

SEQ ID NO: 121384 - DNA, 20 bp, Artificial Sequence
  Description of Artificial Sequence: Synthetic oligonucleotide
  Target: ATXN1; (+) strand; PAM type: NRG; PAM sequence: CAG
caaggttatatggctaacaa

SEQ ID NO: 121385 - DNA, 20 bp, Artificial Sequence
  Description of Artificial Sequence: Synthetic oligonucleotide
  Target: ATXN1; (+) strand; PAM type: NRG; PAM sequence: CAG
acagcattgtgcataaaatc

SEQ ID NO: 121386 - DNA, 20 bp, Artificial Sequence
  Description of Artificial Sequence: Synthetic oligonucleotide
  Target: ATXN1; (+) strand; PAM type: NRG; PAM sequence: AGG
cagcattgtgcataaaatcc

SEQ ID NO: 121387 - DNA, 20 bp, Artificial Sequence
  Description of Artificial Sequence: Synthetic oligonucleotide
  Target: ATXN1; (+) strand; PAM type: NRG; PAM sequence: GAG
aatccaggtctgctaactct

SEQ ID NO: 121388 - DNA, 20 bp, Artificial Sequence
  Description of Artificial Sequence: Synthetic oligonucleotide
  Target: ATXN1; (+) strand; PAM type: NRG; PAM sequence: CAG
aggtctgctaactctgagtt

SEQ ID NO: 121389 - DNA, 20 bp, Artificial Sequence
  Description of Artificial Sequence: Synthetic oligonucleotide
  Target: ATXN1; (+) strand; PAM type: NRG; PAM sequence: CAG
gctaactctgagttcagtgt

SEQ ID NO: 121390 - DNA, 20 bp, Artificial Sequence
  Description of Artificial Sequence: Synthetic oligonucleotide
  Target: ATXN1; (+) strand; PAM type: NRG; PAM sequence: AAG
gcatcattctcttcttgtac

SEQ ID NO: 121391 - DNA, 20 bp, Artificial Sequence
  Description of Artificial Sequence: Synthetic oligonucleotide
  Target: ATXN1; (+) strand; PAM type: NRG; PAM sequence: CAG
tacaagatcccccctccccc

SEQ ID NO: 121392 - DNA, 20 bp, Artificial Sequence
  Description of Artificial Sequence: Synthetic oligonucleotide
  Target: ATXN1; (+) strand; PAM type: NRG; PAM sequence: CAG
ccccctccccccagccctta

SEQ ID NO: 121393 - DNA, 20 bp, Artificial Sequence
  Description of Artificial Sequence: Synthetic oligonucleotide
  Target: ATXN1; (+) strand; PAM type: NRG; PAM sequence: CAG
ctccccccagcccttacagc

SEQ ID NO: 121394 - DNA, 20 bp, Artificial Sequence
  Description of Artificial Sequence: Synthetic oligonucleotide
  Target: ATXN1; (+) strand; PAM type: NRG; PAM sequence: CAG
cagccagtctgaaacatctt

SEQ ID NO: 121395 - DNA, 20 bp, Artificial Sequence
  Description of Artificial Sequence: Synthetic oligonucleotide
  Target: ATXN1; (+) strand; PAM type: NRG; PAM sequence: AGG
agccagtctgaaacatcttc

SEQ ID NO: 121396 - DNA, 20 bp, Artificial Sequence
  Description of Artificial Sequence: Synthetic oligonucleotide
  Target: ATXN1; (+) strand; PAM type: NRG; PAM sequence: GGG
gccagtctgaaacatcttca

SEQ ID NO: 121397 - DNA, 20 bp, Artificial Sequence
  Description of Artificial Sequence: Synthetic oligonucleotide
  Target: ATXN1; (+) strand; PAM type: NRG; PAM sequence: GGG
ccagtctgaaacatcttcag

SEQ ID NO: 121398 - DNA, 20 bp, Artificial Sequence
  Description of Artificial Sequence: Synthetic oligonucleotide
  Target: ATXN1; (+) strand; PAM type: NRG; PAM sequence: AAG
ctgaaacatcttcaggggca

SEQ ID NO: 121399 - DNA, 20 bp, Artificial Sequence
  Description of Artificial Sequence: Synthetic oligonucleotide
  Target: ATXN1; (+) strand; PAM type: NRG; PAM sequence: AGG
tgaaacatcttcaggggcaa

SEQ ID NO: 121400 - DNA, 20 bp, Artificial Sequence
  Description of Artificial Sequence: Synthetic oligonucleotide
  Target: ATXN1; (+) strand; PAM type: NRG; PAM sequence: TGG
caggggcaaaggccatctgc

SEQ ID NO: 121401 - DNA, 20 bp, Artificial Sequence
  Description of Artificial Sequence: Synthetic oligonucleotide
  Target: ATXN1; (+) strand; PAM type: NRG; PAM sequence: AAG
ggcaaaggccatctgctggc

SEQ ID NO: 121402 - DNA, 20 bp, Artificial Sequence
  Description of Artificial Sequence: Synthetic oligonucleotide
  Target: ATXN1; (+) strand; PAM type: NRG; PAM sequence: TGG
aaaggccatctgctggcaag

SEQ ID NO: 121403 - DNA, 20 bp, Artificial Sequence
  Description of Artificial Sequence: Synthetic oligonucleotide
  Target: ATXN1; (+) strand; PAM type: NRG; PAM sequence: TGG
ggccatctgctggcaagtgg

SEQ ID NO: 121404 - DNA, 20 bp, Artificial Sequence
  Description of Artificial Sequence: Synthetic oligonucleotide
  Target: ATXN1; (+) strand; PAM type: NRG; PAM sequence: CAG
catctgctggcaagtggtgg

SEQ ID NO: 121405 - DNA, 20 bp, Artificial Sequence
  Description of Artificial Sequence: Synthetic oligonucleotide
  Target: ATXN1; (+) strand; PAM type: NRG; PAM sequence: GAG
tggcaagtggtggcagattt

SEQ ID NO: 121406 - DNA, 20 bp, Artificial Sequence
  Description of Artificial Sequence: Synthetic oligonucleotide
  Target: ATXN1; (+) strand; PAM type: NRG; PAM sequence: GAG
gcaagtggtggcagatttga

SEQ ID NO: 121407 - DNA, 20 bp, Artificial Sequence
  Description of Artificial Sequence: Synthetic oligonucleotide
  Target: ATXN1; (+) strand; PAM type: NRG; PAM sequence: AGG
caagtggtggcagatttgag

SEQ ID NO: 121408 - DNA, 20 bp, Artificial Sequence
  Description of Artificial Sequence: Synthetic oligonucleotide
  Target: ATXN1; (+) strand; PAM type: NRG; PAM sequence: CAG
gtggtggcagatttgagagg

SEQ ID NO: 121409 - DNA, 20 bp, Artificial Sequence
  Description of Artificial Sequence: Synthetic oligonucleotide
  Target: ATXN1; (+) strand; PAM type: NRG; PAM sequence: TGG
cagatttgagaggcagttaa

SEQ ID NO: 121410 - DNA, 20 bp, Artificial Sequence
  Description of Artificial Sequence: Synthetic oligonucleotide
  Target: ATXN1; (+) strand; PAM type: NRG; PAM sequence: GGG
agatttgagaggcagttaat

SEQ ID NO: 121411 - DNA, 20 bp, Artificial Sequence
  Description of Artificial Sequence: Synthetic oligonucleotide
  Target: ATXN1; (+) strand; PAM type: NRG; PAM sequence: CAG
ggcagttaatgggacatgca

SEQ ID NO: 121412 - DNA, 20 bp, Artificial Sequence
  Description of Artificial Sequence: Synthetic oligonucleotide
  Target: ATXN1; (+) strand; PAM type: NRG; PAM sequence: AGG
gcagttaatgggacatgcac

SEQ ID NO: 121413 - DNA, 20 bp, Artificial Sequence
  Description of Artificial Sequence: Synthetic oligonucleotide
  Target: ATXN1; (+) strand; PAM type: NRG; PAM sequence: CAG
acatgcacaggaatgaatgc

SEQ ID NO: 121414 - DNA, 20 bp, Artificial Sequence
  Description of Artificial Sequence: Synthetic oligonucleotide
  Target: ATXN1; (+) strand; PAM type: NRG; PAM sequence: AGG
catgcacaggaatgaatgcc

SEQ ID NO: 121415 - DNA, 20 bp, Artificial Sequence
  Description of Artificial Sequence: Synthetic oligonucleotide
  Target: ATXN1; (+) strand; PAM type: NRG; PAM sequence: GAG
tgcacaggaatgaatgccag

SEQ ID NO: 121416 - DNA, 20 bp, Artificial Sequence
  Description of Artificial Sequence: Synthetic oligonucleotide
  Target: ATXN1; (+) strand; PAM type: NRG; PAM sequence: AAG
atgccaggagtaacatctgc

SEQ ID NO: 121417 - DNA, 20 bp, Artificial Sequence
  Description of Artificial Sequence: Synthetic oligonucleotide
  Target: ATXN1; (+) strand; PAM type: NRG; PAM sequence: AGG
tgccaggagtaacatctgca

SEQ ID NO: 121418 - DNA, 20 bp, Artificial Sequence
  Description of Artificial Sequence: Synthetic oligonucleotide
  Target: ATXN1; (+) strand; PAM type: NRG; PAM sequence: GAG
taacatctgcaaggactgct

SEQ ID NO: 121419 - DNA, 20 bp, Artificial Sequence
  Description of Artificial Sequence: Synthetic oligonucleotide
  Target: ATXN1; (+) strand; PAM type: NRG; PAM sequence: TGG
tctgcaaggactgctgagca

SEQ ID NO: 121420 - DNA, 20 bp, Artificial Sequence
  Description of Artificial Sequence: Synthetic oligonucleotide
  Target: ATXN1; (+) strand; PAM type: NRG; PAM sequence: GGG
ctgcaaggactgctgagcat

SEQ ID NO: 121421 - DNA, 20 bp, Artificial Sequence
  Description of Artificial Sequence: Synthetic oligonucleotide
  Target: ATXN1; (+) strand; PAM type: NRG; PAM sequence: TGG
atgggaaccactacttccaa

SEQ ID NO: 121422 - DNA, 20 bp, Artificial Sequence
  Description of Artificial Sequence: Synthetic oligonucleotide
  Target: ATXN1; (+) strand; PAM type: NRG; PAM sequence: TAG
cacatttatacacccactcc

SEQ ID NO: 121423 - DNA, 20 bp, Artificial Sequence
  Description of Artificial Sequence: Synthetic oligonucleotide
  Target: ATXN1; (+) strand; PAM type: NRG; PAM sequence: CAG
gcctgccttctctactgcaa

SEQ ID NO: 121424 - DNA, 20 bp, Artificial Sequence
  Description of Artificial Sequence: Synthetic oligonucleotide
  Target: ATXN1; (+) strand; PAM type: NRG; PAM sequence: TGG
tctactgcaacagttctcca

SEQ ID NO: 121425 - DNA, 20 bp, Artificial Sequence
  Description of Artificial Sequence: Synthetic oligonucleotide
  Target: ATXN1; (+) strand; PAM type: NRG; PAM sequence: CAG
tgcaacagttctccatggca

SEQ ID NO: 121426 - DNA, 20 bp, Artificial Sequence
  Description of Artificial Sequence: Synthetic oligonucleotide
  Target: ATXN1; (+) strand; PAM type: NRG; PAM sequence: AGG
gcaacagttctccatggcac

SEQ ID NO: 121427 - DNA, 20 bp, Artificial Sequence
  Description of Artificial Sequence: Synthetic oligonucleotide
  Target: ATXN1; (+) strand; PAM type: NRG; PAM sequence: TGG
gttctccatggcacaggctt

SEQ ID NO: 121428 - DNA, 20 bp, Artificial Sequence
  Description of Artificial Sequence: Synthetic oligonucleotide
  Target: ATXN1; (+) strand; PAM type: NRG; PAM sequence: GGG
ttctccatggcacaggcttt

SEQ ID NO: 121429 - DNA, 20 bp, Artificial Sequence
  Description of Artificial Sequence: Synthetic oligonucleotide
  Target: ATXN1; (+) strand; PAM type: NRG; PAM sequence: GGG
tctccatggcacaggctttg

SEQ ID NO: 121430 - DNA, 20 bp, Artificial Sequence
  Description of Artificial Sequence: Synthetic oligonucleotide
  Target: ATXN1; (+) strand; PAM type: NRG; PAM sequence: CAG
ggcacaggctttggggcatg

SEQ ID NO: 121431 - DNA, 20 bp, Artificial Sequence
  Description of Artificial Sequence: Synthetic oligonucleotide
  Target: ATXN1; (+) strand; PAM type: NRG; PAM sequence: AGG
gcacaggctttggggcatgc

SEQ ID NO: 121432 - DNA, 20 bp, Artificial Sequence
  Description of Artificial Sequence: Synthetic oligonucleotide
  Target: ATXN1; (+) strand; PAM type: NRG; PAM sequence: CAG
ggcatgcaggacactaaacc

SEQ ID NO: 121433 - DNA, 20 bp, Artificial Sequence
  Description of Artificial Sequence: Synthetic oligonucleotide
  Target: ATXN1; (+) strand; PAM type: NRG; PAM sequence: AGG
gcatgcaggacactaaaccc

SEQ ID NO: 121434 - DNA, 20 bp, Artificial Sequence
  Description of Artificial Sequence: Synthetic oligonucleotide
  Target: ATXN1; (+) strand; PAM type: NRG; PAM sequence: AAG
tgcaggacactaaacccagg

SEQ ID NO: 121435 - DNA, 20 bp, Artificial Sequence
  Description of Artificial Sequence: Synthetic oligonucleotide
  Target: ATXN1; (+) strand; PAM type: NRG; PAM sequence: CAG
ggacactaaacccaggaaga

SEQ ID NO: 121436 - DNA, 20 bp, Artificial Sequence
  Description of Artificial Sequence: Synthetic oligonucleotide
  Target: ATXN1; (+) strand; PAM type: NRG; PAM sequence: CAG
aacccaggaagacagaaaac

SEQ ID NO: 121437 - DNA, 20 bp, Artificial Sequence
  Description of Artificial Sequence: Synthetic oligonucleotide
  Target: ATXN1; (+) strand; PAM type: NRG; PAM sequence: CAG
cagtgttgtaaacatgtgcc

SEQ ID NO: 121438 - DNA, 20 bp, Artificial Sequence
  Description of Artificial Sequence: Synthetic oligonucleotide
  Target: ATXN1; (+) strand; PAM type: NRG; PAM sequence: AAG
aacatgtgcccagataatga

SEQ ID NO: 121439 - DNA, 20 bp, Artificial Sequence
  Description of Artificial Sequence: Synthetic oligonucleotide
  Target: ATXN1; (+) strand; PAM type: NRG; PAM sequence: AGG
acatgtgcccagataatgaa

SEQ ID NO: 121440 - DNA, 20 bp, Artificial Sequence
  Description of Artificial Sequence: Synthetic oligonucleotide
  Target: ATXN1; (+) strand; PAM type: NRG; PAM sequence: CAG
atgaaaggttaccaacatca

SEQ ID NO: 121441 - DNA, 20 bp, Artificial Sequence
  Description of Artificial Sequence: Synthetic oligonucleotide
  Target: ATXN1; (+) strand; PAM type: NRG; PAM sequence: AAG
taccaacatcacagtttact

SEQ ID NO: 121442 - DNA, 20 bp, Artificial Sequence
  Description of Artificial Sequence: Synthetic oligonucleotide
  Target: ATXN1; (+) strand; PAM type: NRG; PAM sequence: TAG
tcacagtttactaagaaaac

SEQ ID NO: 121443 - DNA, 20 bp, Artificial Sequence
  Description of Artificial Sequence: Synthetic oligonucleotide
  Target: ATXN1; (+) strand; PAM type: NRG; PAM sequence: AGG
cacagtttactaagaaaact

SEQ ID NO: 121444 - DNA, 20 bp, Artificial Sequence
  Description of Artificial Sequence: Synthetic oligonucleotide
  Target: ATXN1; (+) strand; PAM type: NRG; PAM sequence: AAG
aaccccccactgcccctacc

SEQ ID NO: 121445 - DNA, 20 bp, Artificial Sequence
  Description of Artificial Sequence: Synthetic oligonucleotide
  Target: ATXN1; (+) strand; PAM type: NRG; PAM sequence: CGG
ctgcccctaccaagcaaatg

SEQ ID NO: 121446 - DNA, 20 bp, Artificial Sequence
  Description of Artificial Sequence: Synthetic oligonucleotide
  Target: ATXN1; (+) strand; PAM type: NRG; PAM sequence: AAG
caagcaaatgcggttttgaa

SEQ ID NO: 121447 - DNA, 20 bp, Artificial Sequence
  Description of Artificial Sequence: Synthetic oligonucleotide
  Target: ATXN1; (+) strand; PAM type: NRG; PAM sequence: AAG
caaatgcggttttgaaaaga

SEQ ID NO: 121448 - DNA, 20 bp, Artificial Sequence
  Description of Artificial Sequence: Synthetic oligonucleotide
  Target: ATXN1; (+) strand; PAM type: NRG; PAM sequence: TAG
ggttttgaaaagaaagtact

SEQ ID NO: 121449 - DNA, 20 bp, Artificial Sequence
  Description of Artificial Sequence: Synthetic oligonucleotide
  Target: ATXN1; (+) strand; PAM type: NRG; PAM sequence: AAG
gaaagtacttagcatgcaca

SEQ ID NO: 121450 - DNA, 20 bp, Artificial Sequence
  Description of Artificial Sequence: Synthetic oligonucleotide
  Target: ATXN1; (+) strand; PAM type: NRG; PAM sequence: GAG
aagtacttagcatgcacaaa

SEQ ID NO: 121451 - DNA, 20 bp, Artificial Sequence
  Description of Artificial Sequence: Synthetic oligonucleotide
  Target: ATXN1; (+) strand; PAM type: NRG; PAM sequence: TAG
agcatgcacaaagagttcac

SEQ ID NO: 121452 - DNA, 20 bp, Artificial Sequence
  Description of Artificial Sequence: Synthetic oligonucleotide
  Target: ATXN1; (+) strand; PAM type: NRG; PAM sequence: TGG
acaaagagttcactagaatt

SEQ ID NO: 121453 - DNA, 20 bp, Artificial Sequence
  Description of Artificial Sequence: Synthetic oligonucleotide
  Target: ATXN1; (+) strand; PAM type: NRG; PAM sequence: CAG
ctctcaacacactccattta

SEQ ID NO: 121454 - DNA, 20 bp, Artificial Sequence
  Description of Artificial Sequence: Synthetic oligonucleotide
  Target: ATXN1; (+) strand; PAM type: NRG; PAM sequence: AAG
tcaacacactccatttacag

SEQ ID NO: 121455 - DNA, 20 bp, Artificial Sequence
  Description of Artificial Sequence: Synthetic oligonucleotide
  Target: ATXN1; (+) strand; PAM type: NRG; PAM sequence: AGG
caacacactccatttacaga

SEQ ID NO: 121456 - DNA, 20 bp, Artificial Sequence
  Description of Artificial Sequence: Synthetic oligonucleotide
  Target: ATXN1; (+) strand; PAM type: NRG; PAM sequence: AAG
aaggattttaaaattacttc

SEQ ID NO: 121457 - DNA, 20 bp, Artificial Sequence
  Description of Artificial Sequence: Synthetic oligonucleotide
  Target: ATXN1; (+) strand; PAM type: NRG; PAM sequence: TGG
attacttcaagtctgccatg

SEQ ID NO: 121458 - DNA, 20 bp, Artificial Sequence
  Description of Artificial Sequence: Synthetic oligonucleotide
  Target: ATXN1; (+) strand; PAM type: NRG; PAM sequence: AAG
gtctgccatgtggcatctta

SEQ ID NO: 121459 - DNA, 20 bp, Artificial Sequence
  Description of Artificial Sequence: Synthetic oligonucleotide
  Target: ATXN1; (+) strand; PAM type: NRG; PAM sequence: CAG
gcatcttaaagtgtacactt

SEQ ID NO: 121460 - DNA, 20 bp, Artificial Sequence
  Description of Artificial Sequence: Synthetic oligonucleotide
  Target: ATXN1; (+) strand; PAM type: NRG; PAM sequence: AAG
tcttaaagtgtacacttcag

SEQ ID NO: 121461 - DNA, 20 bp, Artificial Sequence
  Description of Artificial Sequence: Synthetic oligonucleotide
  Target: ATXN1; (+) strand; PAM type: NRG; PAM sequence: GAG
gaaaacctcactcaatcttt

SEQ ID NO: 121462 - DNA, 20 bp, Artificial Sequence
  Description of Artificial Sequence: Synthetic oligonucleotide
  Target: ATXN1; (+) strand; PAM type: NRG; PAM sequence: AGG
aaaacctcactcaatctttg

SEQ ID NO: 121463 - DNA, 20 bp, Artificial Sequence
  Description of Artificial Sequence: Synthetic oligonucleotide
  Target: ATXN1; (+) strand; PAM type: NRG; PAM sequence: CAG
actcaatctttgaggtctga

SEQ ID NO: 121464 - DNA, 20 bp, Artificial Sequence
  Description of Artificial Sequence: Synthetic oligonucleotide
  Target: ATXN1; (+) strand; PAM type: NRG; PAM sequence: AGG
ctcaatctttgaggtctgac

SEQ ID NO: 121465 - DNA, 20 bp, Artificial Sequence
  Description of Artificial Sequence: Synthetic oligonucleotide
  Target: ATXN1; (+) strand; PAM type: NRG; PAM sequence: GGG
tcaatctttgaggtctgaca

SEQ ID NO: 121466 - DNA, 20 bp, Artificial Sequence
  Description of Artificial Sequence: Synthetic oligonucleotide
  Target: ATXN1; (+) strand; PAM type: NRG; PAM sequence: CAG
ctgacagggtgtcacatgaa

SEQ ID NO: 121467 - DNA, 20 bp, Artificial Sequence
  Description of Artificial Sequence: Synthetic oligonucleotide
  Target: ATXN1; (+) strand; PAM type: NRG; PAM sequence: AAG
ggtgtcacatgaacagttca

SEQ ID NO: 121468 - DNA, 20 bp, Artificial Sequence
  Description of Artificial Sequence: Synthetic oligonucleotide
  Target: ATXN1; (+) strand; PAM type: NRG; PAM sequence: CGG
acatgaacagttcaaagcaa

SEQ ID NO: 121469 - DNA, 20 bp, Artificial Sequence
  Description of Artificial Sequence: Synthetic oligonucleotide
  Target: ATXN1; (+) strand; PAM type: NRG; PAM sequence: TAG
caacaacaaaaaacccccac

SEQ ID NO: 121470 - DNA, 20 bp, Artificial Sequence
  Description of Artificial Sequence: Synthetic oligonucleotide
  Target: ATXN1; (+) strand; PAM type: NRG; PAM sequence: AAG
ccccactagatttgaaacaa

SEQ ID NO: 121471 - DNA, 20 bp, Artificial Sequence
  Description of Artificial Sequence: Synthetic oligonucleotide
  Target: ATXN1; (+) strand; PAM type: NRG; PAM sequence: TGG
aacaaaagctatcttgatta

SEQ ID NO: 121472 - DNA, 20 bp, Artificial Sequence
  Description of Artificial Sequence: Synthetic oligonucleotide
  Target: ATXN1; (+) strand; PAM type: NRG; PAM sequence: GAG
cttgattatggtaactgcat

SEQ ID NO: 121473 - DNA, 20 bp, Artificial Sequence
  Description of Artificial Sequence: Synthetic oligonucleotide
  Target: ATXN1; (+) strand; PAM type: NRG; PAM sequence: TAG
aactgcatgagttatttaaa

SEQ ID NO: 121474 - DNA, 20 bp, Artificial Sequence
  Description of Artificial Sequence: Synthetic oligonucleotide
  Target: ATXN1; (+) strand; PAM type: NRG; PAM sequence: GAG
ctgcatgagttatttaaata

SEQ ID NO: 121475 - DNA, 20 bp, Artificial Sequence
  Description of Artificial Sequence: Synthetic oligonucleotide
  Target: ATXN1; (+) strand; PAM type: NRG; PAM sequence: AAG
taaatagagcctgaaaccta

SEQ ID NO: 121476 - DNA, 20 bp, Artificial Sequence
  Description of Artificial Sequence: Synthetic oligonucleotide
  Target: ATXN1; (+) strand; PAM type: NRG; PAM sequence: CAG
atagagcctgaaacctaaag

SEQ ID NO: 121477 - DNA, 20 bp, Artificial Sequence
  Description of Artificial Sequence: Synthetic oligonucleotide
  Target: ATXN1; (+) strand; PAM type: NRG; PAM sequence: AAG
aacctaaagcagttttacat

SEQ ID NO: 121478 - DNA, 20 bp, Artificial Sequence
  Description of Artificial Sequence: Synthetic oligonucleotide
  Target: ATXN1; (+) strand; PAM type: NRG; PAM sequence: TAG
tacataagacacttgtttcc

SEQ ID NO: 121479 - DNA, 20 bp, Artificial Sequence
  Description of Artificial Sequence: Synthetic oligonucleotide
  Target: ATXN1; (+) strand; PAM type: NRG; PAM sequence: AGG
acataagacacttgtttcct

SEQ ID NO: 121480 - DNA, 20 bp, Artificial Sequence
  Description of Artificial Sequence: Synthetic oligonucleotide
  Target: ATXN1; (+) strand; PAM type: NRG; PAM sequence: CAG
aatgctttaaaaaataccac

SEQ ID NO: 121481 - DNA, 20 bp, Artificial Sequence
  Description of Artificial Sequence: Synthetic oligonucleotide
  Target: ATXN1; (+) strand; PAM type: NRG; PAM sequence: AAG
gctttaaaaaataccaccag

SEQ ID NO: 121482 - DNA, 20 bp, Artificial Sequence
  Description of Artificial Sequence: Synthetic oligonucleotide
  Target: ATXN1; (+) strand; PAM type: NRG; PAM sequence: CAG
ccaccagaagtgcattctaa

SEQ ID NO: 121483 - DNA, 20 bp, Artificial Sequence
  Description of Artificial Sequence: Synthetic oligonucleotide
  Target: ATXN1; (+) strand; PAM type: NRG; PAM sequence: TGG
cattctaacagttacctgat

SEQ ID NO: 121484 - DNA, 20 bp, Artificial Sequence
  Description of Artificial Sequence: Synthetic oligonucleotide
  Target: ATXN1; (+) strand; PAM type: NRG; PAM sequence: GGG
attctaacagttacctgatt

SEQ ID NO: 121485 - DNA, 20 bp, Artificial Sequence
  Description of Artificial Sequence: Synthetic oligonucleotide
  Target: ATXN1; (+) strand; PAM type: NRG; PAM sequence: TAG
ctgattgggaaaatgatttc

SEQ ID NO: 121486 - DNA, 20 bp, Artificial Sequence
  Description of Artificial Sequence: Synthetic oligonucleotide
  Target: ATXN1; (+) strand; PAM type: NRG; PAM sequence: TGG
ctagtaaaacacactgtaac

SEQ ID NO: 121487 - DNA, 20 bp, Artificial Sequence
  Description of Artificial Sequence: Synthetic oligonucleotide
  Target: ATXN1; (+) strand; PAM type: NRG; PAM sequence: GAG
agtaaaacacactgtaactg

SEQ ID NO: 121488 - DNA, 20 bp, Artificial Sequence
  Description of Artificial Sequence: Synthetic oligonucleotide
  Target: ATXN1; (+) strand; PAM type: NRG; PAM sequence: TGG
tggagtacccaaatctaaca

SEQ ID NO: 121489 - DNA, 20 bp, Artificial Sequence
  Description of Artificial Sequence: Synthetic oligonucleotide
  Target: ATXN1; (+) strand; PAM type: NRG; PAM sequence: TAG
ggcccacaattattccttga

SEQ ID NO: 121490 - DNA, 20 bp, Artificial Sequence
  Description of Artificial Sequence: Synthetic oligonucleotide
  Target: ATXN1; (+) strand; PAM type: NRG; PAM sequence: CAG
caattattccttgatagtga

SEQ ID NO: 121491 - DNA, 20 bp, Artificial Sequence
  Description of Artificial Sequence: Synthetic oligonucleotide
  Target: ATXN1; (+) strand; PAM type: NRG; PAM sequence: AAG
gtgacagaaacttttacaat

SEQ ID NO: 121492 - DNA, 20 bp, Artificial Sequence
  Description of Artificial Sequence: Synthetic oligonucleotide
  Target: ATXN1; (+) strand; PAM type: NRG; PAM sequence: AGG
tgacagaaacttttacaata

SEQ ID NO: 121493 - DNA, 20 bp, Artificial Sequence
  Description of Artificial Sequence: Synthetic oligonucleotide
  Target: ATXN1; (+) strand; PAM type: NRG; PAM sequence: AAG
aaggttttttttaaaaaaat

SEQ ID NO: 121494 - DNA, 20 bp, Artificial Sequence
  Description of Artificial Sequence: Synthetic oligonucleotide
  Target: ATXN1; (+) strand; PAM type: NRG; PAM sequence: TAG
ttttaaaaaaataagtaaaa

SEQ ID NO: 121495 - DNA, 20 bp, Artificial Sequence
  Description of Artificial Sequence: Synthetic oligonucleotide
  Target: ATXN1; (+) strand; PAM type: NRG; PAM sequence: GAG
cacaatgctcttccccttat

SEQ ID NO: 121496 - DNA, 20 bp, Artificial Sequence
  Description of Artificial Sequence: Synthetic oligonucleotide
  Target: ATXN1; (+) strand; PAM type: NRG; PAM sequence: AGG
acaatgctcttccccttatg

SEQ ID NO: 121497 - DNA, 20 bp, Artificial Sequence
  Description of Artificial Sequence: Synthetic oligonucleotide
  Target: ATXN1; (+) strand; PAM type: NRG; PAM sequence: AAG
ccttatgaggaccctaaacc

SEQ ID NO: 121498 - DNA, 20 bp, Artificial Sequence
  Description of Artificial Sequence: Synthetic oligonucleotide
  Target: ATXN1; (+) strand; PAM type: NRG; PAM sequence: AAG
gatgctgattgcttaataaa

SEQ ID NO: 121499 - DNA, 20 bp, Artificial Sequence
  Description of Artificial Sequence: Synthetic oligonucleotide
  Target: ATXN1; (+) strand; PAM type: NRG; PAM sequence: AGG
atgctgattgcttaataaaa

SEQ ID NO: 121500 - DNA, 20 bp, Artificial Sequence
  Description of Artificial Sequence: Synthetic oligonucleotide
  Target: ATXN1; (+) strand; PAM type: NRG; PAM sequence: TAG
ctgattgcttaataaaaagg

SEQ ID NO: 121501 - DNA, 20 bp, Artificial Sequence
  Description of Artificial Sequence: Synthetic oligonucleotide
  Target: ATXN1; (+) strand; PAM type: NRG; PAM sequence: TGG
tgcttaataaaaaggtagta

SEQ ID NO: 121502 - DNA, 20 bp, Artificial Sequence
  Description of Artificial Sequence: Synthetic oligonucleotide
  Target: ATXN1; (+) strand; PAM type: NRG; PAM sequence: GGG
gcttaataaaaaggtagtat

SEQ ID NO: 121503 - DNA, 20 bp, Artificial Sequence
  Description of Artificial Sequence: Synthetic oligonucleotide
  Target: ATXN1; (+) strand; PAM type: NRG; PAM sequence: TGG
aataaaaaggtagtatgggc

SEQ ID NO: 121504 - DNA, 20 bp, Artificial Sequence
  Description of Artificial Sequence: Synthetic oligonucleotide
  Target: ATXN1; (+) strand; PAM type: NRG; PAM sequence: GGG
ataaaaaggtagtatgggct

SEQ ID NO: 121505 - DNA, 20 bp, Artificial Sequence
  Description of Artificial Sequence: Synthetic oligonucleotide
  Target: ATXN1; (+) strand; PAM type: NRG; PAM sequence: GGG
taaaaaggtagtatgggctg

SEQ ID NO: 121506 - DNA, 20 bp, Artificial Sequence
  Description of Artificial Sequence: Synthetic oligonucleotide
  Target: ATXN1; (+) strand; PAM type: NRG; PAM sequence: TGG
aaggtagtatgggctgggga

SEQ ID NO: 121507 - DNA, 20 bp, Artificial Sequence
  Description of Artificial Sequence: Synthetic oligonucleotide
  Target: ATXN1; (+) strand; PAM type: NRG; PAM sequence: TGG
gtagtatgggctggggatgg

SEQ ID NO: 121508 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcaaaacattt

SEQ ID NO: 121509 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcaaaacatttt

SEQ ID NO: 121510 - DNA, 20 bp, Artificial Sequence
  Description of Artificial Sequence: Synthetic oligonucleotide
  Target: ATXN1; (+) strand; PAM type: NRG; PAM sequence: AAG
tgtaatcaaaacattttggg

SEQ ID NO: 121511 - DNA, 20 bp, Artificial Sequence
  Description of Artificial Sequence: Synthetic oligonucleotide
  Target: ATXN1; (+) strand; PAM type: NRG; PAM sequence: CAG
aatcaaaacattttgggaag

SEQ ID NO: 121512 - DNA, 20 bp, Artificial Sequence
  Description of Artificial Sequence: Synthetic oligonucleotide
  Target: ATXN1; (+) strand; PAM type: NRG; PAM sequence: GAG
tcaaaacattttgggaagca

SEQ ID NO: 121513 - DNA, 20 bp, Artificial Sequence
  Description of Artificial Sequence: Synthetic oligonucleotide
  Target: ATXN1; (+) strand; PAM type: NRG; PAM sequence: AGG
caaaacattttgggaagcag

SEQ ID NO: 121514 - DNA, 20 bp, Artificial Sequence
  Description of Artificial Sequence: Synthetic oligonucleotide
  Target: ATXN1; (+) strand; PAM type: NRG; PAM sequence: CGG
aacattttgggaagcagagg

SEQ ID NO: 121515 - DNA, 20 bp, Artificial Sequence
  Description of Artificial Sequence: Synthetic oligonucleotide
  Target: ATXN1; (+) strand; PAM type: NRG; PAM sequence: GGG
acattttgggaagcagaggc

SEQ ID NO: 121516 - DNA, 20 bp, Artificial Sequence
  Description of Artificial Sequence: Synthetic oligonucleotide
  Target: ATXN1; (+) strand; PAM type: NRG; PAM sequence: GAG
attttgggaagcagaggcgg

SEQ ID NO: 121517 - DNA, 20 bp, Artificial Sequence
  Description of Artificial Sequence: Synthetic oligonucleotide
  Target: ATXN1; (+) strand; PAM type: NRG; PAM sequence: AGG
ttttgggaagcagaggcggg

SEQ ID NO: 121518 - DNA, 20 bp, Artificial Sequence
  Description of Artificial Sequence: Synthetic oligonucleotide
  Target: ATXN1; (+) strand; PAM type: NRG; PAM sequence: GAG
cagaggcgggaggatcactt

SEQ ID NO: 121519 - DNA, 20 bp, Artificial Sequence
  Description of Artificial Sequence: Synthetic oligonucleotide
  Target: ATXN1; (+) strand; PAM type: NRG; PAM sequence: CAG
gcgggaggatcacttgagct

SEQ ID NO: 121520 - DNA, 20 bp, Artificial Sequence
  Description of Artificial Sequence: Synthetic oligonucleotide
  Target: ATXN1; (+) strand; PAM type: NRG; PAM sequence: TAG
ggaggatcacttgagctcag

SEQ ID NO: 121521 - DNA, 20 bp, Artificial Sequence
  Description of Artificial Sequence: Synthetic oligonucleotide
  Target: ATXN1; (+) strand; PAM type: NRG; PAM sequence: AAG
tcacttgagctcagtagttc

SEQ ID NO: 121522 - DNA, 20 bp, Artificial Sequence
  Description of Artificial Sequence: Synthetic oligonucleotide
  Target: ATXN1; (+) strand; PAM type: NRG; PAM sequence: CAG
tgagctcagtagttcaagac

SEQ ID NO: 121523 - DNA, 20 bp, Artificial Sequence
  Description of Artificial Sequence: Synthetic oligonucleotide
  Target: ATXN1; (+) strand; PAM type: NRG; PAM sequence: GAG
cagtagttcaagaccagcct

SEQ ID NO: 121524 - DNA, 20 bp, Artificial Sequence
  Description of Artificial Sequence: Synthetic oligonucleotide
  Target: ATXN1; (+) strand; PAM type: NRG; PAM sequence: TGG
caagaccagcctgagcaaca

SEQ ID NO: 121525 - DNA, 20 bp, Artificial Sequence
  Description of Artificial Sequence: Synthetic oligonucleotide
  Target: ATXN1; (+) strand; PAM type: NRG; PAM sequence: TAG
ctaccaaaaatacaaaaaat

SEQ ID NO: 121526 - DNA, 20 bp, Artificial Sequence
  Description of Artificial Sequence: Synthetic oligonucleotide
  Target: ATXN1; (+) strand; PAM type: NRG; PAM sequence: CAG
caaaaatacaaaaaattagc

SEQ ID NO: 121527 - DNA, 20 bp, Artificial Sequence
  Description of Artificial Sequence: Synthetic oligonucleotide
  Target: ATXN1; (+) strand; PAM type: NRG; PAM sequence: AGG
aaaaatacaaaaaattagcc

SEQ ID NO: 121528 - DNA, 20 bp, Artificial Sequence
  Description of Artificial Sequence: Synthetic oligonucleotide
  Target: ATXN1; (+) strand; PAM type: NRG; PAM sequence: TGG
tacaaaaaattagccaggca

SEQ ID NO: 121529 - DNA, 20 bp, Artificial Sequence
  Description of Artificial Sequence: Synthetic oligonucleotide
  Target: ATXN1; (+) strand; PAM type: NRG; PAM sequence: TGG
aaaaaattagccaggcatgg

SEQ ID NO: 121530 - DNA, 20 bp, Artificial Sequence
  Description of Artificial Sequence: Synthetic oligonucleotide
  Target: ATXN1; (+) strand; PAM type: NRG; PAM sequence: TGG
ggcatggtggtgtgcacctg

SEQ ID NO: 121531 - DNA, 20 bp, Artificial Sequence
  Description of Artificial Sequence: Synthetic oligonucleotide
  Target: ATXN1; (+) strand; PAM type: NRG; PAM sequence: CAG
gtggtgtgcacctgtggtcc

SEQ ID NO: 121532 - DNA, 20 bp, Artificial Sequence
  Description of Artificial Sequence: Synthetic oligonucleotide
  Target: ATXN1; (+) strand; PAM type: NRG; PAM sequence: AAG
ctgtggtcccagctactctg

SEQ ID NO: 121533 - DNA, 20 bp, Artificial Sequence
  Description of Artificial Sequence: Synthetic oligonucleotide
  Target: ATXN1; (+) strand; PAM type: NRG; PAM sequence: AGG
tgtggtcccagctactctga

SEQ ID NO: 121534 - DNA, 20 bp, Artificial Sequence
  Description of Artificial Sequence: Synthetic oligonucleotide
  Target: ATXN1; (+) strand; PAM type: NRG; PAM sequence: GAG
tcccagctactctgaaggct

SEQ ID NO: 121535 - DNA, 20 bp, Artificial Sequence
  Description of Artificial Sequence: Synthetic oligonucleotide
  Target: ATXN1; (+) strand; PAM type: NRG; PAM sequence: AGG
cccagctactctgaaggctg

SEQ ID NO: 121536 - DNA, 20 bp, Artificial Sequence
  Description of Artificial Sequence: Synthetic oligonucleotide
  Target: ATXN1; (+) strand; PAM type: NRG; PAM sequence: TGG
agctactctgaaggctgagg

SEQ ID NO: 121537 - DNA, 20 bp, Artificial Sequence
  Description of Artificial Sequence: Synthetic oligonucleotide
  Target: ATXN1; (+) strand; PAM type: NRG; PAM sequence: GGG
gctactctgaaggctgaggt

SEQ ID NO: 121538 - DNA, 20 bp, Artificial Sequence
  Description of Artificial Sequence: Synthetic oligonucleotide
  Target: ATXN1; (+) strand; PAM type: NRG; PAM sequence: GAG
tactctgaaggctgaggtgg

SEQ ID NO: 121539 - DNA, 20 bp, Artificial Sequence
  Description of Artificial Sequence: Synthetic oligonucleotide
  Target: ATXN1; (+) strand; PAM type: NRG; PAM sequence: AGG
actctgaaggctgaggtggg

SEQ ID NO: 121540 - DNA, 20 bp, Artificial Sequence
  Description of Artificial Sequence: Synthetic oligonucleotide
  Target: ATXN1; (+) strand; PAM type: NRG; PAM sequence: GGG
ctctgaaggctgaggtggga

SEQ ID NO: 121541 - DNA, 20 bp, Artificial Sequence
  Description of Artificial Sequence: Synthetic oligonucleotide
  Target: ATXN1; (+) strand; PAM type: NRG; PAM sequence: GAG
ctgaggtgggagggtcactt

SEQ ID NO: 121542 - DNA, 20 bp, Artificial Sequence
  Description of Artificial Sequence: Synthetic oligonucleotide
  Target: ATXN1; (+) strand; PAM type: NRG; PAM sequence: TGG
gtgggagggtcacttgagct

SEQ ID NO: 121543 - DNA, 20 bp, Artificial Sequence
  Description of Artificial Sequence: Synthetic oligonucleotide
  Target: ATXN1; (+) strand; PAM type: NRG; PAM sequence: GGG
tgggagggtcacttgagctt

SEQ ID NO: 121544 - DNA, 20 bp, Artificial Sequence
  Description of Artificial Sequence: Synthetic oligonucleotide
  Target: ATXN1; (+) strand; PAM type: NRG; PAM sequence: GAG
ggagggtcacttgagcttgg

SEQ ID NO: 121545 - DNA, 20 bp, Artificial Sequence
  Description of Artificial Sequence: Synthetic oligonucleotide
  Target: ATXN1; (+) strand; PAM type: NRG; PAM sequence: AGG
gagggtcacttgagcttggg

SEQ ID NO: 121546 - DNA, 20 bp, Artificial Sequence
  Description of Artificial Sequence: Synthetic oligonucleotide
  Target: ATXN1; (+) strand; PAM type: NRG; PAM sequence: CAG
ggtcacttgagcttgggagg

SEQ ID NO: 121547 - DNA, 20 bp, Artificial Sequence
  Description of Artificial Sequence: Synthetic oligonucleotide
  Target: ATXN1; (+) strand; PAM type: NRG; PAM sequence: GAG
tcacttgagcttgggaggca

SEQ ID NO: 121548 - DNA, 20 bp, Artificial Sequence
  Description of Artificial Sequence: Synthetic oligonucleotide
  Target: ATXN1; (+) strand; PAM type: NRG; PAM sequence: AGG
cacttgagcttgggaggcag

SEQ ID NO: 121549 - DNA, 20 bp, Artificial Sequence
  Description of Artificial Sequence: Synthetic oligonucleotide
  Target: ATXN1; (+) strand; PAM type: NRG; PAM sequence: CAG
agcttgggaggcagaggttg

SEQ ID NO: 121550 - DNA, 20 bp, Artificial Sequence
  Description of Artificial Sequence: Synthetic oligonucleotide
  Target: ATXN1; (+) strand; PAM type: NRG; PAM sequence: GAG
ggcagaggttgcagtgaatc

SEQ ID NO: 121551 - DNA, 20 bp, Artificial Sequence
  Description of Artificial Sequence: Synthetic oligonucleotide
  Target: ATXN1; (+) strand; PAM type: NRG; PAM sequence: CAG
gagatcttgccattgcactc

SEQ ID NO: 121552 - DNA, 20 bp, Artificial Sequence
  Description of Artificial Sequence: Synthetic oligonucleotide
  Target: ATXN1; (+) strand; PAM type: NRG; PAM sequence: TGG
cttgccattgcactccagcc

SEQ ID NO: 121553 - DNA, 20 bp, Artificial Sequence
  Description of Artificial Sequence: Synthetic oligonucleotide
  Target: ATXN1; (+) strand; PAM type: NRG; PAM sequence: GGG
ttgccattgcactccagcct

SEQ ID NO: 121554 - DNA, 20 bp, Artificial Sequence
  Description of Artificial Sequence: Synthetic oligonucleotide
  Target: ATXN1; (+) strand; PAM type: NRG; PAM sequence: CAG
ttgcactccagcctgggtga

SEQ ID NO: 121555 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggtgaca

SEQ ID NO: 121556 - DNA, 20 bp, Artificial Sequence
  Description of Artificial Sequence: Synthetic oligonucleotide
  Target: ATXN1; (+) strand; PAM type: NRG; PAM sequence: AAG
tccagcctgggtgacagagt

SEQ ID NO: 121557 - DNA, 20 bp, Artificial Sequence
  Description of Artificial Sequence: Synthetic oligonucleotide
  Target: ATXN1; (+) strand; PAM type: NRG; PAM sequence: AGG
ccagcctgggtgacagagta

SEQ ID NO: 121558 - DNA, 20 bp, Artificial Sequence
  Description of Artificial Sequence: Synthetic oligonucleotide
  Target: ATXN1; (+) strand; PAM type: NRG; PAM sequence: AAG
aaggcaccacctcaattaaa

SEQ ID NO: 121559 - DNA, 20 bp, Artificial Sequence
  Description of Artificial Sequence: Synthetic oligonucleotide
  Target: ATXN1; (+) strand; PAM type: NRG; PAM sequence: AAG
aaaaagaaaaaaatgaaaat

SEQ ID NO: 121560 - DNA, 20 bp, Artificial Sequence
  Description of Artificial Sequence: Synthetic oligonucleotide
  Target: ATXN1; (+) strand; PAM type: NRG; PAM sequence: AGG
aaaagaaaaaaatgaaaata

SEQ ID NO: 121561 - DNA, 20 bp, Artificial Sequence
  Description of Artificial Sequence: Synthetic oligonucleotide
  Target: ATXN1; (+) strand; PAM type: NRG; PAM sequence: TAG
agaaaaaaatgaaaataagg

SEQ ID NO: 121562 - DNA, 20 bp, Artificial Sequence
  Description of Artificial Sequence: Synthetic oligonucleotide
  Target: ATXN1; (+) strand; PAM type: NRG; PAM sequence: AAG
aatgaaaataaggtagtatg

SEQ ID NO: 121563 - DNA, 20 bp, Artificial Sequence
  Description of Artificial Sequence: Synthetic oligonucleotide
  Target: ATXN1; (+) strand; PAM type: NRG; PAM sequence: CAG
aggtagtatgaagcaataca

SEQ ID NO: 121564 - DNA, 20 bp, Artificial Sequence
  Description of Artificial Sequence: Synthetic oligonucleotide
  Target: ATXN1; (+) strand; PAM type: NRG; PAM sequence: TGG
acttgcaaaatattgtttta

SEQ ID NO: 121565 - DNA, 20 bp, Artificial Sequence
  Description of Artificial Sequence: Synthetic oligonucleotide
  Target: ATXN1; (+) strand; PAM type: NRG; PAM sequence: GGG
cttgcaaaatattgttttat

SEQ ID NO: 121566 - DNA, 20 bp, Artificial Sequence
  Description of Artificial Sequence: Synthetic oligonucleotide
  Target: ATXN1; (+) strand; PAM type: NRG; PAM sequence: GGG
ttgcaaaatattgttttatg

SEQ ID NO: 121567 - DNA, 20 bp, Artificial Sequence
  Description of Artificial Sequence: Synthetic oligonucleotide
  Target: ATXN1; (+) strand; PAM type: NRG; PAM sequence: GGG
tgcaaaatattgttttatgg

SEQ ID NO: 121568 - DNA, 20 bp, Artificial Sequence
  Description of Artificial Sequence: Synthetic oligonucleotide
  Target: ATXN1; (+) strand; PAM type: NRG; PAM sequence: AAG
tgggggctcgcgacttgccc

SEQ ID NO: 121569 - DNA, 20 bp, Artificial Sequence
  Description of Artificial Sequence: Synthetic oligonucleotide
  Target: ATXN1; (+) strand; PAM type: NRG; PAM sequence: AGG
gggggctcgcgacttgccca

SEQ ID NO: 121570 - DNA, 20 bp, Artificial Sequence
  Description of Artificial Sequence: Synthetic oligonucleotide
  Target: ATXN1; (+) strand; PAM type: NRG; PAM sequence: CAG
cgcgacttgcccaaggttgc

SEQ ID NO: 121571 - DNA, 20 bp, Artificial Sequence
  Description of Artificial Sequence: Synthetic oligonucleotide
  Target: ATXN1; (+) strand; PAM type: NRG; PAM sequence: CAG
gccagtgtacttgatctcaa

SEQ ID NO: 121572 - DNA, 20 bp, Artificial Sequence
  Description of Artificial Sequence: Synthetic oligonucleotide
  Target: ATXN1; (+) strand; PAM type: NRG; PAM sequence: TAG
agtgtacttgatctcaacag

SEQ ID NO: 121573 - DNA, 20 bp, Artificial Sequence
  Description of Artificial Sequence: Synthetic oligonucleotide
  Target: ATXN1; (+) strand; PAM type: NRG; PAM sequence: AGG
gtgtacttgatctcaacagt

SEQ ID NO: 121574 - DNA, 20 bp, Artificial Sequence
  Description of Artificial Sequence: Synthetic oligonucleotide
  Target: ATXN1; (+) strand; PAM type: NRG; PAM sequence: TAG
cttgatctcaacagtaggaa

SEQ ID NO: 121575 - DNA, 20 bp, Artificial Sequence
  Description of Artificial Sequence: Synthetic oligonucleotide
  Target: ATXN1; (+) strand; PAM type: NRG; PAM sequence: AGG
ttgatctcaacagtaggaat

SEQ ID NO: 121576 - DNA, 20 bp, Artificial Sequence
  Description of Artificial Sequence: Synthetic oligonucleotide
  Target: ATXN1; (+) strand; PAM type: NRG; PAM sequence: CAG
tcaacagtaggaataggatt

SEQ ID NO: 121577 - DNA, 20 bp, Artificial Sequence
  Description of Artificial Sequence: Synthetic oligonucleotide
  Target: ATXN1; (+) strand; PAM type: NRG; PAM sequence: AGG
caacagtaggaataggattc

SEQ ID NO: 121578 - DNA, 20 bp, Artificial Sequence
  Description of Artificial Sequence: Synthetic oligonucleotide
  Target: ATXN1; (+) strand; PAM type: NRG; PAM sequence: CAG
agtaggaataggattcaggt

SEQ ID NO: 121579 - DNA, 20 bp, Artificial Sequence
  Description of Artificial Sequence: Synthetic oligonucleotide
  Target: ATXN1; (+) strand; PAM type: NRG; PAM sequence: CAG
ggattcaggtcagctgattc

SEQ ID NO: 121580 - DNA, 20 bp, Artificial Sequence
  Description of Artificial Sequence: Synthetic oligonucleotide
  Target: ATXN1; (+) strand; PAM type: NRG; PAM sequence: AGG
gattcaggtcagctgattcc

SEQ ID NO: 121581 - DNA, 20 bp, Artificial Sequence
  Description of Artificial Sequence: Synthetic oligonucleotide
  Target: ATXN1; (+) strand; PAM type: NRG; PAM sequence: TAG
ccaggctgactgatttccac

SEQ ID NO: 121582 - DNA, 20 bp, Artificial Sequence
  Description of Artificial Sequence: Synthetic oligonucleotide
  Target: ATXN1; (+) strand; PAM type: NRG; PAM sequence: CAG
tccactagacccaacgtgta

SEQ ID NO: 121583 - DNA, 20 bp, Artificial Sequence
  Description of Artificial Sequence: Synthetic oligonucleotide
  Target: ATXN1; (+) strand; PAM type: NRG; PAM sequence: TGG
tagacccaacgtgtacagaa

SEQ ID NO: 121584 - DNA, 20 bp, Artificial Sequence
  Description of Artificial Sequence: Synthetic oligonucleotide
  Target: ATXN1; (+) strand; PAM type: NRG; PAM sequence: AAG
tacagaatggaaacacaatg

SEQ ID NO: 121585 - DNA, 20 bp, Artificial Sequence
  Description of Artificial Sequence: Synthetic oligonucleotide
  Target: ATXN1; (+) strand; PAM type: NRG; PAM sequence: CAG
atggaaacacaatgaagctt

SEQ ID NO: 121586 - DNA, 20 bp, Artificial Sequence
  Description of Artificial Sequence: Synthetic oligonucleotide
  Target: ATXN1; (+) strand; PAM type: NRG; PAM sequence: AAG
cccactgtctgctttcaatg

SEQ ID NO: 121587 - DNA, 20 bp, Artificial Sequence
  Description of Artificial Sequence: Synthetic oligonucleotide
  Target: ATXN1; (+) strand; PAM type: NRG; PAM sequence: TGG
gtctgctttcaatgaagcac

SEQ ID NO: 121588 - DNA, 20 bp, Artificial Sequence
  Description of Artificial Sequence: Synthetic oligonucleotide
  Target: ATXN1; (+) strand; PAM type: NRG; PAM sequence: GGG
tctgctttcaatgaagcact

SEQ ID NO: 121589 - DNA, 20 bp, Artificial Sequence
  Description of Artificial Sequence: Synthetic oligonucleotide
  Target: ATXN1; (+) strand; PAM type: NRG; PAM sequence: AAG
tgggaaaatttgaatttaat

SEQ ID NO: 121590 - DNA, 20 bp, Artificial Sequence
  Description of Artificial Sequence: Synthetic oligonucleotide
  Target: ATXN1; (+) strand; PAM type: NRG; PAM sequence: GAG
attactgattatttaaccct

SEQ ID NO: 121591 - DNA, 20 bp, Artificial Sequence
  Description of Artificial Sequence: Synthetic oligonucleotide
  Target: ATXN1; (+) strand; PAM type: NRG; PAM sequence: AGG
ttactgattatttaaccctg

SEQ ID NO: 121592 - DNA, 20 bp, Artificial Sequence
  Description of Artificial Sequence: Synthetic oligonucleotide
  Target: ATXN1; (+) strand; PAM type: NRG; PAM sequence: GAG
actgattatttaaccctgag

SEQ ID NO: 121593 - DNA, 20 bp, Artificial Sequence
  Description of Artificial Sequence: Synthetic oligonucleotide
  Target: ATXN1; (+) strand; PAM type: NRG; PAM sequence: TGG
ttaaccctgaggagatgata

SEQ ID NO: 121594 - DNA, 20 bp, Artificial Sequence
  Description of Artificial Sequence: Synthetic oligonucleotide
  Target: ATXN1; (+) strand; PAM type: NRG; PAM sequence: TAG
catattttaatacaaatgtt

SEQ ID NO: 121595 - DNA, 20 bp, Artificial Sequence
  Description of Artificial Sequence: Synthetic oligonucleotide
  Target: ATXN1; (+) strand; PAM type: NRG; PAM sequence: TAG
atctatgaaaccaaaaaaat

SEQ ID NO: 121596 - DNA, 20 bp, Artificial Sequence
  Description of Artificial Sequence: Synthetic oligonucleotide
  Target: ATXN1; (+) strand; PAM type: NRG; PAM sequence: AGG
tctatgaaaccaaaaaaatt

SEQ ID NO: 121597 - DNA, 20 bp, Artificial Sequence
  Description of Artificial Sequence: Synthetic oligonucleotide
  Target: ATXN1; (+) strand; PAM type: NRG; PAM sequence: TAG
tttgctctttacaaatcttg

SEQ ID NO: 121598 - DNA, 20 bp, Artificial Sequence
  Description of Artificial Sequence: Synthetic oligonucleotide
  Target: ATXN1; (+) strand; PAM type: NRG; PAM sequence: AGG
ttgctctttacaaatcttgt

SEQ ID NO: 121599 - DNA, 20 bp, Artificial Sequence
  Description of Artificial Sequence: Synthetic oligonucleotide
  Target: ATXN1; (+) strand; PAM type: NRG; PAM sequence: TAG
gtaggcaactgcaaaaaaaa

SEQ ID NO: 121600 - DNA, 20 bp, Artificial Sequence
  Description of Artificial Sequence: Synthetic oligonucleotide
  Target: ATXN1; (+) strand; PAM type: NRG; PAM sequence: AGG
taggcaactgcaaaaaaaat

SEQ ID NO: 121601 - DNA, 20 bp, Artificial Sequence
  Description of Artificial Sequence: Synthetic oligonucleotide
  Target: ATXN1; (+) strand; PAM type: NRG; PAM sequence: AAG
taggtaatacatgttcaaaa

SEQ ID NO: 121602 - DNA, 20 bp, Artificial Sequence
  Description of Artificial Sequence: Synthetic oligonucleotide
  Target: ATXN1; (+) strand; PAM type: NRG; PAM sequence: TGG
acatgttcaaaaaagttttc

SEQ ID NO: 121603 - DNA, 20 bp, Artificial Sequence
  Description of Artificial Sequence: Synthetic oligonucleotide
  Target: ATXN1; (+) strand; PAM type: NRG; PAM sequence: GAG
ttcaaaaaagttttctggct

SEQ ID NO: 121604 - DNA, 20 bp, Artificial Sequence
  Description of Artificial Sequence: Synthetic oligonucleotide
  Target: ATXN1; (+) strand; PAM type: NRG; PAM sequence: AAG
aaaagttttctggctgagtt

SEQ ID NO: 121605 - DNA, 20 bp, Artificial Sequence
  Description of Artificial Sequence: Synthetic oligonucleotide
  Target: ATXN1; (+) strand; PAM type: NRG; PAM sequence: AAG
agttttctggctgagttaag

SEQ ID NO: 121606 - DNA, 20 bp, Artificial Sequence
  Description of Artificial Sequence: Synthetic oligonucleotide
  Target: ATXN1; (+) strand; PAM type: NRG; PAM sequence: TGG
ttctggctgagttaagaagc

SEQ ID NO: 121607 - DNA, 20 bp, Artificial Sequence
  Description of Artificial Sequence: Synthetic oligonucleotide
  Target: ATXN1; (+) strand; PAM type: NRG; PAM sequence: AAG
acgcacacacatacataaac

SEQ ID NO: 121608 - DNA, 20 bp, Artificial Sequence
  Description of Artificial Sequence: Synthetic oligonucleotide
  Target: ATXN1; (+) strand; PAM type: NRG; PAM sequence: GAG
gcacacacatacataaacaa

SEQ ID NO: 121609 - DNA, 20 bp, Artificial Sequence
  Description of Artificial Sequence: Synthetic oligonucleotide
  Target: ATXN1; (+) strand; PAM type: NRG; PAM sequence: CAG
aagagtatacatatatatta

SEQ ID NO: 121610 - DNA, 20 bp, Artificial Sequence
  Description of Artificial Sequence: Synthetic oligonucleotide
  Target: ATXN1; (+) strand; PAM type: NRG; PAM sequence: TAG
caaaaacaacaacaaaaacc

SEQ ID NO: 121611 - DNA, 20 bp, Artificial Sequence
  Description of Artificial Sequence: Synthetic oligonucleotide
  Target: ATXN1; (+) strand; PAM type: NRG; PAM sequence: AAG
aaacaacaacaaaaacctag

SEQ ID NO: 121612 - DNA, 20 bp, Artificial Sequence
  Description of Artificial Sequence: Synthetic oligonucleotide
  Target: ATXN1; (+) strand; PAM type: NRG; PAM sequence: TGG
aacaaaaacctagaagaaat

SEQ ID NO: 121613 - DNA, 20 bp, Artificial Sequence
  Description of Artificial Sequence: Synthetic oligonucleotide
  Target: ATXN1; (+) strand; PAM type: NRG; PAM sequence: AAG
ttgtcatttcctaaaatttg

SEQ ID NO: 121614 - DNA, 20 bp, Artificial Sequence
  Description of Artificial Sequence: Synthetic oligonucleotide
  Target: ATXN1; (+) strand; PAM type: NRG; PAM sequence: CAG
agataatatcttctcgtcct

SEQ ID NO: 121615 - DNA, 20 bp, Artificial Sequence
  Description of Artificial Sequence: Synthetic oligonucleotide
  Target: ATXN1; (+) strand; PAM type: NRG; PAM sequence: GAG
ataatatcttctcgtcctca

SEQ ID NO: 121616 - DNA, 20 bp, Artificial Sequence
  Description of Artificial Sequence: Synthetic oligonucleotide
  Target: ATXN1; (+) strand; PAM type: NRG; PAM sequence: AGG
taatatcttctcgtcctcag

SEQ ID NO: 121617 - DNA, 20 bp, Artificial Sequence
  Description of Artificial Sequence: Synthetic oligonucleotide
  Target: ATXN1; (+) strand; PAM type: NRG; PAM sequence: TAG
ctcgtcctcagaggtattca

SEQ ID NO: 121618 - DNA, 20 bp, Artificial Sequence
  Description of Artificial Sequence: Synthetic oligonucleotide
  Target: ATXN1; (+) strand; PAM type: NRG; PAM sequence: AGG
tcgtcctcagaggtattcat

SEQ ID NO: 121619 - DNA, 20 bp, Artificial Sequence
  Description of Artificial Sequence: Synthetic oligonucleotide
  Target: ATXN1; (+) strand; PAM type: NRG; PAM sequence: TGG
gaggtattcataggccatcc

SEQ ID NO: 121620 - DNA, 20 bp, Artificial Sequence
  Description of Artificial Sequence: Synthetic oligonucleotide
  Target: ATXN1; (+) strand; PAM type: NRG; PAM sequence: GGG
aggtattcataggccatcct

SEQ ID NO: 121621 - DNA, 20 bp, Artificial Sequence
  Description of Artificial Sequence: Synthetic oligonucleotide
  Target: ATXN1; (+) strand; PAM type: NRG; PAM sequence: TAG
aggccatcctgggtttcatg
